United States Patent 7,365,185 (GENOMIC PLANT SEQUENCES AND USES THEREOF) - sequence listing, part 31

SEQ ID NO: 59783 - DNA, 13826 bp, Oryza sativa
gtcaggggagatccacgcgagctgatctcttccgtggtggtaaagccctaactcgctcggatccatttcgcgctgattcgtgtcgctgaagccctaaccggccttcttgttctccttcttccgcagtgtgcgccgtgcgggacggggtcgggtcgttttctgtgacctgtagaatagggtagggtttgaggcttttgagcagaggcgcatccgccgcgtgggtgggtgggtgcggcggtggaggggaggatgtcgtcgctgagccgggagctggtattcctcatcctgcagttcctcgatgaggagaagttcaaggagactgttcacaagtgagtgtttcaatctaggctgaaaaaaagggtgaaattatcacatgtctgtctagcgtttgtttaactcagttggggttccggcgctgttgttcaggcttgagcaggagtctgggttctacttcaacatgaagtacttcgaagacgaggtgatcaatgggaattgggatgaggttgagcgctacctcggtggctttaccaaggttgatgacaaccgctactcgatgaagatattctttgagatccgcaaacagaagtatcttgaggcccttgataagtaagtatgggagggaacatgtccctacaggaattttaggtgctggagtggaaagcgttgctaactgggtttgtttgctgctctgcaggcatgatcgttcgaaggcggttgaaatcttggtcaaggacctgaaggtcttcgcgtcctttaacgaggagttgtttaaggagatcacacagcttttgacgttggaaaactttaggtatgaatgtaatgtaccaaaatggtggtctgacactttatttatgtacattagagcatggccattaattttgtggctgtaactattacttggttgctcagtctatggttttttattttgtcttgatagggaaaatgagcaactctccaaatacggtgatacaaaatctgccagagcaataatgcttgttgaactaaagaagctgattgaagctaatcccttgttccgtgacaagcttcagtttccaaatctgaagagctccagattgcggacacttataaaccagaggtagcacatgatggagaaacacggcttccccttacattcaatcatctggaattttgtttcttgcaatacagctggttacataagtacatctcatgagaggactttaactcatgtcagctcctgacagttccagtgataatgttatagtttataagccaactactttgttccacaggacccacaatttttttctcaagtttatttaaatcactgcttcttgtttagcaaagataacctgctatatttagcttgaactaaatgagcaatacggctcatttatgacactcatcctaatgaagatttctttttatgacatatgtggtataaataccaagttttaaatcttctgttgcattattcattttctgggatattggatagacatatagagcttgaagttgaaaacggaaaattatctaatgatttactcacgtcacacaccattgtgtggtttatctgtactgttttctttatatgttgcgaattacttatcactatttattatctgtaagatttggctgtctacttggtaggttgtcagaactcagaattagtgcttgctgattctaagttctagggataacttcacagcaccatgctgtatacttttgatttatcatatgtttaaaatttttaatgtggaggagggataatgcatggacctttgacttttttataatatgttgcagcttaaactggcagcaccagctttgcaaaaatcctagacctaaccctgatatcaagactctgtttgttgatcattcttgtggacaaccaaatggtgctcgtgctccatcgccagcaaacaatccattacttggatctataccaaaacctggaggtttccccccattgggtgctcacgcggtaagtccttttagcatatttggatgcttcatgtttatgtgaaggacacggttgttttgaaatcggttccattccctttttcagccatttcaacctgcacctacacctgtcccacctctggctggctggatgtcaaaccctccagcagtaacacatcctgctgtgtctggtggagctattggatttggtactcctacaaatcctggtacctgttctaattactgttacaaactattattaagtggtctaaattggaaacagcacacatagtctgttgattcatggcattcttcttttaaatcttgtagctgctatattaaaacatcctagaacaccaacaactgccaatccttctatggattatccatcaggagattctgatcacgtctccaagagaacgagaccagttgggatgtctgaggaggtatttgtcacatctctttgaaatacattttgctatttctagtgtacgctgacactttataataccattgcattttgcctaatcattattgacatatatacttgattgtaactataatgatctaattttgcaggtgaatcttccagtgaatatgttacctgtgacatatccacagagtcatagttacccgcaagatgattttcataaaaatgttgcacggacattgagccaaggatcaactccaatgagcatggacttccatccagttcagcaaactctccttcttggtcagttcttaaattcttgttgctttctcatgataaatcaaattttgccccttccatagcttctcatatacactgcttatattttagttggtaccaatgttggtgacattggattatgggatgtcggtaccaaggaacgacttgttttaagaaacttcaaggtttgggatcttacaaaatgctcaatggccctccaggtttgtccgttatactatgttatttgagtttttgttgctctttattagcctcaatctaactatgaccatgtaaaattgtaaattcttcaataggcatcacttgtcaaagaccctactgtctcagttaaccgcataatatggagtcctgatggaaccttgtttggtaagatgatgtggacttgtgccttttctatcctctacccacagtttctaatgtctctttttaacaggtgttgcttattcaaggcatattgtacagatctattcataccatggcggtgatgatatcaggcagcacttggaggtatgaatgcatattcgttgttcttctttccttttttgttttgacaggaagttcttccttcctaattggtattagtttcttattgtataatcgtctaatctgattcctgaatttgattaatccctcctttcttaactagattgatgcgcatgtcggtggtgtaaatgacattgcatttgcccatccaaataagcagctatgtataataacctgcggagatgacaagacaattaaggtgagtttctgtgattgcatgagttctgggactgaaagtctctttgtttaacccagaagtgctaagttttatgggcaccatattctaggtctgggaggccactagtggagcaaagcaatttacatttgaaggtcatgaagctcctgtttactctgtttgtccacattataaggaaaatattcaggtgcacctgcagtttttatgctataacgatcaatattaactattggaggctacttttccttacctgttgttatttttcttcgtgcagttcatcttctcaactgctttggatggaaagataaaggcttggctatatgataatttgggatccagagttgactatgatgcgccaggacattggtgcacaacaatggcatatagtgcagatggttcaaggttcataattatttctttgttagcatgattcatgtgggtaactgggtttttgtctttgttttcactgattctttttgcccttgtgagtaggttattttcttgtgggactagcaaggatggcgaatcacatctagtggaatggaatgaaagtgaaggagctgtcaagagaacttaccagggatttcgcaagcgatcgatgggtgttgtccaatttgataccacacggaacaggtttttggctgctggagatgaattcttgattaagatatgggacatggacaacacaagtcttctgactaccattgatgccgatggtggtcttcctgtgagtgttttcctttatctgtagatactttggtaaatggtgattggttcaaatgaaatgagtaaggaaatttccatcttaatctaacctagcatgcaattattaggcaagtccacgggtccgattcaacaaggaaggtactctgctggctgtttctacccatgaaaatggtatcaagatcttagcaaatgctgatggagtacggttgctgcgcacattggaaaatcgttcatttgatgcttctcggagtgcgtctgagactgtaacaaaggtaagttcttgtgaccatttaaaattacaactaaatatttttgcaagcttgacccaatagatccatcttggtgcagcccctaatgaatccattgactgctgctgctgctgcggcggcgtcagctgctgctgccgggactagttcaggaaatgctgctccaccggcaataactgcactggtttgaccatattcacaattccttttctattgatctttctctttctatcagaaaaccttctatagtgacccaactaacttgtacattcttggaaaaattctacagaatggggatagccgaagcttggttgatgtaaagcctagaatagctgatgagccattggataaatcaaaagtctggaaacttatggagataaccgagtcaagtcagtgcagatcattgaaattaacagataatatgaggacaagcaaggtgatattttatccctcttgttgcaatctgcagtataactgtctcagtggttctataaaattaatactttgtagtacattattaagtaattttttaggctgagttctttcctctcctttcccaactcatctccctctttttccgtgcacacgcttttcaaactattaaacggtgcattttttttacaaaagttttcaataggaaagttgcttcaaaaaatcatattaatccattttttttaaaaagctaatacttaattaatcatacgctaatgagctgctttgttttgcgtgcaccaaggattagttcccaactgtgtctgccgaacacagccttagtgtgtatagaacaaacaccatatgttttgacaagtttccatagctaatattatttgatttattgcagagtaggggtgggcataaaaacaccgaaaaccgtagaccgaaccgaaccgagccgaattggtggtttcttcggtcttcggctgcttgcttgctcggtttgattttttacatcatttggtgtgcggttttttcttcagtcttcatctgccataaaccgaactaccgagaaaaccgatctgtgtgtgtctccctcctggcccaactacacaaggcccattaacttttccccatatccctaatttgtgcgtggggtcgtgtgggattcgtgtggtcgtgctgctcgccgtcgcggccgagtgcagcaggggttggcgactagcgctcctggagcttgtgctggacgattaagcagctttggtgattagtggttggacggtggaagatcagaggcatgtcgtcatcatcgagcgagctccatggctgcgtgtgcgtaggtcctcgttgagcgcggcattcttcggtaaaaaccgaaagctgataaacccgaactgacattaatcagttttggaaagctcagtttttatttttccatagctaccgtcggttagtattttacataaaccgagttatataaaaaacctaaaagaccgaccctattaaaccgaaaaaccgagtgcccacccctattgcagagtatgattgttaattgaactaaagccactgactgtttccgtgaatgatgcttgcccaatagaatgaaatgttttgtcacctcatattttgactagcattcttgagattcttctgatccacatccaagtaccaactgctggtttttatctgtaagggtttccatagatcttatttgttttgaactgcagatttcaagacttatttacacaaattctggtgtcgctatcttggctttagcttcaaatgctgttcatctgctctggaaatggcctcgcaatgaccgaaactcaagtggaaaggttaaatctggattatttacgcacataaatatgctcagttttacctacctgctctgtataccaggtccaggggcaagcaatttgtgcatatgattgttactaactttttatgtttgctattgactcttctaggctactgcaagtgtttctcctcaattatggcaacctccaagcggcatcctcatgactaatgacataactgacaaccctgaagaagctgtccattgctttgctttgtcaaagaatgattcatatgtcatgtctgcatctggagggaaaatatctctgttcaacatgatgacttttaaggttagttacaagtttatttctattgtttgtctcttatgtagaaattgaactttaatcatatggtgactgcagacgatgacaacttttatgcctccgccgccggcggcaacgtttcttgctttccatcctcaagataacaacattatagcaattggaatggatgactcaaccatccaaatctacaatgttcgaattgatgaggtattagcacatctaatggcattgctctgcgttattcttataaaaaatggaacaagattcaatcaattttttttttgattctttgcacaggtcaaaagcaaacttcgagggcactctaagaaaattactggacttgctttttcaaatgtattaaatgtgttagtctcttctggagctgatgcgcaggttatttactgaactatcaactcacaccatagagcaagccacttctgtttgtctttactgtttatacttttcctccttgtagatatgtgtgtggagcacagatgggtgggataaattaaagagcagaatgttacagataccatcaagtcgtccatcatctataatcttagacacacgtgttcagttccatcaggatcaattgcactttcttgttgtgcatgagacccagattgccatatatgaaactacaaaattagaacccgtgaagcaggtaaattctctcttcacgtgcagttcaagttaactacaaaggctatttcattactcaccttaactttactttcagtggcctgtccgggagaactcttctccaataacgcatgccatgttctcctgcgatagtcaattgatttatgcaagctttctggatgccactgtttgcatatttaatgcatcgagtttgagactccaatgtcgaattcttccagcatcctatcttcctcagaatatcaggtattctacaaaaactcaacaggacacaatatatcctttatatattctaacttactggattaaattggtactcttgcttctgaaaacattttgtcttgctgttctcaatcaatctcattagtttagtcagtgcactagcatattatgctaagaaactaagaaaatatagagtcgaggtaattgaaaacagtacttggggtatcaactacgaacacacatagacagaatagctgcaataaatcactaagactaattggactttgatgaaatttaccttaagcaaccagatctttacaataaatagttgtgtcaaccaatcctaggggatgagagatgtcgtaattatctttcaatttttttggcttatttttcacatttgattggctaatatatttattgagtgcattaatacatgtccaatgggactgctgaactgaaaaagaagtttttggaggaaaagtgcatattatctttgtttgctcagccaatgtttcttttgttcaaacttatttttaacagacaagttattaaccattatatgttccttgtttcctagctcaaatgtttatcctgtcgttgtggcggcacatccttcggaagcaaatcagtttgctctaggcctgactgatggtggtgtttatgtattggaacccttggaatctgagagaaaatggggaaatcctccaccagcagagaatggatcaaccagcgctttgtccacacctcctaatggagcatcaagttctgatcaaccagaaagataatgatgaggagtttgaagtgttacattttttgtacttgcacggtacaaattcactaaccaaggtatccttcttacaagttaattcaccgggccttcttacaaagttaacaaaagcaacaaaagtcacatattcgctgctctgttgagacatgatatatagaacaatcataatgcatcacttgcaatgattagtgtgataaatttaccactccatgattagtttgattaatttaccacaaaaatatctactggattcctgagaagtgtttttgcacgcatgaagaataatatatgttctccttttctttagttgaggatgcacacattttggttgacattagctgatatccaaacctcacctttttcagcctgacccctcttttattatgcagacgatgcacttcactcttacagcttcccttccgtagagctggttccaaggggtagtcgatgaacggacggaataaaaagacaagcttaacagcagttcatttgttgcttatatgtctcactgttatctgtattaagtgagggaagagttagtcctagtatttaattttgctgtctgtcgtgctgtgaaaaaagatgtttgcaagtagcttaagctgtagcaacaatttgtctgaacttattatcaccttttattcacaactagaaagtaaattgctgctcctatcgtttgtgttcatctctgttctcttgatgcatgtcttgcgctgtttcatccagtcgtgccacccgcgtagcacggtgtcacaatgcagctcgacctttacatatccactttgctagattcaattgctatttgagcctttgccttaaaattgctggggggagattttacgcgcatgggttatggtttctctatgctgcagtacatgttgacatactgccgtgccatgccagcgaaacaacggagcatcagccgcttttgcagcgtgccgtttcatcgccggccaaagcaggaaactctgacaaagctatcactaccatatgtaccttcacgtactactccttgtcacttaggtttgctgcgtgctagctgccgcccttcaattcttgcacagctttcggcagcaaaggataaggccgtggcctgcgtagtacgttcgtaccacgtatgtatcgccggaaatatgtacatcggcgaacaaaaggagaggcgatcgctaggcaggcatggaaagatttgaaagcgatcgagcccactgccgcgtcggcgtcggggtcgtcgttgcacgcacgcacgcactggggcgggcagggcagccagatcagagacgctctcgctggggaaagggatgcaaaggactggatggtgttttggcatgcatggctgaatgccagggagagacatggtcggtggatcgccatagctgggggcagctagcccagctgctgcactgcactgcactggttggatcagtacatgtgaccagtgtggtacagcgtactagtacgtgcagtggtagtactggtacttgggcgtcgcgttctgtttatcgccctcgtacacgcactactacgcagcaaatgcgaagctgcccaggtggtcatgtggccatccgctagatgaccgtacgttcacgggggacagtcctgtgtacggtcgacgcaggagaggtggagttaggctgtgtttagttcagcgtaaaatttgtattttggttgaaattggagatgatgtgatcgaaaagttgtgtgtgtatgacaggttgatatgatggaaaaggactgaatttggatccaaactttagatctaaacacagccttagagaggagttggcgtgagtacggctgagttcagtactttactcctaccatcacataaaaaccaacatagtaaccaatattataacacattataatactgcgaatcttttgtttaaatttatggtattaagatgtgttacatctgatattagattagttttttttatgagacgaaggagtagaatgttagcagctgattagttaagtactactccttccatcccattttgggtgagacggtggtataattgttataaattttcaaaacagttttgtttatttaaaatatatatatatagaaagcatttgcactaaatatagctttagcaatttggaagtatgaagacaaccgggtccatcaactcaatatcttgaaattaatcatccacggctgggagaatcaagataatttgatgcagtacttcaaaaaaaaagttaggtcactttcaaactgaatgatggatagattatggataaaataaaattgaacatatagatggattaaatacatactccctcaacaggagcatgtccagactcgtattattagaatatattatagtattagaatatatcacatccagtattagatttgtttttataggacggagggagtataacctagaaaaggttatctaaactatgctgatgtagcaagttcttaaggaaatcatatttttgaaagtgtgccacggataccatgtagtatgtatctcaatcgactacttagaacaatcctactatacattttgactcactcatccgatcgacgaacgactgaaacagtggaacactgaagtgcggatggcgtgaggctacactatgacttggtccgacgcaatactacttccacatcataggcaagcccatatatacagtaagtttaaacttagagagacaatgtttgacatgaccgcacgccgcttctatttttagggggggggggggggggttatattaatggagttattcatcaggcctagaaattcagaacctaaaatactaggaacaaataaatatgcggctttcttataccttttgttatgtcatgaacgtgtatattatgccatgtgtgtagcatttagaaacaaggggagtatcattttatttctcagtctatttctccatcccacctgtaacaaaatataaggatttcattgaattttaactttaaccttaatttctgctaaaattcttactctagtactagtactttcgaggtggggggagtactccacccattacctacagtaattctcctcattgatgattcgtccatcgtggaggacaaaaattgcagtggcaggatctggctgctctactcccactttggatgaataacaattgcagcagtggctgctgctgctgctgctggagcagcaagttttccgcttttacagtccggcacctggggaagctttcacggctgcctcgcgatcatgacggagaggaacgttgcgtttcaacgaaaacagaggaattgacatgtaaagattcacaaaactggtggccagtgagctggagtacgaattaattttccggtcgcaaacacgctcgcaaggagccttaatcgcaaggcggcgacgtgttaagcaacgagatagtcagaaaaaaataaaaaaaatgaaaaaaaacggaatggttagggtaattatcaactgattatgggcctgttcactttgatgccattttcaaccataccatttttttggcaaagttgctaaaaaaatatctacgtttagttcgtggccaaatcttggtaaatacaaatttgataagatttattttggctacaatctgaacaagtcctatgtgctggaaatggcttgagatctcagggtcatggcccaaacttctatgccggcgttaagttctgtgatgtacttcctccgtcctataaaatacctaattcagtgtgtgtccagattcaaatctagaattgggtttttatgggatggagatagtacggttggtttggtcaaaataggtgggcaattttggcgcgccaagttgtaaaaatgttcatcggaatcgccgtcgttttgttctaaggtgaggtgcttgtatttacttctacaaaaaaattatgcatcgtgttgtttgatcaaacttagaacaatcgtctatgtgaacttgattgctgacaccagcacgtggcactctctcagacgataacgtcacaccattgttgatggattgacaatctcaattggcataagtttacttgttgacgcttgagatccccccccccccccccccctcaatttttggcagcaatcacacatctcagaggaaggaatctgcttcaatttctagcctcctggaattgttgcattggatggaaatttgggcagtcgtctactgtcgagaatctctgcgcatcactgtgctagctaaaatacgtaggagtagaaaacaaacaaggtaatgtaaccactcaggagcagagtgtattttggacatatgaatgcagaaacatatcatgcactatacacatgtgactgtaacaggctatccgatggcatgaaatcaccctccatcaatcgatttccgtggtgtaatgtaacttttgccggacacatcaaccggcaggttgagctttagtcatctcttgtctgtcgccgaaagacgcctcatccactcaaaattagtcttgactttttgccaatgggtctccgtttcatcagttgaaatcgacgtttactaatgcaacgtagtttattatcaattttttttaacgaatcgggcagggtgccaatttcattgagtatagtagaagaaaaatatttctgtactaagtataatggaaaaattgtacaagggtgttcacgctatggtatcatcaatgagaggtgcttactgatcaagttatgggctcttcggcaacttgccggtggtccgtgtcgctcccgtcccaggggcgacccggacgacgaaaaatcctccgccgccgccccctccctcctcctccccttcgtcttgccgccgcccgagcggctcgtcggcaatgccggacggccacaaggacggcggcggcggcggggcgttctccccacaaggatgcccagcggcggggaacaccgggggcttctccacggtggcgggtcacaggaggtggtggctggacggtcggcgcggcggattaggccacgccggttgcgaatccaccttcctcgacgccggatctagcctcgccacggccagatcgggtctaggcgaccccgacgatggcggccggaggaggcgcgacgtctcggctatgctgggggtggtcttcgagcggtggcaggcggcgaggctagccccagctcgtctcttccccctctagctcccagtggctaggacggcggaggaggggaggtggaaaggcgttggcgacggagtcccttcggacggcgcgctagtacaaaaaggctttttccatacgggcaaaaggcatctttgcatgcggttggggcaaccgcatgggagagaaggtctgtaaaaatcacccttttcgcatgcggccggcccaaccgcatgcgaaaatcccattttcgcatgcggctgcttataccagccgcatgcgaaaataaattcagcaaacaaaaaaaaataaaaatccaaaatatcctaaaccctagcccgccgccgcatggtgccggattcatcgcccccgccgcccgccgtcgtcgccggcaccggatccatcgctcacgccgcccgccatcgtcgccggcactagatccgtctcccccaccgcccgccgtcgtcgccggctccggatccgtcgcccccgccgcctgccgtcgtcgccggcaccggatcggccgcccccgccgcccttggcgctggatccgctcgaggcggcagagccgcccccgccgccgcggcggtgaggaggggggaggggcggtgaggaagggattgc

SEQ ID NO: 59784 - DNA, 20933 bp, Oryza sativa
tttgtgctcagccccctccacatataccttcgcacataacttgccttgactagagcatttcaacccaaatcccccaaaatatccctaaatcggctagggtttcaacggtgaggttagcggaaagaggccgagaggtagcggctgtggcggcctcggcggtgcgataagtggcaggaggaagcgcagtgcagcggggttagcggtggcacgtttatgcaacatgttgtgatgtggagggggctgagagcaaaagtgttgcctacgtggcaatgccacgttggcggtcaaacgcagtcaaaggatgtttggaccggggtggtacattaaaccaaattcacggacctaaacatgcaattttcaagttcacggacctaaatgacaccaccacacaagtttagagaccggccatgtatttcactctattatttatttgataggttctcaaaacatttgatgagcacctggcactgaatagacagacactttgtattgtgaaggctgatgaatgagttcataactcgtggggtaaatcggatcatggatccaatgaaaaacaaaatttgaagaatattctggattaaggaaactggttgcattatcagttgacaatataaaatgatagtgatatattctattatatacatcaaatagtggaaacaggctcccaacattattttgataagaaagctggcctaattacagtagatatcataatatgacaagaatgatacattctattatgtatttcagaggcaaacccttttacttttaagtcctaaatatcaaaagctaccatagagtgcagaccggcagatattaaattgtcaagtgaaaaaagtagaaaatatttaggattcaaaaagcaatccaaaattgaatcccaagccaagtactacaatccagtccttgtattacgggcttgaagttctagaactgcccagtgcagcatgatctgcacaacataaaaaaagctcccagaatattttgaacgatgcagcacgaagtttacaacacgccaggtgtggaagacagagagaaataagatgtcctcgctttcatgaggtgagaacatgttcttgtgtgcattttacatatttgtcctcggaaactatgcagagttatgctttgagcagaggagtgatcatgtgctgtgtaaacactatagtgtatggaactaaccatagattactcggatataccattagctaaaggctaaaacacacaaaaaaactgcaaagaggaagaaaacatacccataaaagaatgttcgccatccacttttcagcctctgataaatgaaatagatatttgctgcacaagagatggccacctggagagttggcccttcttcagtagggaaaacaagggtaagcactccaagcaatacaaaagttattgctgtctgccaaatcactttactagaaggtgtttgaaatcttccctgaatagccttgactggacgtgactgagtaagttccctatactttttcttgagatccacttttggtttttttctatcagagaaactctgcatgatgattctgtcatgggcagactcaattgcatcaacacttggcttatgccctgcatacttgtttatcagaaaattcctggcagctcgaatttcttcttcagatgcttccctgctgattccaagtcgctgatagggatccttcacatggattctaggaaagatggctgaagaaattaagcggttaaaaagtgaggtgataattacaaaaaagaactaatccaaacaacaaaaccgacaggacaataaaaagtatatgtgatctcaaataaaacatgagaggaacagattgtgagaaaaagtatatgtgatctcaaataaaacattagaggaacagattgtgagactaaatggcgtgattttgatataatgtccaatgctttggccatggtatagttaggtatttatacttttacaatttaatatcaagcatgccttacagcaaactacacaatttgttacagaggtataccaagtggttcctagtaaaccatactgctcgttactataattcaacatgacaaatttggttggtaaaagtacatatatgtacttactatgttacatttttttcttacatagccctaggaagttaaatacttacgagttgacgagtcagctgtgtcaccaaatgatgcagtagcaagcggtgtgattctggtgtttcgcggtgcataacagaaaggagtactatactttgtgtatctgcatgaaggatcgcaataagatttcccactgcataaactaaagaaatctttggcagagagttgatgaggccagaagaagcacaagatacaatacctatccacattgatgaaaagtttaacactttccttacgtcccctgctgaaggccaacgaagagacaagtcccaagggtgcactcgacgccctcgaagtaaccggacatcgagcagcccttgaaggattgattgctagactatgtgccaacatctcaaggaatagttgaacagcctaaattgaggcctttcccctcctaagcacaacaacagtaaattcatcaatcacctagaacaaatttagcaaaggaaaaccaatgccatgcacaaagatacacaaccgaacgctagcagattacccacacccattaattaaaaaaagtacaatcatcacaatatacaacttaggaacctggataagaaagcaattaattcagacaaggaggaacatatcgagcgattagcagccaaccgaccgtcaccctcagaaatcaaggggtgtgtagcctgaaaaattcacaccattcaccacacagtgccaccggaaccctacatgccattaccaaccctacaacccacggaccctgcacctgcatcagcatccatcccggcgtctaacctaacctgtcctaacctaaccatcggtgcaccggcgccgcaccggaatcgagcggggtcaagaaggcgaagacgaggagccttaccgtgggaggtgacccgcgcgtccggcggaccaagagcggcggcgctgggcggaggaggaggccgcctccgtggataagggggggcggggtggtgtcgcgtcggtgagggtacaggagaacgctgcgcagggtggtggtggtacttccgtaatttccttccgatttcctcctcgtcctagatggccctatactctcagggcctaattgggcccagcccaaccgcgatcccaaaaaaggagtgggccccacctgggaacggaatgcaaatgcaatggccacggtcaaggtcgtcccccttctcctgcaggtgggccctgctctcccacgtcagcatcactccaagtgtactttaatgtgtgtctgaggaggagaatgggattgagtagattgagaagatacgtaaaataagatgagccattagctcatgattaattaagtattaactattttaaatttcaaaaatgaattaatatgattttttaaaacaattttcctatttaatttattttaaaaaaacgcaccgtttagtaatttgaaaagcgtgcgcgcggaaaacaagactcaatctcccctatcaccgaacagagcctaagtttatccacttggacagtgggggtggatacacgcacgcacgcgatcctccgccgtccgcttcaccccgcgcgggcgatcctccgccgtccgctgggctccgcctcggagatccggcctcatccgcctcgtcgtctcctctcctcctcccccactcgcgtcgcgtctcctttctttaattgcttctctctcttctcccaattgcagtcctctcccccccactaatcccacccggtaatccctctcacgatgaacggccgcggcggcgattctccggcgacgaattgctgcaggggcggttcttcttcttcgtcttcgtcttggcgccggtcgatgtgggtctggtcgttgagtttgtatgcgatttgaccgctcccacgcacctgtggcgtagttggttgcggtgcaactgttcgagctattgactgtttggctggctctctcctcggcgttattctgtggccgtttgggggattgggagtattggaatcctactcttccaggtacccatgataataagttcttccctccaaaagaattcttttcttgaccatttcatcttgccttttggagttttgttgacctgggctaaagttcacttctgtctttgcttaatatgcgtgtgggagtagagtgttctgcatgctataaatggaaggtttcttttttgtcatcgtgcatggacagggctaagcgctcgaacagttttggagtgtttgaccgttttatgtgtgtgagaagtggatccctggggattatatgtgttatttctaggcttgcagcggaataaggtttattgttggaaactttctttctaagatcttgttaatttcattgatgggactagtgcacattcaacaatagtaagttttagaaaaggaacaacaaaggtgcactttcaatatgactaggatgtttgctctgcactttagcccctatagtttcctggacacgctaaaaaaacgcccttcacacttatcttaccttatactaaagccattaaacttaagggattttttagacaatttcttgttttatctcctagagctcacaactaggtgctttaacctccgaccagtgcaccgttcatctccatttttagggattaatcagccactttttgtttaatcatccgactaatcgtccgcatattgcacttgattatcatttaaatatcttttatgaacttcatcttcaagatgtttaagaatattcacaccacagagtacttctcttgatgctcataaattagcagttccagtttgatattaaagtttttagtcaccatatacctttaacttcccaatctaactttgttaagatccttaaattatgtactttatggaaaatcaataaataattcaggtaaatacgatctgttttttgtttttgcattatccaaatagttgttccagataccttttcggtatccatatgtccatatttacttactgcctgagtaactgagtactttttctcggtaatttcatatgtttttgctaagctaaggttttgggcttataactgtcgagtcattacagttttcctttacaagatatgatgatttttcccccaatatggcaatatctaatcattaccttcggattttggaccagttctcctaagttcttcacaggaacaagtctgcaatcaggatggtttctgaagtctttgctaactttgagcttagtgacttgatgggtaattgattctcttgggtgttgttgcatttgtgctgtaacgtggataggagtcatggaaggtgtggtaaccagttcagttggtgaaccaaatcaagacaatgagccaagggattcttcaatagaacttcccagagtcattactgacatggagacttcagccatgcatgatcctgaagctcaaaagctaattggacatgaagctgatactgaattaacgccttatgaaggaatggaatttgagtctgaagatgctgcgagggatttctacagcaaatatgcaagacatgcaggttttagaattcgaatcagcaggtacactcgttctagacgtgataattcaataatttctcgtcgtattgtctgctcaaaagaggggtttcatgaaactcgtgattgtgaaaacctccatgtggaccagaaacagcaagcaagggtaggaactagagttggttgcaaggccatgttaatgattaaaaagtttgggcctgacaaatgggttgttaccaaattcataaaaatccataatcatggaccggttccaccaagaaaacctcatgctggagaacatcatgattgtgatctaatggaaaatccacattctattgaggtggaccctattgatgagccagtcgagggtatggaatttgaatctgaagaagctgctaaattattctatattaactatgcgagggttaatggtttccgtgcacgtattagcaggtactgccgttcaagacgtgataattcaatcatttcacgccagatcgtgtgttccaaggaaggcttccgtgaggttcgagccagaaaagatattacagatggaggcaaaacaacgaagcgccctagaatgataacaagagttggatgcaaagctatgattgtagtgaaaaggatgaactctggaaaatggatggtttctaaatttgagaaggagcataaccattctttgttatcttctagagcagtccctattacatcaaatgattcttctagagaagttattgattttgctgcaacgagtaatgatcctaatgaagtaaaggctgaaggatgtagcacaggaattcaatgtaattctacagattcactaactgtcctttacaaccatctatgtcaggaagccataaaatttgcaaaagaagggtcagttacagaagaaatttaccatgtggcaatgaatgccttgaaagaggctgcagagaaggtttctgaagtcaaaaggagtcacccgacaatgtcacagagtaaacatgaagttatgcaaatggaaactatgagtgcttcgcaatgttcaaatgatgacaaacagaaaacaatgacaccacagctcaagtttttgcaagagcccagtcccagtcttgtgctaataccaaccaaccttttgactcattcaagctcgaattgtgctgacaatattccactctcatgtgatttaactataaatggtaactatgttatgataatgataagctaatccattgctttgttagtgctttctccacaccgaatgatgttgggataattgttttatttgtaactgttgcttttgtatcaacagcgggggaagtcaagcatgtatcagaaagttcttgtttggctgcgaacagaaaggaagactcttcgcagaaatcccaggttacaaattacctgcttgcttatatgtcatactgttactaagggcctgtttggcacagctccagctccagcttcaccccttctggagctggagctcagccaaacagtttcggctccaccaaaactgggagtggagctgagtggagctctctcacaaaatgaactagagttgtggagctgggtttaggcagctccacaactccactccagactcaactcctggagttaaatttaggagttggagctataccaaacaggccctaatatacctagacgatttgtgtattctgtattggactagaaagatcttatgcgtagttctgaccgcggattccacttgtaatcaagccttacagggaaaggatgaaaggtttcatgtactttctaaagaaactacggttgctattcctgcgatacctctcacgctgtacatgcctataatgaagaatccaactggagattctgcaggtaatccatttccttctgctgtttacaggaaataagtgtaaaagtaatatttaaaattctagatagaaattacagatgcatcagtttagaaatctattagatatttatgcctgtcaattgttttcttcatcatatgtggcaagataagatagtaagtttacaacactaaaattttagaaatgacccaataattatatgtttagtaatgcctcttgacaccattttcttttgaaggaacaagaatattcgtgtgtggtctgttgtcctcatctgcaaaaatttaccaattgttttgcctactatagtagtttgcctgacaatttagttcgatagatcttgaaactcttcagtttggcatttctttgtttctttggaatgataggtggcttggagcattgtgtttatctgggttactttttttcttttttgcaatccaagaacataagtcatttaggatacttaataaagcttgtatagttgtgcaaatatggttataattcataccattgctggtagctttcaaaaagaggttatatcatttctagtgaatcactgtgagtatttactatcataaagcatttgcactgtacttgttaaaacatttactagtattatttgttttcaattccccagcgatcacatgagtgcttactcatcatcataaagcttttcatcatttagtcgatttccctacttgataactatctaccagtggatcttgattgattgctacctgccgttagaatgctctcctgacatcttcccattttcctggaatgcagatggccaatacaggttgttggccgctcctattgaagcagttccaatttcataccgtcctgcagaacccatccaacaaccacacggaagttttcctaattcagggccactacccggttttctacctaaactgtacaaacgaggaaaaggtccaaactcgctggtgcatgctactgctcttgcttgtggtgctcgtgtcgtgcctcctgaggaggctgcctcgctgatcaaggctattgagtccaagatcagatctggaggagccacaatagcaaaattgccttcaagcagcttgacacctctaattcctgaggtcgcctctatgtcatcttctagtgaagatgatgaggaaaatgaccacagtgagccactgatggcgagtgttgaacacaactgccatgatcagagctctgaggaaatgaagttggaggctgatccaccatcagagttggaaactgaagctgagaattgttctgcgcagccagaaaatgaaaacaacggtcctactcattgctgacaactgagaagtgagaactgaagtattgaagctttctgaaatcaaagccccacaaggtagtgattatatatatactgtaaattttgagcatttacataagattggatttaggattctaacagcttgtctcacttgaattatagattctaattgtgataactcaaataatttacttcaataaaggacttgtaaagagggtcgccttgctgttacaatatttgtggataatgtatacatgcacttttatagaaagaaaactaatgtcacagtatcttatattgaaattgggtccatatgtctggagaaaacatttagccatgttatatgaccacatttcacggtttaagaatttcacagacgaaggtccaattcgtgtgcaataattagggaaaaatcgcttgtttttttttgacaattcctaatatcacttttgctttcatttgaatggtctcaccaaaactcctgcaagctgaaatatagacaatagatatggttgcaaatggttccttccatgctaacatctccattcttgaaagctagaattttctcaaataaattttctcaatttttttctcaagctagtttagtttcttgaagctgaagctcaattttgatactgcaatataaagcgtgcgggatgatgtcgagcaccacaacgtttacctggtgtcgttcatttctttgaaaaacagcccccttcttcattactcttttatgcggttatgcctgaataatcctaatcaaagagaaaatgtcaggaagaagccatggtagtttgccactcgtgcacgatccggcactatgttgaaaaggttatcactcgtttaatcaacattatcgctgacctttcgacaacgaattggcagagcaaatattgcactaatccatggcgtcgccatgaaaaggaaatcacccctatgtcaaacggctgtcgtaccagagcagcagtgctgtaccagtgtacggtgggtgaacaagattctcgtttacttttttctcgggagagaggttcaaaagtcatagttctgactaacaacatttcttggaaatcttttaagtgattcccttaatgctgacacgatcaatttctctgggatatttgtatgccgtgcagttctgatcttctcagtttaacgaagggaacgaacctccttatcgtaagttgtacttgtattatcgtaaaaaaatatgtgtattccttttgtgttgaatgtgtgagaataatttttttgaaggtacaaacaaatgaataattattataaagttagaaaatgaatatagaacagtattgtaagaaattcatatgtaattagttttttttcctataaaaaatcatactgtataacagttcaagaagcatactcattaatccattcatcaaaatggaacaagcagggcagaatggaggtgtctgatggtatagtaacagaggagcaagcactggacatatgatcaaatcaagatgctttcaaattccaattcagaaaatagagatgtgtacaggggaagggggaatggagcatactgcatacacaccgtcaagctagacaaactgacagaacctaacagacacgcatgaaacttataggaagctagctaaactctaccggtagctgcacatcgatccaacattttcgtcatcatcattggcaaacacgcatagacccacttctttattgtaaccaactgactagcttcatcgcgttctttatctgcatattttttattcttcagtaactcaaaagtttggtccagcagcgaggatcttgtctgtcaggctgctgtctcccccgatcttgtagttggcgaacacctcgaagttcttcttgaacaggccagccagcttcaggagcgtctccttgtacgcgcccttgtccgtccactgcacagaggccacatttccgacgaagaacaactcagactctgcattttttacatgtatagcagaaatggcatgaactgatgcgtgatgctacggagcttacggtgttgatcgggtcgaggatttcagacgggatgccgtcgatttcagtggggatctccaggccaaacacctccgtcttcttgtagttggcggtgaggagctcaccggagtggatggcgtcgatgatcttcctggtatacggcagcctgatccgcttgccaactccgtacctgaacagtgaattcagagttagttcatgccacaggtaaatgtgcaatggtgtggacgctgttacagtggacagtagcagataccttccaccggaccaaccggtgttgacgagccacccggtggcgccatacttctgcatcttctcggcgagcatggcggcgtacttggtcgggtggagcatgatgaacgctgcaccgaagcaagcagagaacgtagcctgcggctccttgatgccatcctccgtgccggcaacctgttgaaatggcaatgcaataacgaagattcaggctaaattcctttgttgatcatcaaggtgataggaaggtaaggcaggtgactctgcttctgaacaaaaattgtttaccagagcagtgtagccactgatgaagtggtacatggtctgtggaaggtttagcttgctgacaggagggaggacgccgaaagcgtcgcatgccaggagaatgacgttcttcgggtgtggcccgacgcacggtatcttggcgttggggatgtactcgatagggtaagcagcgcgcgtgttctctgcagaaaagttcagagttgtgagatttccattttttgttttttgctgtaacttttgtgactgactgaaaccggattgcgctttggagataacttaccggtgacagatttgtcggtgtaatcaacttcacgggtgtgctcatcaaagacgacattctccaacactgcagacgccaaacattttcgatcaatgaaatggcaagcgggagaaactagaatgatcgactaaattaaactgaaggttcaggcaactaccggtcccaaacttgatggcattccaaatatcaggctctttctcctgtgacaagtctatgcacttggcatagcaaccaccctcgatgttggacacgccagtgtcactccagcagtgctcatcgtcgccgatcagcagcctgttgtggtcagttgacagagtagtctttccagtacctgccgattaaaataacacatacacaaaatcagccaaaaagatgacagtaaacaacaagggcactaacaacacaaattcttcagtgaaacaggcatcatgcacacagcaacaaagatctcaaacagatatgatgtattcagttattatatatatggtgatcaaggggaacgcgtcagatgagactgagcaggtgacggcaccacgggtgttttttcatttcatccaccgtggagagccatcttattacctgacagtccaaagaagagggcgacgtcgccctgcttgcccatgttgcagccggagtgcagggagaggatgcccctcctgggcatgaggtagtgcatcaccccgaagagccccttcttcatctccccggcgtactgcgtgccgaggatcaccatctccctcctagcgaggttgatgtctacgctcgtcgacgacgtcatgtagtgcgtgtaccggttgcaggggaactgcccggcgttgtatatggtgaagtccggcgtgccgaactcctccagctcctcctccgtcggccggatgcacctgccaagcccatttcccccacatatccattccggttactactgcaattctactacttagtacgccgctgatgtgagatgatcccccatgtcttggtaggcatgcaataggattccagcacacacacacaacatatagtcacatatatctcataatcatggagcagtatacgtcaaggtgaacttatctggtggcgacacgaacgagcgacctaaagatagtgcaaagtgacggcttcacttacatgttgtgcatgaagagcgagtggtacgccctggccgagatgatacggactttgatccggttctccgtgtcccagttcaggaactggtcgttcacaaacacctacagaaatacagaacaaaatatagtttgttatcaactgctgatgtaaaaattactgacacggtcactgaacttgagagtcgtatatcaccttgtcaagggagttgaggtagtcgacggccctctccctgttggtgaggaaagtgtgctcgtccatctcgatgttgggcgaacccctgcagtaggagagacacaggcaaaacagagtgatcagtcagctgcaaatcagcaagcagagcctgcagaaacagagctttgacatgcacaagtagagtaggcggtgaactcacttgccccaccaaagctcctgcgcggaggcctcatccttgacgatgcgcttgtccctcggcgaccggccggtcttggcgccggacagcgtcgccagcgcgccggtggacgtgatgaacgaccccttctcgtacttgatcgcctgctcgtacagctctgctcgcccacatcccaccagaaaacacgtcacttacacatgtcacgagttataatccctgaacaaaaattacagccgttctggcgtcgcgtcgcgtaccagcaggcgagaggttgtagagcacatgggtgaacttgagggagctgtcgctgacggcgatggtcggggtgacgtgcgggtggtggtggtgcaccggctgcgggtgcggcgacggcgcgcccttcgccgcggcctcgcccttcctcgccggatctcccctgacgaccttcggcccggtctcacgcgtcagcgacgccaacgacgcgctgcatcagacgtcatcgtgacagggatcgttccatcagttaattaccactttatcaggtcaaaataataataataagaacatccaaagaaaatcagcacttgctcagttgcttgctaccactgctaaacttactcctaaataaaagtaagaccatgtctcaatgaactcattgtgtctagttagtccgaatagaatactgtgtcgagcggcttgtgtagaacgatacgaggtttcctctaatttcttgggggaaattcaggcgcaagttacgcgacggcaacagctaccgacgccgccgcgtcaggctgatgaggagattatcgggtatccccgcggcgcaagttgccgccccaaattgcgctcgcgttcgttacgtctgagacaccgcatcggcggctggtgcgtgtcgtatcgtatcccccaacaagccctatcgcgataccgtcgacgttgccgatcgacacaaacggcagcgtgcatgacggaagcatgtattgctctcccaaaaatacagctaaaatcaacgcctctgttgtctctaccgcccaatcgaattctgtcacgccaaggttcttcgctcgctccccagcatgactgcgaaatcgtattgggatttttgggggtttgcgtggattcggtgcgatgcgagggggaatgcgaacttgtgcggtgcgtgcaagcgggtggatgttctgggcaattttgtgatgcggtgcggtgcggtgcacgggggatgtcacgtgaaaggctgcggcctgcgggcagcgggcgtgcatggcacggtgcggacatcttgtgatgattgtcctttctgctggaaaacgacctgggattgtaatccggacctacttttttttttgtccaactttttgtgcgtattagccgattaacccacggtaatcctagtcccaacattacttctttttttttttagaaacacattacttggtttggccccgtgagttacttttggtttatctttattcgtttcatttacgctctgaactctacgtgtctgttacgaatttaggttgctggatatggttgacacgcccgtcctccaatgtccacgtggcagaacaggtgcacaactaccattaccatggtccatcctttcgttctcttccatgtgggagtaaaattatccagcaacaacgtcattttatttttttttactttcgtcctatctaaaaggggattgttcgattcctcctcttcattttccatttccatttctcccggctaaaatttcccattttcatttgtcattcccttgttagttttcttaacaaatgcattggccagtggccatttccaattcagattgctcgttaggaagcaaaaggcaaagcctattattatacgagcgttctcaaaaaaaaagagagagagagagagagagccgaggagtcacctgatggactggagctgctggcgctggcgctcctcctcggagagggcggcggcgaagggcgaggaggcgccgtccttgatgggcgtggtgggcgccgaccgcttccgctgcagcgagtggagctcgtcgatggtctgcgcccgcaccggcgccgagctgtcgtcgtggcatatcccgttctcgtgcttcttcgtcttcgccccgtgcgtctcgatccgcgccagcccgttcggcgtgctcgccatggccgtctccggtcgcgcgaaaccttcaaaaaaaaaagtaaacagtcacgttaattagcaacgccaacataacagcgctagttacgatttacgacccggttctgccattgatgcttgcagcatccaaatgccggtgcaaaaaccacggagaaattaaaagagatgatgaacacgtacgaggcagtcgaggaggagatcagcaacgcgatagtgtacaagatgacaggacaggagtggagaggtgtggggcgtattgggcggagtccgggtgcgcttttaaaggggcagcgagttaaccatggttaggtgctctaaccatgagtaggtgttccaacctgagttacgaggcccaaataccgacgtcgtcgatcaggattgagaaatgggaaaatatacggtgaaaactatgtatacggtgaaaacttaaaacctaccattaaatcgaaaaataaacgtctaagattcatctacgttatcacgggtaaaaattttactcgtaagtttacttatgagtaaaaattttattgagacttatattgacatggacgattctcgtacatttaattttcaatttaatggtaatttttgagtttctaatatatatgatttgcaccgtatatttgtcggactttctgtcccacgggaggttgtggttaacgtcggaggctcggagcgagaggaatcaccaccaaattcgctgcatgcacactttgcacggttgcaccaggtttgggacttggataaatgaattcagacggcggttaactggaaattggttggattagctaagctacgaaatggatttgtcacacgcttttccttttgtatagatgctcagagtaaattatagtttacagtagttatccatcgaaacgttccacatatacacttataatttttttcctttgaaatcaacaaaaacaaattcgtggtaacttgttttcctaattagcaaatttggctcagtagattcagtgattcacagtagtcaccaccgttgtttccttctcaaaagagtatatctatatatttatattaattaatttttacaaaacttatcttttacaccaactggtactatgctcctgcttttcaacaggactaaaagaaatactaacaattagtttgatggggttgaattttatctatccacttttttatgggttgattctcgtgcagaaacactcttttattttgtcttttaggcaatatggttttttcatgtggcggatgaagatgtgcgagaagatgtagacgactatctgattttaatagattttgcagtattagtagagatacgtagaagcagaaagaaaaggaccatcactaatctcaattgcaaatagaacaatgtgattaacattattcatgtggttagcttttataaacggagcaggagatgacgagatgtagctgtaaattcattgataggaataggattaacacccgtagcagtgagaactggattgcctaagatatataagtaaacaaattggccaagtatgtggaaaaggcattagtactacaaagtagagtaatttacaaataggattattatgcatgcttatcatctgcaccgccaatcatccagctagatcactggtgcgattatgcaagtcctttgtggtcgccattatcattcgcagataatctgaccatcctgggtcggcgcaggtcggccttcacctgttcatctatctagccgttatccaacctctcaagataaatccaacaaaaaataatctctcacaaagataatccaacaaaaaagggtgtgcacagctgagcagcccgacgtgccctctaaaaaatacgtaataagaacagagagcagtgttgacatttgatccagtcccaaccaggggcaacacagtacggtcattttacggttatcacgtatggtgatcttcttaatttttaaaaccacaataaatctcatgatgatttgtgtgataacagtcttatcattgtaaacttacctaaaatgatttggtgaacctgatcctaactcccaggctcccagctaatgtgtctgtgtgcgtcgcaaacatgcaattgcagatttgcagtcatgcagatgtgtacgtgagatggattggatagggacgacaacttattgctcctacgctgcttaagttgaaacacccttttcaacatttgttctgtgaataagtattccatctcaaataaaaaagtagtactagtacaagtcttcaaacacttgcactatactagtctaaaagcaacgaatttgctgtgcataattcaactcaagcgagtctacttcaccagtcgattaatgacagacattaactacttagcctagtcatttttttcctacttttctgatgtgtatctgtccttttcattatcgctcccccaatttactactcaccgctaactcctcaaccatgagatttctcgagattttggtgaatgaaggggatactgccgggaagctgagggagtaattaattaatggttaatccattcacgttagggtgcatgtaaccaagttggttccgtgaacccagttaagcgtagtggatcagatgccatgaaatcggggaaatattaattttcctgatcattttagtagtagtgcattttgcactcagaagcgaaatggaattgtgaaaagtatggtgaattttcttgtaagcttttatttttcttccgtcaattaatgactcttgataatgcttggaagtagtagtagtggtgactatgcatccctgttgtataggaggtgacatgaggaacagagggaaacgtggagcttgatgcgtgtactacatccctccgtaatgcaagtgtaagcgtttgactcgttttattattgattattctaccttcttcctgtgtgtatacatgagtttgtctttgctgtccatgtgcagatacatttctggttatcttcataaaaaaggaagtcaattgccacggtgtatatccgacgcgaatccgggtcacactcctcaatcctcatctacatggcattggctatgcacaacattatcctctggatttttcttcgtgtatttagacgtgttcctactttttttttttgaaactcaacgtgttcctagttggatgccctcggcggcttcaagctccaggacttgaacgagtctccaactctccaagcacgagcgtgatggcctagtagcagcagcgtgcccttgccccttgctcttggggcagtaacgggaggacgatgtttcgccgaagttattgatcgagccgactaacgactgcacgcacgagtggacaatgtctttgatcattcatcactgggtcagtttgctcctttttttataaaaaaaaaatcactgggtcagttagttagtcagaccttctttgtttaggcttagacttattggcctagattttttaagtcaacttattgacttatatgatttataagccagtggatttaatgtcctaagtttagtggtggagttatacatctatctcatataagaaaaaaaagcttctctaacctaacttttggcttaatagtattagagtggcttatggctttaaaaaagtcaaataaaaaactgcttgtttgttttggcttagacttttcgacttataaattggcttataagcctaagcaaaagagggcctcaaaacaatcgccgtcgaccaaccaaacaggaaacaagatttgagaaatagtacgagttagtagttcatatgctacggcgcctacaccaggttgtgcacaatgcaccgctaggctaattctgaaagtagacgtgcctgttgagcttggacgacgtagcacgaaacgcgatcgaaagaagacatcgtattgttcatgggacgcgcgttaatgcgttatagatggggctaaaaccaaatggcgatgggaacacctatatatttatcgataaattttctcctaaaaatttgacagatgtaattatagtataatcgtagtgtaattacactgtaatttgtatgtaattacactgtaatttgcatataactacagtgtaacttgtatataagtttcacgtaattttgaatcgttagatctattacaagatttgttttggtgaggaagaaaaaacaatcacagcacacatatatgtgaaagaatttgttcccacaacctccattttaccgaaataacatgttacggagagatttttgaaagttacatacaagttacattatagttacagtgtaattacactacgattgtgtaattacatgcaagttacagtgtaattacactacgattgtactgtaattacatctgtcaaatttttcggggaaatttgtcaacaaatatatagcaaaattgaatggggattcaccccctccatccggccatcccatgagatcggtgcacacacgcgtcggtgacaggcgccgcgcgcaatggggaaatgggaaacgggaggcaggcggcagtgacaaggttgcgccacacgcgcggcggggagcggttgcgtacgtcgattgttgcgtacgcctactcgcgctggcggggttttatggccgcgcgcgtcgggcgaatcgaaggcttcgcgatctcgcaaacacatgaaccgtggcccttgcgcgctcgacgtcatgcacgtaatctgggcagttatacacaccaaccgcccggcgtctggctcgtcgtcacgtcgtcccccgctatcctcttcacgcgcgcatatctatctatctatctccgcttttgcgtggcgtggctgcgcgtgacggcgtgaggctgttaaatgcggacttgtggcacgtgcctaggcaagcgcggtgagcctctctgttttcaaacgcccggggcaggttgtaacgctccgcttttcgtgagtcgttaaaaaaaaactaactcggcaaaatcctaattgcgaaaattttcgttctttgtgtgagagtctaagttgtgccaaggatctcaatttaatcccgttgttccctctcatcgaaatcagaatcctccacctcgaaaattcctcttccgattcgagtctccaaaatcaaattccgaaagtcaatcccttcctttgaatccttgccgaatattcgctccgactaaaaaaaaaaaataaatatccaagtttccgttttgaatctcttccttgacttctcctcgagtctcccttgattcctccctaaaccatcgagttcgaatgtcaaatttgaattcgaatccaaaaccccaattcgaatccactccaaatcagtcttctctacaaaagtctattttacctccctcgtgatgatttgggccgaaacctgccgctggcccatctcttctcagctccctccaactccacgtgcgccgcacgtgaccaccgagagagagagagagagcgctgtctctctctcccttccctctctcggacgttctctcgctctctcgtcctcttcctctctttcgctgtctctctctctctctctcgttttctctctctcgcgccgacgccgctttccgccgtcgccgcccaaaacccgccaccgccttcgctctttcccgcgctcgcgcgtggccgaccggccggtcgttgccgccgtcagccctgccgcgcctgcgccgcgcagccgcccggttgccgccgcgtcaagccctggcgccgcctgcgtcgtgccctgccgcgctgccgccccgccgctccacgccgctagcttccaaggccgagagaggcatcccctgtctcactcccctctccctcctccttttcccgtttcggcaagggtcaagccctcctttccctcttcctttcccctttttcccgaccaccgccgatgtcatccatggtcccagccgcttgcggccaaagcgcggacgctggtcgtgcgactgcaccagct

SEQ ID NO: 59785 - DNA, 47221 bp, Oryza sativa
cacgtagacaaaagtgacaaatagtttaagaaatcatctcttgccagtggtaaattattaagcgtgaatcaaataggggcatttggataattacaaaatctaaaagtggcaaatagttaaattccccttaaatttgggcttctgctgcttgcatcctctgccgctagtggtgcaactggaccgtatgcggtggtggatctcagccgtcagatgctgcattgacggttggattgagcagcggcggagccactccccttgcgggtcgggctccgcctctaccgtttcctccatccatcaacaatttataaaaattagttgatcatctgaaaatgctagtagtggctcgggcttaacaatgttgctcgcttcgctgctgctaggattgagtgacaaagtggatgttccgtcctcctgtggtcactggtcacgaacggtgagaagttcagtgtgtggttactcatagtactgagttgttgtatacatgcactggctagttttaaaaatatttaaactgaaatttattcggttattatgatacataagttacatgcacgagctaattcgcttgaagatattgagttacggagaaaaataaaatctattactcttactagctctgccaaacaggcttttagtaggaagtacagtggcatcgtgtttgatgcagagcagcagaggtcgagcttccaaaagacagaaaaaaattcaagtgaataaaattgaaatttctgatttgatctataaaatgtggagtagtagatacgacctttcaattcgggaaacatcaaattaaaattgctaagtttggagcattcgcatctacaatctttttacctttcatcattgagacacgaatcaactatagcaattccgatgtagacggccaagccacaacaaacaagaacacgctctaattcattgggggcgatagtgattagtcaaggttgtttcaacgattacgatgtgaaactttgaaagagaaaccccatttgttatcgcacacaccatactcaaaatagtactctctccatattttaatgtatgacgccgttgacttttttacaacgtttgaccattcgtcttattaaaaaaaattatgcaattatcactttattttattgtgacttgattcattatcaaatgttttttaaacatgacataaatattttcatattttacaaaaattttgaataaaacgaatggtcaaacgttgatcaaaaagtcaacagcgtcatacattaaaatacggaaagagtacaaggtttgtttcaacgattacgatggactacggatgcagtgccatgatcgataagaccactatataagagaaaaaaatagacgattaacgattaaaatgtaagagaaaaaaatagaataccatcctataatagacgattaacgatacgataagaccactatatataattaggcccatatcgatcgaataaagccgaaaacaaaagttattgatcacacgaagccgaaaacaagatgtcaaccaaatgaatccgaaaacaagagtaacacaaagataccttcctggtgatcaggagaacgacaaagagataccttgagaatgagaaagaccaaaaggataaactgaaatgttgccaaagcagcaaatcctacctagcaattagcaagatcggttgggttttgccagatgtgcattggccagaagggaacggaatggctttgctggctagtagtgaactcctacgccggaagatataaaccgagtatatatttgctacctctatcttaaaatataaacacttttaaagttagacacatgtattaagaaaacagatttaattaaatagataaatagggtgtgtggttataatttgttaagaagataatatagaaaataatttatatgaattgaatgtaatttaactggttaggtttcttatggtggaatcagtgtacttgggtttaatttctagatttaacacggtgtttatatttacgactaatttttctttcagtggtaggtttcaaattctatatttggtacgggtgctcgcatttacggctaattattcttttagtgatgagcgacgtatccatcgacagcgaaatacccgtgatgattttatcaatctcaaaaaaaatatcggctcggtcttcgaccctttttaccgaaggtgtttataggccctgtttagatcctccaaaacgttttgccattttgtagcactttttgccattttggatctaaacactagtagcaaaagttggcaatttggcatttgacatttgctagtccatagtagcaaattgtgccaaaaaatgttttgggaccactacctctctctttctctctgtcactttagtgctagaatggcaaaactttaacatacatctaaataccaactagtacttttgcaatgccaaaacttttaccaccaaaacttttgccatttgctatttgccatttcaaatagatctaaacagacccatagttgtaaggcgtgcgtgtgtacgtttctacagtttatcatattgtaaacacggaaaactagtgacatatgccgtcaccttttttttttttgggctgagctagagagagctctgtcgagtaggcgtgttgacaccatgttgccatcctctcctgcaccatgatgtggtcatcattgccgctcgtggctcgctgacgccccgggcccacgtctgggttcgcctttctgcctgcctgttggctgttgcgaccggccacctggggctcttccctcttcagtttgggcagccagtgacgcgtgtaactgcctgctggttttagtgagagttaggtacaccaacgtggtggttgttggctactgctgctgccagaggcaagggagcatgcatgtcatgtttggcctaagctctttagcttccaatggtcaatgatgtgtttgtatttatatatagtgaatatttggtctggctatagggccctgtttttgagtcatttctgttcttttttctgaattaatttaattagaggcttcttttcaatttgttacaggtcttgacttttaggctgctaacagcaaaattgtagaagtcttattcaaaaaatcgccacctccttctctaaatgttgacactagttaattcaaatttaagctaaccaatgttaaaaaaaatagagataatggagggagtacctttattatgtcagttatgtgtctttggcttttaagccgtcgaaaaaattttcttctaaacgtgttcttaatttatgtatgcatgtgcagctaataatcggtacaacctatacggtaagttattggaaaagcatgcaccaaaactattaagtacacgcataacttaatttatgagagcttagatattagtgtctaactacatgcacatttttatagaaactatttattttctgagtttatcctttggggtttctttgacattggacgtacacgtattcacaattatatgcgtgtcgtgtacatatatatataagtaatgagatatatgtctatgtaagaaaaatgagcattaattcctgcaaatatttttgatcgcgttatatatccaataatattgactgaaagtagtgaaaaataaacaagatggcgttgggacttcgcttgcatcgtaagtgcttggctgactaacaacaactaattaaactctacgagctgacatggtttgtcctcgctgaagaggttttacctaattaatcagctgttgtttttggaacaacatgacccttgtttgcaacaataattgccatggcgctactatatatatgtcatcttccaacttgtttggaagttgggatggtacagtactaaaataactaatatgatttcacctatccactgaaattaaaatatatatgtgggtggataatttcaagacctttaatttgtttggatttggattcccctaatatcgattaatttcaatccatacgtaccgtgctatactagctgtgcttaactaggagtataatattaatattctctcaacttggttggaccaaatggcaaccatccgaaatagaatatgcataaaggtattatgacgacatccgacaaagttattttcaactagctgaatgagcaagacacgctttcgtgaacttaaagatatttattacccgggtaaattaacttgtttggattactaacaaataatcgaaactttgtatatatcatagaaaaatatggaaaaaaattatattaggggaagctaaattgaacagggttttgcctctcctaaattcatcattgtccgcacgtttgtcaaatgctagatgggaaaaaggcacgcccatctcctctctcaattaaagtaagtttaattagttctaaaaaaattaaagtaattaagtttgagacagtgatgaatcccgtatgtaaattgagcgagtgctctagactaaacaaaatagagatatatcaccttaatatttttatatgagacctaaatacacatacgatcaaaagaaaatacattgctttctctattttgattttcaactatattaatatatctacacaaatctataggaacaaattcccaaatgggtatgatctacccagagagtagattggatacttgcagctttgagcgcccagcacttcacgtagcatgtggcatccttgccgtatgcatggccagtagagtcactagtactcgctccatttcgtgttataagtcgtttattttttcttctaatcaaacttctttaagtttactaaatttatagaaaaatacagtagtattttcagcacaaaacaaacatatatatattatcaaactatattcaatgctagatttaatgaaactaattttatattttagatattgttaaacttttttataaacttgatcaaatttaacaaagtttgactagaaaaaaaagttaaatggttcaaaatatgaaaaaaagagagtagagagtagtgaattataagctgaggttgaaggttgggcttgcgcaccaacaaaccccaccgatggatctgtcactggtttgagacaagttaaaactaactctttaaagcaggcttgttactccttccatttcttccttttagcatttaatttttttctcaaaatattttctttacgtaaaacagtaggagaggctcctactgcgctacattaaataatataatatagaagatttacaaggttacgagaatttacaaaagacaaattaattaaaaatgtctaaccatgattgtcacctaggtttgtccatctcttttgctctatgcatatgcaaggcaaactccctcagaaaatcagccttccatttatcaaaactgagagcaacattgttaaaaatgaggtcactccttctgcaccagatgtgccagcagccgattgtcaaaacttcaaagaagaaagtgtgctgaaaagagatctgagctgaagtgatcatgttcataaattccaaggccaaattccagtgaataccaatgtgttgccagacattgttgtgctaatggacaggagaaaaacaaatgtgccatgctttctgtggtcatggaggttcacatcaaacagtttgtgccatcttatatgttgaattgctttttatgtaacatttcctttgtgttgagtcgattcattagcatgagccaaagaaaaactttaagcttcattgtgcatttgcttttccagagtattgatagatgcctggcaacttgaagatgttcaaaaaacattgagtaaactttcttgggttggtattgatctgagttccataaacatgaccatttgtcaggctaattgttaatctgtaagctttgcaatctgtcatttaaataatgtcattagtatattccaaagcatttatagatatatctttcccttcctctattatgggaatttgaatgcttgttttgtgaaaaagataatcaggacttaattaatgagagtagcaatataatttgtcacactttctagtttagtgtgaaatttactgtaatgaaaagttaatttgaaatggtacctataatttaattttatttatatcctctagtcatcaattaggaacttaactaacatatatatactccgtacataacattaacttttagtgccttgggccaaaataaactacaacaatatttttttttatttgtattaccctatatttcctctcttttttgaaccagtacacattgctgcctcttacagtatatgaggaacactcctctttgagtctctagctcctcagcctcattgtctagcacttgagatatcactagttcttactgaaaagctgagccaaaccaaaccagggaaatcaattcatttttattcaaactgaataattttaattctaaaataataaaatgggaatgccagacaatttcgatatatccaagacatcctaaaagcgtctttttttcacacttcatatatttttcgacttggtttttattttttttaagaactttgggcttgtattctagaggatgatttatgtcctagggatggaaaaggaacccatgcatcctgacccttgtcactacatccaaacgacacactgatatttgtgtagactttatggatctctagcaagatgcgacgtgtatgttatagaaatactatacatgaataatgtggggaggtttaaatatatgtgaatttattatttgcaaaccgctagtggtgcaatctcataaaacctttgggaataaatttagctctatttgtatctggggactagtccctgtcacatcggatatttgaatactaattagaagtattaaacgtaggctaatgacaaaactcattccataacatggactaattcgcaagatgaatctattgagcctaattaatctatgattagcatatgtgatgctatagtaaacatgtactaattatggattaattatgtttaaaatttttctcacaaattagctctcatttatgtaattagttttattattagtatatgcttaatacttctaattagtgtctaaatatccgatgtgatagggattaaaatttaatccctgtatccaaacaccacctaagacttatcaacagggtgtccaacgactctccgtaactgtttggcacgtacttcggattcgtttttttcttgcttaaattatagccatttaaaacttcacatatcatcctccatcgttttaaagcttctatgcaaaattatatagtactctaaaatgcacggtacttactagttttttttttttgctaggccatcgaagagaagctggccaagaattgttaatattgtgcaaaaaattgtattatacactactgctgaaccagctatcactggcggttaaaaaccacactaccgctatcaccacataattaactcagcaacaaggtcaccagtattagtttcaaactctcaatcttgattttttttttcaaattgaaatttcactcaacaaaaccgaaccattctggccggtgttgaaagccggccaatgttcaggcgaaattcctgatccttacaagcaaatgaaatatcaatatggcaccgacgtttctggtgcttcaatcaacaacgtgcttgtgtggtgatgaatgctcaagaagctatcaatcatcagtgatcactaaattgtccacgtttatgtcctctttctgttgtctttactttggtcacatcaccattttgcaaacagtagatactgctcttccatatataagcttgtcagttgtcacacacgcacaataagaaagctgacatgagagaaagcaaattaggaaggaattaagacacatgtgaagaggcttatatatgagattaactgaattctaatttgaaaagagatatgctgcgctaactgttactctatgcattcatcaatataacgaattttgggtttcaattttatccacaaattataagaaattcgaaaatactattttacttaaatttcacatgagcttatctccaaccacctcccatttgatgagggggtatcctatttttttcccttcaatattaatcctcaaaaaatctagaatagattatatttatgaactgagagagtatatggtattttacttgctgtactaatataattttttataaaatataagtgaatcatcttatcaatttatatgcaccacttttttttaagatagtggatttaaaaccgggcctctaagtctaagcacggattttcacggtcagtgtaccacaatcttatatatgtactccctccgttttttaatagatgacaccgttgactttttctcacatgtttgaccattcgtcttattcaaaaaattttattcaaatgtataagatataaatcacacttaaagtaccatgagtgataaacaactcataacaaaataaattataattacgtaaattttttaataagacgaacggtcaaatatgtgagaaaaaatcaacggcgtcatctattgaaaaatggaggtagtattaatttatacgtaccacttcatatgttcatgagtgcatattttcatgggatactgtatatagcagcatgtcttttttttttactggcaagtgcagactttcatctgtagccagtgaaaaggatcaccgacatcaacacatgcatacaaccatatattgatatatacaattgagatcctctgcagtactgcatgctctgctcaatgcctgaatgcaactttcatttatagccagtgaataaggatgatgttgccatcttccacttgaactccatctagtctaggacgtctaggagtatataaactagctaggtgatgactaatccaatcaaggattctgcagcttccacatacatcagttcagatatatagcatcaaccaagtgtatccttggagcgtcttagccatccattttttattttccatatgaattgaactttttgcattggtgttcatcatgggctctgaagatttctgccgtgtttttagcattataaaagtgaaatggacatgatcggaatactgcagccttatctttctttttgttctgtgatgaagtctgcagctacaacgatgtaatatcagaatatatagatcttcagatattagtgtatctttatatgattgacccctgacaaagatggcacctgaatgcatggcgtgcttttctccctgtttcaaacagatttttgcgttctaaaaaaaagatttttgcatcaattattgaggcaaattgtttactcgattagcacgataaaatataagtaaactttacatctggcttacaataagtggtaaattaataatgcagtagatgatattgatttttagaaatcgtatttttaaaagcgtggagcaagtaatctatggcaaaaatctgaaaatgataaaagctaaaaggaagagggcaatatatacgatgtctgaactctgaagggttcattattagaaggatcatgttcatggtcctggagtcctggactcttgtactaccagtgatgaatagaaaggttgacaatgatctcctgtatttcctctgttgtcaacactctattgtattattagactcttgattggcataaacggcgatatttcaaggttagctgcaatgcgttcatactataaatagtggcttgctattggcattcattacgcgtgtgcaacactcaaattattggtcttgtattcatgcagacaataatctgtctggtactatacaggaattgggatgttttcgttgattgaacaccgaaatcttatctacaataaaacacggcttcgcattcttaataatatttatctcactactaaaaatccccatgttccctaccgtttaatattttcctactagtgtgtgtggagacaaggaaaataaaaatacccatatcgtaccattctaggaacatagggaaattttttgtttcatacagttttacagtattaagagggaacaaacaactgaaacgttcaccatgctggccggtcatgtttccctgcgatatgattaaaaacaaggtgattccccgcgctttaatgcgagaattactaagtaattattaatttttttgacagcaagttaggagtaaaaagaaaaaaataataatgaaacatcagggtttatcaatcaaataataccatgcttcaatgtgaaacatattgataagtatatgttaaatattgtaaaagtgatagatagatttgttaaaatatcgtgcaaatgatacgaggggtgatgattcaaggtttcaaacatgctgaacatgctgctacccagtcaagtgaaatgtccatgcatgtttggttttcaccttaatattgctatgttgtaggaagcaaacttatttagcaaactgtaagtttttattatactatgcaacaggtaggaaataataagaatacctggtgatcagagatcttgacaggcaccaggaagaagtcattgtccacctccatagcatcctttcccccagccaccacctctttccgcatcttggacaggcggggatcgtctttgtccctaatcttcgtctgcagcacaccatccttgaatagcttcacacaaagtagcgaaagagagagataatgccagaatagattgctagtgttgcccagcagaaaaaggaaagtctgtaaattcattctcacctaagatgaacaacagaggtctgcccccaattctgtgtgtctgcaaaaatcaaccaagaaacaatgaggataatgagcagcacaaccgaattagccaaggaggaagatttcctcttgttggctaaacgaaagaaaaaaaagggcaccaattaacctgcagcagtagagtgggcgagcttccaagagagaggaaccgatgatagcagcacgagcaacagaagcaaaggtgctgctgcccttgtccgtggccgccgtcgtcgtcactaccgccgccctcgaccgctgccaccgccctcatccgtgtccgccgccgccaccgtcgagtacagccgcctcgtcctcgtccactgccgccctcgaccgctgccgcctccctcttccgcgtccgccgcagccgccctcgtccgcgtccaattccgccgcgctcgtccccgaccgccgccaccgtcgctgtcaccatcgacagagtctgtcaccgccgtagtcgctgttgctgggggaggcgatacggtacaggaggcgatgcggtggggagcgaagggaccgagggcatgctccaaaacgcaatgaggaccactgagatgtaatccaacggtcgataattaaatgatgacgtggcttcaccaaatctcagctttgggtcttaactttatgaaagaagggattatatgggactaactctaaagaatttagctccagaaaaatttgcctgtcctcattttctttaaaaaaaattgcctgtccctgctagttttatagtttccctccagtccatacatctctgtcccacctcgtccacatagaaaagccctagccgcctccaccaaaatatttcccttcttcggtgaaatcagcggccatgctctagtgtcatgccattatctaaggtcattcttgcttcccgcaactctcctgcatcgaatccctaaactttccacccaaaaaacacgctttgtggccctaaatcctctattcgtcatcccccattacctttccatccattaaatgcgcatgaccaccttttaaaaaactgacaccttttaaaaactgagcagtgagcttatgagcggataaggggaggagagtgcgcggtgacaagcggataagaccgagagtctctctctctctctctcggcctcccctccgccagattcggtgggaggagaggcatcgatgatggtggtggcaggctccggatctcacgggcggtgggctccagatctcacgggcaagggcgtccatgggcgacggcggcctctccgtccgtctcccctcccctggcctgccttggcctctcctctccatccggccagcaacggtggccaacggtgtcctgctacttccggctccaatgagcacccatgtcgacttgaatcctctttctctctccatccatctcttcagccttcggtgagcaccaccatttctctttgccttaaccctatcttcatttctagatctagagcaagcttttctccggtggatgcagccaacagcgactttttatgatgcttgattctatgatgtgaacttatcgatgaacatttgatcgtgtgatccatgaacttgttgattgtctgatgtgtacttttatatatatatatttggatttatttttggtgactttgaagcactagcttagctcaaattgagctaagctggagtttttttttttttgcaaatcgtatacctctaatagacttcgtggtgtcagttgggaaatccggcacctatgaaagtttcccaaccaacaccaatagccttttctataatagtgatatagggtatgttcagcagtcagtcacatgctaccacaaccactttggttgaacctttctaaggtttggtggttaaaatctttgctacggcttaggagctgtttggatggggggattgatttttagcctctgtcacatcggatgtttggacactaattagaagtattaaacgtaaactaatgacaaaacccattccataaccctggactaattcgcgaaatgaatctattaagcctaattaatccatgattagcctatgtgatgctacagtaaacatgtgctaattatagattaattaggcttaaaaactttgtctcgcgaattagctctcatttatacaattagttttgtaagtagtctatgtttaatacttcatattaatgtccaaacatccgatgtgacagagactatacaaagttagtaactgaattcaaacactaccttagtaacgggatccaaacaccaccttagtaagcttaagagagaatcgtgtcatatttttcttaatcacttacacccgagccctagttttttagaagtactaatcttgctacaactgtctaaatagttgatcaaatttatctaatctatgataagttatggccgacaactaaacggggcttataatatcttccgttatatttgaagaaaacacgacccagttagctcagtactaatacttatgtgcaaacagtacgttacacagtacaatgtcggtcttttgtagtactacctccgtttcaatataaatataaatatagttgtggttttccatatctaacgtttgaccatcattcttatttaaaaattttatgattttttttaaaaatagttacacataaaatattattcatgttttatcatataataataataaaaatactaattatatttttttaaataaggcagatagttaaatgttggacatgaaaactcacacttgtactgatgtagatagtaattagggtgtgtttagttcacgctaaaattagaagtttgattgaaattataacgatgtgatggaaaggttggaagtttgtgtgtaggaaagttttgatgtgatggaaaagttagaaatttgaagaaaaagttaggaagtaaaccagaacttaatttttttgtctatgaaaaagagggagagggaggtacgtacgagctagaaactgcagagtgtgaatgcattcccaatcaatcagtcactgtaatctcaaacaccatggacagatatgatatggagtagataggagtgaaaagggtcggaaacgatcggaattgatatcatctctttaaaaacggtgctcgatcagccaataattgaccatatttatcatttaaactactcagtatcgatattaatacgatgcagaaaaaattatgaaaaaaatttaaaatagcaaaaaaacgatacggtcggaaacggtaccctttatacggaaacgacactcggttgatcgggaatttccgtgaccatcttcacccctatgagtagatatgtgatcaatcctgcagtctgcgctgcgttgtttggttacatgttttccgaactactgaacggtaatattttttctaaaaacctttatatataaaagtcgctttaaaaaccatacaaatctatttattttaaatttaaaataaataatactcaactaattatatattaatagctcatctcgttttacatatcttcccaatttacttcttttctcttctctcgaactcccagctagctcaaaagcaaaccccagaaaaatccaccggctgccacaagcagccaccgtcagaccatcacatatacacatcgccattagcagtcgagctgtcgaggtcagggagccggctaatttagcccatgcatgatagctccaattcctccatcctataaaataatttcgtatcttttacctctaccattcttttcaaaatgacatcacttctttcactttatttatatctaatccataaattaattagttttattttgttgatatttcttatccacttagaacaagttttatagtaaagatgatgatcacctctaatttatcttcatattacttgccttagatatacacccgtgctaatataccataataatatattttactatattactatattagtttctttctctcctccccgtagaagtttgtgtagagattgcttctttcatgacatgagaggtggtttctcctctctctcctttgttttccttttccatctcatcatgtgatcctattatcctacaaatacgagcgtttggatgtccgtagtacttgctctcataaatatataatattattttttcttttaaggagagacactttggtagtatatttttacttcatatcaatttgtgttatgatgataaaagatgaagttatttttggaacgcatgtagtactatagctggtgcatgaggctgcggtgcagtgccaccagcagctagagatgaattgatcggctgcacaagaggagggcggctaaggcctctcagagcgcaagcaccggttgccggatcctagcccaaaaattgtcccaaagacactcctccccacagtacaagaatcctattctgtgtagcttaattgaatgaaggtactatggaaggaaactgagcccacagtgggcggaaccccaagcgcatggacacgggtagtgcggaacaaatttattcctcacttaccctcgagcggtccgtccgctgacttatctacttttcctcatcctcctcttcttctgcctcacttctcgaatgcggccgccgctcctgatcctcccctccgccgccgagccatcacagcggcggcggtggcggcgaggtggaagcgcgacgctggcctcgtgcagcggcggaggaggaggggaaaggctcgagcggggcacgcctccaccgcggcgaccttgccgaggggggcctcgagcagcgccgccggaccccggggagtggcggagccgcacggcacaggccgccgccgcgaggaggaggagcagaagcaggagccgccgtttttttcttgcactgtctagatctgttggttcggggtgatttgagttgacttgagttgatttcagcggtttggtccgcatctgtggtggtttggggtggaattcgctgtgcgtttgggttgatttcatcagttcagcgatgattccgttggagggcgatttggggttttctgcaggcttgttcggcgcgagggcacgggaccatatatgaatattcagtatgagcttctgctagctgcctccacgcgctccaaggaactgatgaatctccattctccaaataatcctccggctgcttgcccatgcaaacggcataggatataggatattgatagtcatagctagggatcacatgcaggggtatccttttttaaaaaaaatttaactttattaactttagaagcatagtaactatgttaccctgatacggagatacggatacggatacgcgttacggggatacgaggatacgtcacttttaaaaaaacaccgatacggggatacgtctatatatacttattaattaaaaaaattactaaatccctgtaaaaaaacaataacactttcttgtagctaaagagattagcctgaaataatgaactttctgattggattatattatctccaccaaagcccagataacagaggaccaagaataatgtataaattagtgtaagactgtaagcagtgccaaaataaaaacaagttgatgttttttccttgctggtggtccagtcagccttgatgaaactccagccgaactaggcactaggaacgatagatgcagtactctgaacttgcaaatccaaaacccatcagacatatgaaacaagatgcattagttcttagaaaaaaataaggggggaagaacgtacacaaaacagatccatcaacggttccttcagtgggaacgaaggacccatattgctcagtgcggtggctctgtgcccggcgatggcggccatcggcggcgctgcgccccggcagtgaaggtggtacacgtctggcacggcggtggtccgttcgacttatggccgccgcggctctccttttgccgtcgttggcggcagcggctttgcggaggcggcgcagccgcgcgcccacgcgtagatgcggcgattgacagtactccctccgtttcagattgtaagactttctagcatttctcatattcatttaaaagttaatgaatctagatacatatatatgcctagattcattaacatctatatgaatgtcggtaatgctagaaagtcttacattgtgaaacggaggaagtatttgttagggttgggacttgggactatccaggatgcgcagagccgtatccaagaagtatccgaattatctttatttatttgaaaatcagaaaaattgaggatacgtatgggatatgtatcggagcgtatccgatggagtatccgatacggatacgctgactgttagccgtatcagtgcttcgtagcatagtacatcaaccaatgatacattctccataagaggagaggattccaaagcttccttaggcctttaagggtgctccaccctggaccggtgctatggggcgccatggaggattttgttcgacatggaacgagcgcccgtgaccaagttaggctcctcacgtccatccatactgagcgacgtagaaccttgtttgctcgagtctacgcgcggccaaaaaaacgaaaggagcctgcgctgtgggcttcggttcttcgccacaccgtgacctcgcgccgcatccagtgaagaaattcccgattcgcccacgaaaaaccccatcccgcccagcgatttcccctcccaccacatccatttttcctcccaccatcgagtcaagaaaaggcaagaaaatcgaagaaccgaagataagagcatgacaagcaagtatagataggagtaggatccctctgggtcttaaaacaccacaggaacaaacatcacaagaactgaatataagaacataacaagcaaagataaaaacaggagagcagttcttgatttttctcatcaagaactggagaacagaacatgcaaagatattaagaacaatgattcgcttcttgatttcttgacagagctgaccgcggcggcgccggcagggtcaggattggcggtgggcagcggtgaggctggtggtggtggccgaccgccggatctactcccccacctcctactcctcctccacctcaccgccaccgcgtgcagtgggtggcgacgccttcttgctccctcctccccgcggcgtgagaggcgagtaggcacggcggaccgggaggaggagcggcggcgcgggcggtgatggcggacgccgccgcggtagccgggacacctcccgccgccaagaactggtggccgcttgcgcgaccaacaagaaccgccggccctccacctcgccgcccgccggatctactcccccaccacctcctcctcctcctccccctcgcccttgctggttggcgaggcggcgcgatcgacgggagacgaggcggcgtggccgaccaggacgaggcggcacggcctaccgggacgaggcggcgccgttgacgggagaagaggcggcggggttgacggcgaggcgaggctgccggagtggagcgccggtggacgaggaggagaagcggcgggtgcagcggattgggaggaggcgaagggctgggagaggagtcgctggaagggtaggttaggaaaattaattcgttccgctccctgtgaccacgcgactcgggtaacgcccactgtgggctgggtttctttccatagtaccttcatcctatttagccacacatatatgggtgcttgcactgtggggtagatgtctttgagctataactttgggctaggggtatgggccccatagcttgcactgctattgcccttagtgtgtgttcgtcacccccttttcccaacccatctccctcgtttttcacgtgcacgcttttcaaactgctaaacagtgtgttttttgcaaaaagtttctatacgaaagttgcttaaaaaaaatcaaattaatccatttttttaaaaaaatagctaatacttaattaatcacgcgctaatggaccactccgttttccatgcgtactactccgattgggaaccgggaatggcgaacacagccttagtagttagtagggcagctggaatgagaacataagcccttgtttagttcccaactttttcttcaaacttctaactttttcatcacatcaaaactttcctacacacataaacttccaacatttttctttaaacttccaattttagtcaaaattccaattttggtgtggaactaaacacaccctaagtgggaaatgttctgacaaactatttgattttgtgtttgaccaatttttcccctagcttgcttggcaaggaagttgcaggggtatcctcaaagatatatatggatatgaggacgtacgtacggtatggctaagatatatctgatcgaatattgatttcggtatcagtcttcggtctggtcatcaaatacttagttatagtataaaatagtcgagatcaatcaattcaatctcaatcgtcataaaccaattgtatgctacgcaaatggtaagtctgttggtcaatgtcctcctaaagtcctggccctcgacctcagcctcacgttgagatatctaaatcaaccaaatgtattgtcattgtgcgctggatttagatcaaaggactagattagagtataggcataggcgcttgcaatgaatttacagttgtagttgccgtcaagtctctagggcttacttaaattgatgttcttcaacatttacttattgagtttattgggccaattttcagccaatatggttaaccgaaggtggtggtcgaattgaccaaaaaattaaatttagtcatttagcagttgatctcttacctagagaagacatattaattcgtgagattatgagagaattggactcgaaaaccaaacaacaaatggggactaaaaatgtaactcccataaccaattccaccatcaacttcctccttcaaactcccattcctcttcccttctcttgccaaacatgccattaatattatgggacaggagtagtcggtgaggctgtgttctttctcatgggttcccaacccatctcccttgttttctgtatgcacgtttgtcaaaccgctaaacgatacacgctttgcaaaaagttgatataggaaagttacctatttttcaagttctttatagataatacttaattaatcacgtattaatgtatcgctccgttttccatgcggaggagagggttcccaacccctccaaaagaacacagcctttagggtcctttcagcaaaatctcattttcatttcacaatgtgactactaagcacaaattccaaaaaaatcagggtcctttcagcaaaacctccacattgaatgagctcctaaaaaaccccctccccattctgtatataagatcatcacacctttctcgttagggtttccgccgcccgccgccgcatcgccgctgcagcctccttcccccttcgccgccgtacaccctccagccagccatggcggagcaggtaagcgcccgcgccacccaccccgcgtgatctctctctccgtcgatgcgctgtttctcgcatcccctcccattcctctcgtttaggatttaggaccagttattaattggcgcgtctagggtgttcgagccatctactggtctgatctgatctgatccagtgtagtgtgatgaccgatgcgaagtttgaatcttacggtagtgaggctttgatctgtgggcatctcctgaggatataattaggaaatggcggcatattttcgttgaatttttttaaagattctgtttaagaatccacgatgtactatggttttgcgatggggatgtgaattcagagctcgcaagctgagacacaaatgctttgtacattttgagactcgatgacattaatgtagtttgggttgtcgcattggcgctccccaagactccacctgtttatttatttcaacccaaggttcattggttatctctgtatactgtgattttcattgacaaaaaatcgatgatgtgtttgggggtgggaatgatggttagattgggttcagatatgtgaaggaagctgtatagtgtatagtacaaagtaaagttgcataaagggtaaaggaaatgtcttctctattaagtaaaaactaactagagttgtcatgatggctagatgcttataaaatgttttatttgggtgatgctcaattgtttgtgttctgataaaacctttgtcatgtttcaccatagcagagttatgttgcatttaccgtggtacatgtcgatgtcgtgcttacaatttgttgactattctattgcacactttagaatgtagtcattatacggtgccagtagttttgacgtatgtcattctttgtattgttcagactgagagagctttcctgaagcagcccaaggtcttcctttggtgagggttctgcttctacctgtaatttttgcggttcattaaatacatcatttgtatctaataattaggtgcttgatttcagcccaaagaaatctggcaaagggaagaagcctggcaagggaggtaaccgcttctggaagaatattggccttggcttcaagacaccccgggaagcaattgaaggtaataaataaattcttccctgtaactatgcaaatcatgcaccctgtaatttggcatataatttagtttctgaagtgtgcactgccatttctttatactttggtattctttcttttacatcctacatcatgaactacatttgccctatgtcgaaacaggttatctctttgtgaatacctagataagtaattggttccaacatagtcttgatggtattacattccctgctcaaagtaatttaacttggcagtgattctttttagataaaagtttttagttatcaaatttattcctcagttttttttagtgatcagtgatttcttagtgataccatttcttttaaaaaagagcttgatgaaagcaaacattgttccttggttccttaccagataccaatttgtatgcgctgttcgttgggctacaggaagaaaaatgcttaccttgaatttttctttttgctacagttggtatttattttgcaatgcatgtaacaattgttctgttgatgatatacttaggaatacctagggaaacttgctactttcatcataatgtaatcaaattgttaactaattctgtttcagggacctacatcgataagaaatgcccattcactggaactgtttctatcagaggtagaattattgctggaacatgccacagtgccaagatgaataggacaatcatcgtacgcagaaactacctccattttgtgaagaaatatcagcggtaagtaaagcaatggaggactatgaacttacatttcttatctgtgatggcatcttatttagaaggtgaacttgttcatcttgtagatatgaaaagaggcactccaacattccagctcacatttctccatgcttccgtgttaaggaaggtgaccatgtcatcattggccagtgcaggtaatgttctctagctgatgctgtacttagtacatgttttctgttttgttctgcatacctgaatattgggattacatgacttgaaagttccactgaattatctgttttctttaaaatgttcttgaaaattaagaaactaatttatattttcatctgctctgtcattcctcttgtattacattgttgatgccataactcagaaccaagcatcatattgttttggatgaggctgttctattgtcttaaccaggttaaggtcctgtttggcacagctccagctccagctccacccctcctggagcttgagctcagccaaatagtttcagctccaccaaaactgggagtggagttgggtggagctctctcacaaaatatactagagttgtggagctgggtttaggtagctccacaactccactccagactcaactcctggagcaatatttagaagttggagctgtaccaaacaggccctaaattgcaaaaatgtttagttcatgtgattattatttttttgttctgtcatgaaatttattctggttatgaacaaaaatgcatttccagcccctgagtttatatttacttctgaattttctttgccctgtgtgtggttgtgcaggcctttatcaaaaactgtgaggttcaacgttattaaagtcatcccagctggttccacaggtggtgggaagaaagcattcattgcagcttgagcttatcgaaaatgcctaatcaatcactagttaaatatacaagtgttcacttagaattcttctagcttgctgttttgaccttctgtctaggtccctggagcatttgccactcatctgaaatgtatccgtgcaagttttgtttagatctctggtcatgcaaattgtggttgctgttgccctgtcgttgggccatgttccttctttgaagcaatagcatcaacagcctgtttgtttcagtcttatgatggtgatgtgcgttatcgttgttttttttaagctggaaattgttcaccatgtcactgacatttcaaaagatgtctatttcacatgaactaaaagatcttgtgatgtttgctattgtgaaattgttgctgcctgataagatcatctctaagattctgacggtgacttgataatttttgcacgcattaaataaacatcttagcctcctagtagctgttgtagttgtaggctgcgtctcaagcttgaagaaaggagatcggttgtttgcaaggcatgcaatttaagcttcttcttaaagtgcatttcagcatgttaaaaccccaaatccatcccagattctccaagaaatagtgaatcaattcagtcatacaaatgagcaccaaatttatcgttcctctctcttgctgcatatctgcacttgtgctgctctcatcacatctccatagtccagccatttcttcattccttggaatccttcttgatcttgcagcaccttcccttccattctatctgctaacatctggcactacaaattctactggaaatcatcggtatcgcgacgaatataatccgttatgcgatgatttcccaccggaatttccaccgccagataccgcggcaatttcaatcttctgtgtcgatcccaatggctgctgcaacttcacaacggtgcaggcagcggtcaatgctgttccaagcttcagcaagaagaggaatgttgtatggatcaacaagggaatctactagtaagcatcagtgtttcttaccttcttcagatttgtagtgctctttccaaagtgcactgttggctgttgcgaagtgtgctgttaccgaagctgaattgttgcagtgagaaggtgacagtcccagcaaccaagcccaacatcacatttcagggccagggattcgatctgacggcaatttcttggaacgacactgccaactcatcgcatggaacgttctacagcggttcagtgtccgttttcgcaacaggctttgttgcgaaaaacatcagcttcattgtaaacacagagtacacagcaatttcagcttaagtcacagactgcaccttaggtagcaatccttgctaactctgaattatttgaaaccagaatgtggcaccaatcccaagacccggtgatgtcggtgctcaggcggtagcactgaggatcggcggtgaccaggcagcattctggggttgcggcttctttggtgcgcaagatacgcttcacgatgatcgtggccggcattacttcaaggaatgcttcatccagggttccattgactttatctttggagatgccaggtcactctatgaagtgagtaaaaccataatccaaagattggaagacaacaaaaatacactttgtcactgactgcttccacctgtgcacttcccagaattgcagggtgatttccatagcagatcctgttcctgcaggggtgagaaccatcacaggttcagtcactgcgcatgcccgggaatctgtagacgacaacactggctactcttttgtcaattgcagcattggcggcaccggcaggatatggctggggagagcatggagaccatattccacagtcgtcttcgcctacacttcaatgtcagacatcattgcctctgaaggatggaatgattggaatgatccttcaagagaccagtatgcatcctctctctattcagtgtcaattgttacctgcatgacaaaaaggtaaattagcattaatatttgtaatgtttgaattgtcaggactgtgttctatggagagtacaggtgcacgggtgatggtgcaaacttatcagatagagtgccatatgctcagaagcttagtgatgtgcaggttttgccttacctgaacacttcttttattgacggagacagatggctaaagccatactgtgattcactgatatctgcttgaagcaaccaaacataggcattaattgtattgcaaacttgaaaaaggaaaatgtgtactccattctttgttttctttttcttctcactttagagcacgttgaattaacaattgtgcatagaccagtcttacagagatgtattattttttacagaagatttagccattgtttgatcatctacatttgagcagcacaaaaatggtacatggaaagggagccaactccaattgttgaattacaattactggcattacaacaagctgactaatatcaacattctaactgcaagagctcaagtccaactatctcatctcatgtcccaatgaaaattgagggatcctgccattctcttcttgagacagatgctttttagctgggtctgagactgttgctttcgacagacactattcctaaaatgaaatctcactcggtgcatggaatgtccgtccacggcatatggcttccaggttctctcccgcataagagctaagtggagaaacttcaacacctgaagtacaagtaaagttatgcgataatcaattcacaaatttccatctaaaaaaatttcagctagtgacggtcttcaaaagtttctagatatacatacaaaacgttacctgtcatatacaagggcacggaatgagtcaaaaagccacctgcagctaccacccatcggctgtgaaggcggagcagcattaatctggcactatcaggagtatcataagttgcaccattagcattctttactggtgcaaattcctcctccctcaaaatctgaaacattaggtgccaacaataccaatgagatctttccaataaatgtttgctttcagtaattaaatagaactagtaatagtgaatttgaagtcaaacctcaaaaagagctgttgatggagaataggtgaacacgtcaaatataaactgttcaagctttaagcctgccgtgtacccatggattgaaggaatcttcttctctgctaaatggtaactgggcacaggattttaaaattaagcacaaaatatggaaagagtaagttgacactgaagtggtattgctgtataatatccaacaatcacattgcaggaagaagaaaaattaaaaaaaaaagaggttgtataacgaaaaactagtcacaagtgatttattatattaattgatataataatgtctgttctattattaaaacaaggttaaaagaagcctcttaattcactctcaagggctagaaattaccacataaattagtaaaagagacaattatcaggtcgattgtggtggtacagattataactgtgttgatcgatctgaaagagttatataagaatattttatatttaccactaggcaaaacagttatatgcaaaataaaacttctaaaataaaaatgcattgaaatacagccacacaattgtccttttctttaaagtttagtaagttagctatatagtactaaataagtaataaaataattgggcgaagtcatttacaagaagttttctattattcgagcctacaataagaacatagctctaaatactatggcaattacctatgcttaaaccacaacttttgatacggaaataaatgttggaacgaaatgaaacatcatgaatcataatgctcaagaacaaaatagttcttcagtaacaatacttacatgctgtccttttcaagactatttgttacttgattaagaaaatccaaagtaaacatatgcaggcatacctgacagaaagatagtaaaatgattatcaacacttataaaggatggacagtggaggggaaagggaataagaagagacatacattgctccaacaataacgaaggcgccctgtgccttgatttatttcagtagtcatagctgcatccatttcactgtactcaactacagaaagaggcccacccctgccacgctgaacaaacactccaactttctcctgtggatatgcctttaacagcaaagcataataatgaaaaacaaaaatgaggtgcataattgaagttgaagaatacttctcattctgctagggattggataatgcactggcataccttccttacgacctttgcagcagcagacacgcccttgtcaatgaaatatcctaggaatgttggatcagcaacacggacctgtatcaaagagattgattattctggtaaaaaaggagatcaattaaacagatggggagagagaggccccattacaatatatatttttttaaaaaaaaagtgtactcaccaatacattgtcaactccatagcaatctacatatttcacacctcttccagccatatcgtccagcaacctttgagattttagagctgtggcacagtaaaaagaggaaataaacaacataattgtggctaacatcgataatatataattgttgtattctgatacaaggaattaccagcatacactccaccattgccatcaggagcccttgctacctagttttcaacagaatgttgcaaaagatgtcattaaccccagaaggcaagcaccattcaagcaagtttattatcacaatacttgtattttgattagatagtccaatgctggttcacttgcaacggaatgatggaagaatgggagatgaaataaaaaaatataaataaagcaaggtaaaaaccttgtatggtgtttccataataaaccttccatcagctgagacacatgggatagtaccttgctggaaaaatgttacctacgaataaagaatcaagtcaaacataattcttagaagtttcatagggcaataggaggtcacatgttgaacttcactggaatttccgttcataataaagaataaagtagtgatccttacttggtcaggctctaagccaaaatatctgtggctttcaaaaaattttcgagtcgcttcatcagtaaaggggctagtcattatataccagtgtatttgtggagtacctggggttgcacaaagttaacatgttgaacatgtgattttttaagaaagagtaaagaaaccattaatggcatgcttgactaaattaccatcagtggactgagcagccagcttctgtatgcacaaaattcgttcagcttgaagttggaaaagtgactttccagatggaagcccgatgcctgagcagaaatcagaggaaaagaacaccatgaatcttaagatcactgaagactgaaagcagactaaaacgtaggatattactccaaaaatactctataatcatcaacacaacagaatgaaaaacaattgcagtatagaataccagcaaaggtttttctcatgagtaaaaaagtttatttttatattgaccataggacaataaggagaacatggaaaagttaacactgaaacttcctgttgaaatatacaatgagaaaataattctaaaaaatagtagggtaccaaaaagagcatttatctgtagttaaaaataaataacattaatggcacagtggaagtagcatgcaacaagataaagtatgacaacttactgaagcatcccttaggatcagaactgccaagccttgttccctgtccgaaattggagagaaagaggatatgtgagatttcatttcctgctatgcgattcatagatcttttccaatcatacttttcaggagttttgagagtacctgaccaccagccaaaaggacaacagccaatttcccctctgaaatggctttcaagcccctcttccaccacctctgcttgtcctcaggagttctatcttcgacggtcgagacactcgactccggcacaggctcgacggctggcaaaggaacacctgtgctcccgagcaccatcacatgatcagaattcagaaaattgcacacgttacatgggaaaatgcctatggatggatgatctcacaccttgtgatctgagcgagcatcggacgatccggtcaatcctagcaagatctaggctctgaaatgcagttcacgaagttgagtaagccaaggtcaatatctcacgatacacaaaaatgcattgctgtcaattcaccttgtgcatgagatcacaattaagctcaatgtacaaaggcagcaacagtgggctgtgtacatccattgtggatgtagaggccggattttaatccattttctaaaaaaaaaaaacaaaggcagcaacagatgatgaactacgaatacatacaaggatcaagctaaagctaaccagtaactatttcaactaggaatttctccatctccatgagatcagctgcgcatctgaattgcgccacaatcgcaacgcaaaaaaaaacaaaaaagaaatctttaccaaacattcgatcaacaaacagactagtgtccactcaaaacggaatctttacgcagaagtctcaactgagcaaccgaatctaaaactctaaaaaagaaaacatcaaaacgcgaggagaagcagcagcagcagcagcaggagcaagggatctcgacctcgatgtcccggacgaggaagtcgcgctcctcgggggcgagctcgtcccagagcgcgaaggcgccctcctggccgtagtccttgagcctctcgaccagctcctgcggcggcgcggcgccccacctccccgccggcgccggcgcccgcggcgccaccacgatctccgccatctcctcctcgagcgagagctagagcgagagcgagagagatctgcgagcgatggcggatgggcggagactatgatgagatgagagtatgatccaatcttggggagattattagtaggagagaggctgctgctgctgattgggtcgtcattagcgtttgtgcgtgcgtgtcagcgtgagatgaggagaggagccccacatggcaatattagggcctgctcactttgataccaaaaaaaacttactaagttttgtcattattaaaattttagcaagttgccaaaaatttacatagttgtttggcaacttgccaaaattttggtaggatttcttatatagttaccaaaatttgacagcaaactaaatgtaatcactttttggcaactttaccaaaatttggtaaggttgaaaatggcatcaaatcgaacagacccttatttctcagttattattatttttttattaaacacagtacaaacgcaggagctcacaacgcgcaccccatccataaatgactgggccggcatatcttgagattgacgaagtcactaataattagccctttgagagcaagtttaatagtatagccaactagtaactctaaatcacttatagtcaacttaatagtcaattcatacaatggttacttataaactgggcatttgtaaatttgccaccagtttttttaaatattgaaggatgtcgaataacagttctagtggtatttttgtaattttctagtggtaattttgcaataacgattcaaagtagtggtaaatttgcaattgcccttgtaaacatatattgcactattaatacatggtcccaccttttatacacatattgtgtctaggaatccgtgctgcagttggttataaattgtagtccattgttcttctctctcctcgatatgtgtttatagatgggttatagtctactattgtacctgcactgagcatatttggaagactgggctggtatatcttgatatttacgaagtcaccaataattggctcaaaatatgagcatcagtatcaaatttaggatttgaacccggatggactgattctactagtgcaacctacccctagaagactgtcggcatatcttaagattgatgaaattacactaattagtcaaaaaatacgagcattcgtgtcaaatttaggatttgaacccggtggattggttcaacaacaaaaaaacttaattagctgaaaatacaagcatccgtgtcaaatctaaaatttgaatccgggtggactggttcaaccacaagaaatttaaccagctcatgtggtggactagttcaaccacccgtgtcaaatcaaccacgaggaacttaattagggtgtgtttagttcctgaaaaaagttgaaagtttgaagaaagttgggagtttggaaaaaaagttggaagtttatatgtgtaggaaaatttttgatgtgatatgatgtgatggaaagttgggaatagggggaaactaaacacggccttagttgagctatgcttacttcgtcaattatttaatactctctccatttcatgttataagacgttctagcatcgcctatattcatatagatgttaatgaatctaggcacacatatatgtctagattcattaatatatatataaatgtgggcaatgttagaaagtcttataagactgtgtttaaatccagaggtgtaaagttttggcatatcacatcaaatatatggacacacatttgaagtattaaatgtagtctaataacaaaacaaattacagaatccgtctgtaaaccgcgagatgaatttattaagcctaattaatccgtcattagcaaatatttactgtaacaccacattgtcaaatcatgtcgcaattaggcttaaaagatttgtctcgcaatttacacacaatttgtgtaattagttattttttcgtctatatttaatactctattcatgtatccaaatgttcgatgtaacaggatgtaaaattttgccaggatataaacagggcctaatatgaaatggaggaagtatttagggcctgttttgttcaagaaaattttccccaaaaacatcacattaaatgtttagacatatgcatgaaacatcaaatgtggacaaaaaagaaaaactaattgcacagaccgactgtaaatcgcgagacgaatcttttgagcctaattagtcaatgattagccataagtgctacggtaacccacatgtgctaatgacggattgattaggctcaaaagattcgtctcgtggtttccaggcgagttatgaagttaattttctcattcgtatctgaaaaccccttccgacatctggtcaaacgtccgatgtgacacccaaaaaaattttttccccaactatacaggcccttattatccctgattctacttgtgcagtcagtagtgattctactagtgtcagtgtttcatctgaaaaaatgtcactgctttctcagagcaggtacaatagcagggtgtaagctagctataaccatattttaaagagataaaggaagagagaagagcagcgggctacagatctgtagccagctacagcacagacttcaagatataacgtgtgtatgacagatgtgaccaaatattaatagtatagtaagcaactattgtatgaattggttattacattagctatagatgatttagagctagcagtggactatactattaaacttgctcagtgcaggcagtagtgtcagtgttcctctgaaaaatatgtcagtggcttctttcttttcactggttagtgtcagtgtttactgtttactggtggtggtttcgtttcatgttgcaaatgcagtgtttgacttggcgaaagttctaggaacttaaaatgaactttcaccagagtggatggtaaacttatcccaaggattaaaatcctactctactcctataaaaatataaagcgtatttgaattgctttctactatttgtatacataaatagtgtgacactaaagtacaataataagaaaatgtttttgaatatgaatctaataacatcaattttacaaaataaaaaaatatgttctatagattaattgctaatgaaagtattgtcctaaagaaataaaatatcttatatttttattcgtagctgtcatttataagtctttaacaatttttttcgtagaagcgtcgcaagattttcaacaaggtagtttcactataactttcagctcagagaaagaggaaaaacaactgagggggcaatcgttatcttttccatctacattagataataataaagaaatatatttagacatacccttcttcaggtatataaccaaaagttgttatattttgataagaggaagtaataaaataactctatactattgcaatcgcaccattaatacataatacaagctgcgaatcagaattgcatcaaagattcagcattgttgcacttgaatgcactggcacttttactatcccatcgaaacacaattcaatacatgttggccttaaaagcaaaattaaagggctcatcatccgcatggaagaatttatctcaaataattaagacactccatgtgatggcacatcagtgagctagctctgacagtatatggtatgaatatcccagcaactgcacgcaaccaaaaaaagacagaaacaacattgatccctctactcgacattctgttcttgaagctatgttaaccctacaaggtaactctagtcggatgtacattttgtctacaagttagagcaagatacaatcatacaacagttttacagcatataccagattagatcatgaattacaacatagttctaacaataagtaccagacttgggctttcctctttagcatcttagcaggtacatcgtagtgctgcacttttttccttctagggaagtcacttgggagggaaccaaccaccattgtatagtttatctgacggattcggtgctgggaggctggcatggtcgacttgtgtaaagtttctagtattgtcaaaagaggaactaaaacaacttggtgaagcagaataatctggtgatggaggtttattcaagtcatgttgagggaagtattgttcaacagctgaagtatcatccagaacaggaatgtcacctctaagggtcttgaaggcaaactcaatgcatggatctgaccaggaattcccaaatagagatggcacagccagcccagacggataggaggctgcttcaggatgtggagctcgcgttggctgagcgggtgctgtggctggcacattttggtattcaacatttaacgcagagctcacaacaggttttccatctgtttgcatggaaaccggtaactcctgatttgcaacatttctccaaaagcttgtggcaggtgcttcttccggctcaggagttaaagagaaaccaacttgcatgatattattttcagcataatttggctgtaagtaatttgcagtattttccccattggcctgtatttgattcacagttaatgcttggatgaaccgtggctgatcagtggtgctatcctgcatagtttgtattttgttgactgtgtcagctcgtctaaactggaactgattggcagtgttatcctgaataacctgtatatgattcacagtatctgcttgccttgactggaagtgattgacaacgttttccctattggcatgtatttgatccacagttaaagcttggatgagatgtggctgatcagcggtgctatcctgcatagtttgtattctgttgactgtgtcagctcgtctcaactggaactgattgacagtgttatcctgattaagctgtatatgattcacagtatctgcttgccttgactggacgtgattggcagtgttttccccattgacctgtatttgattcacagttaaagcttggatgagctgtggctgatcagtggtgctctcctgcatagtttgtattctgttgactgtgtcagcttgtctcaaatggaactgattagcagtgttatcctgattaacctgcatatgatccacaatatctgcttgtcttgactgagactggttggtaatgtattcttgtgtagtctccatttgaaatatggcgtctgcttggctcgacggcaacagatcgacagtgtttcctagatcaatctgtatttgatttgcatggcttacttgtgactctgactgttcagtaatgtattcttgtatagtatgtatttcattgaaagagtctgcttggcttgactgtaaccgactggcagaactttcctgctctgtctgtatttgatccagagaatctgcttggctagactgcaactgacctgacatgttcctttgattagtctctatttgattcacagtggcagcacggctcaactgtgattgtgagtaattggtaacgtattcttgtctaggtcgtatttgaacaaaataatctgtgtggctcgactgtaattgactgacagcattttcctgatctgtgagtatttggttcacagtgtcagcttgtctcagctgtgacgaatctgtagtgtccccctccataacacgtatgtgattcccggtgtctgcttggcttgacagcaactgattgtcagccctttcctgaacagacgtcatttcagtggaaatgcctgcttggttcaatcgtgacttatcagtaggattttctttagtagactgtacctcattgacaagatttacaccgataagttcatcttcaggctcagtatttaaatcatgagtgatcttcagtgaagctaagcgaggtgatgctcggacaggcatggcaaccatttttgcagggacgattttatgcttcttgggcttccctcctgcacttggctgttttctttttctcggaaaagatttcttttcccttggagcatcaactttgtaggcatgtttttgagatgctatcatgccctccaactcgggcatcttttttgggttgttgagttctctatatggactgagctgttcctcccacggcagcatgagaccttctgaagttagcaattcacattgaatggccttgtcggcggtacctggccttgtatgttgcaacaatgttgctgtctgattttcacaaaatgatctaataagtacaaattgttgtgaaaaggggacatacaaaaggaaatttttgccatcttcaaaacacaactttggccacaaatttctatttaaatattttgttagtaatttttaggcagatctgcacacatgatttccatgtatctaaacgacaattattcaagactggagggagtagagtctatagtaaaattgaattcagaaggaatcagagttctttatctgatgtaatagtgcatgaaaactctgattctttacgcacgcaaagaggggcaaccaggacaaggagcagttgacacttcacatgtggctgatgtctgagctacaagaaacatataattactagggctggactctataaattttaaccaaagcaaatatgttcaatttgaggtgtgcatggtaattaagatacctagtatttttgtttatttaatgtcctgatagaagaagcaaaatgccccagtaactcaaaccaagaagaactgcaaggaactcacatgagattggttttcaatagtacaaggatcttggatagttctctttcttggccttacaatgcatttatagatgtcccctgatttaagaaaacggtgcacatccttcagagagcgaaattcatatccactgactggatcaatgtagtactgcagagattaaaacaaggcaaaaataagtttaagacacaacattcctggaatgccctgaaggctttcattattaaaggatcacaagagctagcaatgcaacatgcattataaagtcaacaaggggaacagtgcccgcctaggctgacaaactgatttttcctgcttaggcagtcagtaactcgccttggtggctgttggcgctaggtgctggcctgccatcatacccgcacctagcaccaaaggtaacactgggcacgctaaaatgtaggttcaactgacaggagcacaggatatgctcatataaaaatgttcacgctatgaaatcataattgacatttcaaacaaagacatgcttcaaataatatcacaagtaacaccagcacccacatgtgccacggaagaggatgactaacaaatttggcctccttggaaatgtggcggttcagaacaaatgagcttattgtaaagatggtaagttaacctatggatacgacaaaagggaacttttgcaagaaacacacaggccctatattgcttttaactgcttttcttattgagatggtcgcatacgacagcatacatgcagcacctgtagaatatatttcttgggtggctactctacctcaaaatagaaccaagatgcaagtggaacaatattgctggttgcaattatattaggcatagggtattgttgctgcacaatattgagatgaatatggagagttgaaactcagcttagagttcttgagatattaagtgcaagtatccatagacatgctaatgactttggaccgatgcggtgattgtgctgcagtatggaatctggttctttactgattctagtaagatttagttgtcacggctccaaagaaatgagtgtttcaaacaacaattactcccaccgttcaaaaatatagtgtgtattaggtttcattaggacaaggctttgaccaaaaattactctgttaggatctcatttttgtgataaaaggcataatcataattcataagtacttttgaatacaaatctaataacatcattttttttcatataaattatactccctccagtttgcacatacttgccgtttcggacaagacagatgtcaaacttctaaacattgactatgcccttctaaaatatttacttcaaaaatatggacaccatatatataagattaatcttgaaaattacctcaataaaatcatatattgttgatatttgtacttttgtacatatattgtaatagaaaacagaggtcaaaattgttatttggagaccatgtccatgtgcaaaacaacaagtatttgcaaactggacatgtcaaagccttgtcctaacgaaacctaaacaccttatattttttaaccgagggagtagttcacagttagaatcaaataagcactttgaaccgagccttagatgtattgttttaggcagaaattagcaagaaaaaagtaacacattgcagcataccggatcagtcttcagatttgatccattcttccttggtctgtcctctttccaccatccatcaggaagcccatcaacaattagatcatcctttctttgaacctagcaatgaaataattagagctagttagatatatctttttcagataaggagtaagagaaaatggatcattacagcataccagctcattcttgtgatttgatacattcttttccgcactgttttctttccattgtccaccgggaagcccattgatgcatgcttcacccttggtttgaacctataatgaaataacaagtatattggtttagacagaaaggcgcaagagaaaaagggtcatgatagcatgttgtttactcggtttagatagaactcagcaagagaaaaaagggtcatgaatcatgacagcataccgggtcactcatgtactttgacccattctttgttagcatgccttctttccaccatccatcaggccccttcatgactggtttatcactattttcaacctaagaataaaataattataatgacaaagtgaagtgttttagatagaaaaggcaagacaaaaacaaggatcgttacagcataccagattactcttgtgatttggttcattctttcctggactgtcctctttcaaacagtcatcagacagcccattcatggcagcttcatccttgacttgaacctagcaacgaatatagagtggtcatcattgacatatatgtcatgttgcacttggaacaaatgaaaaggggtagatgaagttagaaatctgcataccataaagggctttcttctgacaagcccacttcgagttctagagcatgaactgtcactgtaatccatctggatgctttctctgacaagcccacttcttgttcttgaacatgacccctctttggaacccacaatgatgtttcctctaacaaacctgcttggagttgcagaatatgaaccattactggcagccacagtagtgtttcccctaacaagcccacttcgtgttttagaggatgaaccttcactgaaattcataatgtcacctcccctaacaagcccacttcttgttttagaggatgaaccttgatttaaacccacaatgccatctcccctagcaagcccacttcgtgtttagaacatgatccctcattggaatccaaagtggcatttcttctaacaagcccacttcgtgttttagaacataaatctcccacgttggaatccacaacgccatttgccccagcaagctcacttcgtgttgtagaatatgaaccttcattggatctcacattggtgtttcccctaataagcccacttcttgttttagaaagcgaaacctcattggactctacagtgctgtttatcctaacaagcccacttcttgttttagaaaacagaacctcattggactctatagtgttgtttaacctaacaagcccactgcatgttctagaacatgaactgttgctgtaatccataatgtttttcccctgacacttggtgttctagaacatgtgaactcctgtggaggttacttcagttcacaaggacctgttcaatcacaacaaaatataaataaataaaatttcctgaagccacagaagagaacaataaattcattccataaaatcaaaatagtctgatgatgacgatgatgcccgattatttgtcaggcccaatgttttcaatttgtccgactaatcgcgattagtgtcctggccggtactaaggtggcttgattctaaccacgattagttggaaagtcactcgattagttgttattagtcactattagtcatcctagtcagtattgaggcgactagactgtctttccaatttaaacacattgctcagaactaatatttgaaaaaaaaaagctaaagaggtactgttacgaaaatactttgttcattaagatttgcagagattaacgatgatgataatgtttctggattaccactcaagtagagagaaaattagacaagctatatggtgcacaaatcataatttagtacgacagataagtaattgaggtggtcgcatgtcttagccttcataaggacattctttccatctttctgtgcccaaataaggaaaacaggcttccaagaaattgcaaccttctgcagccccacttagccttatctatcaaaaaagggaagccatactattaaagaaacaagttattctcctcgatctcccataaggttagaaatccagtgccactagtcacttaaaactagtagtccgcaattctttttttttcctgatgggcgcataaatccctacctattttccattggttcataggaaaaaactgttcatagcttaagaacgagcctcaactcaaaaaccgtgtggcacaaactattaaaaataacaaaaatatagctagtggcggacataacgtggggatattgggtggtgtggggcaaagaggggaaggcaatcggatccccaatttctctcttttcttttcttgagatgccatggagggttaacactatcacactacggcataagcttgacaaatccgcaatcaggttaaatgattcaccgattcagtggagtagaaagcctctcagcgtgccacaacacaatttcccccaaaataaattcaaacgagctagggataatcaccataagaaaatcacagaaatcaacaacgtccgggtggattcccccaactttacccgcgacgactactccgaggcggtcgagaggatataccttcgaggaggaggagtccgcggaagaagcaggaggaggagcacccgcacaggcacgcccagcggaggaacggatcgaccctccctcgcagcagcagcgggagaggaaaaccctcggaagcaaaccgagcggcagtcaacgaagggacggaccggagagaagcggatgaggaggaggaggaggacggggtgggggggcctcgccgtcgctggccgccgcggctagtggtcggatggtggtgcggccatggctagggttagcgagcgcgcgggggggagcgcgtgcgtggagagggggttgaagagaagaaaaaggagggagaccttttttttttttctttttaggcttagcgaagaagaagacgaggtgggtggtggtgaggtgaggtggtgacttgggtgagtgaagtgaaccagtgaggtggtgtggtggggcgccacgtatgcaacgttgaagtgtatgcaggctcactgttactctgatgaacccacttactgacagtgtgcttaccagaagtttcacaaaccaccggggccgaggttatcgcgctcggccctagcggtaagcatggttaccgtgttaaccatgaaaaactgtatgaaaccgtgcaaaatttatcaaaaattcaaatcattttttaaatttatttgaatttaaggaggttatcgcggtttttctattaccgtacccacgcggtaaggccggtaaccgcatgcttgccgacaataatgtaaaccctggtgcttactggctgacacgccatgtttagtcgtcgtagcaatacttaggcttccttcgcccaagcaaagttcgaaactttctttcctctacgtttactactgcgttcgattgttgctttttaggctgtgttattctcccttttttaaactcacccctcttttttccgcgcgtatgttttttcaaactgctaactaatatgttttatgtaaaagttttctatagaaaatttactttacaaaatcatattaaactatttttaaagctcttttaggctaatacttaattaatcacaagttaataggtaacccgttttccgttcgggaagactaagccatagatgaggtacaatagcatactataaaccagctataaacgcatatcgaggagataaaagaggaaagaagaagagcggtgtgttacagatttgtaactagctgcagcacgggttgcatgaagcaatgtgtgtatgggtgggaccaaatatcaatagtgtagtacccctccgtcccataatataacaaccgtgttcgctagaggctgttcccaactagaacagtgcgcacgaaaaacggaacggtccattagcgcgtgattaattaagtattggcttttttttcaaaaatggataaatgtgattttgttaagcaattttagtatagaaactttttgcaaaaaaaaaacaccgtttagcattttaaaaagcgtgcgcgtggaaaacaagagagatgagttggaaaacctgagataagaacacaacctaagattggatgggatatttcatagtgcaataaatctagacaggaggcatgtctagattcgttgtactataaaacatccaatcatgttctaggttactaaattatggaacggaggaagtatatgtttatagataagtattgtatgtattggctattaaattaattatagatgatttagagctaataattggttgtactattaaacttctcttagaggtcagttttgctgtcacgcgaaacaagatagaccattattagcgtatgattgatcaagtattgattattacgaacttaaaaatggacttgtttaacttttttaaagaacttttatatagacaacttttgtaaaaaacacattgttcagtagtttaggaaacgtgtaaaaaaaacgaggaagttgtagcttagatttggagctttagagcagggaaaaatgatgcactcgttatcttatactccctccgtcctactacaagtataatataatacatacatgacatatatactacgaatttagacaggcaattgccatattcaaattactttgtgttttactctattctaggcggtgctcttttggaggggttcgcaattaagtagtagctacaaaatttttttgaaaaatggattaatatgattttttaaagcaactttccaatataaactttttataaaacatgtaccgtttagtagtttgaaaagtgtacacgcgaaaaacgaggaagatgggttgggaacccatgggaaagaacacagcctaacccaaacacctatatatctcaccattataatttctaaaaacttatatatctctaaccattaatttctaaaattttatatagttttaacatcggtgctccaaggacagtggatgcaccaacggcacctgcctgctagccaccgccggcgctgccggaggcgaggtccctccggcgagccggccggcgatggcaccgccgatgcatgctcaagccacctacatgtacaagatgcttctgtatgtgtagctagcagcctagcacactgggctgacaaataaaaaagatgggtacctgtgctgctgtgcggcttgcaaactcgcatagagaattttagaatgagtacgagacatcctaatcttattatcaccatgaatcttattgcaaaatgtcaagctgatcaaattctgtcacaccagtggcaggcagcctagtacaagccgtcaagagtttttctcaaggtgatcaaacgctggtcgatctgcatgctcttgtgatacagaaagagcgatcgatctgacatgcccatgttttttttcctttttttgcaggaagatcaaggttcatgaggctagctagctcagtgcctgaagtgcctgacgccggtgaagaggagggagacgccgtacttgttgcagcagtcgacggcgtcgccgtccctcatgctgccgctcggctccgcgatcacgccgatgccgttctggcacgcctcctccacggcgtcgttccaagctgtcgttgcattgtaaggaaggcatcaacgaacacgaaaaatgtgattcttacaaaatgtgacaacattgcaaagctgttcttgtagtgtgtgtgacagaacgtgcaaggaagtaatcgttgaacatggtaatggtggttgcaatggtaaaatgtaattcttaaaaagaaaagagaagtatttcatgattcagaacctacggatgctggtggcttggtcataaatcaaacataaattcaactactactgatcagcaaatgaatgtttcagaacctacatatgctggtagcttggtcataaatcaaacataaattgaactactactgatcagcaaatgaattggctcagaacctacagatgctggttgcctgggtcataactcaaacataaatccaactattaatgaagtttgcattatcattttgttttgattgccactatgttaatgttgtgtgcaaacaaattcaggaaattatcagagtccagattttccagtaatgcaacatttgttcttaccgaatgggaagaatgcatcactggccaaagcagctcctttggcctcctctcctgctttcctgaaagcaattctcagactctccagtctgtttggctggccacttcccatgcctaacatgcagttattctgaggataatccacagcatcatgttagtccaccaaatcaacaaattattttgttcatgtagcagaggcaaatatactgaccttggctatcacaatggcgttactctttacgtgctttacacaaagccaggcaaatttggcatcagagagctcactgtcttgaggagctctctcggacactgttgtgaaggtgatatcttcaggggttagatcatcagactcttgagccaaccagccaccactgacttgcctgagtgatagcatcccttttccacttctcttcgcctccagtatcctcaatgtctttgatttccctttgaggatctcaagacccttttctgtatagccgggtgcaacaacaatctcgtagaacattcgcgtctgtccatctgtagggctcctgaattcacggatttcttttgcaagatcctgaaacatgatatagtgtgaataatggtcatgcccaacaacacaagtgtttagaggcaagaagtctactggatacctcatcaattgtcgtattgaaagcaactatcccaccaaatgcactaacaggatctccctttacagccaacctgtatgcttcaagaatatcctgtcgggatgctactccacatggatttgtgtgcttaaccacaacacacgtaggactctcaaactctgatacacagttccatgcagcatccgcatctaagtagttgttgtaagacatttcctgtaacagaaaatgtcatatgtaaacacaagaaacgtcacattactggtacaacatgagttcgcaaagagtggaaatggccagaaacaggttatatgtactgaaaaaaacaaatactaaagtcagataaacatgcaagtagtaaaaatcaagttgaaagagatatttttttgtaagttactatccgtgtttcattttagttgaatgaaaggaggcatgattttctcaccttcccatggtgctgaattgctgttgcaataccaccagcattaactacagaaagactcttgtccccatagaaggcagctttttgatgaggattttcaccataacgaagtgtagatttcagggacaggggcacggtgaagttcggggggaatacatctcctacatgagaacatgatagtgtaatgatatctgaggaaatgttgacaaaaccatcatatataaactagatcattacaaaaagttagtgttaatacctttgttcgattgcttccacaaccattctgagacagctgaatcataagaagcgacatgttggaaagctttccatgctagcatcttgcggaattgctggtcatcttgttttccttgcagatactctaatagagcagggtaatcttcatgatccaccataacaagaacatccttatgattctgtcaggcacaggaacacatcacaattgagcaacaatagaactgttcctatcaatgaacaacaaataccatctgtataaatagatgggaaatccatttacatatgtcaacatgatatcaaatttgtatgaagatatcaatccccaagctaactaaaaagtctcaagaaccaataaatcaccttagctgctgctcggatcatcgtaggtccaccgatatcaatgttttcaatgccatcctcgaaagaaattacaccagaggtgaccttgttatagaatggatacaagttcaccacaaccacatcaaatgtccctgtgcccaaaggaaaaggtcctagttaactgacaatacttcatcacattaactctttacaatgttcgagagaagataagtcagtaacacaaatgaactaacaatctcaccaatgccatgctcattcaatgccttaagatgatgctcctggtctcttcttgcaagaataccaccatgtacactggggtgcaatgttttaactctaccatcaagctgaatttaccaaatgtgaaccattggataaaatgaaatttatttgcagtcagtgcaaacatatctaattaagggacaaaactgagtaaccaacaatgataaacgatgctaggaagcaacatatatttcaagaaatgtaggagtaaaataaaaattaggttataccatttcaggaaaatttgtaatttgttcaacttttgtaacattaactccagctgcttccaggcttgatgctgtgccaccagtcgaaataatagaaaacctacagtagcaaaatgtccataagatgatcatatactagattgaaaaagaatcaacagtagaaatctaatcatggttcatcctttataaaatcatgtttcgttatcctgatccaaattgtcagccttaaaattatgcagctggggaagataaactgcaagaagcttattatggcgaataaagcctaactttacaaaagggcaaatatgataatttactactggtctactgcttgatataggaatttgatatacaacaaatagttccatggtgatgatgagagaagctttaaagcacaaaattcaaatattctaaagtgaacttgacagcaaaaccacaactgttaaatataaaaccgaaaaggggagcatcccacaagatgaaaggtttaccccaaggcttgaaggccattcccaagataggccaagtctgttttatccgacaatgatatcagtgcttgtttgactcctgctgtgttaggaacttattattagctcacacattgaaatatatctttatgtcaagaatgagaaaacacaaaaatcaatgggcgtatagaaatcaacaggagtacagggccaaaattgatttgttcaaaataaatctaatcatggttcaaaataaactataataagaagcttattacagagaataaagcctaactttgccaaacagcaaatgataagttcactgttcgatataggaacttgttattagctcacacattgaaatacatctttgagcatgctgcatgaatctactctttgagagaacatagaaaataatgggaatagaaaaaacaacggcaccaaatttatctgttcaaaacattcaaccaatataaacagcgcaacaaatcaaacatatctacatggatttctggatggaactaaaataaaccagtacaaaaggatctcaacggaacatagtcatcaactagaatatggcgtgcaaagtgctaaattttaaaattcacacgtatgaattttatatcgaatggtattatacaagaatataggcattgaaacaccaaagccaactaactgttgttaagcatgctgcatgcatttaagcatttagaacacacatatttgccccccttaaaaaaattatactccctccgtttcaaaatgttt

SEQ ID NO: 59786 - DNA, 12750 bp, Oryza sativa
cacctaaccacatttattgcggtttggctgagcgtgtcacgccgcatgtaacgcagtgcagtgcactagtttatccagtcagtgaccagtcacagaccggtcagatcgcgggttaggtggcgacaggcgatctgacacacgccttgccccatcccgtcaggacgagggcttctaggcgctcgtccccagctggagctagcgtgttacctcccagagatggcacgttagtcctagtcagatatatgccaggcttcatcctaaccattgcaggcaagatgttgtgtgaagaagggcgaacatgtagattgctaagctgacacgtggtggacaagaatgaccgacgtgactggtctgacaccggtcatgtcgtcagcagacagccacgattccacgtcgcacctgctcccggcgaaagtggaggtagttgtggcccgtctcatcagaaggtgactcggacggcaactatacaaatctcggtccatttatgaaaaggtggggtaagtccccacaaaaaaagagagaaatggtgcatgtggtatccccttaagatataaaaggaggaccttgcccactgagatggggattggatttttcggatggagaaggatcagagagggagagagtaagagctctctggttctccagctctttgtagcttcttcatacatagatccaccaaaacacaggagtagggtattacgcttctcagcggcccgaacctgtatacatcgcccgtgtcttgtgtgtttccattctcgcgaaccttccacatacagagagcttagaatctcaccctgagtccccggccgaaccggcaaagggggggcctgcgcggtctcccggtgaggagccccacgctccgtcatctggcgcgccaggtagggggctctgcgagtgatcttctgagctctcgcactcttgcgtgtgcgccaagcttttcctgttcagcccaatggccgaacaagcaaaggcgcacaacctctctccgagcgttagcggtgacgatgggaagtcaaacccacgccgtcgagctcgtactccatcgccccctccacgccaaagtcctaggagggaggaggtgctcgagagggtcgaaggatccgcgacttcgacatccacgggtgatggagaaggacggcgagacggggagcgtcgcctcctcgtctacggcgacggcagcacgccccagggtgcgctccaagctgcgggcgcgctcctacgtcacccgcccattgtccctgacccggagtctccagcccaacgttggctggacgacgtggccaacttggtcatgacggcacggcagcgcctaggtgctggtgggcggtcctccgccaccaagacctctggcgctgctaccaccggctccgtatcgtcaaggcggagggcgcggcgagcggcggctgttgctcgccattcggccgccactccttcgtcagcgcctccgacccaggaagatctgcgtggggggccggatgcccgcatcagtatcgagcgccggcgtaatggccgacgtgctgcccacgcaacggagggcgcctcctcgtccggagtgtcacatcaacacggacgcggggatcagccctccgtgcccccggttggtggtgtcggctgtagagcctttgtggcgagccttcggaacgtccgttggcccccaaggttccggcccaccatcgccgaaaaatatgacgggagcgtcaaccccgccgagtttctccaggtctacacgaccgggatcgaggccgccgggggtgacgatagggtcatggcgaatttctttcccatggccctgaagggacaggtacggggttggctaatgaacttgccacccgcgtccgtccactcttgggaggatttgtgccaacagttcaccatgaactttcaaggcacatatccgcgcccaggtgaagaagcggacttacatgcagtccagcgaagggatgatgagtcacttcgctcatacattcagcggttctgtcaagtccgcaacaccataccatgcatccctacacatgcggtgatctacgcgttcagggggggtgtgcggcacaaccgcatgctcgaaaagatcgcctccaaagagccccagactaccgcggagctttttcagctcgtggaccgagtggctcgtaaggaggaggcatggacctggaacccctccggttccggtgtggcagcttcggccgcccccggatccgctgctcagacagggcggcgtgacaggaggaggaagaagaggtcagcccataccgacgacgagggtcatctcctcgccgtcgagggcgcttcgcgggccacccgaaaggggaggcctgcgagcgacaaaaagaaggaagccgacgctccctgacctcggctacttggaagagcgaaggtggcgcgcggcccttcgagccgcgcgcaaccagcagagcctgcggcgctaccatcagcgccacgtccgggcccgataactctgcgtcgacgacctcgtcctacgccgtgtccaaacgcgtgctggactgagcaaactctcaccaatgtgggagggtccgtatcgagtgatcggcgtcccccggccgggctccgttcggctggccacgggcgatggcacagagctgcctaacccatggaacatcgaacaccttcgtcgcttctacccctagtgggggtcgggtgtcaggtcttgggctcgggccaaccccgcacccccccgggcgtgcagggttggccgggggcttatcttttttctcttccgtatttcaataaaagcattttcgatttcctaaaggctgtatctgtgctgttgtttccttttgaaggatcttgacttgaaataggtcactcgtgttcaatcctgccctcgggggctcgggtcagctaaaatcgccaaacggggcccagaaccgagccgtgccccgggacgtggtgaactccgggggggagggaatcggcaaaaacccacaatcgggtcacccataaccctcggtcaccacgctcccggcttggccagtctcgacatgtggatctccccaggcactagccttgacccgcgccgtttgaggctgggacctgggcacgagcccttgttcaagccaagacacagaaggaccgtggcacagaccatcctcgtctcatacacagaacaaatgaaattgacacaaaaatttcctctttatttgattgcagattaaatcagcctataacaagaaggaggcccgaaggcctcggaagaagaaggaaaagaagaaactatttaaagattggcgggggcctgggggctcactccgatgcacccgtgtcgccagcctcgtcgccactgtcggttttcccttgctgatgcgcgcgatttgcgaccgccgggattctgcccgaagagagagagagagcagggaggagaggcccccgagccgaacggcggcccaaggcccccgacggccggaactggctctccgcctgcttgtccgacggtgccaggcgcccccgacccccaggatggccccgaggccactgcgggaaggccgcgcctgtcgccctctgaccccgaggtcgtcggcacagaagccgagtgcgccccgcgtggcctctcggatggagagcgccctggacatgtggcccctgacgaagaagatcggccccaccgaaaggtgcagcggcccgtctacttcgttagcgaggccctccgggacgccaagacccgataccctcaggcccagaagatgctttatgctatcctgatggcttcgaggaagttgcgccattatttccaggcgcatcgggtcacggtggttacgtcttatcccctcggccgaatcttgtataaccgagagggtactggacgggtggtgaaatgggcaatcgaactctctgaattcgatttgcgctttgaaccaagccacgcgatcaagagccaggccctcgccgactttgtggtggagtggaccccagctcccgagctcgtctccgtccccgaggccagctcgagcccatcgcagctgcctcacaccgccctctgggtgatgttgttcgacggcacctgtaggaaccggccccacctgtcaccaggccttagaagtggcgtcacgcccgaccgcttccctcggggagggcgatcgccctggcataacgccgggggctactgtcggtgacatgggaccgggagtatcatgactagaggcttgaggcagacacaatcgcccacgtggcctggcaccctcggggggcgtcgggcccgagggtgatgtgttcgccctcctctttgtctccccgagggggtcgggccgcacccgcctcggccccgagggccgaggcgccccgacccctcgtgggtctttgctctgcgtgtatgggttaggtgagcacagtggggctcacctaaccacatttattgcggtttggctgagcgtgtcacgccgcatgtaacgcagtgcagtgcactagtttatccagtcagtgaccagtcacagaccggtcagatcgcgggttaggtggcgacaggcgatctgacacacgccttgccccatcccgtcaggacgagggcttctaggcgctcgtccccagctggagctagcgtgttacctcccagagatggcacgttagtcctagtcagatatatgccaggcttcatcctaaccattgcaggcaagatgttgtgtgaagaagggcgaacatgtagattgctaagctgacacgtggtggacaagaatgaccgacgtgactggtctgacaccggtcatgtcgtcagcagacagccacgattccacgtcgcacctgctcccggcgaaagtggaggtagttgtggcccgtctcatcagaaggtgactcggacggcaactatacaaatctcggtccatttatgaaaaggtggggtaagtccccacaaaaaaagagagaaatggtgcatgtggtatccccttaagatataaaaggaggaccttgcccactgagatggggattggatttttcggatggagaaggatcagagagggagagagtaagagctctctggttctccagctctttgtagcttcttcatacatagatccaccaaaacacaggagtagggtattacgcttctcagcggcccgaacctgtatacatcgcccgtgtcttgtgtgtttccattctcgcgaaccttccacatacagagagcttagaatctcaccctgagtccccggccgaaccggcaaaggggggcctgcgcggtctcccggtgaggagccccacgctccgtcactgtcatacgcacattcacccatatgaaaatacgtgtgtataacctacccttattagcatctcccaaagactgggccggcgtatcttcatatttacgaagtcaacattagatgcatcaatgtcgatgggtacgtcaactaccattaaaagaactagcaaggtggcccgcacagattgcgcggctagcatcattatattttctctcatataatagcatatatgttttctcattatattattcaaatatattaaaatgacaacataattttaaattttgcaataactttacaaaactactaatgtgtaatattcatattatattttatatacgtgttagttattaattatttttaatatcaaattttagttatttgtaattatatatattcttatatggactctagactcgtcttttaatattcctttcttttttaattccgaattttctgtaaattgtatttctatatagacactatgctcttcttccaatattatttatttttatttctgaattttcatattatattttatatacgtgttagttattaattatttttaatatcaaattttagttatttgtaaattatatatattcctttatggactttagactcgtcttttaatatttcttttttttaattccgaattttctgtaaactgtatttctatatagactctatgctcttcttctaatattatttatttttatttctaaatttttattatttctaattttatttctatgtggactctaaacttatttttcaatattctttaatttttaatttcgaatttcagttacttctaaattgtattcctatatttgtattcatatattgaccttaaactcttcttcccatgtttttcttaatttataattttagttatttgtaaattgtatttttatacggactctaaactctacttttaattttattatgtttattatttcaaattttagttagttttaaattcctatatggactctatactatacttctaatattccttatttttaattccaaatttttattatttcctaattgtatttctatatggactctatactccaattctaatattccttatttttaatttcgaatttcagttatttcctaattgcatttctatatggactctagtctcctcttctaatattctttatttttaatttagaatttcagttatttcctaattgcatttctatatggactctattctcctcttctaatattccttattttttaattccgaattttagttatttcctaattgtatttctatatggactctattctcctcttctaatattccttatttttaattccgaatttcagttatttcctaattgtatttctatatggactctagtctcctcttctaatattccttattttttaattccgaatttcaactatttctaaattgtatttatatatggactctagtctcctcttctaatattccttattttttaattccgaattttagctatttctaaattgtatttctatatggactctgctttttctttttctctgattaatgtgagaatttctaggccatgagagcgaacatagaggctcctttttctattcatttaataatataatagataataatttagccgtaaatatgagtacccaactacccatgttaagtctagcacctgagtccaggtgggatggttacaccataggaacataatcagttgagctacgcttacttctacgtagctatattctacaacgaagataatacatgaaattaattcaaagaatgttacaaatggttacgaagataaaatatatagatcgcaaaattaaataggagaatattttgtttggttaagaagagaatattgatagagaaaatgcctgatttttaaacaaattttgattacttctatattttagatcaaattaatgtggtactttttcatatgtggtcggctcatctcataagcatatggtacgcactatttatatatgttccctttgtggcaaaataaattaacttatagagtttaaactttatttcaaaataaaaggttagctaccatgtgattctagacgatgctccagttgctatccgtgcgtctgctttcttaaatattttgaaatagagatgttgtgtaaatatctgtattaaacctcaaatttgacgtccaaaataaaaaaggaaacacggctaaagtttgaaaaagattcagggtgtgttgcgtgagtgaagctgatctaacagtcggcttaggaccggttcgaccgacggcagatggctggtcgaaccaataacatttgaccggtagagtcgactctgagtttaatttgccggttctcatactttcttgcttgggtttgagttctctcgagtcataattggtttattgtcctagtaagacatggagatggatcaatgaaaggcaagaccaacccttttataacgttcatggctagtttaattaagagataagctgcactcaacgcattagctaattgagaatcattcaatcagttttgtatatactttttatgtaattcgttcatcttcacctgtttgcgttgtaagacatccatcctccatgtgagagtgcgaatcctctttaaacatttgtcttgtgaatcttccgttacatctataagacgggagtttgtctcaatttatgtaaatgagctccgctacctgaatttgatcttctaaacttgacttgaggatttttctcaagattaggattgttagtgactcgccgtaaatttttgggtaatttggaaccatgtcattataattttgcaaagtttgagatatgtcatcggtatctcaatgacttgtaaggatgtcatatatcaaattttgtaaaattataatggcatggtttcaatttttcctaaattttttaggtgaatccgaatcgtgttggcgacatgatcaaaattagacgcgaattgagcaatatgcatgctggagaactcctcttatagtcttattcccttttttttttgtcgccaagatgattagaggtgtagttaattacttaattatctttgttggttgctctacttttatcaccgtctactcccatcattccttcgccatataataggatgcaatcacttggcaagcttgtcaggtaggacaatgttcttataccagattccatatgaaccgggaaatcgggaacttccgtttggctctgttcagcaataacaggaagaaattagtactagcagcagtggtgtctcttgcaggtgcagtgtatcgataaggttttttttttttttttgttaatgtgatctggcccttgatactgtagttgtttatgtaaagttggtctcgtgttgttctctaacttctatgtgctgaggagcagctgttccttttcttgtctgcttatcttgtttcttaatttaaagacgcacaggttctttttttttaattccaatgatagttaaacgaaattgagttaatctatacgtaaacgtgcgtggatcaacaccttaacacgtttggtgatacataaccatacaaaaactgcacgagctgcagtattttccaatagggccacctaagcttcagactattaataacagcacctaagcttcagactattaataacagcacttacaataatgcaatactcttgaataagtcacagttgtgtgtatacgccttttgtaatcagaaggaaacaactctcacctaagtcgcccagggtcgtaaattaacacccgatagacctagacgattacataataagcatatcaattctgcaacccgtataataacagttattttggtaaaatagaagtatacttacttccttcgtcctataataaatttattttagctcatttcatttgtcccaaaatatttagagtggtcattgtattcgagtttatgaaagtagaaaatagttgtgtttgaagtagataaaatgaggaatggttatatattgggatttgataaagcagagatattttaggtttttagttttgtattggtatgtattaaatggatgacaaatgaatttactttagaacggaggtagtaaaaaagatgaacaatacttgatttgagtaccaccaccatgcacccaatgtagtatactctcctacttgtagctgttttcctgcgatcaggatcctctacaattgactgcaccatgcatttatcactgacatctctctatccgtctccccgtacctccacggttactctcactcatagtatcaggcaacttcgacatcaagcaagacatgaaccacatagtacaaaacattaattatagcaaaccaaatcattccggaatgcatcggtacggtagctattgcgtaccccgtaaatgcacacgatccccaattccccatcgagcagttgtcaaaaaaaaaaaagagaaaagaaaccaaggcctatttgatgagaaattagctagcttatcgtgaaattaaatttgtatgtcaccgtgcattcagctcgtcaatctcgtctgtacgccgccctgacgttgatcattgcctcagctcgttgacaacgaggaagtcattccatccatcaccgccgccgctcacaccggcacacgcgtgtgctagtctcacgatgcagtcccacaccgacgaccgggagaggcgcggacgagacggttctgttcagtttgtggaaatcttaaaaaaataataattatacaacctctatcttgggccatgtttgtttcagtttaaaattattgtaatctagattatagaactagattaccataagttagattataatctgtttgttagttgttagtcacccaataatctaaaataagcacctttagagtggcttaccagattatagtaacttggcttataaattataataatatatcataataagctatctggtttttcagcttactcctaataatccatattataataatcctaagctgtattaaacagggcctaatttacttttttagatttcttagaatctgtacgacaaactaaattgttagaagaaacttctgatagctgaagattataggagaacctatagccattagaagcttccaaacaagatctacgacgcgcagcgggatgtccacaccgccttcccccccacgctcccgatcgtggaagcagcggtgacaagaaaaatggcctgttcactttgatgccaaaaaaaccttaccaaattttggcattacaaaaattttggcatagttgccaaaattttagcaggattttctatatagctaccaaaatttggcagcaatctaaatatagccacttttttagcaactttaccaaaatttgataagtttgaaaatagcatcaaactaaataggccaaaagaatagcgtgcggccggctgcctgccctcgtgccaccaacggggacaggggatcggatcgtacgtgccgcctccccctctccagcctccgcgaccggccgcggcgccttcgctgccgtgcacgcaccgtgccgtgcttgccttgcctgcttggtcggcgcggcgcggccatatcccccgcgccgcccgcacgcacgcccgggccgcgcgactccaccgccgctcgcgtttgaccgtaaccgaaagcgccgcgcgcgagtcgtggacccggcggatcgggccaaagaggcttttctgggctcacggaccgccgctgcgccgatacactacacacactgtttgacccgaccccatatcctcctcttgtctccgccgcgaaaccgcctgccccgggggtggacgtggaccgagccttcggtacaccacagcagcaaaacggatcgtacgcgacacggggacacgcaggcgcaggtccgtctaatcctacctgaggttgcagccttcggctaaaaagctctactgtttccacaccaacaaagcagagcctacacgctgacatgtccattgcttctgctcccgacagatcatcctcgcggcttagctgtggaccgggtgcatgcaaggtaggtaccccgctccccagctgatgaactggcgtccacgtcgtcacctcacccagccaacggcagccatcattattaactcgccacttacgctgcctccgagatgattttcacttgaccacgcatctttaatccggattaatcacctccttccttcgcttttaattactttttgtatgtttaatcaccccgccgaaccccaggtgacgaccgcgcgcgcggcggccgcggctactcgtggacctggtgcacggcgcgggggtctacccgcggatctcgaggcagcggcggacggaggagattcctccacgtctcccgacctggtgcggagcgtccacgcgctggaggacaagcgggagcatttcttccatcggttacggcgcagcagcaagacacgatcaaaggagagagagagagagagaggaagacgacgacgacctttgttgttgtttccttctttctcttctcttctcctcatcctcctctttagcttcctctcgcgctcgccgtctctctctctctctctctatcgggcgcgcgcctttctgtgttggtcgtctctttcctcgcgtgctctgccgctgcgcaagaatcaaaaggcgccggccactagagagagtgtgtgtttgtgtgtgtgtggcttgagttgagagttgagagaccaatcgaccatcggctgtgatctcaaaagagagagaggggcaaagcgaagtgggcagacttgggcggcaatccttgcgaatcatcaagggattctgtcttttctttggtgcgattcgattgtttctttgtagggggaagggagagaggagggggggggggggttttggcaattggcatggaggaggcggaggagatgcaggtggagaggatgcaggaggaggtggagggaggcggcgcggatacggataagctcagctacgagattttctccatcctcgagagcaagttcctgttcgggtacacggacccgcaccagctgtggctgcccaaggcgccggcggcgcaggcgtcggcggcgacggccgtgccgtcggggaaggcggcgcagcgtgggaaggtgtgcgtgctgtgcgtggatggcggcggcggcgggctgcgggcgctgctctccggccgggcgctggcgcacctggaggccgcgctccggcgcgcgtcgggcgacccggacgcccgcgtcgcggactacttcgacctcgtcgccggtacgggcgccggcggcgtgttcgccgcgatgctgttctcgacgcactcgcgcggcgcgcctctgttccacgccgatgacacatggcgcctcgtggctgaccacgctccccggctcttccgcaaggccgcggcggctcgacgtcgctcttctgccgacccaagaagcggcccctcgcggcgccgacggcggcgctggacgcggccatgaagacggcgttcggcgaggagctcaccctgcgggataccatcaagcccgtgctcatctcctgctacgacctcaagtcgtccgcgccgctcgtgttctcgcgcgccgacgccctggagagcgagagctacgacttccgcctcttcgaggtcggccgcgcggtgtggt

SEQ ID NO: 59787 - DNA, 20070 bp, Oryza sativa
cacccacaaaacctatggatacccccctaagccccccttcaattttttcatcatagttgataagataggaggtgctaaaggtcttataatagcattttagcatagtttaataatgagattatatgtttatatcggtgtactcggtatgttgagtccccccaactttttgtttctggatccgcccctgatggttggtggtgagcttttgcatgcatggcatcctgggttcgattcccttgccatgcaaattttgtctttaatttcccttggtgtatgctccctctttctatttgactcagtgccatacttatctttctatttgaatcagtgtcatatttatttttgaaagaatacaaacaaatgagagaataaaaaagaatacaaacaagtaagagaataaaaaagaacagggaaaaaaaatgacttttctagcgatcggtgagattcgaacgtaggaccatgtgtacacaaggcaagcaaccaaaccatggcaccactaccttggtacacagaacaaatcaaattgttaattagcaagtatatggggtcagcgccgaggtatttgacgctaaccccgtgccacgtgaaaattcaatgccagctcaacaaaaatctcggcgccaatgtttttggcgctgagacgttagacctcagcgccaacctcaatggcgctgaaccgacggcctagttttggttgaagtttttggcagggactattttcaaaataagtttttataaagggccaatttgtcgaaaaaacggtgttgttggcgtgtatcgatcaggtcaggtggatgggaagagaacggacaccggaagagcgttcccgttaattgctgctcctgattacttatttgctcgctgttaaccgcgacagaattgtgtacgtgcgagaggccgtttttaaagttgtgcaagagattctctgttaactcgatggcgagatgccgatcgatggcaatgcaagacgcgtccatcgtctccaaaaccgtgcgagcgcgacgcgtcggaaatactgtgcactctgtgcctactccgcgtcctctaaacttacggcccgaattcttagtccctccgtttcacaatataagtcattttaatattttttatatttaaattaatgttaatgaattcagacatatatatatctatttatattcattaatattaatatgaatgtgtaaaatattagaatgatgaaacggaggaagtatacagtacaataccgcctcggacgggcacctcagggcgcaacattactgcatcgtattagcccacccgaatctagtaaatctagatggaataagatcactttgactccctcaactgaccactaaatctaaatcgtattcctcaaccacaataccagaaatcttaacccccgaacttacaaaaccggtgtaatttgactcccttggtggttttggagggtgatttcgctgacgtggtgcacacgtggcagcgttgatccggtctttgtcccacgtggcattgacgtggcgcttatgtggcattaaaataaaaaaatatatgcagggcccagtcattcacccaaaaataattgtgggacccacaaacatgtaggtcccacatgtcatcctccctcctctatatttccctctttcgcttttacagcggcgttcggatcggcggcggcgacggcgggcgatggacgaatcaacagcggcgggcgggcggccattggagttgcggatccggaggccggatctgcccctcgcttcattcctcctcccgatagactgcgccatggccgtcgccgctgcgctgccgaccgtcgccggggagctagccatggacgagactaaacattcacaaatctcaccagggctggccgcctgggcccaaggtagagctggccggctactaggaggacgcgggagctcaggtccctcggcggcggtgcgggcgctccagctatggcggagagggtggcttgctttggagggggatagggaagaggacaaatattgcccgctgggcagtagccaaaagcaaaggagtactggggcacatctatacacgagctagacaaacgacagatcctacaatgctcaaaaccaaaaccactacatcagttcaacatctcgaaacaagaaattgtaaattgaaaaaacaaaacaaaataagccacggcaaattgtccaaatttcacgcgtcgacgaggatgcacaaggaaggaactaagagtactagaggtttacttgttcaaatcgttaaacgattggttggaattagtgggaggtcatcgggaagcgtcgacggtgaaggcctaaaccgtcggcttgtacccctggccgcgccgaggctgaccagcacggacttgaggaaactcctttcccagcgacatggctccggcgccctcaaaggacaccgcttctgacgtcgacaaggacggtcgctgctccatgcatggctccggcgacgacgggagggtgtcattaatggcgctgctagagtaggcggagcggtggcgacggcggccggggacgccagcctgaggcgcatgatgaacgccgtcttggtgacgcccacgccgatcgtcgccgcgagcaccgagttgcggctagctatgccggctgccttgaagatgctcgggccatacaacaccacggcctcgatgccggtgaggtgctggaagaagtggatccccagggcagcgatgacgatgcgctgcaccggcggcgtcgggtgcaggaacgccgagggagccaacgctgacgccggcgacgcagcggccggcgaggagtgcagcgaagttgggggtgaggcccatgaggacggagcccgcgaggagatacagtcggcgagatgcaggagggaagagagggaggaggaagaagggataagagataatgacatgtgggacttacaagtcagtgggtcccataattttttttttggtgaatgacaaatgggccctgcatatatttttttattttgatgccacataagcgctacgtaaatgccacgtgggacaaagatctggtcaacactgctacgtgtgcgccacgtcagcgaaaccgctcttcaaaaccaccaaaggagtcaaattacaccagttttataagttcgggggtcaagatttctagtattacggttgaggagtaccatttagattcggtggtcagttaagggaatcaaagtgatcttattccaatctagatcgcgaccatccgatttgggccatctagtcttatgcccgagaagagatgcaccgcaccagaaggcccattaaaacttcagtcgcgcatgcatccagttgaggcccacaatatatctagtgccccggtccggccagccgtgagcccacgtgaaccgccaaccgtctccctcgccgatctcggcgtcgcgagtcgtgcgtgacccaacgccgcccgcgttggcggcacggcgcgccgggcacctccacggctccacccttcgccgcgcgtgcctcaacgatgccacgccgtggcgtgcattcccacgtcatccgacgagggcgtgcggcgtgcctaatctacgggcccagcgagcgagcggcggccgtcgccgccgcgccgcgccgcgctcgctcgcgtggccaagatcaacgggagcaaagacgttgtggttggtcctcgtgggccgcgtcaaaggggacacgcacgcgacggtcgaaactgtactggtcagtctcagtctcagtccggagtcattgctatttacaactcaatagcgaacaaaagcgatttatttacatacgtacaatcgtatgtacaatctatactaatttttcaggagatatgcaagctacactgacaaattacatgtttaaacctaacgattattctctgaatcattagttcgtgtacacttgctagcagctacttctttctatactgcaatctagcctgtccatgcaaggagataggactgaaaactaacgaaatcttgggacatttgctcaaagaccatgagcacagagaacacccccatccctactaaaactggctttgcactagtcaagtccacattgccactgccaccggcgacagatgattccgcttcgacagatccagctctcgaatctgacatcctggaggcgatagcccacgccatcaatggaggaagaacgccatacaagatggtcatgcagtaaccgccctgaacgttaggaaatcaacccaccaagtaattaatcttctgtaagtgtcggaaccatgctagctaggatggcaagaactgaaggatttcacatgtattggtgtacactcactgcaatgtcagtagcaatggagaatgaattcggaacggtagctgcaattagcacggttggggcaaccacagcccctgcagcgatgtagctgagcctgttgttgtccacagccgttttcgctccacgatgccttaatgcttcttcttcctgcactcatcgattgtttgttcataaaactgaacagattgttcttagatataaattaatgcaagtcctctggctgatgaagcatacatgtccttgggctgaagaagagacaagattggtcatctgctcaatgaagaactgtgaagctcccagcagtgttccgatcagcgacgtcccgacagcaaggagtgagaacgtctccacaacagtataactccatctacaaaagaaagaaaattttgtcctgttaggattcaacgcctccagcttcatacagagaagcagattgcaggtgaagctgtacacaacgtgttcttgctagtgcagtagtgctacagcggagacgctcactctgtattaagcatatccaggatgtcaaacccatcaagatccgtggagatgctgagcgcgatgtcgtcccacacgagcaaggacagcaatggcacgatgctcccgacgagtatcgagagccgaatcctcacgaggtcccctccaaggtacgcgcatatcactgcgacaattgcacactgaatcttcagtacttgtacctcttgcaagttgcaaatttcatccgtgggatgattacataagttgcattgcatgtacctggtgcgatatcatggaagaccagcgtgaagatgatcaccggaagcgttgcagggacctgctcccagttggtgttagctggcagggtcaggccggcaccgaatgctactgcagacacctcgatcgtcagcagtaatcctgcatcagtagacagatcacgatggtagttagtacttagtactagtgcgcaagacagatcacgttgatgacagcaagaacatgaggtgtatggatgtaatatggttatcagctacagtaggtttgctcttacttcagcacagtgcattgtgttgcaagtagtatggagctcccagtggggagagtgggtgtttgttcgtcattgtctctacactttcagaaatgagttactactccactacatgccatctttgaattccagttgggcgaaccagtgtttgttcatctctgttttcacaatttcagaaacgagttactgttccatatgctgctaccatctttaaagtcacattttctttttcttgcttaattagcttggagatgttcagacagcagaatttcttctgaaagaagacggctgcagatgccaaaatttgtcatttaagcgtattaatgcagatctaaacaatgtggtatttagtaccgttggctgttccaagtgttgatcacaacgatagcttaccaacctatcatgacgaaagtgagcagctggttcactttgtcggtgacgcccgtgccaccggcggcgatgaggagcgcaagggcggcggtgaaggcgcagccggagacgggctcgggaacgccggcgaccacgctggagagcacctcgccagacttggacgtgtaggcgaccatggaggtgtaggacaggaacaggtaggccgcggcggccaggttccctccccactcgcccagggtctcctgcgccatgctcttcagcgatatgacctccagctgcccgccgccgccgccatcgccgtcgccgccggcgtccttccccttcttccgccgcaggtggacgttgatctcgaccaggaggagcgcctcgatcaccaggaacgcccagcaggtgaccatgcacgccgcgctcggaacgaacccctgccaattgcacgaccatcagcaatgccagcgaccctagtaagagtcacatcggcggaccttaataagttaaagccaaagtttattttcttaaaacttaatttttaagatgattttaagatattttcaatgcatttttttcaagtattaacttttaaatctctaaaaacatgtatataaaaattttacctataaactaatttttattttataataaactgttttgatttattggagaatatgagtaatcgacaagaacttaaacatccaccatacaaaggaaaagttcaagttcagatttttcttcttgttccatttctgttcgggagatttttttttttttttacgaatttgccagatcaagaatgcttgaggttggtgggtcgacaattaaccaagtgaaccttgaatgctcgtaactactcctcacaacaaagacagagaaattcagctgtttgtggggggtacatgtggacggctacttcagatctgtctcatgatagtactactagaactgctgctactactttcatttttggcgatcagatatcctgtcagttccgtgccaaattcatggtcctgaatcctgatagatgggccatcactaattacttcaccgtacgttgtagactagtattagtagtataatctttcggtgtcatgtggaaaggtcaaggcaagagagggacctgtcaccggtccgagatatgaatatacttcctccgtttcacaatgtaagtcattctagcattatctatatttatatggatgttaatgaatctagataaatatatatgtttagattcattaatctagattcattaacatcaatataaatgcgagaaatgttagaatgacttacattgtgaaatggagggagtactacgatgagagggtgattgattccatcgattttttcgcgttgtcttcctctaaaatcatgcaccgtgttgatcacatgtcgaaatcggcgcaggcgatcgttcgttttagggattctgattgtgatgatgctagcaataggctcgtcaggtgtagggtagtacggcgactcaccgcgggcgccgtgcgctgtggcacggcgaggatgccggagccgatgctggtcccgaccacgagcgcggcggcgccaaccacgctcccccgcttcgcgccaccgcccgaagacggcgcctctgccacgcccgccgccacatctccctccccctgaggcggcggccgcgcgtcgccgccgcgcgctcccgccgctctcacctcggagacggcccgggccctctcgccggtggctgcactactgccgcaccactggacgccgccgccgcgatggactctcctttccggcaagcatgtcgtggtcgtcactgggatgcaccggtacggggcgcggtggaatctagctgggcggtgctgcaagcgggcgcgcgtgatggcgccttgcatcggggaggtttcttgggtgtttgtgagctagagctgcggactggagggaatccccatggcggtatattcatcgtaggagtgacggagtgcgttgtcgagtgtcgaccacacgatcatgtggaatcttgagctccggtggtgggcggtggaagcggaatcttttgcagttgtggagcaggagcgcgcgcggacggacacggttgccgtgagactctggaccatgaaggctgattttgtttggagctatacatctccatcagtggtttgtggctgacaatatgtgaaaaataaacttcgaaaatagagtaaactagcatggtggtccagtccgcgcagattgcgcggctagcatcattatattttctctcatataataacatatatgtttttttattatattattcaaatatattaaaatgacaacataattttaaattttgtaacaactttacaaaactactaatgtgtaatattcatattatattttatatacttgttagttattaattatttttaaaatcaaaatttagttatttgcaaattatatatattcttatatggactctagactcgtcttttaatatttcttttttaaaattccgaattttctgtaaattgtatttatgtatagactctatgctcttcttccaatattattttttttatttctgaatttttatattatattttatatacgtgttagttattaattatttttaatatcaaattttagttatttgtaaattatatatattcctatatggactctagactcgtcttttaattccgaattttctgtaaattgtatttctatatagactctatgcacttcttccaatattatttatttttatttctgaaattttattatttctaattgtatttccatgtggactctaaactcatttttcaatattctttaatttttaatttttaatttcagttacttctaaattgtattcctatatttgtattcctatattgaccttaaactcttcttcccgtgtttttcttaatattgaattttagttatttgtaaattgtatttttatacggactctaaactctacttttaattttattatgtttattccaaaatatagttagttttaaattcctatatgcactctataatctacttctaatatttcttatttttaattccgaatttctatttttttcttaattgtatttctatatggactctatactttacttctgatatttcttatttttaattccaaatgtctattatttcctaattgtatttctatattgcctctatactctacttctaatattctttatttttaattccgaatttcagttatttcctaactgtatttctatatggactgtatactctacttctaatattccttatttttaattccgaatttcagttatttcctaattatatttctatatggactctagtctcctcttctaatattccttatttttaaatatttcttatttttttttaattccaaatttcagctatttctaaattgtatttctatatggactctgctttttctttttctccgattaatgtgagaatttctaggccatgagagcgaatgcggagggtcctttttctattcctttaataatataatagattactgttcgtgctgtatattcttgccaaatatttttaggagtgttaatttaatagggggtaaaagagaaggttgagaaataggtaaacgggatgattcattagcgcatgattaattaagtattaattattataaatttgaaaaatatatcactatgattttcttaaagtaactttacatataatttttttccataaaacacatcatttagtacttgggaagtgtacgcatgaaaaagtcaaatctactcacaatcttgtgcaaatgaaaacacccttaggccatcaccgatgcgtctctgggtcgttccctcgccgacggacatccgcttttccgtccgcgtcagctccctacgatggagcgcatcccccggcccagggacgcgtctctcgccacttttcagccgagcgatgcagccgagggatgcattgggagggggatgggctcctgtggacatcggttccccaacgagttttcctatttcaccccttggtagagctggagtatccgccgaccgaggcggacccacaagagagatagagagcggcggcaacgacaaatccgcggcggagtaggcacctcatccacctcgtgctcgccatccgccgcctcgactgccgcgatcagcacggcgctcgccaccgtccgccgccttgtccaccatgcgctcgccatccgccactgtccgccgccgcgacccgcgcggcgccggatctgccacctccggggtcgccgccaccaccttccacgggagagagagagagggggggagagagcggcggcggcctgggcttctctcggtgctctcgcgtggatgatggagaaagagagagagagagagaagagaggggtagaataggaaagagaggaagaggagagagagagagagagtcttttttgggttgggatactcattgggctacccagatgtgacctgcattatagaggtgagtacccctaaaatccctcagatagtgaggacaccctagaagtggctcatattgttgatgcccttagactaccccttgaagcattttttttcactttgaaaagtgatcgctgccaaatgttaagcattggatcagttgtctcacgtgtaagtgagacatggacagcaaaaatggttccttattgcctgaaaaatagtccctgttacttaaaaatctatccgggacttaaaaaatatttttagtcccgatttaaaagcacaataggactaggtgatctttagtcccggttggcaccaaagatcatctttagtccagactgattccatgtcaggctgtgttaggacgcccaagatttttactaaatatactaactttaattccgattggtattaccaaccggaaataaaaatcaaaacactatatataatttttatgacttatcctcttctcccatcctcaaaaactcctcgtctcctctatattttttcctccatctccttatctctctttcctgtacctgtttttcctttctttccttatctcagcgcggggagcggctgggagcgagccgagcgcacgacgaggagattgggcggcggccgggcgcacgaggagacggggcagcaaccgggcgtggtcggcggcggccgggctggggaggctgggaggaagaatttgtttgtttacgatttgtggtgaatttcttcttgagaatttgtgatgtatttaaccgtgacgtgaatatgtgatgttatttttagaatttgtgatgtaaccatctttgagaatttgtgatgtatgctctgtggtttggagatgatttggggatttcacgatttggtgatgatttgggaatggagttaaatcaatatgcaaggagttaaaaacaataaaaaaactaaaaaaaactaccaatcgagacctggtctcttcatctttaatcccggttggtaacgatctttaatcccgattatttcacgctatagtctcggatacaaccaggactacatagggttacgaactattgggttgtgatccaaatttatttgcacacgtataaaggctaacttcggacggagtgaagcggaggcccgtcgtcggaggcttgggctggagcgaagtgtccagattcgttatactaggagatgccacatcccctcataggttgtcttttttttagacgaagagagtacggggctgtttggttcttaactaacattgacataactcactttagacaatgttaggcagccacactttttgtggcctacaaattataagccacacttatggcaaagttaggtaaaagattgagtctacgacgtgtggggtaagatgataagaaagtatggattgccataagacaatgaaacaaacacaaggctaaaacggtataacagtctaaaatgtattgtggtaagttgaagcattgaaccaaacagcctacgcctcaactgcagtctatcttctccgagatggatccattggtgagcgccttgaatgtggcaggtgcaggttgcctcggcaacgtgggctctccacctatgctgtcgtcctctccaaccccgttccggcgattcgcaggctttcctctcagcccacaggccgagcgagtgatgaggcgtccaactaattctgctctcgccttcattgcgccatttaacactcggcgctctcggctctcctcctcactaccccaactacccactcccccctccacttaaacgcgcgcgcccccccgcccgcctctccgtcctcggaagcgccgcccactcttccgtccacgcctatcgctcctctccgtgggttccccccgcgcaagttgtgcgcgccatggagatgcagctcgccgccgtcctcgcctcgctcgccctcggcggcgcgctgctcgtgctcgtcttcggcaagtggtggcagccgctggccgacgccgacaggcgcgtcaaggagctcgccgacgccgtggaggcgctgctgcagctgcggtccgagctgctcaaggtggagcccgcgccgccggagtcggaccagctggcgcgcgcgtggctgcggcgcgtgcaggaggcgcaggacgaggtcgcgtcgctcaaggcgcggcacgatggtggccagctctacgtgctccgcctcgtgcagtacttcgtctccacggcacccgtcgccgggtcggccgagaagcagctcaaggccgtccgcgcgctccgtgagcagggcgaggcgctgctcgaggccgcgctgtccacgccgcaggcgccgccgccgctgctccgccagccggaggagctggagctcccgccggggaccagtctcacgaggccctacctcaacgaggcgctccgcttcctcggcgactgcgacgccgcgctcggcgtctggggcgcggggggcgtgggcaagaccacggtgctcacgcacgtccgcgacgcgtgcggcctcgtcgcgccgttcgaccacgtcctgctcgtggcgacctccagggactgcacggtggcgaagctgcagagggaggtcgtgggcgtgctcggcctccgcgacgcgccgacggagcaggcgcaggccgccggcatcctgagcttcctcagggacaagagcttcctgctgctcctcgacggcgtgtgggagcgacttgacctggagagggtcggcatcccgcagccgctcggcatggtggccggccgggtgaggaaggtggtggtggcgtcgaggagcgaggcggtgtgcgccgacatgggatgccgcaagaagatcaagatggagtgcttgagcgaggaggatgcgtggaacctgttcgaggccaacgctcgcgaggagacgatccatcgccaccctcggattcctgcactttcaagacaggtaatcacttgatctgtctttgtttgaaatcagattggttcaaaacaagcgctacgtttagcattttcagttttccttcaaaaaatagatatcttccatccgttagatcatacaatggtacatgcttaagtttcagtctaggtttgatgctaactgtaaggatttatttcgattgagaaatgagatggtcaaattctcatgtctccgctaactgaatttccttgtatatttttttataaatggattttccgataaacattagctacctttttaaatcaggatcatctctgtgatttcctgttctttccagctactaccaaattgcaaatcacaaattgaatgctatcagattattatcacccaatggttatggtacaatactaccctttgcagaatggtcttgcagaagattttaaaatgtgttccgttttacacaaaggcaatcgaacaattctgtttctctattttccatgataatctttctgtttcttcaatccttttgcactggcttgttgcacgacttatcaacgtgttatgtacttatgtgccatcaagtttagttgatgtatttcatttacatttgatctgttccatcattgacaactgctaataaattcgttctacaactaaacaggttgcttcagagtgcaagggcttgcctttgtccctcgtcaccgtcggccgcgccatgtcgagcaagcgcacaccgaaggagtggggcgacgcgctcgacgccctgaagaagacgaagctctcgagcgcgcccggcccggacaagatcgctcaccctctagtgaaattctgctacgacaatctggagaacgacatggcgagggagtgcttcctggcctgcgcgctctggccggaggatcacaacatctccaaggacgagctcgtccagtgctggacagggctcggcctgctcccggagctcgccgacgtcgacgaggcgcaccggctcgcgcactcggtgatctccgtgctggaggcgtcgcggctggtggagcgcggggacaaccaccggtacaacatgttcccgtccgacacgcacgtcaggctccacgacgtcgtccgcgacgcggcgctccggttcgcgcctggcaagtggctggtccgcgccggcgccgggctgagggagccgccgcgggaggaggcgctgtggcgcgacgcgcggcgggtgtccctgatgcacaacggcatcgaggacgtgccggcgaagacggggggcgccctcgcggacgcgcagccggagacgctgatgctccagtgcaaccgtgccctgccgaagaggatgatccaggcgatccagcacttcacaaggctgacctaccttgacatggaggagaccggcatcgtcgacgcgttcccgatggagatctgctgcttggtcaacctggagtacctcaacctctccaagaacaggatcctgtcgctgccgatggagctgagcaacctgagccagctcaagtacctctacctgcgcgacaactactacatccagatcaccataccggccgggctgatctcacggctcgggaagctgcaggtgctcgaactgttcaccgcgagcatcgtctccatcgcggacgactacatcgcgccggtaattgatgatcttgagagcagcggcgcgcagctgacggcgctgggcctgtggctggacagcaccagggacgtggcgaggctcgcgaggctggcgcctggcgtgcgcgcccggtcgctccacctccgcaagctgcaggacggcacgcggtccctgccgctgctgtccgcgcagcacgcggcggagttcggcggcgtgcaggagagcatcagggagatgaccatctactcctccgacgtcgaggagatcgtcgccgacgcacgcgcgccgaggctggaggtgatcaagttcgggttcctgacgaagctccgcaccgtggcgtggtcccacggggcggcgtccaacctccgggaggtggccatcggcgcgtgccacgccgtggcgcacctgacgtgggtgcagcacctcccgcacctggagtcgctcaacctcagcgggtgcaacggcatgacgacgctgctgggcggcgccgcggacggtggcagcgcggcgggtgagctggtgacgttcccgcggctgcgtctgctggcgctgctgggtctgcccaagctggaggccatccgcggcgacggcggggagtgcgcgttcccggagctccggcgcgtgcagacgaggggttgcccgcggctgaggcgcatcccgatgcggccggcggcgagcgggcagtgcaaggtgagggtggagtgcgacaagcactggtggggcgcgctgcagtgggcgagcgacgacgtcaagtcctacttcgcgcccgtgctgatctgaacaaaacaacgtcgtcgtcgctgcaatctcgccgcgccgtgccgcgcgtgcgtgcatccgattttccgatgcagaggttgaagttttggagacgtgctgatctgttagggaaggaacgtcgggggaaatttggtgactgttaatttggattatttttcattttcctttaaatttgggacggtttcttttgaacatcttgtgtttcgttgccaaaaggaaaactcaaccgctgaacattgcacttctttctttgttttgctcaaactatatcctatgctacaaacaagcaaacttgaatatctgatatgttcatactagttttgtgctcgaattcccgacgtgattataaggctgaattcctgacgtgattataaggctgagtttagttccaaactttttcttcaaacttttaacttttccatcacatcaaaacttttctatatataggcctggtttagtttccaactttttcatcgaactttcaacttttttatcacatcaaaacttttctacacataagcctggtttagatttcaactttttcttcaaactttcaacttttctatcacatcaaaactttcctgcacacataaactactaacttttctgtcgcatcattttaattttaatcaaattttcaattttgacgtgaactaaacacgcccatacaaatttccaacttttccgtcacatcgttccaatttcaatcaaacttttaattttggtgtgaactaaacacaccctaatacgtaggacatgctgatgtttactggggggcccttccggcctggggagtagcaggctgggttggctatgggccatggtttgggctgcacctggacattgcagctaaatggatcggttaattacctaagcagtcactaaaaagggctgattagagttttctttttttttatctcgttatatcttttttttcttgtgagaataaagctaaactcagttcgttcctttctcaaagtatgagatctgttatgtatgaaatctacgacctgtttggatgttttccagcttttgtcacgtggaaagcttttaaaagatctattgcacaccatgatgaattcattaccagctttgactggacaaacaaagatgtataaaagaaggagcgtatcctatgcacacaggctctcgcgtgtacacaccgtgtacaccaactaaaaattatcacaaaaaattctaggaaaattcatacatgtactttcaatagtattacatctacgtgcaaagtcgcatcttcaaattcattctacatagagaataacaaaaaagataaaattctgacaaaattgcaaccttaaaactgttagattttttgtttttttgttacggctaaaatataatgaatttgatgttaagattttaaccctatgtgtaatacaattgaaagtatgtgtatgattttttctagattttttggtgacattttttagttggtgtgcacgtgtgtacacgtgagggcctgtatgtatagaatatgttgccataaaaggaaggggtgtgatgtagatattgtctgtactcaactaaggagaggagaggaagaagaacagagatgttgagatgtggatctaaataaacatttactggtgcaaggagaaagcatccaaaacgccgcttgctaaatcataggatactttagtacgagtgtattatataagtaatcaggtaaatatgttgacatgaacataattgtagaaatacatgatcattttcatttgaagccaaaatatggcatatcaaattcttaatagtactttggctagtgtttggtttgctattaaaatgtgccattggactcaatcaaaatttacctatattttgacattgccaatatcttaacatggtagcgaagcaaacaaacctataatgccaatttttattgaatatatgtgataattgttttcactcgattcaattcagattcaagagacgatgagtggttaaaaacaaaccacaaatgaaacaaggagtaaagcaagggcttgtttggattgaagctaaattttgtccaaccaaaatcatggcaaatttaaccgtgtcacgtacgcctcactagttcaaattatatactagcacaaaaatttaccaggttttggcaaaacaagcctttaggttggttcagatccgtttgttctagcatggaaaacaagataatttattagcgtatgattaattaatcattactccctccattccataatacaaggcacaagtactttttagatttgttctataatataaggcatacatgcatacatgctattaactaacacatcttcttcactaaaatattactatttaaattttccactatcaaaatctctaattttattgggtgcatgcattgtatttattagattaatccaaactatgaggtgataataattatttattggtctttgggttgtgtcttgtattttggaatggagggagtaactaaaaactttaaaaatagatgatattttttaaaagtaacatatatatatatatatatatatatatatatatatagaactactatacggcaccttagggtgctacgtattaaacaatacctgatacagcctccagccccaccaggtccataataagcagttaaaatttaactcatcgacgaccaatctccaatccacccctagcccaaactatgaggtgataataattatttattggtctttgggttgtgtcttgtattttggaatggagggagtaactaaaaactttaaaaatagatgatattttttaaaagtaacatatacatatgtatatatatacatatacatatatgtatatatacatatacatatgtatatatatacagaactactatacagcaccttagggtgctacgtattaaacaacacctgatacagcctccagccccaccaggtccataataagcagttaaaatttaactcatcgacgaccaatctccaatccacccctagccgtagtagtaattttttttacttgcattttgcaccgcctatatatgtatttgtatccagcaataagcccgtaaccattcaaacctccaattcccgaaatttttggatccatcccagcacccagccgtagaatgccctaccggcacctcaccgccacgccatcgtgatcgtcgtgttcgcggcgggatccgcagtaggcaacgtgcaacgagatccaagccgtgagtggtgataagttgcgagacttggtggcggatcggtatccggctctacccgtcggcatcgccgatgtcaaattgaattggtgtggcgccggcaacaatgctttcccaagcgcttgcctcgatggcgggcctacggcggcggccacagggatggaggcggttcaggactcgggagaatagatgtgcctcatccttcatcttggatctacacagcagttgcgcgtacatgcatggtcggggatgttgagggtgccatgcatggatcccggtgctgaggggcgtggcggcgagcgctggcgttgtctgtgagtaggccgggctctacggccggatatggcttgttttttgcgaagcaactagcgaacggtgcagtcgacaatcgatctgcgcagcccctaccatcactggatgtcgctccctaggagcgtgccatggaacttccatgagcaggaggatcgatgaagagcgtcagccttggtgccatgccggccatcctccatgacatcgacggtgcccccgcgggccgcgtggcctcgttgcctgctgcagtggttccatggataccggtggtggaagctgctccctcgctggtggtggaagtacattttgcgctcgacgtaggggagcatggatccgacggtcagggatgaggaggtcgtcgctacctttagaggttcataccgcgctagttgcagaacattgctgtggaggacagaggaggacgtctcctccaggctccaggaccaccatgtcctcggcgactccgcctgacgaatgcccgtgtcctgtaatccagcgttatttagttgtttttatccaatgatatttttttaccctaagttggtctcaactcccatttgtaattttttttaactcaggaagttaaatgtgtatacgatcgtattaaacacagtgccgtcattaagtgagtaataaaatatttattcaacaattaatgagttattaactataataatgcaaaaaggatgtaacaaaaatattattgttaacacacggaaactggtgtgaaaaatatacggggagtaatatcgagcccctaatttgtggggagtaaaattttaactaagtttaaatagaggggagtaaaattttaactaggtagatatacaggtctgattttgctatggaattttttactggaattaatactaccggatgtaagtgggaaaaagattaacaaaataattttattagtgagaatggaccaactgcagtaaatattttacttaacacaggctagcatctggagtgctgcatgcggaacggataagtcggaaggaggtgggaggaaaaaaaagaaaagaatagcggtactgcgaagggagttaaaaacgggaaaagcggaggaggagagggaggggggcgactggtactggcgttacgaaactcggtggcgcgtacgggcgctacgtagcgtcaccgtgtgtgtgtgtgtgtgtgtgtgtatatatatatatatatatatatatatatatatatatatatatatatatatatatatatatatatatatatatatatatatatatata

SEQ ID NO: 59788 - DNA, 29495 bp, Oryza sativa
taaccattacaggcaaaatgtagtgtgaaggagggccgacgtgcagattgttaagctgacgcgtggaggacaagaatgaccgatttgtgaccattctgacaccggtcatgtcgccagcagacagccatgattctacgtcgcgcctgctcccggcgaaagtggaggtaggtgcgggccgtcccatcagaaggtgactcaaacggcaaccatgcagatctccgtccatttatgaaaaggtagggtaagtccccataaaaaagggggatgggacatgtggtatccccttaagatataaaaggaggaccttgcccacggagagaaggggagatagattttgggggagagagagctttttcttggactggacctttccagattaggagcccataacaagggagaggctggctgatactttgtagctctttgatacacagatctcccaaaaacacaggagtagggtattacgcttctcagcggcccgaacctgtatacatcgccagtgtcttctgtgcttcctgtctcacgaaccttccacatacagattgggagtttagagtttcacccagggtccccggccgaactggcaaaggggggccagcgcggtctcccggtgaggagccccacgctccgtcatctggcgcgccaggtaggggactctgcgagtgatcttcagagctcttgcgctctttcgtgtgcaccaagcttttcctgttcagcctcatggctgagcaagcaaaggcgcacgacctctctccgagtgtgagtggcgacgacggggagccgaacccacgccgtcgagctcgtactccaccgccccctccacgccaaagtcctgggcgggagaaggcgcccgagagggctgaagggtccgcgacttcgacatccacaggaggtggaaaagggcggcgagatggggagcgtcgcctcctcgtctatggtgacaacagcacgccccagggcgcgctccaagctgcgggcgcgctcctacgtcatccgcccgtcgcccatgacccggagtctccagcccaacgttggctggacgatgtggccaaattggtcatgacggcacggcagcgcctagatgctggtgggcggtcctccgccaccaaggcctctggcgctgctaccaccggctccgtgtcgtcaaggcggagggcgcggcgagcggcggctgttgctcgccattcggccgccactccttcgtcgactccttcgacccgggaagatctgcgtggggggccggacgcccgcgccagcatcgagcgccggcgtaatgaccgacgtgctgcccacgcaacggagggcgcttcctcgtccagagtgtcacctcgacacggacgcggggaccagccctccgtgcccccggttggtggtgtcggctgtagagcctttgtggcgagtcttcggaatgtccattggcccccaaggttccggcccaccatcgccgaaaaatatgatggcagcgtcaaccccgccgagtttctccaggtctacacgaccgggattgaggccgccgggggtgacgacagggtcatggcgaatttctttcccatggccctgaaggggcaggcgcggggttggctaatgaacttgccacctgcatctgtccactcttgggaggatttgtgccaacagttcacaatgaacttccaaggcacatatccgcgccccggtgaggaagcggacttgcacgcagtacagcgaagggacgatgagtcacttcgatcgtacattcagcggttctgtcaagtccgcaataccataccatgcatccctgcacacgcggtaatctacgcgttcagggggggtgtgcggcacaaccgcatgctcgaaaagatcgcctccaaagagccccagactaccgcggagctttttcagctcgcggaccgagtggctcgtaaggaggaggcatggacctggaacccctccggttccggagtggcagcttcggccgcccccggatccgccgctcagacagggcggcgtgacaggaggaggaagaagaggtcagtccattccgacgacgagggtcatgtcctcgccgtcgagggcgcttcgcgggccacccaaaaggggaggccagcgagcgacaaaaagaaaaaggccggcgctcccagcagggagcgcccagccggcaagtggtgcaccgtccacaacacttcccttcacgacctcgcggactgccgtgcagtcaaaagtttggctgagcggacgaggaaatgggaggaagagaggaggcaggagcgccgagagggcaagtccccggcggttccttccggcaatcggcgaagtgaggccaagcagaaggcccccgccgaggacatcgatgacggcgatgatgacctaggtttccaagagcctggggccaccattgccactgtcgatggaggagcgtgtgctcacgtttctcgccggagcctcaaggccatgaagcgagagcttctggccgcggcccctactcatgaggcgacgcgccgggcgcggtggtcgaggttgccctcactttcgaccagaccgaccacccaccgtgcgttgcccggggagggcagattgcgatggtggtttctcccaccgtttgcaacgtgaagttggggcgtgtcctcattgatggaggagcagccctcaacatcctttcccccgcagcctttgatgccatcaaggccccggggatgatgctccggccgtcccagccaatcatcggtgtgacgccggggcacacttggccgctaggtcatatcgacctcccggtcaccttcggtggacccgccaatttccgcacggtgcgggtgaacttcgatgtggcggacctcagtctgccctacaacgcggtcctggggaggcccgcgttggtgaagttcatggcggcggtccactacgcctacctccagatgaagatgccgggccccgatggccccatctctgtccatggcgacctcaaagtcgcgctcgcttgtatggagcagcgcgcggaccgcctcgccgtcgtgtccaagcccgagggtggcgacgagaggcttggcacatccgcccccgccgccccgaggcagcggatagtcacgtgcgatgaggtcccggtcaaggaggttgtcctgggcgacggcccgtccaagaccacacggatcggtggtctcttggatggcaaataggaagacgcgctcgtctctttcctgcgggcaaacgctgacgtcttcgcatggagaccggcggatatgcccggggtccccagggaggtgattgagcaccgtctcgccgtacggccgggcgcaatgccggtccggcagaaagtgcggcgcccgcataaaacttttgagagcctccgctccgcccgcataaaactgaaccccgataagtgcgtgttcggtgtacctgcgggcaagcttctcgggttcttggtctctgcccgaggcatcgaggccaaccccgagaagatacgagctatagagcggatgcgcccccccagcaagcttagggatgtgcaatgcgtcaccggttgcatggccgccctaagtcggttcatatcgaggctgggagagaaggcgttacccttatttaagctcctcaaacgctccgggccgtttacttggacggaggaggctgaacgtgccctcactcagttgaaggcgtatctcagctctcccccagttctagtcgccccggagccaaatgaacccttgctactctacttagcggcgaccccacaagtggttagtgcggcgttggtcgtggagcgcgatgaggacaatcctcattccgcgcacccccaccttgtgcagacttggcccgggagagagcagggaggagaggcccccgagccgaacggtggcccgaggcccccgacgaccggagatggccctctgcccgcttgtcagacggtgctaggagcccccgacccccaggaaggccccgaggccactgcgggaaggccgcacctatcgccctctgaccccgaggctaaccctgtgccgatttggcccgggagagagcagggagaagaggcccccgagccgaacggtggcccaaggctcccgacgaccggagatggccctctgcccgcttgtccgacgacgccaggggcccccgacccccaggacggccccgaggccactgtgggaaggccgcccctgtcgtcctccgaccccgaggtcgtcggcacagaagacgagtgcgccccgcgaggccgctcgggtgaagagcgccccagggatgcggcccctagcgaagaggatcggccccaccgaaaggtgcagcggcccgtctactttgttagtgaggccctccgggatgccaagacccgataccctcaggcccagaaaatgctttacgctgttctgatggcctcgaggaaactgcgccattatttccaggcgcatcgggtcactgtggttacgtcttaccccctcggtcaaatcttgcataatcgagagggtactggacgggtggtgaaatgggcaatcgaactttctgagtttgatttgcactttgaaccacgccacgctatcaagagccaggccctcgccgactttgtggcagaatggaccccggctcccgagctcgtctcggtccccgaaaccggctcgggtccctcgcagctgcctcacaccgcccactgggtgatgcagttcgacggctccctgtctcttcagggcgccggtgcgggggtcacgttgacctctccgagtggagacgtcctcaaatacttggtccgcctcgactttcgagcgaccaataatatggcagagtacgagggactccttgccggactcagagtggcagctggactggggatccgccgcctcctggtgttaggcgactcctagctggtcgttaaccaagtctgtaaggagtaccggtgctctgactcgcagatggacgcctacgtgcgccaagtacggcgtatggagcgccattttgacgggattgagcttcggcacgttcccagacgggataacatgatggccgacgagctctcacggctcgcgtcttcgcgagcccagaccccaccttgcgcctttgaagaaaggcttacccagccgtcggcgcgacccgaccccttaggggagacggatgcgcctgaccggcccccgaggcccgtcggagtccaggcctcgggacccgaggggagtgctcccagctcccttagattgattgcttggatcgccgagatccaagcatacctcacagataagactctacccgaggaccgcgaagggagtgaacgcgtccatcgcatctccaaacgctacgtgctggtagaagggaccctctatcggcgcgcggctaatggaatcctcctgaagtgcattcctcgggaacaaggcgttgtgcttcttgccgatatccatgaaggcgaatgcggagcccactccgcctcgcgcaccttggttggtaaagcttttcgccaaggtttctattggccgacagctctcaatgatgcggtcgacctggtccgccgatgtagagcgtgtcaattccacgccaagcaaatctatcagccggcccaggccctgcagaccataccactttcgtggccatttgctgtctggggactcgatatcctgggaccgtttaggcggaccccgggcgggtttgagtatctgtatgtcgcgatcgacaagttcactaagtggcccgaggcttatccggtcgtcaagatcgataagcactccgcacttaaattcattaagggcatcacagcccggtttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcggaaatcctcaaaggtcttaaaaccaagaccttcaacacactcaagaagcacggcgtttcatggatcgaggagttgccagcggtgctctgggcaaaccgaactacaccaagccgagcaaccggggaaacgcctttcttcctcgtctacggcgcggaagcggttctcccatccgagctcaccctgaggtcttctcgggccaccatgtactgcgaggctaatcaagatcagcttcgcagagatgacctcgactacttggaagagcgaaggcggcgcacggccctccgagccgcgcgctaccagcagagcctgcggcgctaccatcagcgtcacgtccgggcccgatcactctgcgtcgacgacctcgtcctacgccgcgtccaaacgcgtgctggattgagcaagctctcaccaatgtgggagggtccgtatcgagtggtcggcgtcccccggccgggctccatacggctggccacgggcgacggcactgagctgcctaacccgtggaacatcgaacaccttcgtcgcttctacccctgaggggggagttgggtgtcaggtttcaggctcgggccaaccccgcaccccctcgggcgtgcagggttggccgggggctgccacacatgcactttcttatttctcttatttcagaatttcaataaaagcagtttcaatttcctaaaggttgtatctgtgctgttttttccttttgaagaatcttgacttgaaataggtcactcgcgctcaatcctgccctcgggggctcgggtcggctaaaaatcgccaaacggggcccagaaccgagccgtgccccgtggcgtggtgaactccgggggggggaatcggcaaaaacccacaatcgggtcacccataaccctcggtcaccacgttcccggcctggccagtctcgacatgtggatctccccaggcactagccccgacccgcgccttttgaggaccagaacctgggcacgagcccttattcaagctaagacacaaaaggaccacggcacagatcatcctcatctcatacacatagcaagatgaaattaacacaaaaatttcttcattttttgattacagattaagttgatctatacaaaaaagaggcccgagggccttagaagaaagaaaagaagaaaaaactgaagaatggcgggggtctgggggctcattccgatgcgcccggatcgccggcctcgacgtcactgtcgtctgcaccaccggcattgccctcctcgtcggagttgggggcaaacgcaagccgaggggccgagccctcgaagctgtcgacgatatagtcggcggcatcccggacttgcgcgcgcgcgcggtcctcggtcccaggagggaactcatccagcgccatccatggagagaagttggggtccctggcctggtagctcgccaggacgagctccaccgctccttgggcgaggtccctcgaggatgacttaattgtcttctcgagctcctcgggaagccgttggagggccccggccatcttcgagaggtgctgggcgaggcctccctggttgtcggcgtactttacggtctgccctctccagaggcccacctgccgaccggcgcgatctaggcgggagacggcgtcccaaagcatgccgggcccgacctcgcctgccaagcggagggcttcgacctccccggcggatgagtccagcgcgctctgcagaccggcgatggtgtgttcggcatctgcgaggcgggcggctaagtcgctttcgcccgcggccgccccgccgctgcgcgccctcgcgtccagctccttcgcccgcgcctcgagctcagcggcccgttggtttagtgcggccctctcggcgcgggcaccttccagattgcggcgcgcctgctcctcctgcgctgcctcgtggagggacaggctgtccgccagctgttgcgccgcggcctcgaccccctcgagagctcgctcccgctcggtgagcgcgtcctcgcggaggcggagcacgagctcttcttcggcgcaggcagcctcgtgcgccgccagtgtcgcttcccggatggtgacagcggcctcgcggtccgccagatccctctccacgacgcaggctgtcacgtcctgataaattcattccgaaataaaattcattttctaaaaggaataatagaattaattaaaattcgaaaagaaattggcaaacactaaaatacgtacaagaaaaattcgaatgtggtccggagaatttttgttaaattctccttggtctaaaaggagccctcaaattttacttgaattttcagagcatgggaattatttattaagcaacaacaaccttgatcaaagtttattaaaaagaaaaagctaaaaataatccccctcctccctttgggccaagtctggcccaaggtttctcccctcttcctctcagcccggccaaaagtttgtttaacctcccccgcgctacagtgctccttcttccagctcaggcagagcccgagctctccagccgtgccgtgcacagtgccgccgcctcctccttccaaatctcgcctccccgttgctccttttttcaaattagttgcgggaatggaatcctctcaatctcctcttccttcccccaactttccccctttaatcccgcccccaatcaccgggatttaatccctcttctttgaccaccattgatgccgccggccacctcctccggcgccgttttcggcctctcccgtgaccggcactccgtccttgccctataaaacgaagccctcctccttcctttggtccattttgctctctcccgagcccctagccacctccccgccgccctgctctctctcccacgccgccggccgcctccagccgcctgtgccacctcgcccgtgcaccgtccggccgtgccgtcgcctcctccagcgtcgcagccgcctcctctcccacggcctgccctccgtttcgcgcagtgaccgccggaggcacgttcccgccgtcgcccttctctttcctccacgccggccgcctccagccgcctctccctcctcgccggagcgtcgtccggtcgcgccgtcgccgccagcagcgtcgcagctgcttcccctccaccggcgtcgcctccgtttcacgcggagaccaccggaggcgcgtccccgccggcaaccagtggcattggtgccactgtactccctccagccggctgctgttcgtcgccggtacgccgatcgacgtcgccgtctcctccgtcgacgtcgcagcgtcgtcctctcctccggctgctcctcggtttcgccggaacaccgccgtcacgcgcgccgcctctccctcggtttcgtcggcacccactccggcagcccctttcgccgtgccagtgcgccggccgacgtcgccgtctgcacccccggcattgcagcggcaaggtcgccctcgccctcgccctcgcctcccctccacccgaacgccaccggtgtccgtcgtcgtcttcaccgttcattctcgcccagttcgtcgtctcgcggtgccgcctccgtcgtgggcatcgctgcggcgtgttccacgccgtcctcgtctccgtgcagccgctgccggctgccctcgtcgcctcctcgccggccccggtcgtcgtcgtcgtcgtcctctcgtcgttcccggtcgtcgtggcgttcgtccctccgtcgagccgttctcgtccgtcgtccgcatccgtcaagcaagccgcggcagccccgtcctcgtcttcgtcctcggctccgcgtcgtcaagccttgtccaaggatcgccgccgaagtcgttccctcaccgttcgcctccgtcgtccccgagctgtcttcgccgcgcccgttcgtcgttgtcgttcccacgcctcgtcgcgtggtggtaaggatccgtcctctcgcttccccgccctcgtcctttcggtgtcgccccgtacccgttgtgcggttgtcgacaccgatacccgtgtaccggtgtcggtagtcgttcgcttgtgggtgtggtgaccgtgttagtgtgcccgctcggtagccgcgtggtttctacgtgtgcagcccgtgtggtgtctagtggagtccgtttgttggccactcgcctcggttgacacacggggtccgcttccgtcgacccgtggaccgtctctgtgtactcggtctaccgtggtcctttaggttgacatgtggggtccgcatgtcaacagcgcagccttcctgtctcttccaggctagcgcttacacatgttttataattgcaaagcttaattataataatccgcaaatctccatataacagcactaaacttcggatgatcatatcttggtcatacgaactccgaatcgacccgttcaagtctcttaatgtttgttataacctaaagaaccctgtgctttctttttatgtattgttattgcttctttttaggcttgtagctttgcttgtgtgtttcgcgtagtcttcgtcgttccggaggttcccgaagcgtggttcgtggtcgtcgctgaaggttcggaaggccgttctctctgagcaaggcaagtcacatcatctttgaacatattgaatcccaatttataaaattatgttgatttaaattattgcattatcgctttatttaaattcccgcgttatcactgttttatctagccatgcctatttacctttgttatgaccttattattgttattgttattatttccttgttcaccctagagtaaacaaaaccccaactagtggacactctactcatggcaccactagtttaattttaggtagatgcttcgcaatttaattaggtaacattaggtggttttacaactctagactttgggaatattcatatcatttggacactatggaatggttggcttatggtggaattggacatacacctctcttcctctttcaaaacccctaaaacctgttttccggtggggtttgggtgcatgccagttgtgggaagtagcaccccggccactataaggattaagctcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggctggtgtcctgctgctagggggctcaatcctgcctgcctgtcccgggggttccggccgtaggtggggttgggtcggtactcttgtttatggctaggatgggttgggaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaatttgctcaacaactaaaatgtggaatggttggcctgggttggcttgggacgagctgggacccagggtcgggttgccagttcggtctgaatcatcgtaggccttgggttaaggcaggttcgtgtgggttcacggccttgattaataatactgtgtagctctaggatcgtcttataaaatggctttgggcaactaagtgacttttaaatgctgttttctgcaaagcttaacccctatattattaccccttgtatccccttgcattaatcatgcatctgccggtgtggcttgctgagtactgtggttgtactcattcttgctcaatcttttcccccattcagtaagagaagctttggagaagaagtcttaggtggagtcctggcttacaccccagttgagcgcctgtgaagatggagccgtaggcccgctagtccgctgctgtttattttttgattgccaggtctaaagcgcctttgtaataatgtaaatattatcgatataataaagatgtgccttttgtatcatgtttgtgtggtgtaccccggcttttcctgggatggggattaatacactagcgttcgggaaaaggcaattttctcggtcgcgacacaggcgcgctcttccagcgccatggcgcgcgcctcgagggtctcttcgcgccgccgggacgccgcttcggtctccgccgcccgctgttctcgggcagcggcagcgtcaagcaccccctgggcggcgtcgagcttcttccctagctccgcctcccagctcccgtattgaaggcggagggtgtcctgcgcctcgttcattacggtggtggcaatgagggcagccccccgctcctcctccacttccttggcgatctccgccaacaccttcttacgggtttcaagctccgagacatgccggcggtgagccttacggcccacctccaccatggcctccaccgagcgtcgcccctcttcgacgcgcgcccacgcggcgtcgagctccgcccgctctgcctgcagggcctccacctgggcacttaacccgtccaacaccgtggtgtttgcggcggccaaggcttgcagaaggggctctgcgctcagtagggcagcagaaggcgtggggaaaagtcgcctcggagaagatgccgcgcggctcggcccgccgatggacgtgccagacgcagggatgtcctccggacctggttgagcctgagcgtcgcccgagggagtgggcccaagcgacgcgcccgcagcttcgtcgccagctgccccggaagttgtcgcctgagcgtcgcccgagggagtgggcccgagcgacgcacccgtggcctcgtcgcgaactgcctcggaagtcgccatcgcctcgtcctggcgaaatccagcctcctcccgagcggcttcctcggcctggtgggcttgggcagcctcctcccgagcggcttcctcggcctggtgggcttgggcggcctcctcccgagcagtttcctcggcctggtgggctcgagcagcctcctcccgagcagtttcctcggcctggcgagcccgggcggcctcctgggcggcctcctcggcttcccgtaggcgatccgcggcctctcgccggtcagcttcccgcctgcgggcctctgcggccgccggatcctcggcctcaggctggccggacttggaatgatgggagggacgtgacgggatctcgctgaaacaaaagaaaagaccagaagacgaacaagatgggcgagtgaaaactcatgttgagagaatgaatatagccacgatgggtgagagacgaacctgcgagggggtcggttaaacgaccactttggaggggaaatgaggtttccccgagatggttctgtctcctccatcttgcggggccgcttcttcttgcgctccccctcgagctgcgatgctggcgcggccccctccgggcgcttgctgctggcacgcgccgccccgccccctcggggaggagaagggggaagtgttcctccctgcttcctcttcccccgggcgtcggcagggcggctgctccccgggcccctgacacgggacccagaagcacgaccccctctcggggtagattgctccccccggcggctccctcctgcgccgtcatggccctttggagctcgctcctcagaggccccgacccccatcataatggtcaggatcgaggcgcggtctggatcgctgcagagggggaggattccttggggaatgagggccgcctccacggagttgagattcagcacccgttggaccaatatcttgaagtcctcaggagcccagtcccatctcactccctggtgggtcctcatgtaatcttcggacccggtgtactcccaggcgccccgagcgcgccgctggagcggcgcaatccgacgacggaggtagtcgccatacaccatggcccctgtgagccactgggatcgcaggcccgccaggcggtcgaggacggcgtcatagccatcccccagatctaccggcgcccgccagctggaggcctgcgccgggggctggctcggaagtcggaggcgcgcttcgtcggcgaggggagtgtagaaccaatcgctcttccagtcgtcccacttcttgcggagggcgcaggggatgtagcggttcagcgccggcccccgtggctggaagtagcagccaccgactaccgatggcggcgacaccgactgcacggtgaagaaccaccggaacagccgaagagatgggcgcaccccaatgaacatctcgcacagatgcgcgaagatggccaatgtcatcaccgcgttgggggtgaggtgcgccatctggagatcgtagaactctagaacatccatgaagaaagaagaaaatggcggaaccagccctgccattgcaaaagggagaaagaagacggaccgccccgggtagtctggcgccgagcgtccctcgcccagcgtgactatctcccggccggcggcagattccggcatgaagcggcgcggcagcccagcctgcctctcgctcacgatgcgggagggcggcagcacgctaccatcgagcagagcggagccccgtgccatggcgccggaggaagagaagattaagagcgagcgcgtgtggcgagggtagggcgcaggaaagaaggagttagggcgcaagcggcaaagacaaggggaataatggcgaaaggaaggaaacaaatcccttcctcagtgcctttatacccttgccaacgctgtgcccggctcctcgtttctcgcgcccactatttcgccccctcgtttctcgcgcccacgcttccactattcccattcgcccgcttgcggcgcatgaggtggatatgcggttgtggcggtcgaggtagatcatatcgtgcgcgcgttaattacgctcgccaaccgaagcgacgttaccatatcttcagatgaaacgaatcgccatgtccagattcgtgtgctactcgagtaatgtggcagtcttgaagagaccgctcattattgacagccgagttaccattgccgatgtgcgtgatttttgaccgttggttttctgcccaattgtggagaccggtcccacctgtcaccgggccttaggagtggcgtcacgcccgaccgcttcccttgaggagggcgatcgccctggcataacgccgggggctactgtcggtgacatgggatcgggagtatcatgactagaggtttgaggcagacacagtcgcccacgtggcctggcaccctcgggggacgtcgggcccgaaggtggtgtgttcgccctcctcttagtccccccgagggggtcgggctgcacccccctcggccccgagggccgaggcgccccgacccctcgtgggttttcgctccgcgtgtatggggtaggtgagcacagtggggctcacctaaccacatttattgcggtttggctgagcgtgtcacgacgcatgtaacgtagtgcattgcactcatttatccagtctgtgaccagtcacagaccggtcagatcgcgggattaggtggcgacaggcggtctgacgcacgcctcgccccatcccgtcaggacgagggcttctaggtgctcgtccccagctggagctagcgtgttacctcccagagatggcacgttagccctgatcagatatatgccaggcttcatcctaaccattacaggcaaaatgtagtgtgaaggagggccgacgtgcagattgttaagctgacgcgtggaggacaagaatgaccgatttgtgaccattctgacaccggtcatgtcgccagcagacagccatgattctacgtcgcgcctgctcccggcgaaagtggaggtaggtgcgggccgtcccatcagaaggtgactcaaacggcaaccatgcagatctccgtccatttatgaaaaggtagggtaagtccccataaaaaagggggatgggacatgtggtatccccttaagatataaaaggaggaccttgcccacggagagaaggggagatagattttgggggagagagagctttttcttggactggacctttccagattaggagcccataacaagggagaggctggctgatactttgtagctctttgatacacagatctcccaaaaacacaggagtagggtattacgcttctcagcggcccgaacctgtatacatcgccggtgtcttctgtgcttcctgtctcgcgaaccttccacatacagattgggagtttagagtttcacccagggtccccggccgaactggcaaaggggggccagcgcggtctcccggtgaggagccccacgctccgtcacatctgttgcatcttgaaaggaccttaatgtcgcctagaggaggggggggggggttaataggcgttcctaaaaattatcacaacctcatagcatattagagagatgagaacttttggttcaaattggaacttccggtatgggattggaagttctggtctcaaccgaaaagtttggcggataatggaataaaacactagctatgaacttgtagctcgaataaagaaaatgtatatgaatcagaaggtgacaaataaggtatctaagcaagatataaggtcaccaactatattaattaagcatgcaagtatagatcgggtaaaaacaagctcaagcacaatatgagagatggcaagaacgagcaaactaagagaggagacacattggtttgtttcccgaagttcggatccatggatcctaggtctccgttgaggggccactctatttcaacccttacctcacgaggttgcacaaatgcactcctcggtttcactcttgatttcttcccttgcagaggcgaaatcgaagccttcacaaacttcccgtggcacaccacaagcttgggtgctcactggcgacgcctagccgtctaggagaccttagtccccaagagtaacaaacacaatcgaagatttgcttgctatgaactcgagtgctcaaagtatggagtgaagttcacaagctctcaacttctcaatctctcaatccaactctctccccttctcaaatccctctcacaaagaggaaccacaaaggatggagtgaagctcactagctctcaactcctcactctctcaatccaactctcttcccttctcaaatccccctcacaaagaggcaccacaaaggatgggaaatggggatggctatttggctttggatgtgtctaatgttgcccaagaacagcagccactcaaaggagggtggaggagtttatatacccgagcctctcaaaaactagccgttggaggcaaagacatgaattttcggaactttcggaaagcattttcggaacttccgaaaatttacagaagctaaactcagttttgcagccattttcggaacttccgaaaagcacagagtaaaacgaccataaaattttgctcgggagcccctttttgatgatcttggactctatggaaagctcacttagaggactacccaactcaaccaaaaacaaggtctaaaaccactcaaaggataggttaaagcttgggtttctctcaaggtagcactataataggtcactttgaacatcgagacatacacaaactcatcgacgttgcatccctcttaatagtacggcattcctatactcaaatataaatagaagagaattataccaataggaatgccttctttccatttccttcctttgtcttaagggacgccaacgccaaaaccgtttcaccgtatattcttcaaatgattgatgcggttacttgtagattcaaatggtctagcatggtccatcatgacaaagccatcactcgcccttcaccaccggattttgttcttcggcaccaagctccttgcttgcccttcaccccggcatggtccatcgcgaccgagcatcacttgcccttcaccgtcttgccatagtagtcactttgtatcccaaatcttcaatatcttcgctttgttattcttggtattttaggtgtaatcatatcacttgagcgtcaacatattttcaatccttggaacctatttttctcattcaacttagtgaaattattagtctcaatgatccggttgtcaacctccacatgttgactaaccgatcgcatgtataaaaggatatgaataaatgatgagtattaatcaacaccacaagtgtcatatactcaaatatatgctcaaatgtaaagatcccaattaaatgaaagtgaataacttggatcaaatacatgcataactaaggtataggatttgcttcccctaaatgtatgcataaggaatatttgtgtgaagcaagagtatgcataaatagagatgaaacattgggagcttatcctatataaaaatagaaggcatttctcaaatacagatattaaaataaaaacataccttcatcatctccacgttctcaatgtaaatagactaaataagagataagattcaaacaaaatattagtttcacatgcatatgtcaatcacgtggaaatattatatatgaacatatcaatatgtacatggagagaaagaatgatacatatagcttgatcttcatacatttcatccttgtgatttaggtccaccatcaatgaacgtttctatctcaactcatatgaagtccgtgaatcatctctcacacactccacttttatatccatatgagactagacaaagaaatgcttacaacaatattagtctcatggaattggatttgtcattaatcaccaaaaccaaattaatagcacttgaactttcacatctgttgaaccagtttctccatatctgctttttgctcatcggacaaatgctcaaccgtgactgggatgacgttcttctcgtcgatctttgtgatggacggtgtcatgatgaatggtgaagtggttccactgggcatgccaaaagcgtgttaatgtgaaacacggctgcctgagagatttgcttcactctggtgcaggtccaaaacttgcctcgagtgtcaagagtgtcacgaccggaaataacccaacatgcgttccttacgtgcgtgtattattccttgtcccaggaggcgaggtacaccaaaagttgatacaattcagagtttaacaagcggaagcgtaaatagttaattattacatgggcaacgaaggcccagcacacacgaagacaacgaaaaacagcggaagactagggtgacgaccacaggcgcttgacggcaggcacgagctagacaccaaagccttcatcatccaggagctcctcttctgggtttgggaaaaattgagtaagactgagtacaaccaccgtactcaacaagacacacccacaagtgcagagtaaatgcaaaggagtacaaaggagttataatacagggggttagggtttgcagtaaacagcatttaaaagacacttagttgctcaaagctaaatttaaaacacgatcctagaactatttgatattattaaataaggccgtgaacccacacgaacccgccttaacccaaggcccacgatgattcagaccggactggcaacccgaccctgggtcccagctcgtcccaagacaacccaggccaaccattccacattttagttgttaagcaggttttaagaattaaaacactaacttgggtgcattgcttggcttgcccataaccgagggcgcggctattcgaataggttttactctgatcagaggtgtacatctttccccacaagacacgtcttcctcacgtgcagccacgtgccacataccaccacggcatatggacggaagacatgacatagtttccaacccatcctagccatagacatgagtaccgacccaaccccacctatggccggaacctccgggacaggtaggcaggactgagcccctagcagcaggacaccagccctgtgccatgacatctcgactaccgggccgcagctcgtgtagccttcatctgtcctagagatgtccattgacccccgacttcgtccatctccatccgtgtacttttgtttataaccagactgagccacaaactaagccttacccactagacatgtggaagtacggtagtactttgcaacagaggcccgaagaccggtccttatgtggccgaggtgctactatcaaaaccatgcaccccaagcctagcctaaaaccattttgagggttttgaatagagggggaggtgtgcatccagttccacaataatccaaccattccataatgtccaagcgatatgaatatccccaaagtctagaattataaaatcacctaatgttgcctaaataataagcgaagcatctacctaagttcagactagtggaaccatgagtagagtgcccactagttggggttttgtttattctagggtgaacaaggtaataataacaatagcaataataaggtcataacaaaggtaaataggcatggctaattaaaacagtgataacgcgggaatttaaataaagcaaaaatgcattaatttaaatcaaaataatttcgcaaagtgggatccaatatgttcaaagatgatgtgacttgccttactcgctttcccaaacgtcggcttcaacctccacgaagagcggatcttccgaagctgcagcgtctacacgatcaacggaaaagaaaagggcttttactctaataaactccatataacaagcaagaacaaaacacaaaaatgggttcttcacttcttaaggaaaaattagagacttgaacggtccaattccgagttcaaatgcccaagttatggctatttgaagtttatatgctctttacatgaatatttacgaatttcttcatttaaattttaatttaaaaatggtttattgcgttagccgagggggaggggcgcgcggaccgggtccacgggagtggggcccacgcggcagcctcacggtccacggtggaccgggtgcacccgggctcacaccggccggcgccgtgggccccacgcgtcagccgcacccgagggcgtgggcggctgacggccgggccccacgcggcagccgctcggcgcgcccggaggcggccacgtcggcgcggcggcgggaggcggcgcccgcgcccctatggtcgccgacagcggccataggcacagcggaacggcggccgagagaggggaagggaagggggaaaagaggcggcggtccccggctcaccccgggtcgacggcgatgacgaaagaggcggccggagcggaggaaggcggcggcgcggctcgggtggacggggacgacggtgttccggcggtcggcgagctcggcgaggtagtggacggggtcggcggcggtgcggcgaagctggaggaggcgacgccggggcgggagacggtcccggcgagcgaggagggccggccggaggtcgtcggcgatggaggagggagagggcgacggcgcgagctcgaatccggcgaggaggaagggtggtgagaggcggaaacggacgggagaagcgcggggagagtttaaatagggttggaagggggagagggcggccggggaggaaggaaaccggcgcgggaggtccggccaccatcaatggcgccggcgagatttgtgggagcaaatccgcccgtttgaatgagagagagagagaggggaaaatggggggaaagggagaggggatcacggggagtaattcccccctattgatttcacgcgggggcgacgggatgcggcggattcggcggcggcggtggcgctaagcgcgggcggggcggcaggagcagcgggaggaaggggatgacgggtgggccccacccgtcagcgagggtggcgggcgggccgcggggaggggccgagtgggccgcggggaagaggagagagggggagggaaatgggccgagccggcccaagagagggagggagggatttttttagggttttttctttttatgaaatcattttaactttgtttatttcttaataattattatttgtgctctgaaaattccactaaaatttatttacacattttaggcttttaggaaatattaaaaaatcctccaagccttaattgacttttaactttgcacattttaatttttgaaggctttcacaaggattttaattattctaggcataatttaaaggatatattttagggtcgttttgggacgcgacaaagagcgtgccaactggtttgatcacagaaaatatagttagcttcacgatagccgatcgctcgataagccgatgacgtattgtttaatacctagccgatacgctcaaaccagatcggctgtatgtttatgataaaacagatagggcaaaactctaaatatgttctatccgctataatattgtccttttattttttgtcagtcaattttggacaatactataaagagccgattatccaatacttagagcaaagtagataaagtaccggatattactccaattaaccttatgtaaacaaatcaatctcagatacaatgatgtaatcaagattgattaagacttgatatatttagatagagtgatctctctatataagtggcatatatatatatatatatatatatatatatatatatatatatatatatatatagaactactatacagcaccctaaggtgctaagtattaaacagcacctgatacagcctccaaccccaaccccacccacccacgctcccaccaggtccatagtacgcagttaaaatttaactcacagacgaccaattttaatcccacccttgcacgccctcccctcactcccatagtccgggtaaattttttacttgatgttatccaacttcttattagttctatatatagttaaaatttaactcatcgacgaccaatctcgatcccacccctgcacccctacccccactccaatagtccgagtaaatttttaactcgcgcaccactaagagccacccccacaccaccctgtcaacgctcctgcccaaacaatagtaatttttttactcacaccaatagctctatttataccatccataaccatctcactgtatccaaacccccattcatactcccgtcctcttccatttttttcggatctgagaaattggggattcagcggcgacgggtgaccggtctgctcgtcggggcgatggtgtggaggccgagctccgagtggtggcgaggagatccatcagtgaggggtggcgtcatcatacacagcgcgtgtgtagcatcacgaagcaaaatagcgcgactctgagcgcttccttcccacaccacatccggattttccgttttttctctgttccgcttatccaggtaccaaggcccgtatatatatctttaccaccccttccatcacaagtaaaaaaatttctgattcaacataacactgagtaaaaaaattacttctatctctaccctaatttgaactgggagttaaaaaatcactctcgagtaaaatatttttcacattcactgagtaaaaaaattacttctatctctaccctaatttgaactgggagttaaaaaaatcactctcgagtaaaatatttttcacatcagatcagttaatagtaaaatttttactcatgtatttttttatcactttccggtgtgttcataataatacttttattcatgtctatttaaggtgcataaaatcacacacaatattcaatcgtgcaaatcaatcataccaccacagtaaaaatattatagatcgtgcgaaagatgaaaaaaaaagagatgcatatctactttgtccttctctgatccacttttttcgttccagttcatatccacagtccactttttccgttatttgcctttttttgctttttcctccgttcctatcaagtattaattcacgttcctaaccacgtaaaggttatcctctccggtttttctgtttgttaactccctttccgattttttcgttcaatacgaacacctcctgctgattccaaggaggggagtggggccttcctgtgccgcatgtatccaacaacctcgagtaaaaaaatcactgcctaattaaattaggttccgttaaaaaaattaccatgtcttttctttcataatttcatcccagtaaaaaagtcactgatcagcttactccattaactaagagacccaataagaaatgatagtaaaatagtagtaaaaaagttttaactaacatatagtaactttttaactgcaagcctcgctctcacagacccacacattcatcatttagtgatttttttttaccaatcacaatgacccctatatgcatcgtttggtaattttcttaccaacacgacacatgtatttgatttgcttggacaatgaataataggaattttatactccactatgatatgtggattctttttttttaataatacttctgttgcatccagtcatacagtgaatcacatgtataaaataatcacacagccctggtggaaaaaaaatacagaatacacaaaaaggaaacattggccatcggcagctctcatcggcatcggcaaagagcagcacgcatctgtcgccggttgtatttgctgatctacagcctagaacattttgcatccactctcgatcggcatgggtacgttggacagcccgggggcgtgcggcgattgactacaatcacggcgaccggcgcaagcagcaccttccaggccaccgtcgatgtggattgaccacgatggagccgtcgaggcatcggtcctcctctgcgttgtcaaaaatactaaagacaaaaaaaagaaacacggaaaaaaaccaaatatgtgctgccgatgacttgcgcaggcggcgcctcgctcctgcagctgcatggccgctaaaccgacagcttgtgcgagatccctcacgccgccgagagtgcctcccacggtcgagctcgtagttgccgggagtggaatgtaatggagccgctcgtggtccatgtcgctgcccatgccgtcggtcgagcttccaccagcttcggcggccacctctcagtccacatcaatggtggcatggaaggtgcttcttgcgccggtcgccgtgattgcagtcagtcggcgctgcacggggttgacgagagacgatgcggccccatcatcttcaccggcccccaccgccgctgcttcttcaccgcatcccagctggtccagccatcttgacggcaggctaaggcgttcgacggctgagtcgatggatccaaaaaattcggggattaggggttggatggttactgccggatagaaacgcatataaatagatggtgccatacatagtaaaaaaattactatcacgttttttcagggatcgcttctaaggtgggattgggaaggatgttcggtacgcctgcagtaaaaaaatgggagtacctatacatctttcgaaagatttttatgatcgtatcacactaaattaccatatcctcaagaaaaagaccaaatccaatacaaaatttaaaatttacatgcgaggattcaaaaattacagtgtaacttacaaaagttacagtgtaagtttcataaattacactgtaacttacaagaaaatatactgtaaatttgagtgagaaaatcgagtgagagataagaaaaaatctttcgagtgagatatagcaaaatcgtaaaaaaaactttggtgggtgcaggcggggtgggctgggcctggtagggacacgcaaggaaactctgtgagacgtgttaactaactaggtagcaccttatagtaccatatagtagttttatatatatatatatatatatatataaactattctacacccgggcatagaatagctattctatacccccctcccaacggtcacatccacttccccctccttaccaaggcctaaaacccacctcccacctcggtcaaaggcccctcccaccgatcaaacccgcctactaactccccccaccacccacctcttctcagctctcgtcccaggatggtgcagtaacacgacgaccactgtgcagtaacattgtgtcttacgtgcagtaacagcgttaaaatatagttgaaatatagttatgacggatctacctttgataagctctttttttctaacatcatggtgtaaacggttttaaaaaaccttacatcacttgggagatattgttcttcaaagcttgacttttttgcaatttgtttctccacaagtagtaatactatactattacttgttattacttgtctgttgtacgttactacaatcacatcacgatgttactacactgcgttttactatattttttgggtagtgttactgcataaacacgtgataacgtgtaccttccgtgcagtaacccttttacttttgtgcagtaacaagtatatggttagcatctgagacttttaacctatatatttttgtttcaattcctaatttactataattcaccacaatattactgtcacatcttacacatgcagtaacgctatattggagggaggagaccaattttcttgagaagagggaggaagaacggttcttgaggaggggagtatatagatgcatcttgaagtttaatccttcacatgcagtaacactataacatcatggtggaaacgattttaaaaaataatacatatcttgtgagatattgcttttcaaagattgacattttgaactttagccctccacatgcagtaacagaatgtgtaatttacagtaacaggggtatatacatgcagtaacatggttttaccaaatgtataaaattgttcaaaacactcctacatcaatcagacatcgctcaaagccacctacagactttacctatggcccacctatttgatcttcatctcgtaaaaatgacacagtaacactgcatttatcatgcagtaacatagctacttagaagtggtaacatgcacctattatgtagtaacacttctacttttgtgtagtaacaagtatacggttagcatgtgaggctttaacccatatatttttgtttcaattcctagtttatgtagtaatactattcaagaaatgcaagacactttgttactgcaaagcttattgtctttactagactcttatattaacgttgtgatagaactgtagtaacgcacagtagtaacaagtaatgctattgtattactacttgtggagagtcaaattccaaaaagaaaagcttttaagaacaatatctctgatgtcatgtatggttttttaaaattatttgcaccatgatgctagaaaaaaaatgcttaacaaaagtagatccatcatggggtgggctgggccggacttgctctatacatatatatacacacacacacatacatacatacacatacatatacatacttgtaaatatgaaaatacaacttcatgtttatagttcaacgatgggcactaagttttacaacaagcgtatatagatcattatctggccacacaagtgcgcaagaatattctctcttttattttgcgacaggaatattcaggcatgctatctaaatgtatattagttgaattacgttctgcagtgctgtgtttggttcagtctagtgtagcagtcttttgtttccatccaagatatgacgtcctgattgtgtgcagtttgctggctatttgtttcatgttggctcgttcacttggtaactggcgcgtacaagaacgtgccaatcctagcagagacaccatgcattggtagaatccactctcttcaaaaatgcctggttgatcatagtccttgcattcttctttcagatgatcatcgatgatatctaaaacttgacgtggagcactgttgtttacatagttgatgatgtcgagtccgtccttgaacataggatcagttggtcttttccctgtgataatctccaatagcactatcccaaaactgtagacgtctccagaaggtgacacatgaccaccatgtgcatactctaaaagggtgcatacagaaagtattgttcgttacataaaagcatatatgtgtactaatgctagcctgtgtaagtgtatggttgacgacttttatattattaaaatgcggaaaatcacaaacatacctggagcaatatatccgattgtgcccttcagaccgactgaattaactgaacctgctgttgtagagaaagaatcaacataaaaccttgcaatgccaaagtctcctaagagtgcggtcatgtcatcgtctagaaggatgttgctaggcttcagatcacaatggacagtaggccttccgcaatcgtggtgtaagtaatccaatgcatcagctacattaacagcgatgctcattctttgagataagcgtagaccttttgaagcttttccgtccactctgtgatgcagccatgaatccaagcttctctcggcaccacgcatttcaagattgaaaaccttcaccgccacttcaacttttggttccttcagccttcccctgtacaccgaaccgtgggcccccctcccaataagattagattccgagaaattcgttgtggcttgagctagatcgttgtaagagaccttaagaaagttttcgccaaaagaagtttgttctgaatattttcttcttggcttcttcttctcaaggattacaaagtagataagcaatataagggacatgaacccaaatattggaatcaatattctgattaaataatattgtttgctcattctatgagaaacagttgggcttgggcatgagggcatatggagatccttatttcctccacagagtccccaattgccaccgagtgaaacagatgtagcgtctgcaaatactccgttcgtcggtatttgtccatagagatgattatatgaaaggtccagactcttaagctgcagatcacttaaagttttaggaattgtacccgataagttgttatgagaaagattgagcgccaacaagcccacgatattcccgaaaggtggaacctctccaatgaaaaaattttgatccatcaaaatgttcactaaatttttacattcgctcaaagaatcaggaattccaccagtaagcttgtttgatgaaaggattaagttaactagctgcctaagcaaaccgatctctataggtatgttgccttggagattattataactaaggtccaatgatgtgagtagagaaagacttcccaggcttggtggtatgggaccttggaatctattgtttgctaaagagagtcttcccaattgtgcaagattgccgatagaggatggaataggcccaatgaagttgttgtttgcaataattagaacttgaaggtttttcaactttccaagccattctccgatagtaccaataagaaaattagaatctaatgtcaacagaattaacccagaaagtttccctatgctatctggaactattcctgaaagtttatttccacctaatactaggttttgaagagttttcgatagattcccaatcgaatctgggataggtccagttaatttattttttgctaatgatagagtttgcagagaactacagttccccaacgcatgtaagaatgcccagcttactctgtcgcttgcttcaaggtcattgttatcaaggtttagagcaagtagtcccgaaagcttaccaaaagaactgggcactgggccagtgaaaacattgtttgacagataaacccttgttagccctgaagcattgcccaaggaagctgggatgttatcttcaaacatattatcttgcaagaaaatacttacgagatttgggagcttgtcaccaatgtcaggtgctaatgccttgcctagcttattgtcacgcaaagatagtccttgaagagatgagaggttgtagaagggacgtggaatttcgcctgagagattgttgtcagccaatgataaggactgcaaattggacaattggccaagctcactgggaatggttccctcgagttgattacttgcaa

SEQ ID NO: 59789 - DNA, 4839 bp, Oryza sativa
ctctcagtttcaattttacttgtcgtttcaatttactggttctagtattcaaaattttgtcaaaatatttatcattttcatattccaagcactttaaagatgtttttccctactattcatcaatatatccatactaatactactcctcacattattttaggtaaaattggttaggatttaattaacttagcatacctcctgtttaatttgagatttatgtataacgataaataaattgaaatgaagggaatactaattaacggactagagagatatcttcatggatggatgtttttttctgaaacaaattcatggatggatgtggattattcgtgctacccacggttggttggtccctttcataattaaggagcttaactctctctatatatagtcgcagttcttactattacattaccacttctttatagggattttctaagatccatgttttactttagactatgtgtatatatgatgacaatatattggtgcgtgattgtgctctgacgatcgaatagctcaataagtcttctcgtaacattgtacaagtgcaagcgctggtcacatacatgcacgcacaacctacccctacctctgtcatgactcatgaggacatccaaggaaatagggtcgtcacatctcgagattaacaaagtcactacatatgccttattattaacgggtatgttgtctagctatcatcgaaaaaataattagccataagtacaagcacttacgttgaatctaggacttgaatatggatagataagttttatcacaagaaaatctaagtagttgagaactacgcttaatccaaatcaaaatagacgcatacgtacgtctaaacagattgaaggcctgaacttaattatatggcccagtctaagatcaattgaaaccaaatgatcgagcaaggcgcgcgcggttacaccacgtatagaacctaaccgtgcatgtgttttatagtaggacttgatggattaatttttctcttgtcggtgcgtggaattatccggagattatatccacgtgcaaactaatacctaaccaccagccagtccccaacaatatactcccttcgtttcaaaatatttgacatcgttgactttttagcacgtatttgaccattcatcttatttaaaaaatttaagtaattatttattcttttcatatcatttgattcattgttaaatatactttcatgtacacatatagttttacatatttcacaaatttttttaaataagacgaacggtcaaacatgtactaaaatattaatggtgtcaaacattttgaaacggagagagtatatcagctggccaaatgacaacagatcatcgtcgactttataacagcagatctcgaggaaaattaaagcgttaacaaagtgtgtagcaagtttctttcacgtagaagtagaccacaatgcaaaaacatttggaatcattcgatgctttcatgtgcccgcgagatatcgatcgatcgatcgatcgacattgcagatcgacgtacgtacgagagaaaaggatgcatatataatgtcgtcgaaaccgacctgatgcaaacacgtctcgtcagagagagagagagaggaatcaccagagaggggatagaatcgattccttgttccaaagcaagcaacgtacgcagctagctagcagctgggtgcacgtacgtacacacagcacaggtcagaggggacaacatggctgtatattgtagctttcggcggcgagccaaaagctagcttgattcgtatgtgtatccatccaatgcgaccgtgaatgaattaaccggtcatttgctgaatttgtacattcatattgcatgcgtgtgcacatgcagtacagatcgatcgatcgatcgagcatctgcaaatacgtgcagcgcgtgctttccttccttcaccgctgggagatgccagatgccccggccagcgacgccacactgtcgagaggcttcatgagcgtttgttccgaacagaattaaacatattcccgaatattaattagacgttcgacctgatgattctagctttcgtctacatgtacattgtcaaaactaaagcaagtccgaagaccattactcctcttactcctctcctctgtttcatattataaatcgtttaacctttttcctagttaaagttcgctatgtttgactaaatttataaaataaattagtaacatctataacaccaaattagttttattaaattcaacattgaatatattttgataatatgtttgttttgtattgaaagattattatatttttctacaaatttggtaaaacttaaagatgtttgattaagaacataaatcaaacgacttataatacgaaacggacgaagtagctagctagcaggctatatattgatctactagctacctctgtttttttagtaatcgacagtaaataatattgaataaacacacaaaatttaaccactaatttttttccttcagaatttataaaaacatgtgattctgcaccactgcattaaaataaaattcaaaatgattctaacagtatgtgctttagtgtacaaaatagaataaattagtgttcataaaagtttggataggagaatcctctgttttcaaatagtcagtgatttataattaatgcaagtgttaatatttgcattgtgaaaaatatcattttgtttgttgtagaaacaatacaatgatgcatgcaatattaaggacaatttaaatgcaggagtaaaatttttattaaagacaaagttatatgaaggaaaataaaatggtaggggatcaaaaaccatttttatgccattatatttttaataactttaaggaatacacagtattaaaaaataattatcaaatgttattgtttcccatgttagatatgtctagaacgactactaagatagtattaaatacagagatataaaggaagtctccaaactttttgtttgaattacaaacccaagggctaaagtttattacctgcatgttaattgaaggaaaaatatctgcctcgtactgcactgataacgtacagtggattgagaaaatattaattttggattcatctactagatttactagctcttacaagaggattttcagtaataagttagcactggtacttaactagcgaataacttcgcaaaattctgctagtttaatttattttcaaacaaggattctctctccaacttgtcaacaaaatagcactatatagctgacgaactcttacgttacaacattatagtcgcagggtcatcttcttcttttcccctttcgaaggcattgtcactttgtcagccttctgctagcctttggacttcaaatccagcaaccatctgaaaagttaaatggcaagtaattcagaaacagaaaagcatatctgctttgttaattagtttgttctggtgatcgtagtgcgcgtgtgcgtcgatgttatatatatatataaacacatggaggggtcgatctcaataacacacaccaacaccaagcaaccgaaacaacttgaagctatcgctagcttagctgcagctcatgcaataagctaattagaagctagcacaaagtatacgtagtaacagcaattctctgatctcgatggagaacaacaagaacagccagctgcagcctcctccaggtgaccattgatatctattaattgctcgctttctaattaatcttcaattaattaacctccgtgtatacatttgtatgacaaataccacaagctagttaacccatctctctctttatcgtttaaacttttaattgttcgtccatctctgaaatctaaactagctgtccgattaatttgtgcttaactcgcttgaactagagtactcgtaatcatgtgtgtttgtaggttacccgaggttggattcggagcagcaggcagggaagaagaagggacgctgctgtggatcatcttgccgccgttcaactaaacgtggggagacgagctttattgaaggatggtacgtatatatacagtatactccactactccagaacattatatatatattttttagataatcagaacattatatttgatgccatgcattaattctgagttaattaatctctgtttcttctcatcctggctatagggttttttttaaaaaaattttcccatcttcaagtgcgtatatatgtcacttggctagtggctatttaattactgatgtttcttattgattgattctgatttatatgcgtttgttcttaattttttcagcattgctgcgctctgttgctgctggctctgcgagctgtgctgcgactgaagaagggatatatatatatatatatatatatatatatatatatgtatcacatatttgctccagatcattgtgaaaatcgagggttgttaattatatacgcatggacgtctgtccttatacttgtttagatgagtttgttcccaatataatgttaatttggcgtaatatattatatatattgtacttctctcatgcagtacgtatatagagtatatagtacgtcttgaggcatctatatatactttcttcccttgttattattgataatatatatttatgtatcgactgtcgtacacaaaataagcattttctacattcatgtgaagatcgagtgccctctgtttttaatcatatgcatatatgctcctcttatagtgccctctgcacgcttgagagctctatcgatgattgtcggagatatgggcccgggggtatgcgaagtgaagggaagttaccttcccgtccagccacgtggctctgcaagctggccccactctcgcacctcgcgagtcacgaaagcggccgggggggggagggggggggggggg

SEQ ID NO: 59790 - DNA, 26951 bp, Oryza sativa
catgatccctatgggtttcacagatggtacttaatggggggatactttacaagtatcacacatgattctactcaaaaagtatcattaagtgggatacatgtgaggtatcacccatgatcctacttagggatcttgtcttctaacataatcctacttgggtatcatgtatcctacttagggatcatgtcttctaacatgatcctacttaggtatcatgtcttctaacatgatccctatgagtttcacgaatgctacttaatggtgtgatactttacaggtatcacatatgatcctaataaaaaaagtatcattaagtgtaatacatgtgaggtatcacacatgatcctacttagatatcatgtcttctaacatgatcctacttaggtatcatgtgtgatacatgtgaggtatcacacatgatcccacttaggtatcatgttttctaacataatccctatgggtttcacagatgatacttagtaggatgatgtgatactttacaggtatcacacatgattctacttgggtatcatctctggtaacatgatccttgtgaggtttcagagatgatactttagtaggatggtgtgatacttgtgaagtatcacacatgatcctacctaggaaaatcgtcgatcatgatacctgggtaggtaggatcatgcgttgctcagcgcgtgtctatcgccatcacacatgagactcgagtctgatcctgtacacggtgcgaggtatcagagtcctctctcgcgtcgtatcctgtgggctcatgtggtactgcagctccgtctgttgaggcgcacggacatcgactatatctgatccacgcaaaaggtctacccagtataatccacttctttaccaacatatatgtacatgaaaacagtagccacatacagagttcatatcatttgattattgtgcccctcgcaatcttccagttcaagacaaaaacagtagccacataaacaattctgaaacttgacttgttacatatgttggttgggggagaggaagggagggggctaaaaaatggcctaagcacgcatccgacactgcttgaaccgaatgagcatagaaatgacgttttggatgtaagtcattgaagcgatggtacaacaaccttttgcatagctccctatgatattctttcatgtagtcctgcatggatgacaagaatgagcagtgtgagatttgtcaagtgggggttaagctgagcccttgttcaaccttgaagagcaccttttcttctttgaaacatgcatgaaatcggattcgcttgaagcaggtggcaatgctatttcaactctgtgcacatgtgtgaaaggacaaagaaaatatcatttcaatggtgattcttcttagattgaaccaaagtatcaaatcattttaaaacagaaaactcccagccagccactgagatctacaaacatcaacaggaaaaaaaaatccaaatcatctgcatctatgactcagctgcatctgccatctctgtcgccacgcgctgccctctatgacaaaaaggataacaattgacaagcaaagcatacccggaactagaagccagcaaccgactgatgcggatttctctgattttgtttacacttcagttcacctaaaaaagtcctaagcagtaagctactagttgaatggagatttctctgtttcaagacagtgtgtacttgttaacgacaaaattgctccaagcaatatttgccttcccatcaatatacaactagaagcatttttagcgatctattccaattcgaacattttgctgcaagtatcatatcaagtatcatatgattcagcacacacacacccctcacctctggtacaaacatccccagtgaatgaacaaaaatgcatagaaaaaagagagagtattagcttactttgatttcaatttggatgtgatatgacgagccccatccacaggttggggattcaacaaaccctagaaaatacaaaaatgaagagatgttaaaatcgaaatcaggaaatcgatgaaaaaggagtgataacaatccggcccaggtggggttggccgaggcccaataacttaagattggctggaccccaacagttcataggcacacccactcggggaaaggcccaatctccctaaaagactagtccaataggggaagggtgactctcccttttaaggtggcttcctcctctcaagctaagcaaggtgggattattctggccggaccccaacagttcataagcacacccactcggggaaaggcccaatctccctaaaagactagtccaataggggaagggtgactctctcttttaaggtggcttcttcctcccaagctaagcaaggtgggattattcagaggctcacacggtcgctgcccgactttagcgtctttgctagcgggtaatagtagagaatgtcctcatcattcccacccccttaacaagggcccaactctgataccaaatgataataatccggcccaggtggggttggccgaggcctaataacttaaggttgcccggaccccaacagttcataggcgcactcactcgggaaaatgcccaatctccctaaaagactagtctaataagggaagggtggctctcccttttaaggtggattcctcctcccaagctaagcaaggtgggattattcagaggctcacacggtcgccgcccgactttagcgtctttgccagtgggtaatagtggaggatgtcctcatcaaggaggaatgagagaaaggggtatcatgcgcaccagctccgccgcagacgccgccgccgcagccgccatcaacatgcttacgtcactctctctcattggcacagctgacctcgtgcgcaccggcgtcgctgaagaggaggagcagcaagcaggctccgccgccgccgccgcagccttgggagctgtaggtgtctcaatgcttctcgagggtgtgtatctgatccgtgagggtgtgtgtttgatccatgggaaattgtcctgtccgggaccgatcccaaacggtatatcggtaagtagcatttctgtttttaaaatgactagcaaaaatgtttggtatgtttcaacatgtgaagataattttcatgattcataaaaactctgctaatttaaataacaaaccgagaaaagatgaacaaaacaatggcaaaacaaagttaactcagttgtgctcgcttcctgtgtcatcacacgaaaaatctcttatgtacacatttccttagcctcacaaatcgatcgggtggctattatataagttgacgcatgtgtattttgctatagatgagtgaaagtttgattattcaattagtgaaagttttttacctatagataaaaagcatttgcaaagtaacaaacttgttgtagacacaccttaatgataatttaaaaaaaatatttatgaggaaagaaatttggtagagaaggataataaaaacagaaaatgaggagattagatgtaggtaaaatacaaagtatgtaactgtacggacaaaatcccttattttatactagtataaagtggaaagtacgatgtgtggtggatttttaagttggattcttgtcctagccaagggctttaacgggcacacgtgttgatgagcatgtatcacacaatctctttgattgtgtttggaaaatgggataaagagagtgggaaatggatattatttccagttttgatatttcccttgtttggataggttgggaatgggatatgcaatcatgctggattgagggtaatattgccaggtgaaattaccaaattgccctcgccattttgacccttctataatctgttgattcatctaccacagctcatagcatcaaatctgagggtgctctttggtgtaagcagctggcagcaatccaccgagatcctcgcgtgggacgaaggctctcgaagatggtgaggtgcatgtatatattatgtgatcgttggctgcatttgaatgttataccacttattgtagggaggggtattttggtcatttctctagaaacttccatttcccatccatcaaaccaaacatgggatatgactttctttcatataatctcccacctcaatctaccagcatatcattttcttttcccaataggtataacccaatatccaaatggagcctttatcggcagaagcgttttcctttgttactgctaatattctactttggatcagtgaaaaacaatttcggtaacctcgggcaagtcattatctcagctgaaacttttgttttttcttttctttttctttgaatttgatcaaaatttattcaaatctagtcaaattgtcttaaaaatttaaataattttgatccaataagtcttcaaaatcccaaaaatttgggaatttcgatgctaccgacatggccgaatttttgagcaaaactgaaaatgaaaaccttgcttcagataagagagacagaattgaattggcttgaagatggaaaaatgaaaacctcgcagtttaggccgacggaaaccgtacattttgggctttggaaggaaattgtgtgtggcctgttaggcaaatagaagggtgcaatttttcatatttgacctagagaatgtaaatgaagaggaggggaaaagatgactccgtgtctttgtaaaaagaaacccatcactctaagcaataaaatgggaggcaactacacgtcaggcgcccgatccggggtgggaaaatcgggcgcccacgtcatgttgacgtcagcatgacgtcagcaagatgtatgcgcgcaaaactattttaaactatttttttattttaaattatttatccaaatcatgatccaattgcactattaaattcgttgcaattaaatctttaaaacaagactacacatggatatattccgacgaaaacttttttagcttattattgaattatttttaaatgttgcacgttgttgcaccaagtatattgaaattgttttaaatcgaaaatatttcaatcatttaaatcgggcgccgtttcaccttatataaaaataatgtttcatcaaatagcgaaataatgtttcagttcactacaacatttgatccatacataatgaaacattataagtacactaggtgaaatattttttgtggaaaaaaatgaaatgaattcggtttccataatatgtgggtgatttgttgcaaaagaatgtttcaatccactgcagcattagatctatacatagtgaaacattgtagtacactagatgaaacattttttgtggaaacaaactgaaacgaattctcttaatagatggtttctaaaatatgtgggtgatatattgcaacggcgtgtgtgctagggtgtgtggtgggggcggcacctgagctagaggcttgcagcgcgcgagctggaggcgcgatagaggcgcccgatttttcctgctgattctccaataaaattgcaataactacttataatttgcagcgcactatataggaaagaccactcttttgagtattaaatcaatatttattaatctgaaccatgagcagttaaactatctgattacatgttgttattactagtagaatgcatgtgcgttgtaacatgcgaaaataatttttacgatcgataaaaactctgctaatttaaacgataaactgaaacaagagaaacaaaataaagacaaaacaaaatcagaaattatatatagtattgaactaggttgtgttcgctgcatgcgtcattgtgtacacgtttctatagcctcacaaatcgatcggatgactatttcaaaagttgacgtatgtgtattccgttatacgtcattgatcaaatattaaaattttgattattcaattagtaaatgtttttacatgtaggtgaaaaacatttgcaaagaaacaaactttcccacatacacatccgtgtcagctctttgctgctgtggtcgatgaataagatggagaaaaggagccgctgtcgtcatcccttccttccttgaccggcgacgtggtcgggtccagtggcggcggagcaggaggcttgatgatgaagagtcatgtccacagatccaacacatcgtctcaacgcccaacgttgcatcctctcaggatccgatcgaccaccctgatccacagcgccgtggatccctgcatgtgccgtcaacggccgctgccgcatcagcctctcttgggaggaaacatgtggggagaaaagaacttgccggtgattgctcgaacctcggatacgactgaccacccgatccgaggatcgatccgacgcgcatcgcgagtccgacccccaacgacaataaataataaccacgttaattaaagactcgtctcgactcgataatctatgtgtttagtttaacgttaaaattagaagtttgactaaaattaaaagtttgaagaaaaaagttggaagtttataaaagtttgaagtttatgtatgcaggaaagatttgatatgatggataaattaaaagtttaaagaaaaagttgtgacctaaactagggcaataccaaataccagagttacgtctccagccgacgccgacgccgatccatcctcccctcaccgcgcccttcttcgcctgcacaaagggagaagctacgtctaatcccctaattcgccggtgtccgatggattgcagcggtgggatggaaaagcgaccagccagccagttcaataagtcacaatcgccgcggggagcttgcgcctccaccgaaccagcgagaacccaggcgaaacgctcccgccccacgccagccggcggcaatgagcaggcggtggcggtggtggtgcccaggcgctcgctaccaagctctatcaaccacaatagcaaaactggcacaagggactggacgaacctcggggacgggccggccggcaagatcgcggagctcaccctcgccaacgacgtcgccgattacgtccgcttccgtgccgtgtgccgcccgtggcggctctcctcctcgctgcacccgcgcccgcaagatggtggcctagacagccgcttcctccctcgtcactggatcatgctcgacaaggcccaccacaataagggcaccactgccgccgccacccaccgccgccaccgctttctcaacgtctccaccggcgggtgcatccacacggacgacatcccggagctcgccgaccacacgatgctggcgctcacgccggagggcctcctgctgctgctccacgagcccagcctccgcctccacctcctgaacccgctcacccgccaccgcaccgacctcccgccggtgacagcgctcctgacaccggagtggcgccgacgagcgagctggcgtttgggcgcccatggcgtgggtcttcgcgtgaacgccgccggttttgtcgtcgaggatgcctccacagtagtggcagtcgatttctccgatcccacggtgcgcgccattgccaagcctggcgacgagagctggaccgtcatcgacgacaggctcaacacgatagattggattatcacatatggtagagtacatataggcacatgccttccatatctagcaaccgatttatagaaacaatatcggagaagattaaggaaggatggcaagggataaacacaatctaacaccccccgcagtcggaacgtcgtgggaacggacattcagactggaccgaaactccaagaagatggcactgggcaaccctttggtgaagatgtcggcaaactgtgacgtagtaggtacatgtagcactcgaacagatccggcagcgacgcgatcgcgaacgaaatgtagatcgatctccacatgcttagtacgctgatgttgcaccgggttagaagagagatagacagcactaacattgtcacagtaaaccaatgtggatcggctcggaggggtatggagctcatgaagaagctgtcgaagccaccaccgcgttggccacgacacgatattctgcctcggcactggagcgcgatacaataagctgacgtttggaggaccaggagaccaagttgtcgccaaggaacacagcataacccgaggtggatttcctggtgtccggacaacctgcccaatcagcatcagagtatgcactcaagtcaacagtggaggagcggcggatgtgaagaccataatcaaccgtgccatggacataacgcaagatgcgtttgagagcagcaagatgaggctcccgtggatcgtgcatgtgaagacagacctgctggacagcataagagatatctggcctggtgaaaatcaggtactggagggcgccagcaagactccgatagttcgtgggatcatgaactggggcaccatcagcggcagagagcttggcgttggtgtcaacaggggtagcacatggcttgcaatctgtcatgccagcacgctccagaaccttgaggcagtactggcgttgactgagatgaaggccagaggactgccgagaaacagagatgcccaagaaatgatgcaagctgccaagatccttcatcgagaactccgactggagagcacggatggtccatcgaagaagtgcatcagaggaggctgtcagaacaatgtcatcaacatagaggagcaaataaaccgtgtctgatcctcgatggtagatgaacaaagatgtatctgattttgcctcaacaaagctgagtgtaaggagaaagctggcaaaccggctggaccatgcccgtggggcctgcttgagaccatagagccgcataggccggcgggaggaaggcttgctgctgggccggcgcgggcgtggtggtgaaggctgtcccgacgaagttgggccgcacgccaaggaggcctagaccggcctggcccggccacatgtggattctccctgtccatgggttgtaggccgtgggccaggcctggttggcccgtggtgcagtctatgcgccagggttgccctgggcgccgccgctgtgtgcttgtccgccgccgccacttgcgccgccgctgccattgctcccgccgccaccaccaccggagccatgaccacggcgtcggttgttgttgcgggagttgttgttggaggtgttggtggaggtcgccgagcgagcggtggtcgaggaagcagcgaggaaggccgtggcagtaacgggcggccggtggcctttcgtcagctcatcgaggagaagctgtgcgcgagccttggcgaacgtcgggaacaggacttgcagaggcaagagggacttgaggttgtcgaatttgtcgttgaggccgccgatgagggtgaggatgagagaccgatccttgacaggttcaccgacgtcggcgaggttgtcggcgaggaccttgagtcaccggcagtagtcgccgatggagaggtcaccctgctgcagatgatggagctcggcggtgaggttgacggcgcgccgctcgccgttgccgaggaactgcagctcgaggtcgcgccagacggagcgtgccgtcgccgtgggaaagagcacctcctgcataagagtagaggagatggagccgtagagccagccgaggacgatgcagtccatctgtgtccagtcggcgtgatcggggcgaggtacgtcggagaagacatgatcggtgagggcgtattttccaagcgcgatgaggaaaaggcctcgccagcgggagtagtttttggcgtcgaggtcgagggtgacggggacgagcgccttcacgttgaggacggcgacggctttgctgtggaggttggcaacggcttcggcgtcaagcgccgccggtggcgcggcggcgtcctgcgtgggggcggccggcgtcgtggtgatgccgagacgggcgagaagcgccaggatctcggggggaagttgcgccgcgggagccggagtggaagccggtggcggcgggatggcggtcgtcgaaggcgcggtcgtcggaggaaccggtggaggcaccgtggaggagtcgtcggaaggagaccgaggataacaggggcgagggccgcccgggccacggtcgcggcacgatcggtggcgtcgccagcgacggcggtggtcagggtgtcgtcgtcctgaccagagggagccttgaaggaggagcggacggcatcggcgatgattttgatggtgtcatcaaggacggcgtcggcagtgagggaggagggaggagaagccatggcggcggcagggtgcgccggccggcggctggggtggagaggaggcggaagcgagaaggaacctaatctgaggacgcccccgtcgatcaaccccaggccaggaacgtcccctcttggccacgtccgtgtgtccagtgccagcgcatgtgccatgctgtatgaccactcccggtccacaccaaccatactcccgtgaaaccgcgagagtcagctctgataccattttgtaacgacccgcctttcccaggctaggcccacttacatctggtagctttcataggtcataagactgtcctcacagaccaacacaagtcttttctacgcactttgtcctcactcatgcgcactcgggaagaattttctggtcggtcacccatccttaaattgctccagaccaagcacgcttaacctcagagttctttagagatcggcttccgaaaaagaagttgcaatttgttgatatgagtattctagtaatcctattaagccctagaccgggatgttacaccctcaccccttacaaagaatctcgtcccgagattcggaacggctagaaagaaaagggcattggtcaactgcagtctatcttattccataactatgataattattctaaggctttaaagaaaactactgctgctttgagactggtggctgagctgtaacacttgaagatgcaactggcactacattggctcctgtgacgacaaagatgtcgatggggtctacttatggaggccaagtcaagtggatcgagggacatgaagatgatggtcgaactaaagtgtccagctgtcaagatggaatgaagtttggatcctagcttagaacctaaaccaccaaattgactttgaagaatagttagtagggtagaacgtttgttgcttgcttgtgtgtaggtaaggttgcattcccatcattggtgtagttcaatgatgagcgtgtaactatattaggttgcttgcttaatcaacttaaacaatataatggtttacacacactagatcaatgttaacatggttaaggtcttgtctttagtgtcacccctctccttctatcttctccaaacctatagcagatggtgaacacttgcgctagtggaagtggaaacaataacaatgatgagaacccaactcttgctcaagttctagctcaacagactcagttaatgaacataatgatgcagcagatgcagaaccagctcaaccaagggaacgacaatcctccaacgccacagaacaagttagctgacttttcttcgtgtgaggccgcctaccttttctagcaccaccaacccagtggaagtaggtgattggctatacactattgagaagaggttggaattgctccagtgcacagatcaggagaaagttgttttcgcttcacatcagttgcatagacctgcttcagaatggtgggatcacttccggatgaacagagcagaaggacaaccaatcacttgggaagagtttactgaaggattcaagaagacacacatacctacaggagtagttgctttgaagaagcgtgagttcaggacattaaagcaaaaggatcgtaccgtgacagagtatcttcatgagttcaaccgtctagcacgttatgttccagaagatgtgcgtactgacaaggaaaggcaggagaagttcttagaaggcctgaaggatgaactatcaattacgttgatttctcatgactatgctgatttccaagagctggttgacaaagcaatttgacttgaagtcaagaagaacaggatggacaaccgtaagagaagactgattgttttcaaggaagcacagggtactagccaaaggcagtgtatcaagcaatcccaagttgatgaatcaagtctaacatctcaagaacagtcgcaacagttgaacatcggtgatgagatcaattcagagactaatgcaagcaatgaagttaacatcaagcaagctactcaatcagtgccagttcagcagaaccagtctcaagaaaataatagtagtggaatggaagggagcagcaggtatgtttcaactgttacaagccatgtcactttgcaagagagtgttcgaagccaaagcatcagcagccgcaaggtcaagtcaacaacattgtcgtcacaggagccaatgcagtgcaagttgcgtcttcaagtgttacagctcaaccaccagtttcaaagcagtagtagttttctttaaagccttagaataattatcagacttatggaataagatagactgcagtttacctatgcccttttctttctagccgttccgaatctcgggacgagattctttgtaaggggggtagatttgtcacagcctgaattttcgtttcaagatttataaattatttaataaattattaatagaatttatattaaatgttcattaatttacaagtgaagtgaaatgtgggaaatcaaatttcctaattataaagcatgggtggatttaatttttattaaattctccatgattaattatactctctgaaattttctcggatttttcggagctcaattattaattttaataatacaaagaacatttcagtaattattcacatattaaattaatcattaatgagctggtttcaatgtttttaaatacttagggtgtccaagtatgttcaagatttttcttggaattatttgaccattggaagtatttttaacaatcgaaagatcatcttattggttaatttatttggaaaagtaataaaatcttcatcctcagcttgggcccttttcagcccattctctcccttcctctcagcccgcagacaagtctgcttttcgtccctctcgctacagtgttgtcttcaacccctagacagagccgactgtctccagcccgtgcacagttgccgccgcctcctccttccaaatccggcctctccgttgctcctttttccaaattagttgtgggaatggaatcctctcaatctcctcttccttttccccaagaaatccccaaaatttctatggaaatcctttccaatttcgcggatcaatctttcctttttccggcgaagatcctaaactttcccgagtttttcccgtcgatttgggcccgaacccgagctcctgtgcctatataaaggaccccctcgtcgtcctctacctatcccctcaagttccatcttccgccgtcgtcggaatcgctctccccgcgctcttcttctctctccaagcgccggcgccgctccagccgcccctagccgtcgcttcggtcgtcgccgtcggtcgccgtctccttcatcagcatcgcgaggtcgtcgccgtcctcgtcccgtcctccgtttccgccgaagatcgccagagcgccgctgacactgtcaacccgaagctcgccgccgcattttgatctccggcgaggccactgctgctccttccgtcgtcgccaagctttgccgtcgcctccattggattcgcagctgcgaagtgaagcccggccacccctccgttgttgccgcacatcgccggaaagtcgtcgccgccgtggacagtacctcgccgcccttcgaagctcgtcgccggccatcttccgtcgctgtccgtcatcgcgtaagtgttggtaaggaccgtcgtctcgtgctcttcctcccggtgccctccgtttgcattattgtgccgtggttcgccggcaaccgctgcccctatgccgttcaccggtgtaggtttttccctagggtcttaatccaacataatctaatccgtgatttgtctagcgttgtcatctccgtgtgttgtagccggaccgtcattgtcgaccctttctctctgatcgctttggttcggtgagacttctatccgttctcttttttcagtggcatattatttctttttaatatatgccatctactaaatataacctaatcttttctgaatgttgctttaatcttttcttaattataaatcatttgtaaattgtttaattaatttggaatagttttttctttaataggtttaattggaattaaatcttataaaattcataagtaatttatatgaaatcggaatgaggccgttcaagtctcataattcatctaaaatcatgatctacatgtttatttactttatatgtattgtttatttggtttttattagtctttttccttgttttatgtgttagcttgtcgtttcgaaggatcgtgagtgcgtcggaagtgttcaagaagattaattgaagaccgaatattgcaaggcaagtcacatagatcccaaacacaattcctttgagcatgttgatcctatatttaaattctctatttatttcaagtatacatctattttcgaatgtcaccgggtggtgtgaacctatttctttgttatggccaatttacattgattatcctatttcttgattacctcggggtataatttgactagttgtatttatatattggttcaactagatacattagatataattgcttagccatgtttagaaacattagcacactattgggataactaatgtttcacatttacttaatgataactaatgttttgctattacttaatgattggttaattaattaatgtgccaactaaaacttgataatggtgggttgtgagcacatgattttgatggtcgtgctcatgacaattaaggaccggttcacgagtttcggttgtgaaacattaaccgtgccaaacacaagccagcataggcaacggctggacactttgtatagcaaggctcattgtggtgtgccagactgagaagtggcggagataagcccacgggggtcgctggggagtctatgcctttggtttttgagggggtgactacgatccaggaaaggtgcgctgctttgagttgagctatgcgaggggtcttgtcacaactacacaaatggtgacatgttcagcatgggcacatgatgatatggtgacatattatggagttgtgtcttgtgggtacagtggtacacctctggccagagtaaaactattcgaatagccgtgcccgcggttatgggcgggtctaacaatgtctttcgtgattagtctcacactactcattaataataatgtggtaattgatggtaattaatttagctcctggtttggaatggtacattcctggtttagagatagatctgtacagccgtgtatagttgttcaggatggttgggcctgtgcagcatgggtgtgcagttcagtgttaattaatattgatgattaattactctactgttttagaattctcaaatgttttgctaaatgctgcttttgcaaatgagctatatattatgccattctttggtatccttgtgcacttgcatatttgttgtgtggcttgctgagtatgtcatatgcccacattgcaataatcaatcgaacctcagttgaagacaagttgcgaaggagaagacgtttggcttgtaccccagttgagctacttgtggtagtggatgtcacgccctgaagtttccccctttttccttgctttaaaaatttgttaaataaatcgtccgaagaaattgtcttaattaacctagagctaaatccctaattaataaaggcatttaataattggaattggcaatgtgggattttccttgagttccacatgtcacaatacattaacaggattgatttttagtgaaattttcagagccttggaaataattttaaccaattaaaaatcaccaaagtgcaattttaaatcccaggaaaaatcctttcccctttttccctttttcgcttttcttttcctctttttccatctttttgggccgtcggcccagtccaccccccctttttctcctacccgcgctcggccttcctcttgttgggtcagcccatgcgcccctccctcctctctctgggacgccgataggtgggccccacctgtcggtcgtctcccacctccggccgttggagccggagctccaaccgctgccgccgaaaccgccgcgccgccgcctcctccgctcctcccgtgcccacgccgcgtcgctcccgcgtcctccccacgtcgccgccctctcccccgcatctcccggcccgcgcgcgcgctcgctaggggcgggattcgaatttgaatccccccattctctctctctccacccccacgtcgccggccaaatcggccacctccccggccacgtccgccccctcccgcacctataaatcgctccccgcgtccccctctctcgtttttcgcactcgctgcgcccttccgtgcttcctatcctcgccgcgccgctcgccccttgcgccgccgcctaccgccgtctccggccacgcgccgccgccactatagccaccaccgcgccgcgcagtcgctgccgtcgcgctcaccgagcccgcccgcacctcggccgccgcttcgttgccgcaaatcaccgccggagctccgattccctcgcgtcgccggtgagctctccattttcatccatctccggccggccactttggccgccgtggtcgctctccctactcctaacccctcacctccccttctctaggtgccgccgccacccgtccgccgtccgtgtcgccggtcgtcgccggccgccaccgcctcctctggtgaggactcccctcctccctccttccctatgtgccgcacgcgccgcagctctctgtgctcgccatcgccttcggccgccgccgccagcctgtgcgccgtccgccgccgcctcccgcaccgccgcttgttgttgccggcgctcgcgcgccgccgccggtcgccatggccgccggtcggcttcgaagccgagccgagccaaccgggcacccttcctctcctcttgtgccgctgcccggtggggcccaccagctggtggaccccccttttagccgctgccggtggggcccgcgtgccgtcgccacctcccccccttttagagccgctgacccatggggcccacttgccggcgccgcccccctccttggctgacgtcagccctgggtattattgcgcaataaattgattaaggactttttctttattagtaaaaacacagttttatcttctaaaattcataagtaattcatccgagctccgtttaagtccattcaagtctcagtaaattcataaaaatgcaaagaatccattaaaaatggttttgtttcctgtttcattagtcttatagcatgttttgcttgtgtactttgtttgtcgcgtagatttcggccgtttcgtcgatccgcggtttctcgaagacgttgctgaggtctcatcagtgcgagagcaacgcaagtcatgcattacaattgatcatattgtacccaatttacaaatatcccgcatttctattaaatgtcgcattcttttacaatgtcatatgggatgggtcctattactcagccatttattgtttaccatatgccattaataacttgggtatcaaaatgattagatgttggtttaggaaatgcttagccatgcttagctccactagtacacaaatggggatcacattattacatagactttgactatgagcatagttttggattggtgccaccgcaatggtgttagttaattaaaatacactgaatggtgggctgtgggtgcatggttttgctggtcgcacccatggcaattaaagaccggttcacgggaaaccctgggagacttaccgtgcttaccacaagcgagagtgggtaactgcttgatctgaagtatagctcgaccctttcctaggcaccggtggcgagggtgggcgtaatggagttgggtcggccagggtgtccggttgtccagctgccagattcaccgcggcgcaagaggggaccgcccactgcccgttgggggtggaggtgaaaccttagcgtggtgtggatggttaggggagggttatgcggagggtcttgtcacgatttccccctttgcagtattatggtgatacttcggggcatggtgacatgtgtggaatcgtgtcttgtgggtacagttgtacatctctggacagagtaaaactattcgaatagccgtgcccgcggttatgggcgatcaaccagattcaccgtgattagtctcacccctagtttagcttaatgaactagtgtagttcaggtggttggttgggcctgttgcaacgtggtgtagcgttggacagtgattggttaatattgattaattactacagttgttttactgctttcaactactgcttttaaatgctagttttatgcaaaagaacccctagcctcctttggttatatcctgcatcatacctcctcttccggtatgacttgctgagtacagtgggtagtactcagtcttgctctcttttcccccacaccagagttgaagttcttctcagttggagctgtctcagaggggttggtttcgtcgctgccgtcaaggtttgcctatggagtggagtcgcccgctgctgaagtcaagcttccaaggctagctcgttttatcttttccgctgcatttgtaatcttttatatttttgtaagacgtggatctgtatgtcaacaattgtcgtttgtgtaccctggctggtcctggacaggggtttaatgcacattcagcttagaaattctggttcgtgaatttctgggcgtgacagtggagccggagcttcgctagatcgttattccgctgctattttctcttttcatttgtaagtatgtaacgttgtattattgatgaatctgtatattaaattgtcagcttgtgtacctcggctgattcctggacgagggttttatgcacaaattagttcggaaattactagtgaatttctgggcgtgacaagttggtaccataataaatggcgtcgtcgtcgtctccatgtgttgccgccggttcaccgtcgtcatctattcctctccgatcgctttggttcggtgagacgtctatccgtgttccctcggtttagtttttaatctctcgtttgtgtcgtcgagtagccgccgccgtgccacgcttagctgctgccctagcgtcgccactgcactagccgcctagtcgtcgctgtgccgctccctgctacagccgtgctgctgctgctcgtgcgtgacaagtcgctgccgtcccgctaccgtagccaccatctgccgtcgctgtgtgtcgtcgtcgctgtgatgtcgccctaacccgagccgcgtgtctccgccgagtcaccgccgcctggccgagccaagtcgccctagtgccgccgtgtcgcagctgtgtgccgctttaacctagccgccgctttaaccgttgctcggtagtcaagttgtctagccgtaggtgcatccctaaattcctaccggcctatcgtttgccgtaccggggctttaccgtgaatcgtttctagcccaccggtttagccgcagccattgttgagtcgttcgctcgttcgttcgaacgaggtgttacccgtgcttcgttcgtttgtccgtgttgagtcgtcctttagtttagagccgtttagagccgccggttccgttcgccggtttcggttgatcatttgggtaatcccgtgtcacgtagaattgactcgttgagtcggtatctcgtgaggctcgcttgccagatcaatctaagccatccgttgaatcttggtcaactctatgtcaagattaatcttagccctccaaaatcgatataaatatgttctctcttttcagtggcatattatttctttttaatatatatcatctaccaaatataatctaatctatttccagaggttgctttaatgttttatctcagttataaatcatttgtaaatgatttaattaatgtggaatagtctttttctttaataggtttaattggaattaaatcttataaaattcgtaactagttcatatgaaatcggaatgaggccgttcaagtctcataattaatctaaaatcatgatctacatgtttgtttactttatatgtactgtttatttggagtttcttagtctttttccacgttttgcgtgttagcttgtcgtttccatcgtttcgaaagtccgtgagtgcgtcgggagtattcaagaagattaattgaagaccatttattgcaaggcaagttacacagatcccaaacacaattcctttgaacatgttgatcctatatttaaattctctatttatttcaactgtgcatttattttcgaatgtcaccgggtggtgtgaaactatacctttgttatggccactttgcattgattactctgtcctttgataccttgggttacaatttgactagttgagctttatatattggttcagctagatatattagatataattgcttaggcatgcttagaaacagtagcacacgattgggataactaatgtttcactattacctaatgatggatatttaatcatagctcacgatggctaatcgtgattggttaattaattaatgtgccaactaaaacctgataatggtgggttgtgagcacatggttttgttggtcgtgctcatgacaattaaggaccagttcacgagtttcggttgtgaaacattaaccgtgccaaccacaagccagcataggcaacgactttaccttttgtatagcatggttcattgcggggcaccagactgagaagtggcggagataagcccacgggggtcgctggggagtccatgccttgtttataagggggtgattatgatccaggaacggtgcgctgtggtggattgtgttgtgcgaggggtactgtcacaactcctttcagaggtaccgtggtggtattgaggcgcatggtgacatgtcgtggggctgtgtcttgtgggtacagtggtacacctctggccagagtaaaactattcgaatagccgtgcccgcggttatgggcggggtctaacaatgtctttcgtgattagtctcacactactcaccataataaatgatgctatcactggtaataattcatggtatcagattaggttccttctcgcttccacctcctctccaccccagccgccggtcggcgcaccctgccgccgccatggcttctccctcctccctcactgttgacgccgtccttgatgacaccattaaaatcatcgccgacgccgtccgctcctccttcaaggctccctctggttaggacgacgacaccctgaccaccgccgtcgctggcaccgctgccgatcgtgccgcgaccgcggcccgagcggcccttgcccctgttctcctcggtctccttccgacgactccggccgccgatgacgccatctcctccacggtgcctccaccggttccttcgatgactgcgccttcgacgaccgccatcccgccgccgccgacttccactccggctcccgcggcgcaacttccccccgagatcctggcgcttctcgcccgtctcagcatcaccacgacgccggccgcccccacgcaggacgccaccgcgcaaccgccggcgctcgacgccgccgcaccaccgccggcgctcgacgccgaagccgtcgccaacctccacagccaagccgtcgccgtcctcaacgtgaaggcgctcgtccccgtcaccctcgacctcgacgccaacaactactcccgctggcaaggccttttcctcgtcgcgcttggaaaatacgccctcaccgatcatgtcttctccgacgtacctcgccctgatcacgccgactggacacagatggactgcgtcgtcctcagctggctctacggctccatctcctctactcttatgcaggaggtgctctctcccacggcgacggcatgctccgtctggcacagactgcaccacgggtcaaccaggcctggcccacggcctacaacccgtggacaaggagcatccacatgtggccggtccaggcctccttggcgcgcggcctagcttcgccgggacagccttcaccaccacgcccgcgccggcccagcagcaagccttcctcccgccggcctatatggctcttcctaggccggcccagtacactgcaccaagcacggcgcctccaactcttgttgccgctgtgcaatctccattccagtggacggggccctcacagtgggacccacgggccctcgccaacgcgtacaacacggccacattaactactccaccgtccaatgaatggtacatggactcaggtgctacttctcatatgacgtctgacaccggtaccctctccacttcccaaagccccacccgcaatactccctctcatactattgttggcaatagctcccttctccctattacctccgttggtcacgcatatttacattaccccaattcttcctttgtgcttaacaatgttctcatttctcctgagattattaagagccttatttccgcacgccgttttacttgtgataattggtgttccgttgaacttgacccttttggcctctctgtgaaggattacccaaccaagatcgagatcgtcaggtgcaatagttcctgtgctctttatcctctcccggcagatgcgtactcctcggcggcctccactcgtgcctttgtcgcctcctccaccaacaccgacctatggcatcgccaccttggccacctcggtcatgaggccctcacccacttggcgtaggcgtctgttgtcacaccccgaagttttcctcccaagccaaattgtaaattacaaatgaccccaagaaaatgcagaggaaatcaggataaaaccctaagaaaacaatgcaaataataatcggatttgacatgtggaatttttcttgaattctacatgtcgaaattcattaacaggatttttagtggaattttcagagctctagaaataattttaaccaattaaaaatcactaaagtgcaattgttaattccagggaaaatccttttcttctttttcttttccctccctttttcctcctttttcttttcggatgggccgccggcccattcccctccttccttcccctcccttactgggccggccgcaggccgaggcccagcccgacagccggccgcccgcctccctcctctcggggtcgccgacaggtggggcccacctgtcggacccgtctccctcctcccgccgatcccgctcgcgccgccaccgccgcaaccgacgccgcgcccacgtctccgccttctccgggccacgtcgaccacgcccgcgcgtgcgccgcattccccgcgcccgttcccctctctctcccgctcgcgcccgcgcccgagatggctgggattcgaaaaccgaatcccgcctctctctcctccccactcccccacgtcggccgtcgaatcccgccgctcccggccacgtccggttcccccatcccctatttaagcatcgccggcaccccctctcgctttttccccattgcgccgacctctcccgagctccccaacgcctccgcgccgtgcaaccacccgccgccgccgcttttgctactccggccgccgctagccgccgctaggctcgccgccgtctcacgccgtcgccgccgttagcttcgcgcggccgaggtccacctcgtccacccctcctccgtcgaggttcgtcgccggagccctcatctccacgcgcacgggtgagcgccacctctaccgccgccttcggccatggatcccgatcgccatggtccatctctctctctctaatccctctcttctccttccttagggcacgccgaagctcgtccgctagccgacgccgtcctcccgtggcttgccgtcgccgtccgccatcgccttcctccgcgccggccaccctcggtgaggcatcccctcccttcttttccccttcctctcctcctagagccgctagccgccgcttcgagtcgtcggccgtcgccttcgactgccgccgccgtttcccgtgccgccggtagccgccgtcgtcgcacgcgtgccgtcgccgtttaacccagccggccggtcggctttgatgccgagccgcgccggcggccgcatttaccgcgcgccccggccgcgaggtccccgtcgccgtcggttcggccgccacgtggcgccgccgcccctccttttccccgtgccactgaccagtgggcccgcgcgccgccaccccctttctctctctcccggtcgctgaccggtgggccccgcatgtcggcgccgcgccccctcgctgacgtcagccctggttaatattgcgcaataaattatttaaggatttcttttatagtaataaacacagtgaatcttctaaaattcataactaattcatccgagctccgtttaatcccattcaagtctcagtaaatcaagaaaaatgtgtagaatccattaaaaatggttttgttctctgtttcagtagtcttatagcctgtttgcaatgtttgctttgtatgtcgctagattccgatccctccgacgctccagtgtacttcgagatagtcgccgaggtccctccagcagcagagcaaggcaagtcatgcttgtcatttgaacatgttgatcctatattgcaaatgctctattgttttctttcaaatattgcattgttttataatattactatgggatggatacctattgttacagccatgcttttggatatcatgctcctttgttagcttgggttataacatgattagactttggactaggaattgcttagccatgcttagttcaactagcacacagtggggatctcatttaaaacctagactataggtttatatgataatgttggtttaataccaccgctctggtgttggttaaataaaatgaaccacatggtgggctgtgggtgcatggttttgctagtcgcacccatggcagttaaggaccggttcgcgggatgccctggaagaatttatcgtacttaccacaagccagcgtgggcaacggctgggcttgtagtgtagctttcctctagtcgacgcatccaggcaagggtgggcgtgatggagcggggcgggccctgcgacggcctctgtcgcttccggattcacctaggcacgagaggggactgcccgtcgcccgctggggacgggggtgaaacctgaggtgtggtgtgcttggctagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtgtaatctgttgaacttggatagtttaggtggatggttgggcctgtcgcaacgtgggttagcgttggacagcggatgtttaatactgcttaattattacaaccgttttcgcattcaattcctgtttataaatgctagtttttatgcaaatgaaccactctagctcttctttgttaattccctgcatcatacccctattccggtatgacttgctgagtacagtgggtagtactcagtcttgctctacttttcccccaacctcagagctcgagtatgtgtccgatggcgggttctccgaggagtaggcttcgtccgtgccgtcgaggatgcctgtggagtggtgttcccgctgcagttcaagtcaaggcttagctcccgtttcttttgttttccgctgcatttctgtaagacctttataatgtttgtaagacgtggatctgtatgtcaacattgtcgtttgtgtaccccggctggtcctggacgggggttttaatacacattctgcttggaattctattcgggaatttctgggcgtgacatctgtcatcccaccacctaaagtcactacatctttatgtcatgcttctcagttaggtcgtcatgttcgtcttccttttcccactagctctagtcgggccaaggcaaattttgatttagtgcattgtgatttgtggacatcacctattcctagtgtgtctggttttaagtattatcttgtcattcttgatgattgctcacattatgtgtggacctttccacttcgctttaaatccgacacattctccacattatctcatttttttgcctttgtgaagacacagtttgccacgaccattcacagcatccaatgtgacaatggtagggagtttgacaattcctccgcccgctcctttttcctcaccaatggagtctccttgcggatgtcctgccctcacacctccccacagaatggtaaggccgagcgcatgcttcgttccttgaacaacatcacccgctccttgctcttccaagccaaccttcccgctccctactaggtcgaggcccttcacaccaccacacaccttatcaaccgtcatcccaccaaaactcttcaacaccacacccccttttttgccctatatggtgctcacccgtcctactcccacctccgcgtgttcggctataagtgttatcctaacctcttcgccaccgctccccataaactagccccacgatccaccccatgtgtgttcctaggctatccctccaccataaagggtatcggtgtctagaccttaccaccaacaaggtcatcacctcgcgacatgtggtgttcgatgagacatgttgtaacgccccgattttcgttcgggaataaaaatcaattaataatacattttctagaaattaaataaaagttaaaccaatttaatcaagtggaattatagaggaaatttgaaattttcctttaaaaatcattggtcgggaatattttgtaatattctttgcgccctaatgtactctccagaattttccgtgaattttcggagctcgagaaatagttttaatagcacaaagatcattgcatcaattaaaataaaaaaaaacaattaaaatcccacttcctctctttgggcctttttcggcccaagtcttcctaccctcccgcggcccgcgcgccccttttctctccctctcgggccggcctcctccctcggcccgctcggctctctctctccctcaagtctgctttacctccctcgcccgttttcccctctctctccccgacaggtgggacccgaggccccacctgtcatcttcttcc

SEQ ID NO: 59791 - DNA, 2558 bp, Oryza sativa
  unsure (1)..(2558): unsure at all n locations
cgttgtcactggttacagtaatagtggcacatggattcttcttaaccttgttggcatgctctctattttcttgtgcttcctcatcatcttcagatctctcctcatcatcttcagctataccatctgtttcactagaatcttcagcatcactatgactgtcatattcttcctcaatgtcatcttcaacatcactgtcatcactgactccattgctaagcacaacattatcatcttcgttgtgcttgagtatttcagcatatatttcagctacatcacccatgattatgcattgagccatatataagcattccttatcatctgatagtgctttcaggccattgtttagttcagcacccggaaataaccaatggaaaatcacttcatcttcttcacttagtgaaacatggtctccaaggtatcctctgatctctggcaatgccaccttgtccctctctatgtatgacatctcagtttgaccaccattataaaccacagaatatccatcataatcaaattccccaccaaagtgaaaccggatacaaagtacatccaaattatccattacacctaacatggcaacaatgagatcatcagtaaacttatcttaaaaaatgaaacattaatcaagcagcaattatctaccaaatcctaaacaactcatcccaagataaaataaaaatcaaccaaaaaacagtcccttatacagtatgaagtgagatagctgatgaacaacaacttatgaagtgagccaccctcgccgggcgtcggctgccacccatgctacatcgtcgatggcaatgatttgctccatttcagcatttccactaggtatgatgcctgcggtgcatgtgccatcgctcgcgacggcttcaagacgcacacgccgagcgccggcatctgacgatggataatgagctcgcaagaaaaaaaaacagcaagggatagcaacaacctaaccctcagtagtgccctaccaccaacgaaatcaaccaaaaaaatttcatcaaccaactgccacacgcacttattatccccttctagaacaaccctaaacctaaagcatgccaagatcgagtggggaggagggagggaggaagggagggagggggagggacacaccacggggctgcgatctcacggatcagcaccgcctatctgagacgatcatcacctggattctccgccgtcggaagggagagaggagatgatgagaggacttgtgagggagaagagtccaacgcatggaggagaatacgacgtgtgattaatctcccaggttctctttctccacgttagatccaacctagtaagcaaaaccacctaatccatgtgccacatcagcaaagcggtttgtattagattagaaaggtgaatagtgatccggttttaagaatctagggggttaagtaaaccaaattaaaggttagggggttatttgctccagggtcatacttgaggggagtaaaactgactttttccattgggtaaattttgctcactaaattatttccagctctgaaaagttacatcgatgctatcctcatgtacatatcactcacattgattaacttggaagcagggttctttcaaggcttcatttttgtgcaaatttgcctaaagtgaatactaaggcatagggtttaatttatctttccaatgtaatgctcatgaaactaatgtcttatttcatattactgaagaggtttcaaaaggtgaagtcatgctgggtttatccatagtcaccaaaagctgagcgcttggatcttgtctttctaagagttgaactattcactaataaattattatggcattgcccttcatggtgctaaccgaagatcatagaatatagacaagcaatttgtgagggtaatatttttttctattaattttctatcaaatgatttgtaagcatggaaatattgtgtttatactcaaagtgtgaaaattgaagagtcagcaaggttactcccatgtttgtaattaagtgtccattttatactgaacaaatggaatttctaatggcatatatgcgtcatagcaatattgcataatagttttttatatataaatgaggtcattctgaaaataccgtatttttagaataattagcaacaattgttgtttgatttaacacctatattgatgctttccactgcttcaccaataactgatgaaaaaccaaattaagaacctgtcgttgataagaanggcttaaantttggcatccctttttttnttccgttataccaccattccacttatggaacttatagtcccacggagtaataaggaaatttgccaacggaaggccgacaatggcccgccccttcttttataaaattaagatcaacctcaattcactccctagccataaaattggggaacaccttaaggtcaattcaatctccggaatgtattatactccacctttcttatttattgaggcccttatacctaagctacaatgaaggagccacctttcttcctattatatttcttaaacctgccgcgtggttatattatcatttaaatttaaattaagcttcaagcctcccaag

SEQ ID NO: 59792 - DNA, 4743 bp, Oryza sativa
attcgcttgccccacggtgcaaggtgatctcaactctcaactgacatctttaatctcaactaacttttgatcctaacaattcaccaatagaaccctagagaaagatactaatttaaacaattgcctagtagttcaaaggtccctcggtcgttccccgaacttattttcattgttctctaatccccatctcgatggctcaatctttgttcactatgagttcttccacacacgcatcctggccctctaacgagcatcacagccttgtggcaatgtatgatccgccccacacctcagatatctggcatcacagactataccagatccactcattagtgtaggcatctcctttgcctctagccaccaccatacacctccccccctccttttctaatccaaacaacgcaaatcaaggtggtgtgtgggacggcaaactagctcaacaaccagcaatcacgacggtggcgggatcctctaggcaagttcctcatagccactgtcctcctccctttagatcctctctctccacccactgatccggccactgtacctcaacaaacatttaacctatttgaagtgatgtgtggtttaagcctaaatggcccaaaaatgttgtagtagtggcggtttagtacactacaagagatcttatgataggtgacgtttcatttacgtcacaaacacataaaatttcgtcatatttcgtaatctgtgacgctcgcgtgacgaaaattcattcgtcacctatcatgcgtctctaaaggcgttctatgacgaaaccttcttttttcgtcattaatctagtgacgatccttctatcgtcataactttgtgacgctcatattcgtcattatctagcctaaaaaacgtcatgagattccatatggcatgatacggcccatgtagtgagcaagctgtttttgggctaggcctttttaaagcccatatagtgaaaaacctattaatgagttaggcatattgtaagtccaattagattttaataaattcagcctaattcatgtatattgaattaaatattgagtgggccatgcatattcaaaaagcccagtaggcccaagcattgcaacaaaatagcatatgggccatgcttactcaagaagtgtcacgccccgaactagtcccgaccggaactagcccgtgacgctccaaattaacctgttaatcgataccagtcccaggaaacagtgctggtattacagggagacagaatatcacagcaacagaggtctctttattatagagtagatgtacagtcatgttgggctgcggacagatcccgagctcacaactgcattacaaaaggaaagcggaagccaggacttggaccaatcaacacaggcgcgacttgggaactaggccgaaaccctaaaactcatcgtagccggcttgctcctggaagaactcctcatcagcaggatccgcttcatcttcttcagcaactggggggggaattatttatatagagcaagggtgagtacgggagtactcagcaagccatgggaaataagtgtttaatgcaggcttcaaggaaaggctgatgtttttgtaattaatttttatttgaactcttttctgaaacaactaagtgagtgcttctcaaacgacacggatgagacagtgcgtctcatccggtcggagtatgtgcaatgtatcagtctttagaatttaaacaaggttggcacccggccaacagctttttcaacggccacccgggccaacaacttttcaaacggccacccgggcctagctgatcccatcagctgcagatttttcaaacaccgaaccccttttcacacagcaatttcacaagcagtagtcaaaccaaactacgctaggaatcacctcacatccgcccatgaccgtgggcacggctgttcgaacagtttgttaacctctgcagagggggtacactttacccgcacgacattactaacccggatcacccagcccgtggggatcagccacgtcgggagacctccaagctttcatgacaaggcatttccaaagccgacacaggtttaccatacgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaatcggtccttaagtgcgagagcgggaaaccgtacacccagtacgtttcccggtccgcggttttggaaatttatttagttcgcaaagaccgacccaggtgtcgggttttccaagtcttttgtaaaactccagttttacccaagttattactcagattttaagtttgaaggcgaccgtcgatactggcacagggtgcacgaatatcgaggcgcaactggatggttacaaggggacatggtatagcaattaacaatggaaggatcaaatgcaacaagttaggtaggtctgccaatctgccttgcagacggaacaacagattaagtgcaatcctatcaatgcataatattttgcaagcaatataattagatttcaaatataggctcaagatgttcaaaggtggcttgccttgctcgagatctagagcttgatcctcgaaatcctcgcactgcgggtcttcgggctccgaaactacacgcgaaacgggacaactcaacaaacggcgaaaatgaaaccctaataatgacctctaagcgtgccattagatagatctcgagatttgaggaattttggaagttgaacggagtcaaacggatctaaggttaggaagatattgaatttctaagattattggattttttggtctaaaggaaaaggatttaattaaatccttttttggaaaagaaaagaaaagaaaagagggagggattatagacttttcctcgggcggctaaggcgcggcccaagggaattggagcggaccggccgagttaaatgggccggccggcccaaggcggcccaagtgcgcgcgcgcgggagggaagagagagagagcgccggtggaccgggctcaccatgcgcggtcccgggtgggacccgcttgtcagcggctcggctcaccgtgcggagggagtacgcggctcatgcgcgcgggcgggggagggacgcggtgcacgcgcgcggttcgcggtggacgcggatgcggcgggcccacgcgcagcctcacggctcgcggtggaacgcgcgcacggggagggactgaccggggtcggctcgacccggtctaggctgagctggcgccgacgtggcgcctacgtggctgccacgcgggccggcgggaggtagacgacgacccggccgcgaatggacggcgggcggcggcggcgagcggcggagcgaaccacggcgatacggacaaaagcgagcacaccggacggttgctcgtgatgaggggagacgagccaacggctcggatttgccggaggaagcttgacggcggcgaatcgtggcggcgacaaccggcggggagggaagagggaaacggtggcgaggccacgaggggtcgattcccggcggtgagagcatctacgcggtttcgggaactcgatgctagcgtcggattggacggagctacgccgagcgaggctggcgacgtgtgggtgctacggagctcgagcggcgacggcggcgagcacgcggcgagcgacgacaacggtcggggcggcgccggctaactacggggagtctactcgagctactaccgaaagctagggggaggagatggagcgaggaggaagaacggagggaggcatcaccgagatgaggaggggcgctgtgacgagaggccgacggcgcgggagtaatctctccggcctcgggccggggaagaggaaggagagggcgcggccgaagtccccttccgtgtccttgctcgtgccgactccttcgacacgcgcaacaacgaacagcgacggcgaacagagcacgggggcggcagctatggcgaggaggcgaaaacgagggagattggaggggaaggagctggggtttaaagtgggcggcaatgtcggtttgggaaccgacttagggcggtcaaggcgcgagctggcgctcggcggtcacggccagagcggcgacagggaggatgatgccggcgggggaaaaggggaaaaaggagggggagaaaggggcttgcccttttgccgattcgggaaaaaggaggaggggagcgggggcgacgcggcagagggaggaggggcgctgcctccgtcccttggcggcttgcgcgcggagtggcggggccgggcggtgacgacagcgatgacggcgggcggtttggagcggcgcgacgacacgggcgacagacgcgtgcagaggctgacggcggcggcgaccgggcggtcggccactcggcacgcgcgcgcggcttgcaacgggcggcgtccgcgcgggcgtgcgcacgcgaacacggcgcgcgggaagtggtagcgagggagcggagagggaggacttcgctcggcgcgggcggcttacgcaggcgcggcagagcgaggagaggggaagggggcgctcggcgcggcggctcacgcgcacgcgcgcgggcggtgcggaggaggaggagcactcggcgcggctcttcgcgcacgcgcgcgcgggcgcgggcgaggcggagcggagctgagcggggggggggagcggagcgcgccggggaggg

SEQ ID NO: 59793 - DNA, 9930 bp, Oryza sativa
  unsure (1)..(9930): unsure at all n locations
tttatccatagtcaccaaaagctgagcgcctggatcttgtctttttaagagttgaactattcactaataaattattatggcattgcccttcatggtgctaaccgaagatcatagaatatagacaagcaatttgtgagggtaatatttttttctattaattttctatcaaatgatttgtaagcatggaaatattgtgtttatactcaaagtgtgaaaattgaagagtcagcaaggttactcccatgtttgtaattaagtgtccattttatactgaacaaatggaatttctaatggcatatatgcgtcatagcaatattgcataatagttttttatatataaatgaggtcattctgaaaataccgtatttttagaataattagcaacaattgttgtttgatttaacacctatattgatgctttccactgcttcaccaataactgatgaaaaaccaaattaagaacctgtcgttgataagatgtgccttaatttttgtcatgcttttttttttctcgtataaccaaccatacaactaatggaactaatagtcgacaggagtaataagtgaaattgcagacaggaggcgcgacattggcgcgccccgtcatctagtaaaattaaaggatcaacctacaactacaatccactagcccataaaaattgcaggaacgacctacaaggctacaatccaatactccaggaatgatttataactccaatcctctcttagtataagttagagcccactaaatactaaagcttaacatgtaaagatgccacatcatcattcactaataattattacatttaaacatcatgcaagcatgttatattatctataattttataatttattaaattttatagcttttcaaatgcttagcctaatgatatgatttggtagacacctctgcattggccaaaatttagtccctgtcacatcagatgttatgacactaattaaaagtattaaacatagactaatgacaaaccccattccataaccctggattaattcgcgagatgaatctattgagtctaattaatcaatgattagcctatgtgatgctacactaaacatgtgttaattatggattaattaggcttaaaaattttgtctcacgaattagctctcatttatgcaattattagttttgtaagtagtttatgtttaatatctaaattagtgtataaacatccgatgtgatagggactaaagttggatccaaacaccacctaagttacaagatcaatcgaccttgtcagtcacctcttcttcctcatcgttgtcggagctgtggacacaatctggtgatggtgcgtgtatggctatcctggcctcttagtcgttgtcgaccatggtgtagcccttctcgtggcgatggccaatggttccggatcatggtctggcactggacaagcttgtcctggcgggcatagagcgtctcggccgttaagcgcgcgtcctcgttgagcttctcctccagctccggcggcaccagagggttgggctcctcttccaggatcgtcgatgtggagggtcctcttgatggccagtatcttgtcaaccagcctgttggccagcagtatcttcccactcgggaccatgatcttctcgccgtcgatcaccgccaccacggggatcggcatcggtaggttcctgttcatcagaaacgccagcggccaccgccttcctcttggtggatgacttcttcatggggccaccgactcactcgccttctcggccgccgtgcctcgagcagagcacgccttcattgatatcttctcactggccaatgccgcctcctcatcctcctcctcggtcgccgcagtgatcacgcgtcgattgagcccaccctctttgccggtcatcacttccgatggggaattttccttagagaatttgatggctcttcttcgtagatggggattttggatgaaccctaacttttcgatagagggaagaggccgccggtgcgtggtagttactaaggtaacataagtgggctatataagttgccacatcagatttgtgcttgtgtggaggagagatgagaggagagagaataaaagtgggctacagatttgtaaccagctacatcacaagctccaatatttttaactatgtgagagagatggatggattatgcattcatgatgcagtatatttctacagctaactattgtatgagtaagctattagatagactataaatgatgttttaaattttgaagttagtagtgggctgtattattaaacttgctcttagagggaagcttaaggggtggctaatgggcgggtgaccaccccaggcgatcaccccccatcctcctatacgttactctccctcccttcctcctccccttcttctcttcctactacaccataaatttaaaaaaaataaaaaaataaagttggaaaaatttatgtatagaaaatactatatataaaaaatatttgaatttaaattcaaatttgaaacaggtatgtaaacttttaacttataaactttgggcctataaactaatatttgaattcaaattcaaatttgaatcgggtatgtaaacttttgacttataaactttggatctataaactttaaatgtatagaagtactatatataaaaaatatttgaattcaagttcaaatttgaatcggatataactcaaattcaaatttgaaacgggtatataaacttctgacttaaactttaggcctataaactttagatgtatagaaatactgtatgtaaaaaatatttgaattcaaattcaaatttgaatcggatatataaacttttgacttataaactctgggtctctaaactttaggtgtataggaaagtaatgcgatgcaaaaaaaaaaaagaacccacgtggtggggggggggggggggcggcggagcggccctgatcgccccgggcaatcgttgcccagtagcaaaaccgtgaagcttatcatagtctgactcgagatggcagtcaccgcctgatcaccggcatcttcattcgctcggatctcggaccatgcaacgcagccgcaccggccaagccatgtcacggcgatcacgccggcgtaggcatcgtcacgcagttgcctgcgtcaccctgttttcgctgccgccgccggagcggatagcggaagctaccgagccgacacagcacgagcaccggaatctccgagccgcgcaatcttaccaatttttagtaaagttaccaaaacagtggctacatttagtttgctgccaaattttggtaactatataagaaatattgttaaaattttgacaactatactaaaattttggtaatatcaaaatttagtaagttttttttttcatcaaagtgaacaggcctcaagtccgttggattggagcatatgggttcaaccaagcaggccaaactttacagcccatcaaggccttgtataagaggcccgccaaatggcccatctcactagatgggcctaaactaaaatcaatttccagcccatcaaatgccttgtctctttagtcgtcaatatcggcccatttactagtatgggctggaaattcgagctactccaaaaatttggcccattccagccaaatccaaacgaccaaacaagcagcgagttcgagagaccactctcctcagatctctaccccatctctcccaccgcttctcagatccaccaccaacacccgcggtcgccggcggccaccgcgcgcgccatggccgcgccagcgacgccgcggctactcctctcgccgacctccaaggacctcatcgccgccgcctcctcctccttcccgtcgccgccctccccgacgacctcttccgatcccgcctccccgctcgacgccttcgcctccgacccggtcctctccgcgttcctctccccgtccttctccccctccgacttctcctccgccgcgctctcctcgggcctcgccgcctcccgcgccgagcagctgcaggaggccatccgcctcctccgccgccacctccgcgccgaggtgctccgccgccacccgctcctcctctcccacctcctctccctccgctccgcctccgcctcgctctcctccctcccctcccacctccacctcctctcctcccacctctcgctcctctcctcccatctctccgcgccgcgcgcacacctcgcgcactcctcctcctccctctccaccctcctctccaccgccgacctcctgctccactcccaccgcctcgtccgcctctcctcccgcctcctcacctccacgccgcctcctgacctcgcccgccaggccgagctccaccgcgagatccgccttctctacgaggagaagaacctcgccggcatcaatgccgtcgacgaggagatgcgcaaggtcgatgcggctgcctctaagctccgatcggaggccagcgctgtgatcgatcgcggcattgctgagtccaaccagaacgacgtctggtgcgggctgcaggtgtactataatctcggagaactgaagccggcagtggaagggctcgtggcgaagtacaaggcggcaggagcgaagagtgtggctgtggcactggacatgaaggctatatcaatggctgcagggggtggaggtggccctggaggcgtgcagaggagtggcacgccacagattggtggcagtaagaaggcggcggaggcactgtgggataggatgagacagtgcatggaggagctgcatcggtcggtcacggccgcatggcagctgcagactgtgctcaccaagaaacgtgttccattcacacaaatgctgttcctcgaggaggtttggcaggtgagacctgatcaatgggctaatcctattgctgcaaattaattgaaatgaaatttagaatataagatgtgttaaagttggtaaacatcgaatagacactatatgaagattttgttgacaatatgatgttcgtctgtgactgtgagtcatgagatatgttggcagccgagagacttaggcagaataatttacatcgatatacctgtaactattttgcagggaacaaatttgatctaagtctacatgtttagttattgatcctatattgtttacacttgagttggcaggtttgcatgatatatcacaatgtaatttgtcaacctaaattggatcttacgatatatcattttcaagtagttgatagtagaaataagtgcatgccttggattagatataatatatcagttctagtcttctagaataatgaattatctttaagatgtcagttggaaagtaatatgaactatctattcatgatgctcagtgttgcaacatatactgagttattacttactacactagtaaacacatatagtcctttctatctcctataacttcctgctgtgtgaaatttatgtgtggatgttccatggtctgtacaatcaagtgctaaatttttcctcgttctaatatttacctgtcaatagtttatacttgtgtgccaatatcttgatattgctcaccttttttttttttttttgaaatttagcattgacatgctcaccatgcgttccgattcctgtttcttgccccactgacaatgagaaaaattgcaggagggtgatcctctgttaacagagagagtatgggatgctattgttaaggcctttgcaagtcaactgaaatctgcctttacagcgtcaagctttgtgaaggaaatttttactcttggatacccaagattgttttcaatgattgagaacctcctcgagaggattttaagagacaccgatgtaaaaggcacccttccagctcttactcccgtagggaaaaaccacatgactgcagccattgagatattccagacagcctttctggctctttgtcatagtcgcctctctgattatatcaatagcatatttcccatgtcaggccgtggtataccttcaaaagaccaaatatcaaggttaatttctcgcatccaagaggaagttgaagttgtgagaactcatgggcatttgcttgctcgtgttctacaagaaattggaaaagttttgcttctcctagcacaaagagctgaatatcaggtattcacctgctactttatagtgaagttatttatttctagtttttcctagggattttgtatgctttctcagtttgtcatgtaaatattagcatatgcgattcttatggaatggtaaatctactactaaactctgatgattttgatttgaaacttgtatatgttacttttacgtcatgacctgtttcactgactgttttgtagattttattctgttaaaaaaacttaagatttttttttctagcagatggttgtagctctatctgtaggtccttattgtgcattggattgttctcttttctcgactaagtttgtgaagctaatcagtcacctcacagacctcaatctatgttcaatatgcactgctcggtcgaccttttcattcacctcaatctatgtacaatgcatttgttggtgcctgtgttattctgttcttaggagctcctctagttataaaagttggccttttcattgagatgaataaaattctggaagttttttttgttagttttgtggttattgggggtcgcagagtgaaataagagagatcttaatctaacccagtgaatgtgtacttgtggggactgctggttgtttccaagaaaatagtgatatcatgttggtttggtgaactaaaatttgtgttcttaacttctgtctcaatttgaagtaaagagagtacagcatagaacttgcattatgaaaaaaatgatgtcctatagtgcactgctgcatgagaaaatgcgactgacgtcttaagcagaatagcagatcatgaaacatggacaacattcgctggtttaagccattctaaaatctacggcatagaagagttggatcaatgtgcctttgctggagagcaaaaatgcacgtacaatctaattatattgtttgctttgctgttggttgttttaccgactgagtactattttcaccatttcctcctatgtgatatacttgcttatttgtatgtgcgcgcactgcacgggttcatttatacacttgtcgtgcagtgcacaactgcaaaatgaccataaattggctgcaggcattgtcttggtttttgtatgcatctgctaggcgctgatgtatattttgcttcaatgcagatctctactggcactgaagcccggcaagttactggcacagtgactccagctcaactgaaaaactttgctctatgtcttcacctccaggatgttcacacacgtatttcaagcattgtgtcaacacttccaaatgttacctctgaaaaactttccaaatcccttgaggccatttatacagtcgcgtgtgattcagtgagccctctattcaaagaaatgtttgatcgtctcggatcatgcattctgaaaatgcacgagcaggactttggaactcatggaatggacgcaacaatggataacaacgcttcagcttacatggaggaactgcagaagtgtgctgtccacttccgtagcgagttcttgtcaaagcttctaccttcatcatcatcccgctcagagaccatctgtaccataatggttagaagtatggcctcaagagtcctcatattgttcataaggcacgcctctctagttaggccactctctgaagccgggaagctgagaatgacaagggacatggccgagctggagctcgctgttggtcagaatctgtttccagtggagcagctaggcgcaccgtaccgggcgctgcgtgcattcaggcctgtcctattcctggagacgtctcagcttgagaaatctccactccttcaggacttgccccctagtgtgatcctccaccacctatattctcgaggacctgatgagttacagtctccattgcagcgtaacaagctcacgccgctgcagtattctctctggcttgattcccagggcgaggatcagatctggaaaggggtgaaagcaaccttggatgactacgagatgaaggtcaggtctcgcggagataaggagttcagccctgtgtaccctctcatgcttcagattggatctgcattgtctcaggccaagggctaaacctgtgttcagttcaacccagcatcacatatgtttgtatcatcatcatgtaggcattgggtacttgagagatcgattgagctttggaatagtttatacaaatgaaatagcatttgcatttgttttttttatggaaataaaggtgttcaaagtacagactctttctcctagctcctattatgttgtgaagtgtgtgatatgattgatcattgtacatctattagtcctgttgttccatctgcctgcttgactacaagcatgggaattttgcatgcgcggcacgctgatcacttgccagttgtatgtatgatctttggtgctaaatcacccgaaatgaaggaattttacctactcatgtgagaactcccagagattccaaagtccaatttgggttctttaaaaaaaattccgtgtaaggcataatgcaattgtttttgtgcagtttttgaggtgtgcaatcggaaaacatatcaatatcgccgttgtgaattttcttttctatttccttgcatctccttaagatttgtgctttatttctctccgtccatgatagtagatggtagtgacagtggacatgtccctaaaatacaagagttagttaaagagggactgaggctcccattggttgctcattttgcctaataagccaatagatagaaaataaaaaataatttataattaaaacttttatagatttgtacgtagcgacttaaaagccaacattaacagaaattacgttaaaagcatctcaaaatcaactaaatcaagttcaaaaatttaaattttggtttattctttgacggtttaggccaaacgatgaggctctgagggagttacacgattttataaacttaataacattaattatttatttcttatattacagattttcagtatatttaacaaggatccgtactcactgcctagtaaacaaaagggatgaaaaatgtatgagcaacataaatatagaaacaaaatgaacatgagtcaaagctactccatcttcatgtcccaatccccaagcaatggatcgatcattcctctctctctctctaaaaaaaaaagaaaaaacaaaataaaaagcaagcagtagatcaacttgccgcggggggagagtgtcagtgactcagtagagagagaggggggcagcggaagaatggggcggtggtggccgccgacgtcggcggcggccgcgacggcggagccgcggtcggtgcagctgctgctgctgggcgtcgccctcgtcgctgcctccttctacgccggcaccgtcttccgctccccctccgcccccgcgctcttactgcccccatccgcctcccgatcgcccgatccttccagaaccccaggtacctcgtctacccatctcggagcgcagggaggtggcgcccgggggtgcctgatccgctgctggctcgcatttttcagttcagttcttggggggaactagaattaggcgcccatggcgttggcggtttgcgttttctggtagcttgcgcaactattgtggcggttttaggttcctaattgtagaaattttcgatgatcttgaattagtgtagaaaggtgattatttgttttgcatggaggactgctcggtttgtttgtaaccaggtgatataacattatgtattagacactgaaaagagtatagttttcacagacagttcggcatttttcagaaaaaaaagggaataaatcggttaggcatttgatcaggaatgactatgcggcgccagtatagaaaatcaaaagagtgcaggccactcctattcagttcataattcgtgacattatattttttagatcttgacacatttctgtatgtcttagatatgaanntcncngntgntcatnncaanngggnttcatg

SEQ ID NO: 59794 - DNA, 8190 bp, Oryza sativa
cgacgattttccccatgactcgtgccgatcgtatacatgatggtcaggttggttggaggctttagagcaagtttaatcgtatagcctactactagctccaaatcatctatagctaatgtaatagtcaattcatataatagatgcttactatactattaatacctggtcccacctgtcatacacacattacgtcttgaagtccgtgctgtagctggctacagatatgtagcccgctacttttctctctctttttttatctttttaaaaatatatttatagttggcttatagcccgctattatacctgctcttagagagttcctggccagcacgctaacgcagaagcaatgtttttatatcaatcacactagcaactatatttcacctacatctgtgatttcaatttcaatttcaatttatctttcagagatggttccgatcttctctgcatatttcaccctatcgcgccggatatgaccgtgtgtgcagaggattagacgtcgagatgtaactatacattaatagcgtcgcatacatttgttcgtgctgcccatcgctcgatctgtcgagcatgttcacgtagactgccaatgtaaacatccttctaccttttcgttgcaatttttttctcagcttaattgatctgggactggtttggtttgtgacctaaattggtcttaccaatttttgtcaatgttaaattttgataaattttagcatagctagttttggtaaggcaaagttatgtttagattgaagccaaaatagcctaagggcttagtttgttttagagccaatttttgccctaccaaaatattggtagtgccaaaatattgataagttttggcactaccaaatttggtggaaccagatcctctaacgtagcgctcgctacgtcagagggacgtccaacggctatcgtccgtccattcggcatcggacggagtcgagcgagcatagcgattagacttcgcccatgttgcagaaaaatcggcccacgcgacctacaaccaatcagccatcgacgccgcctccgagccacagccgccgacgccgctaggaagcaagtcgtcgccgtcggcgtcaccgccacagcctgcgcctccccagcgaggtcccttcattgccacccccctcttccccatccccgtcccgcgcccgcctccgtgtcctccctcgagcggaagcctccgctgcgtcccgtcgtggaggtcgcggaccgtgcgcgtcgacaaaaccatgactcctggttggaggtcaacatgtcatggaacatacagcaggaaagaagcaacttgtccaaagcaacaatgcattgttgtgagatttattgttaagagcatctgagtactgcaattttgacacagatttgatccaagtctgtattcatgtcagttctgctctcaaattgcaacaaacattaaagtatgggaccaaatctatagatgtgcaacaatcaaatgctcaatctagcaacaacagcacattgtaatgttcagtgtttactgtcgaagcagcatcaacacaagtgacattcttttgctatactgaagtttcaatccatttagacgtactgatttgaaaacgaaaaattgatgcaactacaatcttcacattcagtgttgagttacaatcccaattcacatcaatttacaacatccatttatatcaatttacggtctcgatctaggtgtacactgccggcagcaagcattcagtgatgcaattacaatcttcacattcagtgttgacgtacactgccggcagcgagccagcaacatgttcaaggagcagctcctcgactactcccgtcaccgccctcgtctccattgtcagcgctcgcgtgcaaggtgtagctaggggtgggcatatttagaccgaaccgaagaaccgaaccgaaaagaccgagaccgagaccaaaaagaccgagaccgagaaattcggttatctgttcggtccctgccctcaaaataccgaatttatttcggtcatttcggttgttaggctcggttaaccgaattaaccgaaatgaccgaaattttggcccaataggcttaggaagcccaataagcccactaaaacaaaccctagagtgatacaacccttaccctaccaccactgccgcactccacagcgtcgcctcctcatccagcctccatcgctccgcctcctccagcctccaccgcgccgcagacgccggctccgccctccacctcgcggcgtcggccgccgccgccgccctccaccgcgccgccctccaccgcaccgcggccgccgccctccaccgcgcggcggccaccgccgctgccctcccccgcgcgggcgccgccgccgtcctccaccgctgtcacgctcggaatttctatccaaaattccaaacgcttacatgtgtgtgaaccctcgtccaggaatcagccgaggcacacaataacaatttgataatagagtacaattattactctaattaataagcgaataaaatgtcattacagaggtagatagttcctctcaatcaataaagatctaagcagcggaaaaataagataaacggcgcagacgactccactccacatgcagcttgaccagggctacacctaatcctccacaccatcagcatcactgtagaactcctcctctgatgaatgattgcaaggtgagtatatgacatactcaacaagccacgcagcaaatatgcaagtgcacaggataacaaaggatggcatagtagggtttcatttgcataaacagcatttaataaacatttcagaatttaataaagtagttaagtagtaattaaacaatattaatccaatgctatacaacataccctgttgcataggcccaaccattcttaacaatcatcccggttgcacagttctatctccaaaccaggaatataccattccaaaccaggagctaatcaaattattaccagttatagcatcttttattatggtgagaagtgtgaaactaatcacgaaagacattgttagacccgcccataaccgcgggcacggctattcgaatagttttactctggccagaggtgtaccactgtacccacaagacacagccccacaacatgtcaccatgcgcctcaataccaccacggtacctcagaaaggggctgtgacagtacccctcgcacaacacaatccaccacagtgcaccattcctggagcataatcaccccttataaacaaggtatggactccccagcgacccccgtgggcttatctccgccacttctcagtctggtgctccgcaatgaaccatgctatacaaaaggtaaagccgttgcccacgctggcttgtggttggcacggttaatgtttcacaaccgaaactcgtgaaccggttcttaattgtcatgagcacgaccatcaaaaccatgtgttcacaacccatcattatcagattttagttggcaaattaattaattaatcaatcacgattgaccatcatgagctatcattaagccatcattaaataatagtgagtcataagttatcccaatagtgtgctaatgtttctaagcatggctaagcaatcgtatctaatatctagctgaaccaatatataaagcccaactagtcaagttataataacctaaggtatcaaggaataaagtaatcaagaacaaaaggactataacaatcaataggttaattccacccaacgacattcgaaaataaatgcaatagttgaatagaaacaatagctttaaacgggatcaacatgctcaaagggatgtttgggatctgtgtgacttgccttgctggccttggaactcttcaaattcttctcctgcaaaaatggactctccggaaacgtcggaatctaaacagaaaggagcaaaatcaccaaacagcacataaacaagcatgaacagtacatgtggatatttttaacatgtagatcttaattttagaaaaaattagagacttgaaccaactaaatccgagctaagatgaattagttatgaattttcaaagattaaatcggattaaatcacttatatgggttttaattgaattatgacgcaataatgaattatttttgaaaaggaaaaaggggtttattgcgtcagcggctagggtttgcggtggaccgagtgcacggggcggctcacagaaacgaacggccgagatccatccatccaaaactgacggccaagatccatcggtccacgaccggaccacgggggacgacgacgatgacgtcagcggtgacgtcaccaccggcggcggctcgggcgtgcaagctcgccggcgaacgacggcgcgacggcacgaacggagggcaccagcacgtagaaagcgacgcggcgaactcaccggtgaccaaaacggcggcggaagatcaacggacggcgacggcgtcgaggaagaagcggcggcaaccttcggcttgacgacgatggcggtgctccggcggtctacagcaacgatggaggggcggacgaggacggcgacgcgacggcgaccacgacggcggccttcccgagcaacggcgacgactagagcgacgacgacgcacggctggagcgacggcgacgacggcggcgcgaggtcccacggggctagggctctacgggcgaagagagacgaaggcgagggtggcgacgggtagcggagacaccgggggtccttttataggggcaaggaggcggcggcgaaggcccacggcgaccggcgacgcgatagaaggtttagggttcggaggagagagatcgatccgaattgaactcgaatccacggatttccaaagcgatttagacgatgtttccaaaagggaaaagatagagtggatcacggggatcctttctcctcaattgatttcaccggaaacggaaaggggcggccggatttggaatggcggcggcggcgcggcgcgtctagggtttcgtcgggaggaagacgacgaccctgacaggcgggccccacctgtcagcggcgaacgcgcgcacgggcgggcgactgcgggccggcttgggccggggagagagagagagagaaggttttgggccgactttcggcccaaagccaaaagagacttttaaaaccttttccaatttaaattattcatgaaatgcaattccatttattaaaaatacttccttagctcaaataaatcccagaaaaatctaggaattatagaattaagcaaagtatttaatgaaattttatctggccccattttatattggaatttattaattaaaaccagatcttctcttctaggcttttaaaataaattctaataattccaatttagacaacaatttatatatttgggatttttagggtgtgacaaccgcgacggtcgacgcctccgccctccacagcgccgcggccgacgcctccgctctccggcctccacagcgccgtggctgacgcctccgccctccaccgcgccggtgacgcctccgtcctccaccgcgccggcgacgcctccgtcatttttttttcattccaaattttctcctgaaaaatttcggttagaccgagaccgaaaccgaaaacaccgagaccgaatttgccggtcctaaattttttgggatgaaattcgatcctgagtttgcaaagaccgaactgaccgaaaaccgaagaccgagaccgaatttttcggtctgaccgaacgcccacccctaggtgtatgagagccccgaggtgggtggtggcaaaagactccgcgagggcaccaccgtggaagccgttgtcgtcgaggcagccgcgacctccacgctggatgaaacaggagaacgcagggcgagggatggggaggagggcagcgatgagaggaggggcttcttccgtggtcctctactactccactccacccgtgcatgcgccggaggagacgacgagctgcagtgagcggctgaagaccacgggaaaacaggagccatcccgattttgctgggtgggaagaggaaggtggcaacgaaggagccctcactcgggaggtgcaggctgcggcggtggcggcgacgccgatggcgcagaggcctcccctcccccatttgtttcctagcggcgccggcggctgtggctcggaggtggcgtcgataccgcgtgggctgttttttctgccatatgggccgagcccatctgctgtgctcgctcgactccgtccgatgccgaatggacggacgagagacgttggacgtccctctgacgtagcgagcgccagaggatctggttccaaatttggtagtgatgaatttgaactattgtaggcaaaatttggtagcaaaccaaatatacatttgctactattgaagttaccaaaattttgatagggcaataagttggtatcaaaccaaacaagccctaagttaactattaaaatgaccaactttcttagacatgccaaaatttaacttcaaaccaaatagatactaaacactattaaaattgccaaatattcgcaagggcaatttaggcctcaaaccagcccttgatctcctatcctttatcacgtgccaccttaaaattgttcacacatctcgcatataccagattaagtattcacctgttttatttagtgtagcacaagattattaattagttaccgaatctatttaccaggacattcgtgcagggtaagcacgtaacactaattaaaacactttttcaatgtagggcccctttaaatcgcaggaatgagaaaacataggaataggaaaaacgcaggattttgataggaatgtaagtgtaaaacagaggattgcaaaatcctctgtttccaagagatttgactcaaaggtcgtttgattggaccgcaggaaaaacgcaggaattagaggagagataaagactcaaaggaaagtttccaagagattttacctcatgttagaattcctcaaaaacttgcatggcattagacaatacataggaatttcataggattccataagatccatttctttgattcaaatggctatataggaaaaattcctataggaatgaaatcccctaaaattcttatgaatttcctttaaatcaaaggggccgtaaagtccagaaagatggttagtacaaaatatttgataaagtacaatttttataaagtatttgggttatttagttttgttttgtgcaggatttaataatttaaaaaattaaaagcaacttattcacatatttgattcaacttttatgtcgtcgtcgttatttaattacgagccattccccgttgtggctgttgcggaggattgtgagctctgttcggtccaaagacagcataagaggattgtgtccgcaacagcattgtggaaacaacaactaacaagggcgatcgccgctatacggtgcttcaagtgaatcaaacaatccatgctatgtggaagggtcaagggtacaagaactcaaaagaaaataaggagaatgtgatgttaatgtatcaatttaccaagtaaaccaaggttcagtgtttatcttccatatttttttatttaatatgcattttagcattcaatctccaataaaaaaaattcaagcattggcataagctctgctcatttcatttcctctcttttctaggtagaaatagatatatctctataatccattaattaagggccgtccctgttagtctaatgatattaagtaaaaaaatatgctaaatgtctaacacaactgtttttttttttttgcgggggtctaacacagctgttgatatttaaaaaatgcaaacaaagaacttgatatgcccaaattttaacggatcatgttagataaaaaagttcatatatatgaggtataactataggtaaaatattcattgttctgcatttattttgaactacagaattactaattctgtaactataaactttggaagttcatttgcatatgaatacacataaaactggcaattaatacataatttttcataaaatttatacaaactttagctttataagcatatgtaatgttaataacatgtgtgaaaaaacataaatagaaccatccagccaaaaactcatcatctgcaaaatttattagtctaccagaaattttcatcatataccaaatttatgcctaagcagatcaaaacagcaaaattgttcaattaaaaggagagaatcgtataggagggaaaatttgggtgataaataatgtttgattgttgactcttgataaaaggcacttctattttaaaactagatgacatccggcacatt

SEQ ID NO: 59795 - DNA, 1252 bp, Oryza sativa
caagccgagcaatgtaccaaagtcagtgtctaattcttaaatttgctcaacaactaaaatgtggaatggttggcctgggttggcttaggacgagctaggacccagggtagggttgccagttcggtccgaatcatcgtaggccttgggttaaggcaggttcgtgtgggttcacggccttgattaataatattggatagttctaggatcgtgtttacaaaatggccttgagcaactaaatgtctttaaatgctgtttactgcaaccctaaccctctatattataattcccttgtactcccttgcatttattctgcatttgtgggtgtgtcttgttgagtacggtggttgtactcagtcttgctcaattttcccaagcccagatgaggagttccttgaagatgaaggctttggtgtctagctcgtgcctgccgtcaagcgcctgtggtcgtcgccctagtcttccgctgtttttcgttgtctttgagtgtgctgggccgttgttgcccgtgtaataattttatatacgcttccgcttgttaaactctgaattgtatcaacttttggtgtaccttgcctcctgggacaaggattaatgcacgcacgtaaggaatgcccgttgggttatttccggtcgtgacaagttggtatcagagccttccttgaccctaggacgagccgtagatcccaagccttagctatattttcaaaaataaaaatcctttattatttgtgaaaacccgctattctctctttgtcttgctgcttcatttatcgtcaaaatctgatcttttaaatgttgtttttcttttgttttgtttgtagatggccggcagcgttacccgtcgtggtttggacatgtctggcttcgtcttggagctgcgaggcatgtgcgtggtcttggggtatccacacggagtggattaccaggccaggccgctcccggagcaggagggtgaggatgcagagcctcacgctggttgggaggtcactgcagtgatcctctccggctctcccgagcggacttcgctggcagtcaccgcgggtggggattccttccccgccgcttgccagaacgccgctctcctcgccatcggcacccttcaccagcgctacccggacgagttgcagcactcgccctaccgctaccaccctcgtcgcggaggagccagcgaccacgccaccttccgagacgccagctcggaggatgacgctaccgtcgtgcacctggcacgcatggtggaagcgtactacgc

SEQ ID NO: 59796 - DNA, 24636 bp, Oryza sativa
catgctacatagattttccttgaaaagactaaccaatgtatatattttctttaaccaatcaatatatatattcagccatatcaatagatcgttaaattctcaatatgaattttgtgagattcatcatcaatatcgttaaattctctggctgaattttgacaatattcagccatatacggctctggctgcatctccccaagcagaatgctgctcccctagtcccctgtcacacgtaaatctggaatatccttaactttgctccagtagtctcctccacgtttgcatcttctcaccagcgtagggcattgtctaataaagagcttttccaggctgtgcagcctctgctggagaccttccggtaaagcctttaaactagggcagttccaaatagccagatcattgagagctgtcagattatgcatcccttcgggtaatgttgttaggctgtcattagttcccaggtagagcctggtcagatttgatagacgttgaatgctgggaggcagggacttcagtcttgggttataatcaattgacagacttcttagagcgcccaggcaacccagtccttcaggtaggtcctcaagtacattgcagctgcatatcctcagatacgataagcttgtagggaaagccactaagttgtagcagaattcgatttctatccgttccaaattatgcatgccctcatcttcaaaggacttcactgagacttgggcaggtggcatacccgtgaagttgttgcaatatctaatgtcgagtcgttttaatgaagtcaagctttggaactcctcccctggccaaaaggtgaggctgttacagtactcgattgttaagtgctgcaggcacgcaaatgatttccagaaccacagtggtgactgcaatgtatcatattggatgaagcagtcacaggaaattagatctaagttctgcacagacatcacgtgaccacttatattttgtatatcttctggtgctagagcactgaatccctgtaggtgtaatttagtgagtgagccccatgatgaaaagtgatgggccaaaacatgatcctttgaatctgtggttccttccaggttttctttatagtgatagattagtgtttttttcctctctaaactcccttgacttgcaccaagatatagatacgacagattactaacacttgacgataagccaatcaatattttgtttcctatcacacttaacgacttgagaaccggagcattaggcatagctgtcaattttggacaatcaatgatttccattgcatctagcacgggaaaattagccggtgttacctgttcaacatcatattcctgccagttctctaaggattccattcgttctagtgacaagagttttaattttgggaatgccactaattgatgatcacattctttatcagagcagaacccgttacacaagtatttcaacttcttcatgtcttttagtcggagaacctcgagaaagggaagcttccacactgatggaagtttcatacaatttatggagtccgttactttgagcttaacaatgttgcgcaatgtgattccattttccatccatatgggaaacgtagtgcccatatactgcctcagctttagaacggtcaatccgttgggaggcttaagagcgtcaagtacttcttcatgacgatataaatgcaaatcttcagcttgtaactccgcagattttgatgtgccccagcaaagtgctaactgctgcaaatttgtcttacactcaaggttggcttcttttgcttctatgggatttgttactttaatcaaattaaatatctgaagcttgcccccaagttttaagtcattcagttcgttaatcctatagccagattcattaccaggtacgaactttgtcaatgtccgtaaattaatgagctgtcctagaccagctggcatgcttgttagtcgagcacagtcatcaaggtacacatggcgaaggctaatcataaatttcatgccatctggtaggtgggtcagcctcctgcatctattgagtatcaacacttgtaaattataaagtgcgctagctgcttcaggtagtgtatttatgtagctaccagacaaatcaagatatcttaagtgcttcataaatgctggttcaacaggaaatttttcgatgccgaaaatatgaagcccaactactctcaaaggagactcattgaatttaatgtcctgggcaatatgcatgtcattcttatctaaggcaaatacactgcggataactcgacaatgctgcatcaagaaaccaatcttttgttgaccctcaaaagccatatgatggacatttttgggtattttcttaattttagccagattttccaaagctaaacactcatcaccgcttatatgaactgcaagatcatgcataagatcatgaattttgaatgtagttacatcactttgcccatacctgtacactttacgttggaaaattgatccaatttgcttaacattttggaaaaatgacctccaaacaagctcccaaaaaacatgattcccattctcttcaatatctgacatcttcttggatggaataaatccattcgatacccaaagatgtattagatcgtccttatcaatctcgtagtccttcgggaatactgcacaaaaagcaaaacattgtttcatatgagaaggcaaatttttgtagcccaaagacagcgctggcagtatctggctttcttcatcccaagtgttgctttcaaaggatggatagccaatctcgtgtctcctgttttgtactcatcaaggctcccatactctttatggctaacggaagcccgcaacatttctcaacaattcttttaccaacctcaacgagctctggagtctcaaccacacctgtgccaaaagctcttctgctgaatacaatccaagaatcttctgggttaaggttctctaggcacaatggactaattgactccatgattgatgcaactttcacgtttcgggtagtcacaaccaccgcacttcccattccacaagaaccaagcaatgttctaagagctccccatttctgtttatcttcattccaaacatcatctagtacaagaaggtacctcttttggcccagttcttcccgaagacgttgctgtagcaattccaggttatcaaacttcagtccacaatcattcccaattgcggtgtcaattatccccttgacaataacaggaacactgaagttctctgacacacaaacccacatatgcttttgaaaatgtgctttcacttttacgtcattgaagaccagctgtgcaagagttgtctttcccagtcctcctatcccaacaataggaagtattagcaattcgtcggtctcggcacttagaagcatatggacaatttcatctctttctttgtcccttccaataacttcctgctcgtcgacgtaggaataggtttgcatcctctcatccactggcatggagcaatttaggaacccaaatcgattcatttgcgaaacaagctgatcaatccgctcgactatctgctggagtctctttcctatcctatacttgaacagtaaaggattataatgagaagagaagaaagcccttacgccagtattgattttatgcccacgacggagcgcttcgcagcggagctcctcgtagtgcagctcatcaagggcgtcatcagcatcacaggcagccagcttcagctttgcgatccaagacttcacagcaggcttcttggatgcctgatcctcggcatcattgatcacttggttgacggcaagcagcaaggtatacagctccgaacgccgtcgttcaatacccccgatgaaactaaactctgtgccgagagactcacctgctttcttcaggagggcaggcaaaagagccgatagtaactccgccatggctcaaagctcagagatcaatggagtattggcagaacagaaaggattggaggacaattaatggtgggttgaggaatgagcgtatggtgtagctggttgagttaagtctttggaaaaaaccatccaaggcacaaagatgagttggagttgaaggagactgataatggaatgagaagaagcaagtgagctgtttgttccattagaaaaaagtgggtgggttgtttaagacaatgggtgcattagatacatcatgttagttgacgcgcttcaaatttcaaataatcacatcatacaatcaaacaacaagtggtcaactgctcagtgtaagctggcaagttgctaaagatgctcagtgtaagccccatatgtcagctgaggtatcacagcaggcatcagcctagcaccagatcagaaggagaagataaacatccgcccactgcagcaaccgaattaaaccaaaccaacagcagcatgtatggtttcacctaaacaaacaattccagcaagtttcctctcctaaggacgtccatagaaaaaatggaaaaaaaatatatgcaagagtgccaatttgtgcattataatgccctactaggctgtcatgtcgtgcattatataaatcgtccaagactttgaatttatctttgtatcgccgcaggtggctataattcagaacaccaactaagcttctattatttgcttattttagtgcctatcaaaattattagtggctatttctgttcacgggctgggaatctacgagcttaccttcggaggtggagctagccgtgccttccgatggctgctgctgaagacgggcttatttgatttaaagtcaatttttactctaccaaaatcttggtggaaagttttggcactaccaaattttctagcattgaatttgaactatagtagccaaaatttggtatcaaaccaaacatgcatgtgtcgctgtttaagttaccaaaattttagtaggataaaaattggcatcaaacgaaacaagcccgatatctcttcgactgtatagctgtgccggatcgagacaaattcctctgctccgtgaagtttcttgcgcccgcatccggctgtcttatgggagagcagcttccgccacaccggccaacaccgggttttggccgccggcagagtgtgagggggattgggtggaggcaaccaaagcggagacaatattgagcacgcgcagtccgtgttagataagttagttattggagataaggtttatattatcacatttaaccatttgatcttatatctataatacggattgatctcaggttgttgagagtgatccgttccctctgtaatgcgccacggcaaaggcttttcctgcctatatcaacaaaggtgcggcccctatcagggttcagcgcttccccctattattccctgatatggtatcagagcaaaccgatctacctccatcaccaagcaaagccatggcaaagtttgggagaatactaccaatcggacatccgatatctcaaaaaatatcgaacggtcaaaatgttgcagctgatcaacatgtgaaacattaatttatatatggtgaaacaaaaaaaaacagcaattgaaacattaaaaattttatgaaacacagtgaagatacacgttgaaacatgttgctatcacttatgaaacaacgagagttaatagatttaaacatatatttttctttcatcaaaatataatcgtgtgatatcttgttgtaaagatgtaattacaacgaatacaacggtatgatcgaatcatagattggataagtagtttagaagaaaaatcattttaaagaccgctaaaatgcatgcatgcaagcattgatggagggtagtggcaattattttcgagaattttgtgaaacacagtaaaaacaggcgctgaaacatatcgacatagcgtatgaaacatgaagtattaatagtttgaaacttatatttttctttaatcggaatataaacatgtgatatcttgttataacgatttaattccaataaatacaatggtgtaatcggattttagattgataagtagtttaggagaaaaaatattttaaagattgacacatgcatatgcatggttggaatgaatagctacgataattgagttagcagttagttgattacagatagaagcacccgtgaaacttgccatatcagttgacggattcgaatctttctagagttagcatgtagacagtgtggaaggcatcgatgtggtatccaatttttccgtgtcagtcgaacggccgattacaagcattttcccgaagtttctcgaagaatcatgccagcaatcactgctttcttttcggaaaagctaggaaaatcgaatcacgcccatggtttgaaattttggttcgaaatttcggcttccaccggcaagcacaaatctccccggaatttttggtttcttgtcaaatatttgtaaatttggtcaaaatttgttcaaattcagtcacaatatgttaaaaattcaaataattttggtcagaaaaacccggaaatcacgaaattttcaattttttggcaaccatcgaaattccggtgcaaccgaaattgcaaactcggatcatgccatatggaaggcgcgtattcttgtgattgttcggggtgctcggttggaaggttctcataggagcagatcaagctccagttgtcattcttcgagaaaaggagggcgaaaaggaaattatcatcaacaaaccagattgtgatgaatggatttcgacaaatcaacaggtgctttcatatttgctttcctccatgactaaagatctacttgttcaagtggcaacatgtagcacaacagcctcggcatggagtatgatccaagagatgttcgggtccatgactcgggcacgaacaatcaacacgcgactctccctcaccacgctgcagaagggcgacatgaacatcacgacgtttgttgggaaggtgcggcctttggctaatgaacttgcaatcatcggcaaacccattgatgatgatgatctgatcagctatatcattgctggtcttgatgaagaatatgtgccggtaatctcgtccattgttgggcgaccagatcaggtgaccgtcagtgaggcctttgcttagttgatactccctccgtttcatatcgtcagattttctagcattgcccacattcatatatatatatatatatataaatgaatctatacacgtatatatgcctaaattcattagcatctatatgaatatgaacaacgttagaaagttttacattgtgaaacggagggagtaaagcttcaagcagaggctagcactttgccagagtggagaatggagaatcctggcctcggctaatagcgcaagctgtgtccagggtcagcaacaaggcgtcagaggtggcggcggcaacaatcaatgaccgagaacgttaatacgtgaacgttcgcgtgttgctcatcccgcgaatgggaaaacacgtggctgggagcttcggacacgtgactcggaaatttgttgcggcacgctgatccaactacatgggcctcacgggctcatggcccatccgaatattttgtgcttatgtggaatgcaaatttgttttaaaactcatttgtaaaaactttctattacctaatgaattttagtttctatgcatagattttatctgtataaagtatatatgtataaagtttatgtgtataaaatatctatatataatttttatgtgtgtaaagtccatgtgtatatacattgaatgtttctacgtataaagttttctatgcgtaggctttctatgtataaagttgtattcgtataaagtttctatgtataatattttctcacccctacccaccacttctcagaaatttaaagggaaaatagaaacggataactctttatgctaaaaatcgttacactgggccttcgaagaaaaaaaaaacttcatgtgacttggacttgcaagtaacatgaataggggaaatgatcgtgggctggcctggtggagagagagactcccgtgtcgctctctgcagggcgacccgggaggcgaccgtcgccgaggccccgctcctcctacgcgcgcgcagcctcgccgccgccggcgatgctgcccccgatggcagtgccggcggcagcgcccacatttatgcaggtgaaacctgccctgtataagatcgttggaagttatatattcatgtgggcatttcgccccccggtgaccagtctaaaaaaaagatcgtgggctggcctacatcaacaaagaaaacaggaaggcaatcaggcttttcatcaaagtgcacgatggtttttctagttcgctcgccccggtcaccgcgaacactcgcgcatcagacttacccatcaatgacaaggtgctccaaacaatggtggaaactgaagtcgaggaagaggcagccctagcggtggtcgaagaaacataggaggtgtcgacaacaggcccaagtgtcaactttgctacaaaaggggacacacggtaaaagattgctagtaccgtttcgatgaagactatgttccatagatgaaaggtttgcaggttctgctgcattctacggcattgatttcaattggtatcttgacaccggcgctacaaatcatgtcaccggagagcttgagaagctaatagttcgtggcaaatatcatggcaatgatcaaattcatatagcgagtggtgcatgtatggagattagtcacatggtaattctgttgttcagatccctagttgagatttacagtgaaaaagtgttctttatgttcctaaggccaagaaaaatcttgtttcatctcatagacttacttgtgatatcttgcctacatagtcatagaattagtatatcgtaaatttttctttataaaggatttggccatgagaagaactctacttagggtcgttgtcataaaggactatatgctcttccatcttcatcctcgaatcaaacgcatacccgtagctcacccgaaaaacaaacgtcgcgcttgttgccaccattcggccagtggaagaccatggtgacttgggcgggtggaaatccacattaatccagtcctgcagtaaggtccatactctgtttgtgtaggcgcacgcagtgaagagatgattgcaatcatcaaaatcagactgacacagtgagtagactggttcatgaggccatccctctcttcagcagaatgtctgccgttaagcaccggcctttaacagccaaccacacgaactttactctagctggagctgttgccttccaaatcagctcaccaatggcaaggtttcctaccatgaaaatgaggtctacttggagatactgagtcaaaataagagagggaaatatataaattaaattgaatcatttgctgctgataaaatgtatagctacatttttcttagataatggattaaataacctggcctctacatccaagtggatgtacacagccacagaatagctacatatatcagtattatttctccaacaacaccctaattcatttaatgttgtttatcatctatgtttcgtgggttattgtacattgaacactacaccaagagagaaaaataatatttgcatcagtggctatccgaataggaagggcaacatcaatcaaacagattggatagaaaaaaaggtacttaattttttggctaaactcattaattttgtttgaaaaatgcatgaaagaaaagaactcagtgaataacttacgtgagcatggcaaacagccccagccaacattcctgtgcctttccatgttttttccgtgagggcatgttctccggaatcgcagccgtaatgctgcttcacgtctagctatgcccaggccaactgcaatcaaattattatcaaacgctgggaaatttataccaatattattgattattcgtaagaaatatattgtgattcaatgatctgtaacgcacattcttctctctttaaaataaagcatattcaaacaatattggttcccgttcaaataaaacaaagtagctcgtgtaaaaccatgccctaattgggggaaaccaggcggagattgtggatcgttagtccacacacaacacaataagaaagggagtacagcaacaaataaattctcaccactgctcgtgcagtagtgcatcaggcgatcaatctctaaaatccgacgccatactccatccccttcaatctaaaccatggagaatcatgccctgattgaacaaaacaagttaaagattgaatacttaatactatcaccgcacaccaagaaaaggactaaatccctcactgaggctagtgaccctgcagcatgcccacatgaagccccttctgcatgcgccatgatttctctagcagcttagcctcatctcccacgctgtctgcatcgtcctcgccctcggatggcttacatggtattatgggtaattttactatccttcataagatacctagatgtaccatatttctagtgtaaaatttgatatctctaggtactaagtacctcaaggcaccaaaaattttagtgtaaaatttaggtacctcaaggtactttctcaagaactgtaaaattccactatagtaaagaccccggccgtagcattcacgtgggcgttgcgcaccacggcgtcggtcatggcctgcgagaagcagcgaatcatagcgtagccccctcacgaactcgggcttgcacggctccagctccaggtccccagcgaaagattcatggtaagtcttcagaactccaggtctccagatctaagaaacagcacaagattcagaagcaggatgaatccacaaacactggcatacctgaatatgctgaaaatggatgcatataaacaaaattacgataactctagggaaatatattgggggaaattataaaaaaatgtatcagggagcacacctttgtttggttcacttggtggaaagaagtatgcaccacctattgtttatcagatgctacacagaaccccatatcctttgggtcagaggtagaaatatatttggcaactccgacaagaaagagggaattcctcgaaatcacacaatcagtgttgagcagtggaactccaatcaatatcagtatatccacaatttgtacattgttacaaaaaggccttgatcccagcaggtcaagatatacgttcggagcagagaaatgcaatgcacttcattcacttaagacacattctgtttcaacaatgtttcagcgtagatacctgcaaaatttctgaacatgagaggaatgatgccaaagttcctccaaacagagtgatgcaattcattcgattaaacaatgtctgacttgataaaagcagcaacaaatggtttcgtagctcccaggtaagtaagactcaaacttgcttaatcgaacagagcaaggcaagggtaagaaagagagaacgagggacaacagtgtgcacctttgtagtataaattaattgtctggctgcccagaacttgatgctcttctttgccaagcgttcatgcatttgggaatgatggttctggctgcatcttgccagacagggcgcggctcacttgtcactcgtaaatcaggaatgtccttgactttctcccaataatctcccccacgtctgcatctcctcgccagagcagggcaatcttcaacggtgaacgtttggaggccatgcagtctttgctggagaccttctggtaaagcggttataccaggacatttaataaaatgtagtgttttgagagcagttagattctgcatcccttcaggcaaggaggttaagctgttattacttgtcagttctaggcttttcagatttgaaagacaccgaatgctggcaggcagggagctaaaacttgggcaacccaaaattacgagagttgttagagtgccctggcaaccaaatcctccaggcaggccctcaagtacattactgtcagttatcacaaggatccgtaggcagatgaagtttgtagggaataccactaagttggggcagcgatcaatctgtaagtattccaaattacatgggcctccatctgtagagggccttgctgacagtcggtcaggtggtacacccgtgaagtttttgcaatctacaatgaagagtttttctaaagaagtcaagcttcggaactcctcctttggccaaaaggtgaggctatcacagtaccagatttctaattgttgtaggcatccaaatgatatccagaaccatagtggtgactgtaatccttcatgttggatgaagcaatcacaagaagacaggactaagtcttgcacagacatcatgtgaccacttatactcttcacattttctggtgctggtgtattgaatccttgtaggtgtagtttagtgagtgaaccccatgacaacaagtgatcgggcaaaatatgctcatcctttgtatcagtgcttccttcacgttctccattatagatatagtatagtgttcttaccctccgtgaactcccttgacttgcaccgagatacagatatgatagattactaatacctgacactaaccccagcagtactttgtttcctgtcaaacttaaagacttaagaatcggaacattaggcagtgctgtcagttttgggcagtctataatttccatggcgtccagctttggaaaagtaactgatgtcacttgttgagtgtcatattcatgccagttctctaaggattccatccattctagtgacaataattttaatttttgaaataccactaattggttgccatattcttcatcagtggggtacctgtaacacaagtatttcaacctctccattcgtttgagacggagaacttcaagaaagggaagctgccacactggtgggagtttgacacacattacagagcctctcaaactgagtttaacaatattttgcagtgtcacaccatcttccatccacattggaaagttggagcccatatattgccttagctttagaacttttaatccgttgggaggcttaagagcatccagcacttcttcaggacggcataattgcaaatattcatctgcagaatgacaatgtgaacaggtgaaatttcgtgagtcccaacaaagtgctagttgctgcagatttttcttattctcaaggttggcttcttttgcttgtaacggatttgttaccttcagcaaattatgtatttgtagcttgcccccaagttctaagtccttgagttcatgaagtctacaatcagattcattgccaaccatatacattgtcaatgttcgtaaactgctgagctgccctagacccggcggcatcctttgtagactagaacaaccatcaaggtacacatggcgaaggctgatcataaatttcatgccgtcaggcaggtgagtcaggcccctgcatctattgagcattagtatttgtaaattgtacagtgcactgaccgcttcagggagtgtttttatgtcgctagaggataaatcaagataccgcaagtgcttcatatatgctggttcaactgagaatctttcattgtcacagatatgaagcccaagcgctctacaaggggacaccatgaatctgacgtccttcatagaattcatatgattcttatgtaaactaaatagacttcggataattggacaacgctgcatcacgaaaccaatcttgtgtggatgtggaaaaactagatgatggacattcttcggcattttatttatttcaacaagattttgcaaagtatagcactcatccccgcttatagaaactgcaagatcatgcataagatcatgaattttgcatgtagttacatctttgtacccatatatgtactcttccttgcgggaccgagtttgcttcgcattttggaaaaatgatctccaaagaagctccagaaaaaccttgttcccagtttcttctatgtccgaggtctctttagatggaatgaatccatttgatatccacagatgtattagatcatccttatcaatctcgtagtcctttgggaatacagcacaaaaagcaaagcactgtttcataaaagaaggtagatgtttgtagctcaatgataggactgtcagtatgttattttcctcccaagtattgttttgaaggatcgccagccaatcccttacactatgttttctactcagcaggcctcccatactatttattgctaatgggactccagaacatttttgaacaatttttgtaccaatctcgacaaactcacaagacttggccacacctgtacggaacgctctttcacagaatagagtccaggaatcttcttggctaagttgttctagagccaatggaggaactgtccccatgactgacgcaacattcgaatttcgggtagtgacaaccaccgcacttcccattttacaggaacaaagcaatgttcttagagcctcccatttttgttcatcttcattccaaacatcatctagtacaaggaggtacctcttttggctcagttcttcccggagacgttgttgtagcaattccaggttatcactcttcagtccacaatcattcccaattgcagtgtcaattatccccttgacaatatcaggaacactgaagttctctgagacacaaacccacatatgcttttgaaaatgtgctttcactttcacgtcattgaagaccagctgtgcaagagttgtcttgcccaatcctcctatcccaacaataggaagtattagcaatttgtcactcttggcacttagaagcatatggatgatttcatctctttctttgtcccttccaataacttcctgctcgtcgacgtaggaataggtctgcatcctctcatcctctggcatggggcaatttaggaacccaaattgattcatttgcgaaacaagctgatcaatctgttcaactatctgctggagtttctttcctatcctatacttgaacagtaaaggattataatgagaagagaagaaagcccttacgccactgttgattttatgcccacgacggagtgcctcgctgcgaagcgcctcgtagtgcagctcatcgagggcatcatcagcatcacaggcagccagcttcagcttggtgatccaggacttcacagcaggcttcttggatgcctgctcctcggcaccatagatcacttggttgatggcaagcagcaaggtatacagctctgaacgccggtgttcaatacccccaatgaaactaaactctgtggagagagactcgccagctttcttcagaagggcaggtagaagagctgagagtagctcagccatggctccaagctcagagtttaaaggaatatggacaaaacggaagagatgagagagcagtggagagtcggcagaaggtctagtatttagaatctacaggaggaggaaagacacagtacataacaagttggtgtaaggggcacataaagagggaggacaatatgtggttcgttgaagaattagaagaaaaaaaaaagattgcatccatcatgctaggtgacgccttgtgaatttcaaataatcatgttatattttaaaatttacgcatagatcaacaggtaaagaacaaacatgtaaatattgtccgcacaggcagacaggctatagtcctatgatcggcacctcctttgatgaagtccaaagctcccagaatttcattttttaaaaaaataacattaaagcggtgtcctattatccatatgtgtctgaattcgtgcttcatatcccaaattgttcatgaacagaacatatacaccaactcatgtacccaaagaattgatagcattgcattttttcagttaaaattgcaaaatgtaaaacagtaaaagccaatgcaacacagaatcaactatgaggtacattgtaagtcatgtatgtcaaagccccagcggacgttcccagggtttatgctgcaatcacagtgaatgttcgttgggtttatgcaaaagagaaatgatcattcgccggaattataaatcattgcataaacccagtaatagcagaatccccctccactgaaacatctccttagcagcaacacgatgaaacttcgaggtagtttcatctttcagctaaacagcgtcaatataaaaaatgacagtatgacacacatattactttattagagaaggtggcaaaggttcgcgcatcttcgcatcaagaatggagggggaaaaggcaagctaaagtataacacgcataattgcaactaaagaactaatatggatcttcttttcaaaaaggaaataaataaataaaataaaaggtaacacccttaacagcagttgttatcaccgcggtgtatgaatagggttatcattctctaccggaaaaggtgtccgttgtggaatcgacccaaaactctactgtatggccgaatttcttgtgattaaagcttcaacaagaatacaatattgctagaccgatccacgcatacacccaccaccaccaccaccaccacccattaaaaaaaacaaaaaagagagaagaaaaactttacctctagaatgctctaagctactggcagggtcaaaaaaaaagtaaagtaaagcttacagttgcaggtggaggctgtggagccatggctgccgcgccgtgccttgcgccgaccgcggagatccggcttcctccgctccgaggagccttggttccagaacgcgtacggcccttgtaggagagaacatggctgccggcgtgcggcggccggcaccgggttttcgccgccggagcggagagcggaggcgaccgagcaccggaatctccgcaaccgctactccaggccgtcggataggagcagacggccaggatctggcccggctcactctcatccaacaaattggaggcccggaatgacggcccatctctgtggatcggcctggaaattaaactaatatttcggcccatcaagggctcgcttgtaaaggccattataacgtgtattggaacagttataactggtgatcagcgtgttccatccaaagagtaccgggaacaacctacacccgctccaaaaaaaaaaattagagactataaagggcggcgccctgggcggccgctggggcgtgcccccgccgccgcgatccgcgcgcgccgccaccaccgtctccctccgccgccatcgtcgtccccgtcgcttcgcgccccgctgccgagagccgcgcgcgccgccgtcgtcatccccgtcgcttcgcgccttcgcctcctccgcctctgccttcgcctccacctcgcgctaccaccgtcggtcgccggcccccgccacgacccccttcatcagctaccggatccggcaccgtccgccaccaccgtggtcgaaggaagcccgtaagctggtgtcctctcgccgctggatgtgacgaggactcccgtcgccatcacgccatcgccgctgcctccgcctccgcctccgcctccacctcctcctccaccgctgtcgcgtcgcagtgtcggagctcctccgcctccgcctcgcgctgttgccgagcgcagccgtctccgccgagcggcggtgaaggcgggcgcagcctccatcagcgacggggtcggagctctgacgaccacgccacagggggcgcaaagagctgacggctcatattctagcatcaggagccacgccgccgcgcccggcgaccgcgacgacgaggaggaggaggagccccgtcgccgcgtccatcctccgccggctgctacaccttcgtccgttccgcatcccgccgcggcgggtaccggcgcctcggctcctccgcctccgtgtccacggccacggatgtgatttgggtggtggtggggacgacgaagcgagagaggagcttgttccatgtcgatccggccgtgcttgaggccgggctggtgcagcgtgtgacgccccgattttcggtcgggattaaaaatcatttaataatgcattttctataaactaaataaaagttaaagcaatttaatcaagtgaaataatgagggaatttaaaatttcctttaaaaatcattggccgagaatattttgtaatattctttgtgccctaaaatactctctgaaatttctcgcaaattttcggagctcgagaaataattttaatagcacaaagatcattgaatcaattaaaataaaaaagaaaacaaagaaaatcccccttcctctctttgggccattttcggcccaagtcttccttctctcccgcggcccgcgcgccccctttctctccctctcgggccggcctcctccctcggcccgctcggctctctctctccctcaagtctgttccgtctccccagccagcctctccctccctctctctccgacaggtgggacccgtggaccccacctgtcatccccaaccttcggcctcccaggccggcaaccgccatggccgcccgagccgcctcacgtcgccgctttccccgcccacctcctccaccctgcaccgctcccgcccgaccgtgggacctcgccgcccacgaccccgctcccctcccccactccgtcccgcgaaaaaccgccgccaccacccccacgacgccgccccacttccccctcgaaatccgccgctccccggccctctcctcgcccccttgagctataaaatcaatccccgtggcctcctcttcctttttccccattttcccgagtccccacgccctctaccgagctctccacgccgatccccatcgccgccgctcgccggcgatctccagccgcgcgccgccgctgctcccgccgtcgccgcgcctcaccgcgtgtgccatcagcttcgccgtcctgcgcagcacgccggcctccactcggttccctccaaacgccatcggaaccacctccccaccgtgtaacctctctccgccgcttgcctccgaactccggccgcctctcctcgccacgctagccaccgccaaaccgcgccaccgccactgtcggcttcgccgctccaagccgagcaccggccatcgactcgttcctctaatccactaccgagccgccctccccattaccaaccaaagccatcgtcgccatttctgcctccggtcgcgccgcgtcgcttcttcagtccgccccgtgttgtgtcgttgccctccccggtaccgcagccatcgtccgtggctcagcaatccctccgtgttcgccggtcgtcgccggactcatctccccatgcctcccggtgagctccgtcgtcatttcggccggcgtttcccgccgcaccgcaactccctaccctctcctaacctcttcatttccttcccaaggtcccttcgaccatcgactgccgtttcccgctcgcggaacgtcgccgggccatcgccgtcgtcgtcgcctcccaccgctccggccgctaccccggtaagaacccctccttcctccccctcctcttcgccggccgcgcgcgccgccgccgcccacgtgcgctgccgctccccttgccgcgccgcgtctccgctctctcgcgtgcgctgccgtcgcccgcgtgtgccgtcaccggccgtcgccgccggtggccgcgccgccgcgcgccgtcgttcggccagccggctttgggccgtgccttgcccctaccgcgccgcccgtgaccgttggatcggctttgggccgatccaggccgtcggtcccgtggaccacttccgtggtccgggtccacggtgccgcctcggccacggtggattgagtccaccgtgtgcctgccccttgtgccgcggacgagtggggcccgcctgtcggcgccagccctttgctgacgtcagcacatccttttcctttgagaaaataaataataattacgcaataattcgtgaataattttagaaattcatttaaatggctcaaaacttctaaaattcatatctaattcattcgaactccaaattgagccattcaacttgcaaaattcatctaaaattgagctctacatgtttgtttacttttgatgtactgttttcttggtttttattagagtttttcctcgttttgcgtgccagcgtgtagttcctgtcgtttcggaagtccgcggtcgcgaggaaaagagttcggaagatcaaagtgaagaagcgaggcaagtcacacattccccttgagcatgttgatcccaatttataaatgttttaccgtttgcaaataaatatgcatgttttgctaattacatggaatccgggtattacctgtctgctcgcttgtgccatgtttacttgatatctgtcctttgtcaaccgggagcaataaatcgactaactcatattacttatttgacctagctagaactatatgcttagccatgcttaattaccactagctcagttgatgggataattacagtattagacctttttagtatcagaatgagctgcgtgctcgagacatctggccatgcttcatggtcgtaattatcccactaaaatgcgactgaatggtgggctgtgggtgcatggttttgctagtcgcacccatggcaattaaggaccggttcgcgggaaaccctggaagaatttatcatgcttaccacaagccagcgtgggcaacggctgggcttgtaatgtagctttcctctagctgacgcatccaggcaagggtgggcgtgatggagcggggcgggccctgcgacggcctctgtcgcttccggattcacctaggcacgagaggggactgcccgttgcccgctggggacgggggtgaaacctgaggtgtggtgtgcttggctagagggggttatgcgaagggtcctgtcacagtctctttccgatatgtcgtggtggcatgtcggcgcacgaaaacgtgtcgtggggctgtgtcttgtgggtacagttgtacacctctgatcagagtaaaactattcgaatagccgtgcccacggttatgggcggtcgaccagattcaccgtgattagtcccaccttaataaattgacccaatgcactgtagttcaggtgggttggttgggcctgttcaacgtggtgtagcgttgatcagtggagatttaatgttactttaattactcaactgttttactgttttgctcaataaaatattttacaactgcctttatgcaaatagcctcaaacccctttttgtatccccttgcacgtctgcatcattggtgtggcttgctgagtacggtagtgcttctgagctgaagacgaagttagaagaccaatgctcagaccccagttgagttttgcctgtggagtggagctgaagccccgctaggatcgcctttttccgctactgtcgttctcttttagtgtgagagctaagtgcctcttctgtaagtattttacgctttatttacgtttggaactgtatattacttgtcgttttgtgtaccctggctggtcctggatagggatttaatatacaaaatagtctggaaatttagggctaaatttctgggcgtgacacggcgcctcctcgcggcggccgggcagcgggcccgcagcggtgcggtggcggtcgcattggacgtgctgctgtggctgcaggcggccgggaacaaggggatgttgggctacgacgatgacgatgaatcagccgccgccgacctgtcggagatcatcgagttgtactcgcaggacgacgtagacgactccagccactgcgggtcctagcgccaactctctctttaaaactgcatatatttagttatgtgtatagggtcataatccctcctgaaatagaaataaggtggtgttctatacatagattaattacttctacgagttaaaaatatgcatctgggaacaaatcacaaatgataaatctggttgtatgtatgtgtaatcaatatagtagatagtaaatactgcagcctaatctgctctcttggttctccgaattaaaaaggacatacagctgtagatgtcgaaaaaagtgccgtttttcttgttgcttcttttggtgcattagatgcatgctggtgcccttcacccatctttcaatttttccaaggatgacataagtcatgatatgttacatgctgggcataaggttacgatagaacttatgtgccgcgtattgcataatgctgtctgtaaatatgaagtgcttgaatgatgatttatattcactctcttctcatattagttgaaaacttgctgctggctatctcttcttcaagcaatctaactttctgaatgattttttttacttatgttctgattttatgccatcacttttattttcatgctctggaaactagaaagtgaaaaaaatttgtgttattttgaataatcgcttcatctttacttgtcatgtaaagctattgatgttccacaaatttcattgttcgaggaatgcgtaatgctggaagacctcttgaagagatgcagaagaaggagagcaaaattgtaagtcttatatttttcaatcatgtaaagaggaaaatattactcagacagatgggcgcacataatttttttttcttctgggttgacaagctatcattcaaagaacaaatgtcctgcattttgttgaaagttggccgctttgaggaggcggagaaaacatataggtccctgctttttatgaatcctgataactacaactgagacacctgtgctgtttttttccctcacttaaatttctttgctttggtcttctggtaagctctaaaaacagtgaatatgggttttgaatttcagcatggacttatgctaatatgttgtttacatgccatttttattccttttgacggatatataatatctgatttttagattattgttattttatagaattttgtgattatgcatgctttagcgacttctgtaaaatactttctcccagtttatgagttatacttctgttaagtgtttgtcaatcggctaattcaacaaattttattggcacttgcattttgtagttaatcacgacaacaatttggtctgcaaccacatgaactatccatgaggcaaaaatcatatgttatcacgattgattctgagccttcagtccttcacttatttaatgtccatgttgcaaaactttgcatggcattgatttaagttatttcttgtgtttgtgctctctttgcctaatatatgtatatcacacgcatggtcttcataggaggacaggggagctataccattacatttctgtagcatgatggtgcaaatttagcatgtgggagggttcttagttaacctggtgggtggtgggtttaaacagaggccaggctgctgctcaaacaagggaaaattgtttttaggcacattttaaagcaatttggatagcggcagacataacattatggctattaccagaacctgattgcatttctgaattctgaacatttatgaagttttgtgagatcaggaaactcttttaccatttctttcttgctttttttatgcctaaatcatcttatcttatgttgttttctatagaaaattatataaccttctgtcactgaaactactaccaatttaccgcaaacttagtggaaaccacaactgtaatttactgcttgcagtgctgaaggtctccgcagaagatggcaagggcaacaagtcttctgtgactgttcatttgtatggcccaaatacagacttggtggttgatcggaagagggaattgcaggtgagcatttgaatagtgtgattattgataatgcgtgtatatcatgtcctataatgttccttcatggctgtgcaattggttcatctgttagtcctgctttattttatttggtgcatttttttacagcaagctcaaagaacctcattgttttttcaaatattcaagggcttcttgaccatgaaggatggtgacatttcagtcctattccacaaaaatatgttaatgaggatgtattattaggagcctcacttgtcggttgtcggtcttgattcttcatgtagtttgtagacaactaaggtttggcactaatagaactagactttcagttaaatggacgatttctatgaaggaagatctaatttgcttcgatactctactatctacatgccatttttaatgctcttatctggtagatcattgaatggttagtatgctcaattatgggttgtatgctaatatgggtgtatatttgtctgcaggatttttttcttccctttccctaccatgattctctatggtgaggtatagctttttatttgtattttactcatccaggccttctgctatctgtagtttccgtaattatattcagctatctgtcttttaaaaccgaattactagctatgagctcaaaatagcatattatttgctgtcgaaaatatagatgatttcttatagcccactaaggctgtgttcgctgctggtagttgggaatatttctcccgtgcatggaaaacggagcagtccattagcacgtgattaattaagtatttgttgttttttttctaaaaatggatcaatatgattttttaagcaactttcgtatagaaactttttgcaaaaaatacaccgttcaatagtttgaaaagcgtgcacgtggaatacgagggacatgggttgggaacccatgctgccgaactaagagcaagttcaatagtatagccaactaatagctccaattcatctatagccaatctaatagctcattcatacaatagttatatactacactattagtacctggtcccacctgtcatacacacactatgtcttggagtccgtgctacagctggctacaaatctgtagcccgctgcacttctttctcctcatttatctccttaaaatatgtttgcagctggcttatagcctgctattgtacctgctctaagcctaaggagtgatggctggatagatacgactctctgttattacccccatcgctgttactattaatgcggccagtgtggcatcactgtagttagaaaggaccgctcttacaaggat

SEQ ID NO: 59797 - DNA, 11775 bp, Oryza sativa
ccgaccagcgccgttgcctccctcagctccgcaaggacgagaaggacctcggccgccgcccctcttcgcgggaaatccgccggagctcctccttcctcggtcgccgatcgaggccgagcccgtccgccccatcccgagcgacgcccgtcgccggagctccgtcgcgtcgtcttcctgaggagccccgtcgccaccgttccttgccgtcggccgcccctttgccgtcgtgcatctcggtgagcactcccctccctctcccttttcctccccttcgttggccgcttcccgggcgtcctcgcgacgcgctgccgccgccggtggccgtccgaccgggtcgctgccgccgcgctccgcgctccgtgcccgcgccgttgccggtggtgccgggcagccggttgccgcctcccccttgccgccgccgcgccttggctcggccgggccggcttcgtgccgcgcctgtgcccctggctgccgctcccctcggccgcccgatcggctcaggccgatctgggccatccacgtggtggacgcgcacccgaggccacgtgtggaccatgtccaccgtgcgccctccccctttgactcgctgacatgtggggcccgcgtgtcggcgctggccgcccctttgctgatgtcagcgaggtccatttcctctgtaaaaataaataataattgcgcaataaatcgagtttaattctagaaattcatttaaatggctcaaaacttctaaaattcatatctaattcattcgaactccgaattgagccgttcaacttgcaaaattcatctaaaattgagctctacatgtttgtttactttttatgtactgtttgtgtcacgcccagaaattcactagtaatttccgaacttatttgtgcatgaaatcctcgtccaggaatcagccgaggtacacaaactgacaatttaatatacagattcatcaaattaactaaaccgataaatacttacttaagaggcacttagtcctcaccaagaagaaaactgcagcggaaaataaaatctagcgaagctccggctccactcccacaggcagctcaactggggtataagccaaacgtcttctccttctggatcctttttcttcaactgaggttgattgattattgcaaggtgagcatatgacatactcagcaagccacacagcaaatatgcaagtgcacaaggataccaaaggatggcataatatcggctcatttgcaaaagcagcatttagcaaaacatttaagagaagtaaaacagtggagtaattaatcagaaattttaaccaacactgaacagcacacccatgctgcacaggcccaaccattctgaacaaccatacccggctgaacagatctaactccaaaccaggagctaagcaaattattaccagttataacatctataattatggtgagaggtgtgggactaatcacgaaaaacattgctcaactcgcccataaccgcgggcacggctattcgaatagttttactctggccagaggtgtaccactgtacccacaagacacagccccacatcatgtcaccatgtgcctcagtaccaccacggtacctcggaaaggggctgtgacagtaccccttgcataacacaatccaccgcagcgcaccattcctggatcataatcacccccttataaaacaaggcatggactccccagcgacccccgtgggcttatttccgccacttctcagtctggtgctccgcaatgaaccatgctatacaaaagataaagccgttgcccacgctggcttgtggttggcacggttaatgtttcacaacagtagctcgcgaaccggtccttaattgtcatgagcacgactctcaaaaccatgtgctcacaacccaccattatcaagttttagttggcaagtaattaattaaccaatcacggttgaccatcgtgagctaccattaaatataaccataagtgatagtgaaacattagttatcccaaatatgtgctaatgtttctaagcatggctaagcaatcatagctaatatctagttgaaccaatatatataaagctcaactagtccaattataatcacccaaggtatcaaggaataaagtaatcaagaacaaaagggccataacaaagaataggttaattccacccaatgacattcgaaaataaatgcacagttgaaataaatagagaatttaaatataggatcaacatgctcaaaggattgtgtttaggatctgtgtgacttgccttgcaataatcggtcttcaattaatcttcttgaatacttccggcgcactcgcgaaccttcgcaacgacggaaacgacaagctatcacgcaaaacgaggaaaaagactaataaaaaccaaataaacaatacataaaaagtaaacaaacatgtagatcatatttttagatgaattatgagacttgaacggcctcattctgacttcaaatgaatttattaagaattttacaagattaaatctatttaaagcccatttaaaaagaattaaataaatttaattcaatttatggacaattttaatatgtagatctttattttaaacaacttttgcaacttgaaccacattaaactgagttaagatgaattagatatgaatttttaaagattaaatcggattaaaacacttaaatcggtttaaattgaattatgacgcaataatgaattatttttgaaaaggaaaaggggattattgcgtcagcggctagggtttcggtggaccgggcgcacgggcggcggttcacgcgaacggacggccgagatcgaaccaatccaaaacggacggccgagatcgatcgggtccacggcggctcacggcggacgactccgatgacgtcagcgatgacgtcaccaccggcggcggcggctcggcggctcgggctcacacgctcgccggcgaacggcggcgcggcggcgcgaacggaaagcaccgggatgaagcggacgacaaggcgaactcaccggtgaccaaaggaacggcggaaaagcaacggacgacgccggcgacgaggaggaagcggcgaagctcttcggcttgacgacggcgacggcgctccggcggtcaacagcgacggcgaagcggcggacggggacggcggcgacttggcgatcccgacggtggccttcccgagtgacgacgacgaccgtagcgacggcggcgcacggctagacgaacggcggcgacggcggcgcaaaagctcccgaggctagggcgctacacacgacggcgggcgaaggcgagggaggcgacgggtagaggagagcttgggggtccttataaaggggctagcgagcggcgacggaggcccacggcgaccggcggcgagaaggaaactttagggtttgggagagagaggaatccgattcgatctcgattccatcgagtttccaaaccgaattgaccggagattccaaaagagaaaaggaagaggagatcgagaagatcatttcccctctaaagatttcaccggagaaggaaagaatcgagcggatttggaaggagaaggcggcggcggcgcgctagggttcgcgggcggcggcggcgacgcgaggaagacggatccgacaagcggggcccacctgtcagcgaccgaacgcgcgcgcgcggctgcggactgggccggctgggccgaggagggagagaagagaggttttgggccggctttcggcccaaagccaaaagaagacttttaaaacctttttcaatttaaattatttcttaaatgcaattccatttattaaaaatacttccttagctcaaataaatcccagaaaaatctaggaattatagaattaagcaaagtatttaatgaaattttatctagcccaattttatattgagatttaacaaattaaaattagatcttctcttataagcttttaaaatcatttctaataattccttttaaacaacaatttataatttaaggatttttaaacaagaaaagctcttaacaattataattagatcattaatgatcaaataattactgaactgttctttgtattattaagagttgagctctgaaaaatccgagaaaatttcagagagttgacttaatcatggagaatttaataaaaattaaatccatccatgctttatatttaggaaattttatttcccacattttacttcacttgtaaattaaagaacatttaacaaaaattctattaataatttattaaataatttataaatcctgaaacgaaaatcaggatgtgacagtttgcttggtttttattagagtttttcctcgttttgcgtgccaacgtgtagttcccgacgtttcggaagatcgcggtcgcaaggataagagttcggaagattgtttgaagaagcaaggcaagtcacacattccccttgagcatgttgatcctaatttacaaatcttttactgtttgcaaataaatatgcatgttttgctaattacacgggatcagggtttacctatctgctcgcttgtgccatgtttacttgatatctatcatttgtcaaccttgggtaataaatcgactagctcatgttacttatgtgacccagctagaactatatgcttagcgatgcttatttagcactagctcagttgatgggataattacagtattagacctttttagtatcagagtgagctgcgtgctcgagacatctggccatgcttcatggtcgtaattatccaactaaaatgcgactgaatagtgggctgtgggtgcatggttttgctggtcgcacccatggcagttaaggaccggttcgcgggatgccctggaagaacttatcgtacttaccacaagccagcgtgggcaacggctgggcttgtagtgtagctttcctctagtcgacgcatccaggcaagggtgggcgtgatggagcggggcgagccctgcgacggcctctgtcgcttccggattcacctaggcacgagaggggactgcccgttgcccgctggggacgggggtgaaacctgaggtgtggtgtgcttggctagagggggttatgcgaagggtcctgtcacggcctctttccggtatgtcgtggtggcatgtcggcgcacggaaacgtgtcgtggggctgtgtcttgtgggtacagttgtacacctctgatcagagtaaagctattcgaatagccgtgcccgcggttatgggcggtcgaccagattcaccgtgattagtcccatcttaataaatcgacccaatacactgtagttcaggtgggttggttgggcctgttcaacgtggtgtagcgttgatcagtggagtttttaatgttactttaattacccaacagttttactgttttgctcaataaaatgttttacaactgcctttatgcaaatagccacaaacccctccttgtatccctttgcacgtctgcatcgttggtgtggcttgctgagtacggtggttgtactcagtcttgctattattccccctttttcagaagtgtagtgcttctgagctgaagatggagttagaggaccaaggctcagaccccagttgagttttgactgtggagtggagctgaaaccccgctaggatcgcctttttccgctgctgtcgttctgtttcggtgtgaggactaagtgcctcttccgtaagtattttacgctttatttacgtttggaactgtatattacttgtcgttttctgtaccctggctggtcctggacagagatttaatacgcaaaatagtctagaaatttgggttaaatttctgggcgtgacaaagtggtatcagagccaacttgactgtaggttgagccaaatggtcaaaccctaaggacaagttttctgaaaaaccctatttgcaaattgtctcctctcgcccttcgacatttctttatgaaacggtttttcaaaattctcctcccagtccctccaatcctcatagttgttaaacctggaggacaaaccgtcagcttcacgcctattcggaagtcaagtcaagcttcgtgcaaagagtgagaagatcagcccagagtcaagtgaagttttcccggagttttcctaaacccaatctttccctgaagagtagtatcgttagctgctagatcgtgtgttgtttgcttgtgtgtaggggtatggtttgcatcattggtggggatgcgaccatactaggttgtttgcttaagcaacttgaatcataaaatccattcacaacagatcaataggcaagtggtttagtacctcctctctagtaacccctcctatttccccatctctctattgcctgcagcagatggtccgcatgagggacaatttcatcggatcaagaccccgtcagtttcatggggcaactcagtgcaattctaatagtattccacgtcagcctcttgaaggtcagcctcaaccccaagtcatggctaatcaaactcagacagtggaagagttgttacaacagatgcgacgtcggtaccaaatatactagatgcaacagatgcaacgacaatgtcaggagtcacgtcaatgtcacccaccgcaggtgcgagatcagatgccagcccggaacccgaatcagagtcagagtcaggagttcccaatatcggcaccgaagacccctgtcaaaatgctgtccagattcccgaagataacgacagccaagtcaacgtcagaccaaaggaaagtaagtgctacctgttatgactgtggtgagcaaggtcattatgtaaggaactgtccatggaaggtgttcgccaggtcacctgaaaaagacgagaagcagtgcccagggagtaaccaagctccaagtcagtctaccgacaagaaggatggtactttgcagcccaactctggagcgaacaggacagtgatatggaagatggataatggcaggaccatgatcatcaccggttcagaatttactcctgaagacgcagcaaggatacccaagcgtcagagaggaagaaataccttccgaggagcgcgtcagctaacccgtcatctcataaagtacggtccgcccagacccgaagatgatgaatcaggagaacggttttctgctgatgacgatgacgacaacgatgatgataatgatgagaatgatgatgcgacccttgacagtttcagggaaagagagttgaagttcaaagcatgtgctagatgtgggatagtcggacacactgctagtttatgcctccccacatgccgctgtggtgaatatacccattactcagatgcatgccctttaaggaaggtcacatgtttcttgtgtgaaggaacagatcatgtgcctaaggactgtcagttgaatgcggtcatagctaagaccaagaaagaacaagggacaaccgtgcaacccattcgtcaaccaatgacaatcgacaacagcggtcacaatccttctgctcttcctccaactccagctccagtggaagccaaccatggaagaagcaacgtcaccaaggatgttcataagtctctgcttgttcccgtttcagctgccaaagtgcataatcagaagcctgcaccctgggaccaagcaagtcgatcctgtcgcaactgtcgtaagccaggacattgtttcagtgattgccctcttccaagagcagcaaaggcagttcgtcgtgattcacaagttaccagcactgcccatgacaccaatcgacacctaaatgtgcaacctccgccccaacggattatcgtcaagggcaccgtcaaaggtcgcattgttccaccggcaatcgtttcaagcctacaacaccaacgccagcaaggtaagcaatgccaggagaataatagctcgctacagctacaaagaggcagtacactccttcgccagcacccgcggcaagcttcgtcagccccaggtcacccagcagttgtcagctctagcaatgcacctcgtattgctccaatccaaaggcccatcggcaaatcaccgctcggtaaccccgcgagcaagaagttcctacctgctgcagctgtcaagagagttgttactccaccatcgaagatcaacaagcagagcaacattcccggtgagacttcagccagtaggaattaaagaaacaagtcggttaggttcgaataatggaagcaatagcagtcctagccaagccccctacgtttcaagttcagcagcagtctacaagtgtttaaccttatagcacttctctctgtacatagatgtttatggcagttatgtaatgaaaagggaatattgaataaagtttgagtcagtcagtttctcttcttttatgattcatcttgagcatgcaaaagcaagttaaaatgtgaatctgtcggtgtcacaagaaaccaagagtttctcttctaactcatcgcaattctgttgaagctccaaaacctgtttgcgagcaaatagaggaatggttaactagcagattgaaaatggttagacgctcaacacccaacatgatgagatctctttaaaggcagtatcaatggtattcggatgaaaagagtgatggaatatttgaaagtgacatcatataaagaatcttgggaactcctctaaaccttggaagccgttagaggatggtaagcggaaatttacaccctagtggtgcgatcatggatcaattacatttttccttagttcaagacagccagtataagctccaggaatcatctcaatgtttctcagaagttgaaaaagaaattgttccatacctgggtcagaagtatacagagtcaagtccagaaatgtgtagttagcagggtatatggcatagaatcccttttaacgaatcatctttaccgaagataggaaagcgaagtggttatgatcaaaaagcagaaactctcggcagtatcaaagtcaatttccggcagtcgttcagattgtagtatttttgggaaaacaattgcagggcctatagtccgtaaacccaggaagagtcagcaaaggacgatcgacgaagtgtaatgtcatgtcaagagaaggacttttgagtttgatctgttaagtgatcagtgggtatgcaatctatttaggcatacgacaccgaagtcaggctagaagcgggacagttatgccagcagttcaattgttcccagtcaggcgaaatgtatgactactcctgtaaggggggtaggtcgcagagatgagttctggctcacctcgtcgctgtttcagttgaaggagccaattgcaaggtgtcatgcagaattacgccggtcctaggtcacttgatggaattctgagggacaccggtgaggccaggtcaacagcttagcttagagaagcaacagtgaggacagttgcggttcagacgaaagacaggtcaagcaggtttcctggaattacgtgtcactcgagtcagaacccgttcaagcggacgtaggatcaatgagttacaaaggtcagatgcaagcttcaggaacaacttcatcctcttcgagtcagcatggtgaattgtcaggttatcaaaattgctaacctcaacaattcagtccaagataagtaagttccttaagcatccacagccctgtctgggtcagttgaagtagaaccagtcagtccagtcttgcaaagcaaaggaacagaaaagttgaatcaatcagttcagtcgtgcaagtctggacaatcagtcaatcagtcagttcgagacagaaagggggcagtgcagtatgcggatccgtccgatcagtcaaaccgcccgccagctccagctttctttctagccatcccagaatctcgggacgagattcctgtaaggggggtagatttgtaacgccccgattttcgttcgggaataaaaatcaattaataatacattttctagaaattaaataaaagttaaaccaatttaatcaagtggaattatagaggaaatttgaaattttcctttaaaaatcattggccgggaatattttgtaatattctttgcgccctaatgtactctccggaattttccgtgaattttcggagctcgagaaatagttttaatagcacaaagatcattgcatcaattaaaataaaaagaaaaacaattaaaatcccccttcctctctttgggcctttttcggcccaagtcttccttccctcccgcggcccgcgcgccccttttctctccctctcgggccggcctcctccctcggcccgctcggctctctctctccctcaagtctgctttacctccctcgcccgttttcccctctctctcgtcccacctgtcatcttcttccctaacctcccgtcaccccaatggccgtcatggccgccggtttcgccccacgacgccgcggttcccgcgcttcaccccgccccacgagcgcgtggaatcgatcccctccacctcctccacttttcccccactctccccgcgaaaatcggcgccggttaacccctccaccaccccacgtcggcgccccacttcgccggccgattccgccacgtccggcctcgatcccgccttcccgagcccataaaaagcacccccgtgctcccctcgtccatttccccttgtttcccgggcccggcactctctccctcgctcttccccacgccgctcccgcgcgccgccacactccggcgaactccggccgccgtttcccgtcgctagggtcgccgccgccctgctccgccgccaccgccagctttgccgccgcccgggcaagctcggccaccgctccatttcccctctccacctctttagcgccgtagccacgcgaaccacctctctccgccgccgcccccgactccagccgcgtcgcgccgccgcttcggtcgacgccgaccagcgccgttgcctccctcagctccgcaaggacgaggaggacctcggccgccgcccctcttcgccggaaatccgccggagctcctccttcctcggtcgccgatcgaggccgagcccgtccgccccatcccgagcgacgcccgtcgccggagctccgtcacgtcgtcttcctgaggagccccgtcgccaccgttccttgccgtcggccgcccctttgccgtcgtgcatctcggtgagcactcccctccctctcccttttcctccccttcgtcggccgcctcccgggcgtcctcgcgacgcgctgccgccgccggtggccgtccgaccgggtcgacttgcaaaattcatctaaaattgagctctacatgtttgtttactttttatgtactgtttgcttggtttttataagagtttttcctcgttttgcgtgccagcgtgtagttcccgtcgtttcggaagatcgcggtcgcaaggataagagttcggaagattgtttgaagaagcaaggcaagtcacacattccccttgagcatgttgatcctaatttacaaatcttttactgtttgcaaataaatatgcatgttttgctaattacacgggatcagggtttacctatctgctcgcttgtgccatgtttacttgatatctatcatttgtcaaccttgggtaataaatcgactagctcatgttacttatttgacccagctagaactatatgcttagcgatgcttatttaccactagctcagttgatgggataattacagtattagacctttttagtatcagagtgagctgcgtgctcgagacatctggccatgcttcatggtcgtaattatccaactaaaatgcgactgaatagtgggctgtgggtgcatggttttgctggtcgcacccatggcagttaaggaccggttcgcgggatgccctggaagaacttatcgtacttaccacaagccagcgtgggcaacggctgggcttgtagtgtagctttcctctagtcgacgcatccaggcaagggtgggcgtgatggagcggggcgagccctgcgacggcctctgtcg

SEQ ID NO: 59798 - DNA, 902 bp, Oryza sativa
ccatcgtgaactatcattaagccatcattaaataatagtgaattataagttatcccaatagtgtgctaatgtttctaagcatggctaagcaatcgtatctaatatctagctgaaccaatatataaagcccaactagtcaagttataataacccaaggtatcaaggaataaagtaatcaagaacaaaagggctataacaaacaataggttaattccacccaatgacattcgaaaataaatacaatagttgaatagaaacaatagctttaaacgggatcaacatgctcaaagggttgtttgggatctgtgtgacttgccttgctggccttggaactcttcaaattcttctcctgcgaaaacgaactctccggaaacatcggaatctaaacagaaaagagcaaaaacaccaaaacagcacataaacaagcatgaacattacatgtggatatttttaacatgtagatctcaattttagaaaaatttagagacttgaaccaactaaatccgagctaagatggattagttatgaattttcaaagattaaatcggattaaatcatttatttagattttaattgaattatgacgcaataatgaattatttttgaaaaggaaaagggaattattgcgtcagcggctagggttcgcggtggaccgggtgcacggcggcggctcacggaaacgaacggccgagatcgattcatccaaaacggacgaccgagatcgaccggtccacggccggaccacgggagacgacgacgatgacgtcagcggtgacgtcaccaccggcggcggctcgggcgtgcatgctcgccggcatacgacggcacgacagcgcgaacggagggcacctacgggtagcggacggcacggcgaactcaccggtgaccaaagtagcggcgga

SEQ ID NO: 59799 - DNA, 2410 bp, Oryza sativa
tgatcatgcggcaggaacgttatttgatgacacactttgtttggatcaacgtgtgtcgctgattttgctccgccttcttcatttgtgcgctgaggacacgctgcataatgaggctctcatagtgatccgcatcttcagccccaatatgctcttcaggtggctcattatctacatggtcagcctcaagcaaagcaagtgtatcctcatcgaaatcactagtagacgagtactcaccatcattttttactaccaaaactcgcttgctagggcactcacgctgcacatgcccaaagcccttgcaacggtggcagcactgaacatctcttgttctgcccgtgaatgccattgaagaagcactcgctgctggctgagcatcctttgtcgtagagcaaactagagggccatattagtgtaatctttgtagtctatgatgtcataaatctcgcggtttaaaccacccaaaaatctagccatagcagcgtcctctgtttcctctaaattacaacgaagcaagcccatttgtaactcctgataatattcctctacactttttgcactctgtctcaattgttgcaacctattcagcaagtcacgtgcatagtaagaaggaacaaatcttgcccgcatgacccatttcaaagcatcccatgtttgtggcatgtaattaggaattttcttgccatgttctatccaccaaaccgaagcaaactaagtgaactcactagtagcagctttaactctattgttctcaggaaattcatggcatgcaaacttttggtcaacagcaatctcccaagaaaggtacgcatcaggatcatatttccatcaaaaggatgtatcttaaatttaattttagaaaaaacatcatcatggttgcatacctcgtgtcggcggtgaccgcccatacctctacgattgttgcatagcggtagacaatcacgagcatctcgctcatcttgatcagtgatgaaccctgagttcctctcgacactcaaggctgttgttggcccgatctttcggtgagttgtgataactacgatttgggagaaacgttgacgatccgactacaaccgtacgagacgttgtgttgcgccttagcgttcaatacacctctccgtggattgttgatcttgccggtgcagatcaaccctattcctgcaagcaaatcgaagaaacaagcaagaacaagataaaagcaatctaatattgcaaataggaatttaatacaaatgataagttggggttccgaagaacaagcagacggacggtctagccgacacgcgcgctgcaagcaagtagcaatggctaaactttaatctatcaaaacccgcgataccctgaaggggtaccaagctatttatagagataggaggaccctagctcgttcgccacctgattggggcgcaccctacatgggccccacttgggccggggtcccagacgaagttacaagcccataggcccattacaggtgtcgcagcaccttgtttctttagttgctgcccactgagatggaatttggtaatgaggcttgatgcattggaaagaggactccgagagctttccatcaagtactcacgggccgaaaacggaggtcgtatggagattcggcggccgtttgaagtcagcagtgtagtaggtggccgaatcggattccagcacttggaggacttgaacttgatatcttgttgttcatccatgatgtgagcaacggatgtatccgtagtagccttagtcacatcattcagtatcaccagtatattcatcctctaaattatcatcgacgtactcaccatcaatgtcatcttcattacgcccaccattgcctctagcattgagataatcaaaatgcctcacaagagcagcaaggctaatgtcaatgcgggcgatcaatgtctccaaccctgtaagcttggtgttggtggtgatctgcgtggactccaattgcccaatcttctcatttgtcacctgcaaatctgcatcaagtccttctgtgtgatgctttgcttgccttgtaaaatattgtatgatgcctttggtgcatggggaatgagacgcaccctcatcatctttatccttggacctgccatggttaataaaacaagagcaacaaaacaacatatgaggtaatttaagccctacggctattgggatgtagcttttgcaaggcgctcactctcagttcactcgaagcctgtctcacaagctcttaccaattcttaccttgcccatagaatgggatggcaacccacaagtctgcaaccatagaacgaggtgtatcggtgccgtagcaacaagacctgtcaagctgtagtcgggtttgtggtggagctggcggtgggctgaaagtaatgcgcaagaaaaaaaatagataaccacgttagccaaagaagttgaataatcactcaag

SEQ ID NO: 59800 - DNA, 16456 bp, Oryza sativa
ccggtgatagggctatgttcaccacatttgaagtaggagggaaagaacaagagaaagtgacatttggagacaatagcaaaggaaagataattgggttaggtaaaattgctatctccaatgatttgtcaattgataatgtctctcttgttaaatctctaaatttcaatttgctttcggttgcttaaatttgtgatcttggcttgtcatgtgctttcttcccgcaagaagttattgtttctagccttcttgacaagtcttgtgtgttcaaaggttttagatatggaaatctttatttggttgatttcaattctagtgaagcaaatttgaaaacttgtttagttgcaaaaacttcattgggttggctttggcataggaggctagcccatgtttgcatgaatcaattgagcaaactttcaaaatgtgatctagttgtgggcttgaaagatgtgaagtttgagaaagataagctttgtagtgcttgtcaagctggcaagcaagttgcatgttctcatcctactaagagtatcatgtccacatctagactattggagctcttgcatatagatttgtttggcccaacaacctataagagcattggtggtaatagtcattgtcttgtgattgttgatgattattcttgctatacttgggtgttatttttgcatgataagtctattgttgccgagcttttcaaaaagtttgcaaaaagggcccaaaatgaatttaattgcactgttgtgaaaattagaagtgacaatggttccgagtttaagaataccaatatcgaggactattgcgatgatcttggtatcaaacacgaactttccgctacctactcacctcaacaaaatggtgtagtggagaggaaaaatcgtacattgattgagatggcaaggactatgcttgatgaatatggtgtttccgattccttttgggcggaagccataaacaccgctttccatgcaaccgataggctttatttgcattgtctcttgaaaaagacttcctatgagctaattgttgggaggaagccaaatgttgcatattttcgagttttttgttgcaagtgttatatttatcgaaagggtattagactaaccaaatttgaaagtcggtgtgatgaagggtttcttctaggttatgcctcaaatagcaaggcataccgggtctacaacaagaacaaaggtattgtggaagaaaccgccgatgttcaatttgatgagactaatggctcccaagaggggcacgagaatttggatgatgtaggtgatgaaggcttgatgagagctatgaagaacatgtcaattggatatgtcaagcctattgaagtgcaagacaagtcatccacctccactcaagatgagccatctacttccgctacgccaagtcaagctcaagttgaagtgaaggaggagaaggcacaagatccacctatgccaccaaggatacacacccctctttccaaggatcacccaattgaccaagtgttgggtgacattagtaaggatgttcaaactcgatctcgtgtcgcttcgatttgtgaacattacctatttgtttcttgtcttgagccaaaacatgtagatgaagctctttgtgatctggattggatgaatgctatgcatgaagagctcaacaactttgcaagaaacaaggtgtggactttggttgaaagacctagagaccacaatgtcatagggacaaagtgggtctttaggaacaaacaagatgagaacggattggtggtgagaaacaaggcaaggttggtggcacaaggtttcacacaagttgaaagtttggactttggtgaaacttttgcccccgtggtaagacttgaggctattcgcatccttcttgcatttgcatcatgctttgatataaaactatttcaaatggatgtgaaaagtgcttttctaaatggtgaaattgccgaacttgtctttgttgaacaacctcccggttttgaagatcctaaaaattctaaccatgtttataaactctcaaaagctctttatggtttaaaacaagctcctagggcttggtatgaaagattgagagattttattttgtcaaaggatttcaaaattggaaaagttgacaccacccttttcacaaaaatcattggtgatgatttctttgtgtgtcaaatttatgttgatgacatcatattcagttctactaatgaggtattttgcaaggaatttggtgatatgatgtctagggaatttgagatgtccatgattggagagtcgagcttcttccttggacttcaaatcaagcaactcaaggatgggacgttcgtgagccaaaccaagtacatcaaggatctactcaagaggtttggcttggaggatgcgaagcccatcaagactcctatggcaaccaacagacatctcgaccttgatgagggaggtaaaccggtagatttaaagctttatcgttctatgattggtagcttgctttaccttaccgcatctaggccggatatcatgtttagtgtttgcatgtgtgcacggtttcaagccgctcctaaggggtgtcacttagtggccgtgaaaaggattataagatatttaaaacaatcctctactattggcttgtgctacccaaaaggtgctaagttcaagcttgttggctattccgattcggattatgccggttgcaaagtggatagaaagagcacatccggtagttgccaaatgattggtaaatcccttgtgtcatggtcatccaagaaacaaaactccgtagccctctctaccgccgaggcggaatatgtttcggcgggtagttgttgtgcccaattgctttggatgaaacaaacattgttggactatggcatatccttcaccaaaaccccactcctatgtgacaatgatagtgccataaagatagccaataacccggtccaacattctagaaccaagcatattgacatacgccatcacttcctaagagaccatgtagccaagtgtgacatagtcattagccacataagaatcgaggatcaactagccgacatctttaccaagcctcttgatgaatcccgcttttgcaaattgaggaatgagttaaatgtcatagatttctctaatgtggcttgagatggtgcacatggttgcttctttttgcattatgtatatttgctctcatttgctcttatattttggatttgttgccatttggttcttcattgcgaaaatggagcatctcactttaagggggagatttgcactcttgcatgtgctctacttccctttatatgtgatcaaatcaactagtggtgctagtagtatttccaaaatgcccaagttaacataagtcaaaacttttgcaaaatcaatgtaatttgaaaactatctcttggaaaatgtttcaaaaggtttcctatatgttttccaagcctcacattgcaagaaaaatgatttttgaatgaaaatgccattttggccctcttttaaagaaactagattcttagttttggccaaaatgagatttttccccaaaatgagattgagaaggaatttgagaaaagtttcaaaacaaagttggtagagaagaagatttgaaatgtttttggtattcaaacctatttcaaaaaacaaatcattcaaaagttatttgaaaatcaaatttgcccaaaaacccctatagaccataaaaggtcacctcctagcacttaagtgagttttgttgcaaatcttcataattttcaaatgttatgaatggttggcaatatttaaactcacacatttcaaaatttgctccaaaagtcatttttttattgaattttattgtgtgggggttgctgacttgtgcaagggctgtgcacagccggcagggggcttggcggtctgaccggcactatatgtgcggtctgactggccaggtgcagtgtcacgtcccaaaacgactctaaaatacattctctaaattatgtctagaataattaaaatccgtgtgaaagcctccaacaattaaaaggtgcaaagttaaaagtcaaataaggcttgggggacttttgtatatttcctaaaagcctaaaatacgtaaataaattttagtggaattttcagagcacaaataataattattaagaaataaacaaagttgaaaaggttttataaaaagaaaaactctaaaaagtcccctttccctccctctccctcttgggccggctcggcccatctccctccctctccctctcctctccccgcggcccatccggcctatccccgcgcgcgcgccgctgacgggcgggcccgcccgccaccctcgctgatgggtggggcccacccgccatccccttcctcccgccgctcccgccgccacccccgcgccctagcgccgccgccgccgcggattccgccgcatcccgccgtccccgtgtgcaataaagtggggagaatcattccccgtgattccctctccctttccccccatttttccctctctctctcgcgttcaaacgggcggatttgcccccgcaaatctcgccggtgccattgatggcggccggacctcccgcgccggtttcctcccttccccggccaccctctctcgacccggctctatttaaaccctccccgcacctcctccgtccgtttccgcctctcgctgcccttcctcctcgccgaaatcgagctcgcgccgtcgctctctctctccgccgtcgccgtcgagctccggtccgccgccgtcgtcgccccggaccacctcccacctcggcgccgcctccttcggcttcgccgcatcctcgccgacctcgtccacccctccgtttcggtcgccgaccgccggaacgccgtcgacctcgtcgacccgagccgcgccgccgccttcctccgctccggccgcctttttcgtcgtcgccgtcgacctagggtgagccgaggaccgccgcctcttttcccccttcccttcccctctctcggccgtcgctccgccgtgcctatggccgccggcgatcataggggcgcgggcgccgcctcccgctggccgcgccgagtggccgccgcgtggggcccggccgtcagccgcccgcgacctcgggtgcggctgacgcgtgggacccacggcgccggccggtgcgagcccgggtgcgcccggtccaccgtggaccgtgaggctgccgcgtgggccccactcccgtggacccggtccgcacgccccctcccctcggctgacacaataaacccttttaaaattaaaatttaaatgaagaaattcgcaaatattcatttaaagagcatataaacttcaaatgaccataacttggccatttgaactcggaattggaccgttcaagtctctaatttttccttaagaagtcaagaacccatttttgtactttgttcctacttgttacatggagtttattagagtaaaagccttttcttttccattggtcgtgtagacgctgcagcttcggaagatccgctcttcgtggaggttgaagccgacgtttgggaaagcgagcaaggcaagtcacatcatccttgaacatattgaatcccagtttataaaattattttgatttaaattattgcattaccgctttatttaaattcccgcgttatcactgttttatctagccatgcctatttacctttgttatgaccttattattgttattgttattatttccttgttcaccctagaataaacaaaaccccaactagtggacactctactcatggtaccactagtattattttaggtagatgcttcgctggttaattaggcaacattaggtggttttacaactctaaactttgggatattcatatcacctggacactatggaatggttggattattgtggaattggattcacacctccccctctattcaaaatcctcaaaatggttttaggctgggctcggggtgcatggttttgatagtagcacctcggccatataaggaccggtcttcgggcctctgttgcaaagcactaccgtacttccacatgtctagtgggtaaggcttattttgtggctcagtctggttataaacaaaagtacacggaaggagatagacgaagtcaggggtcgatggacatctctagggcaaatgaaggctacacgagctgcagcccggtagtcgagatgtcatggcacagggccggtgtcctgctgctaggggctcagtcctgcctacctgtcccggaggttccggccgtaggtggggttgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgattaataatattgtatagctctagaatcgtgtttacaaaatagctttgagcaactaagtgtcttttaatgctgtttactgcaaatcctaaccctttatattataacccccttctactcccttgcatttatcctgcacttgtgggtgtgtcttgttgagtacggtggttgtactcagtcttgctcaatttttcccaaacccagaagtggagttcctggaagatgaaggctttggtgtctagctcgtgcctgccgtcaagcgcctgtggtcgtcgccctagtcttccgctgtttcccgtttgtctttgtgtgtgctgggcctccgccgcccatgtaataaattaactatttacgcttccgcttgttaaactctgaactgtgtcaacttttggtgtaccttgcctcctgggacaaggaataatgcacgcacgtaaggaacgcccgttgggttatttccggtcgtgacatgcggcggtctgaccggccgaatagggccgatctgaccggccgaggtgggcccaggcagttttgccccttttcttctccatcctgcacctaccctctcccatctcatcccgattcatccccaactcgaaaaactctctctctcaccttccctcaaaccctaactcttttctccaccaaatcccctcggtttgaccgtggatttctctctggttacaccgtaagtgattctcctccgcttcctctctctattccatggattcgttcgtgtttttgttgagtttttatccatggcatggaaccctaggtgaagaacgaggtgttcttcgatttgcaccagtagagggtagtttcttggtgtgattcatccccttcaaccggtaaatcactatctctcttgtgcattctctcaaattaatctatttcaccctagggctatgggtagttattccaatcctgatgaattaggccatattctttgatgttctagttccaatcttaagctatattgttctagcaatttttagactcaaatgtgaagatgtgaaaatttttgaatgcttgaacttgtaggaggagatctgcccagagccacaggcggtctgaccatgggtcagtcgccggtctgaccggcgtgtgcgcccggtctgaccggccggcagccgtcggtctgactggccaccagcgggcggtctgaccggcctgatgccgtcggtctgaccgaccctatgggcggtctgaccggcctgatgccatcggtctgaccgccctactggctgtggtctgaccacccctccataggatataggcaaattttcacctctccaaattgtttctagaattattactaatatctatcatcctttgctctttgatagtgatgcctccccgcactcgccatggtcgtcgtgcacccactccggatcccgtgagtgagcctgaggaatcgtgcggcaatgagtacgctcaaagtgatgaagaggttgaggtcaatgttgaaggggctagtgaggaggctagtggagatgatgacagtggaagtggagaggatgaggatgaaggaagtgatgatatgcatattgatccctccatcgcaatataccatcttgaggcaccatgatcagtttttgaggcctcgggacaccccggatccccgttttcacaccgctttccagaagagtgtgtatgagcaggtttatgcagggaaagcttttgtagagcataagtggatttcttggagagacacaatgagactccagagtttgagggcttgcaggatctcttcaagactgttggcattgaccagattgtgactctcaaacaagactacaatgaagatttgatccggcagttctatgctacagtgtgggtggctggagactatggtgagatgaagtggatgtccaacacccttcaatgttctatctccaggaggtaattccggcgactcctcaatattcgcttggactttggagatgacttgcatgaggagcacacccataatccgctctctatagactatttctctcagttttatgaagatggagtgcagtacacacatgggaaggttgctggcctgacgactatccccagtgtggttaacaggattgtgagagctaccatcctctctcgccttggtaacaatgatcatattaggggggcggcttggcacgtcatcgatgccatcatttagggccgtcagttcgacattgtgtctctcatgatgcaagagattgccatctccaattggacctttacttagggaatctattatgccccttacatcatgaggttgattcaagacaagcttggggctgctgggcaaaatttgaagaagcacaagcagtacaagcccagccttcagcttggagctccccgtgctcctagggcggcgccctcctctcatcctggagctagctcaagctcagcacctcctcctcctcctgggtatgatccaaatgctttcttctatccacagtatgcttattttggaatgcaacccaacgaatacttcaacctggtacttggggctattaacaccctaagtgaaagcattcaacacttgtctaccgggcatgaagcattacatgaggatgttcgtggcttgcgtacggatgttggagacttgaatgcttccgtggggagattgcacactagagtgggtaacattggattctcgagtccaaatgttggagagctcccaagtatttgtgtatccacttcagcgcgtcctccttctcctccacaagagtgaagaccttttttgtgcttgatgccaaaggggggagaaaagtgtgctctattgtcacgtcctgataaattcatcccgaaataaaaatcatcttctaaaaggaataatagaattaattaaaattcgaaaagaaattggcaaaccttaaaatacgtacaagaaaaattcaaatgtgacccggagaatttttgttaaattctccttggtctaaaaggagccctcaaattttagtggaattttcagagcacaaataataattgaaaagaaataaacaaagttgaaaaggtttataaaaagaaaatcctaaaagaagtcttttccccctcctcctcccttcttgggccggctcggcccattccctccctctctctctctctctccccccggcccatcggctccccgcgcgcgcgcgcgccgctgacaggcgggcccgcccgccgccctcgctgacgggtggggcccacctgtcatcgccttcctcccgccgcgcccgccgccgcgcccgtgccctagcgccgccgccgccgcggattgcgccgcatcccgccgtccccgcgcgcattaaagagaggggaattactccccgcgtttccctctcccgattccccctcttttccctctctctctccctcggattcgtccggattcatcccgcgaagttcgccggcgtcttcaatggcgcccgagatctccgcgcgcggtttcctctctccccggccgcgctctccccctcccgttgctatatattcgatccccgtgcttcgctcttccgtttccgccgctcgccgctcgctctcgccgtcggtttcgtgcccgcgccgtgctcctctctctccgccgtcgccgccgaccttcggttcgccgccgccgtcgctccggtcttcctcccggctcggcgccacctccctcggcatcgccgcatcgccgtcgacctcgtccgcgcctccgtttcgctcgccgaccgtcggagcgccgccgtcatcgtcatcccgagccgcgccgccgtcttcctccgctccgtccgccgtttccgccgccttcgctgcctcggggtgagccgaagaccgtccccttcgtttcccccttccctcctctctctcgggcgccgctccgccgcgccgatggtcgccggcggtgaccatcggggcgcgggcgcgccgctcccgtcggccgtgccggcgaggccgccctcgggcgcgccctcgcggctgccaagtgggcccggccgtcagccgcccgcgcccgcgggtgcggctgacgcgtgggacccacggcgccgaccgccgccagccgcgtgcgcccggtccaccgtggaccgtggggctgacgcgtgggcccccaccccccgtggacccggtccgcgcgccccgctccctcggctgacgcaataaacatgatttttaattaaaatttaaatgaagaaattcgcaaatatccatttaaagagcatataaacttcaaatggccatatcttggccatttgaactcggaattggaccgttcaagtctctaatttttccttaagaagtcaagaacccatttttgtgctttgttcctgcttgttgtttggagtttattagagtaaaagccttttcttttccgttggtcgtgtagacgctgcagcttcggaagatccgctcttcgtggaagttgaagccgtcgtttgggaaagcgagcaaggcaagtcacatcatccttgaacatattgaatcccagtttgtaaaattatgttgatttaaattattgcattatcgctttatttaaattcccgcgttatcactgttttatttagccatgcctatttacctttgttatgaccatattattattgtcattgttattactaccttgttcaccctagaataaacaaaaccccaactagtggacactctatttatggttccactagtatgaatttaggtagatgcttcgctgattaataggacaacattaggtggttttacaactttagactttgggaaatattcatatcacctggacactatggaattgttggtttatggtggaattggacatacacctctcttcccctttcaaaacccctaaaacctgttttcggtggggtttgggtgcatgccagttgtgggaagtagcaccccggccactataaggattaagctcgggcctctgttgcaaagcactaccgtacttccacatgtctaatgggtaaggcttagtttgtggctcagtctagtcataaacaaaagtacacggattggagatggatgaagtcgggtgtcgatggacattctccagggcaaatgaaggctacacgagctgcggcccggtagtcgagatgtcatatggcagagggttggtgccctgctgctaggggctcagttctgcctgcctgtcccgggtatcccggccgtaggcaggattgggtcggtactcttgtctatggctaggatgggttggaaactatgtcacgtcttccgtctgtataccgtggtggtatgtggcacgtgtttgcacgtgaggaagatgtgtcttgtgggtaaagatgtacacctctgatcagagtataatctattcgaatagccgagccctcggatatgggcaagcctagcaatgtacccaagtcagtgttttaattcttaaaatttgctcaacaactaaaatatggaatggttggcctgggttggcttgggacgagctggaacccaggtcgggttgccagttcggtccgaatcatcgtaggccttgggttaaggcaggttcgtgagggttcacggccttgattaataatattgtatagctctaggatcgtctttacaaaatagctttgggcaactaagtgacttttaaatgccgtttactgcaaaacttaacccctatattattatctccttgtaccccccttgcatttattctgcatttgtgggtgtgtcttgttgagtacggtggttgtactcagtcttgctcaatttttcccaagtccagaagaggagctccttgaagatgaaggctttggtgtctagctcgtgcctgccgtcaagtgcctgtggtcgtcgccctagtcttccgctgttttttttttgttgtctttgagtgtgctgggccttcgttgcccatgtaataattctatatacgcttccgcttgttaaactctgtattgtatcaacttttggtgtaccttgcctcctgggacaaggaataatacacgcacgtcgggaacgcctgttgggtgatttccggtcgtgacaagttggtatcagagccatctcgactgtaggataagccaagtggataaaacctaaggacatattttataaataaaactatttgcgaaagttcctctttttctccttcccctaatgttatttgcaaaaggtttactcttttcttccttcttcaaatttcaactagtactagatggtcagctttgcgaagaagaagatgtcgtcagttgtttgccgaagctccggaagactgttggatccgctagcgaagcaaaggaagcagtgaagccagctgtgaaggagtgaagatcttggagaacccgtcgcagaacctaagccaccctctagtgtttcgtttgtcgtgtgtttccttgcttgtgtgtgtagcgcgtggtttgcatcagtgggttgtgatgtaaccatgctaggttgtttgcttaatcaacttgcagaataagcctaacatacatcataacagcaaaagacttagatctgttaaggtcctatccttagtttccaatctgtctctcccctttgttttccctctctccctctccaaacctttgcaacagatggctgacaatgagaaaggcaataaggtcagaagtcaggacattggtacctcaagctcccgagtgaatgaagcaccagacaccagttgtgtggcagtggtccaacacctgattaaccagaaccaattgcttatagagatactacagcagcatcggatgccaattttgaacccgagtcagatgcaacctcaagtgcagttggaggcagtccaagcactcacaccacaagtcagcgcatcgccaacatcccagaaggcccctcatgccatgccacatgttgacccaaaagaagccagtatcatctgttttatgtgtgatgagcaagggcactatgcaaggaactgtcctcagcagaaaagaaaagcaccaatgcgaaccgaagatgaagtccgtaagatgatcattaccagcacagaatggcctccaccaggaatgacaaaacatcagagaagaaattccttccgaggtgcacaacagttgacagagcatcttttagctaatggaggtagagtgtctgatagtgaagattcagatcaagtctcctcagatgatgaagatgaaatggaacgtaaggcatgctctcgttgtggagaagtcggtcatgttgccagctcgtgtgccactacctgctttcattgtgaggaagaccatccacccggtgaatgccccatgagcaggatcacttgtttcttttgtgaaggaactgatcatgtaccaaaagattgtcaattcagttttctgctgacgaagaagatggccaaccaacccgccagttccaacggagagaagcatcaaggcaacacaaatccccgccaagattacagtttcagcctcactccagtgccaggacagaggaatcaaaatgagaaaagaaaatgccgagtccgggaagatatctgttgcttcaattgtcaaggaatgggtcatttcgccgacaagtgcccaaaaccgagaaacatagctgccagcacgtcagtccacgcagctccctgcaatcagaagcttgctcctcagcgaattgtcatccatgcatcccaaagcagtcctatggcccgcgttgcaacagctccaactccagcgagtgcattaccacaaggtgtcaatgctcactttcagccccagcaaagaattgtcgtcgatggaagaagttgtgtctctccccgacctactccaggccaagcaaagggcaatcgacctccggagggcgataccaagcagaagaccgtcatccgcttcaaccagcaatcagaaggaagcttctcctgtgaatgatagcattatgcagtcctatcacatcatcacagaaccaatcgaggatgcagtcactggaacaatgccagctatatctctccagaatcaaaatgagcagccatgtttgtggttttcagtccgctacttatcgtggtgtaatcgaaagtttgcagcaatcatgtaatacataaatatattcatgtctataaacagtgagcttgctatgcttatggatgattcatattgagaatacaatgtaccgatgttaagcaccgtccctttttgtttaaagcagtgcctcgtattcatgtaatgagggagaaatgtgtaatacagacaagttccatgaggattcgtttgaaagatgcggatatgtgatcatgtgtataattgtttactgacaaaggagacctagggtctcgtgtcagaggaactatattctaacctcgagttaatagccaacctgtggatggaaaagaaaaacaattaaactgtgttgggttaaaaagccaacgagacagtagttgaggataggagttcggatacgccttttacagatcaagataaggattgttggaggaaaccccgaagggtacctgccatacctctacattgataagatcggatatacctgccaacagataaggagatccaggagacatcaatatttgagaacataatagtcgatggttggtaattagtttatctggtatcagaaaaaggtcaacggtgatgtggcagaagaacaatttggatgctccccatctcgaggaagcactaaagatgaccatcggcaattaaaccctagtggtatagatacggatagcaggcaatgtatttccctgaaggtagtcagtgcagcttttgacgcaccacttcaaggtttcactgaaaggcaacaagccaaaggacctcatcatccccagaagcgtccgcaatccacattaaagaataccccctgttagagataagccgaaagaagattgataaaagagattggcaaagatgttctctagcatgaaagaagtaggccgaaaggtgattgataaacagaaacatgctctgcatcgctcacggaagacccctgattgtaattgcccgcaacagtcaccttgtcattaagtaagcaagatgacctaggtaaaagtgtttctatgaaggcaaagagtgaaatcttcaactcggtatcagatgctacacggagtgaaaaatgcaagcaccggttaccaggcaacgccatgtcctgggagatgatccaacgggaaagaactcatcaaggttaaaggtgtaaaggaatacgttgagtgctaactgatgacaacaggaagagaatagcggaaagtaaactgaacataaagaaagtgaatctgagttgcttgttcgtgggagctattcccagttatgaaccaagtgatatgttcgaagatagtctacagaggtcagattaagatcacctctaacaacgaagcttcagatctggcaggatcacgatcagacaataagaagtccagcagtaaaactatttgggaagacgtcaaagtatgtcaagtgggataaattggttctcttgggaagcataacttatagttagagtggttgacccttgcatcgaatagccgaagtacctagcaccggagaccaggaaagctaatatgagacagttgatggcaagttagaagtgaataacaagcatgatattcttatgatgacaaacatagtatcctagtaatgacaagctagtgttgacgcatgacgtgaagtggtaacttgtctgaggttgactccgaagatatgaagcatgagaagttctggaacggaagcatcactgcactaccgcaacctagtctgagtcagccaaaaggtgcaccctggtccaagtcaggtgaagagaagattccatccgcaacaggaggtcaagccaagcagttccgagtggtgaagttttgctggaagtttgtcaagacgcgacggaagaagtcagacaagaagagaagaccgcccaacctatcttcttgctagcctcctcgaatctcggggacgagattcttgtaaggggggtggatttgtcacgtcctgataaattcatcccgaaataaaaatcatcttctaaaaggaataatagaattaattaaaattcgaaaagaaattggcaaaccttaaaatacg

SEQ ID NO: 59801 - DNA, 11419 bp, Oryza sativa
ccggtgaaggcaaccaaccgaaggcagcaacccaacccccaaggcaacccacctccaccaccaccagcagacaccaacgccattctcacccagatcctcgcccaacaagccaacatgatgaatgctttcctccaccacctccaaaacccgccacaacagaatgctccaccaccaccaccccaacactctaaactcgccgagttcctccgcatccgcccacctaccttctctagctccaacaaccctgtagatgctttggattggttgcatgccgtggggaagaagctagacacggtgcagtgcagcgacgaagagaaagtcatcttcgccgcccaccagctgcaggggcccgcatctctatggtgggaccacttccaggctacgcagcccgaggggcagccgattacttgggctcgcttcaccgccgctttccggagaacccatgtgcccgccggagtcatggctcttaagaagagggaattccgagagttgaagcaaggcaaccgctctgtgatggagtatttgcatgagttcaacaatctagcccgttacgccccagaggatgtgcgggaagatgaggagaagcaggagaagttcttggcaggaatggaccctgagctgtctgttcgtctagtctctggggactacccggattttcaacgactggtggacaagagcatccgcttggaagccaagcacaaggagctggaatcgcacaagcgccgcttggcaaacttccgcaatcagcagggtgctaaccagagggtccgctacaccaatccctatccagggggatcctcctcgcagcagcagcaacagcagcagcaacctcgcccagcgccccgacctcaattcgtggtgcgcgtcccaccgccgcagcagcagcagaatcagcaagggactcgtgcaccccgtcctcctacgccaactgtgcagcccgttcaaggccgcagggacgctcaaggtcagcagcgtctgtgcttcaactgtttcgagcccgggcactttgcggacaaatgcccgaagccaaggcgtcagcaaggccaagcgcctccccgctccaacaacggtggcaaggatgtcatccgtggtcgagtgaatcacgtgacggccgaggacgtgctgacaactccagacgtcatcgttggtacgttcctcgtccattccatccctgctacaattttgttcgactctggagcttcccactcgtttatatctgtgccattcgtggggagaaatcagttgggggtagaaaggcttagaaaccctctgcttatcaccacccctggaggggttatgacagcaaagtattatagccctgccgttcctatagaaattcaggggattccttttccctcggatctgattcttctagacacaaagaacttggatgtgatccttgggatgaattggttggctcaattccaaggagtagtggattgcgcgaggcgcactgtcactctgtaccgagggccagaacaaccggttgttttctttgcacccccaacctctgtcagaagttcagaacttcatcagatagaactgtcagaaatccccatcgtcagagagttcggaaacgtgtttccggaagaactacctggtatgccgcccaagcgagagattgagttccggatagatcttgctccaggaaccactcctctgtacaagcgaccctaccgtatggcagcaaatgaactggccgaagtaaagaaacagttggaagagttgaaagaaaaggggtatatacgtccgagtacttccccatggggtgctcctgtgatttttgtggagaagaaagacaaaacgaagaggatgtgcgttgactacagagctctcaatgaagtcaccatcaaaaacaagtaccctcttccccggatagatgatctgttcgatcagcttaaaggtgccactgtattctccaagattgatcttcgttccggatatcaccaattacgtattcgggaagaagatattccgaagaccgcattcactacgcgatatgggctgtatgaattcacggtgatgtcgttcggtttgaccaatgcacctgccttcttcatgaacttgatgaacaaagtgttcatggaatacttggataagttcgttgtggttttcatcgatgacattctgatatactcacaatcagaggaagaccatcagcaccatctccgtctggtgttgggaaagttgcgggaacatcaattgtatgccaagcttagcaagtgtgagttctggttgtccgaagtcaaattcttgggacacgtgatatctgctaaaggagttgctgtggaccccgaaacagtaaccgccgtcaccgaatggaagcaacccaagacagttactcagattcgcagtttcttaggtttggcaggatactaccgaaggttcatcgagaacttctccaaaatcgctcgacccatgacacagttgttgaagaaagaagagaagtttgtgtggagcccgcaatgcgaaaaggcgttccaaactctcaaagaaaagctggtttcctcgccagtgttaatcttgccggatactcgcaaggatttcatggtgtattgtgatgcttcgcgccaaggattggggtgcgtgctcatgcaggacggtcatgtggtagcctatgcctcacgccagctacgtcctcatgaaggcaactaccctacacatgatttggagttagccgcagtagttcatgctctaaaaatctggcggcactatctcattgggaatcgctgtgaaatctataccgacaataagagtctgaaatacatcttcactcagtcggacctgaatcttcggcaaaggagatggttagaactcatcaaggactatgatgtgggaattcactatcatcctggtaaggctaacgtggttgccgacgctctaagtcggaagagccattgcaatactcttaacgtccgtagctttccacccgagcttaatcaacagatggaagccctgaacctcagcatagttggtcgcggattcttggctgcgttagaagccaagcccaccttgctcgatcaaatccgcgaggctcagaagaatgatccggacatgcatggactcctcaagaatatgaaacagggtaaagccgctggtttcacagaggatgaacacggaaccttatggaacggaaatcgggtatgcgtactagatagcagagaacttaaacagctgatacttcaggaagctcacgaaagtccttattccattcacccgggcagtaccaagatgtacttagacttgaaggagaaatactggtgggtcagcatgaagcgggaaattgcagagtttgtggctctatgtgatgtgtgccagcgtgtcaaggcagaacaccaacgaccggctggacttctccagcctctccaagtgccggaatggaaatgggatgaaattgggatggatttcatcaccggccttccaaaaacccaaggtggatatgactctatatgggtaatagtggatcgattaaccaaggtagctcgattcattcctgtgaagaccacctatggagggaacaaactagcggagctctacttcgctaggatcgtgagtctccatggtattcccaagaaaatcgtatctgataggggaagccaattcacctctcacttttggaagaagctccaagaagagctgggtactcgattgaatttcagcaccgcctatcacccgcagacagatggacagaccgagcgtctaaatcagatcctagaagatatgcttcgcgcatgtgtcctggacttcgggaagacttgggataagagtctcccctatgctgagttctcctacaataacagctatcaagccagcatacaaatggcaccttatgaagcgttgtacgggcgcaaatgccggacaccgctattgtgggaccaagttggagaaagccaagtgttcgggactgatatcctgagagaagctgaagctaaagtcagaatcattcgggataatctaaaggtggcacagtctcggcagaaaagttatgccgataaccgacgccgtgatctggaattcgcagtggatgactttgtgtatcttcgggtcacgccattgcgaggtgtgcacaggtttcagacgaaagggaagcttgcacctcggtatgtgggtcccttccgtatcatcgctcgacgcggagaagttgcttaccagctggagttgcccgcctccttgggcaacgtgcatgatgtgttccatgtgtcgcaactcaagaaatgtcttcgagtgccatccgagcaggccgactcagagcaaattgaagttcgcgaagacttgacctatgtggagaagccagtgaaaatcctggacgccatggagcgcaggaccaggaaccgggtaatccgtttttgcaaggtccagtggagcaaccacgccgaagaagaagctacttgggagcgcgaagacgagctgaaggcagcccatcccgatctcttcgccagttcttccgaatctcggggccgagattccgtttaaggggggtaggtttgtcgcgtcccaaatcgactctaaaatctatcctcgaaattgtgcaaagaataattaaaattcatgtgaaagcctccaacaattaaaatgtgcaaagataaaagtcaaatgaggcttggaggatttttgtatatttcctaaaagcctaaaatgcttaaataaattttagtggaattttcagagcacaaataataattgaaaagaaataaacaaagttaaaaaggttttataaaaagaaaaccctaaaagaagtcctttccccctcctcctcccttcttgggccggctcggcccatttccctctccctctctctctcctctcccgcggcccatcggctccccgcgcgcgcgcgccgctgacaggcgggcccgcccgccgctctcgctgacgggtgggacccacctgtcatctccctcctctcgccgcgcccgccgccagcgcccgtgccctagcgccgccgccgccgcgaatcccgccgctcccgtccgccccgcgtgcaatcaagaggggggaattactccccgtaatcccctcccccgtttccccctctttcccctctctctctccctcggattcgttcgaatcaagcccgtaatcgtcgccggcgcaatcaatggagccgaatcttccgcgcgcgattcctccctctccggccgctctttccttcccccggcgctatttaaaccctccccgagctccgctctttcgtttccgccgctcgccgctcgctctcgccgtcggaatcgtgctcgcgccgtgctcctctctctccgccgtcgccgccgagcttcggttcgccgccgccgccgctccggacttcctcctcactcggcgacccctccgtccgcttcgccgtgttgtcgccgaccccgtccgccgctccgcttcgcccgtcgaccgccggagcaccgtcgtcatcgtcatcccgagccgcgccgccgtcttcttccgctccggccgccgctctcgtcgtcgtcgttgtcccggggtgagccgaagaccgccgttcgccttccccctttcctcctctctctcgggtgccactccgccgcgccgttggtcgccggcggcgaccatcggggcgcgggtgcgcgccactcccgtcggccgcgccggcgaggccgccctcgggcgcgccctcgcggctgccaagtgggcccggccgtcagccgcccgcgcccgcgggtgcggctgacgcgcgggacccacggcgccgaccgccgccagccgcgtgcgcccggtccaccgtggaccgagcggctgacgcgtgggccccccaccccgtggacccggtccgcgcgcccgccccctcggctgacgcaataaacatgatttttaattgaaaattaaatgaagaaattcgcaaatatccatttaaagagcatataaacttcaaatggccatatcttggccatttgaactcggaattggaccgttcaagtctctaatttttccttaagatgtaaagaacccatttttgtgctttgtttttgctgttatgtggagttatttagtgttaaagcctttttctttttccgttggtcgtgtagacgctgcagcttcggaagatccgctcttcgtggaagtcgaagccgtcgagtgggaaaacgagcaaggcaagacacatcatcttgatcatattgaatcccattttataaaattatgttgatttaaattattgcattatcgctttatttaaattcccgcgttatcactgttttacttagccatgcctatttacctttgttatgaccatattattattgttattgttattattattaccttgttcaccctagacaaacaaaacctcaactagtggacactctattcatggttccacaagtatgaatttaggtagatgcttcgctgattaattaggcaacattaggtggttttataactttagacttgggaaattctcatatcacttggatactctggaatggttggcttatgttggaattggacacacacctctcttcctctttcaaaacccctaaaacctgttttcggtggggtttgggtgcatgccagttgtgggaagtagcaccccggccactataaggactaaagctcgggcctctgttgcaaagcactaccgtacttccacatgtctaatgggtaaggcttagtttgtggctcagtctagtcataaacaaaagtacacggattggagatggatgaagtcgggcgtcgatggacattctccagggcaaatgaaggctacacgagctgcggcccggtagtcgagatgtcatacggcggagggttggtgcccaatgctaggggctcagttctgcctgcctgtcccgggtatcccggccgtaggtaggattgggtcggtactcttgtctaaggctaggatgggttggaaactatgtcacgtcttccgtccgtataccgtggtggtatgtggcacgtggcaacacgtgaggaagatgtgtcttgtgggtaaagatgtacacctctgatcagagtaaatctattcgaatagccgagccctcggatatgggcaagcctagcaatgtacccaagtcagtgttataattcttaaaatttgctcaacaactaaaatgtggaatggttggcctgggttggcttgggacgagctgggacccaggtcgggttgccagttcggtctgaatcatcgtaggccttgggttaaggcaggttcgtgagggttcacggccttgatttaataacattggatagttctaggatcgtgtttacaaaatggccttgagcaactaaatgtctttaaatgctgtttactgcaaccctaacccctctatggtatatttcccttgtactcccttgcatttattctgcatttgtgggtgtgtcttgttgagtacggtggttgtactcagtcttgcttaattttcccaagcccagatgaggagctccttgaagatgaaggctttggtgtctagctcgtgcctgccgtcaagtgcctgtggtcgtcgccctagtcttccgctgtttctcgtttgtctttgtgtgttgggccttcgctgcccgtgtaataattttatttacgcttccgcttgttaaactctgaattgtatcaacttttggtgtaccttgcctcctgggacaaggattaatgcacgcacgtaaggaatgcccgttgggttatttccggtcgtgacaagttggtatcagagcctcccttgaccctaggacgagccgtagatcccaagccttagcaatattttcaaaaataaaaatcctttattatttgtgaaaacccgctattctctctttgtcttgctgcttcacttaccatcaaaatctgatcttttaaatgttgcttttcttttgtttgtagatggccggcagcgttacccgtcgtggtttggacatgactggcttcgtcttggagctgcggggcatgtgcgtggtcttggggtatccacatggagtggattaccaggccaggccgctcccggagcaggagggtgaggatgcagagcctcacgctggttgggaggtcactgcagtgatcctctccggctctcccgagcggacttcgctggcagtcaccgcgggtggggactccttccccgccgcttgccagaacgccgctctcctcgccatcggcacccttcaccagcgctacccggacgagttgcagcactcgccctaccgctaccaccctcgtcgcggaggagcccgcgacttcgccaccttccgagacgccagctcggaggatgacgctaccgtcgtgcacctggcacgcatggtggaggcatacgacgcagctcgtatcgacttccatcagatggtgcgtcgtggcatggtggagaacaacatgaagatcctggagctgcgtcaggagaacctgcagctcaagaaggacctcgacgcgttggaggcgcagctgcaccagctcaagatcgcccagggagaggtcagccgtcccaagcgtcgccgcgtctgccgcagccagaagatcaccgcccgcaagagcacctccaggccagagcttgtccgtcagtccctggcgtggacctgcttcgtcgagacccctcgtgccgagcctgcgcccgtggttccccaggagggggaagcctccggcgttggtagctcggagggtgcgctgttgctcaccttccgtcctggcccgtcgcagcggtagacgagcagttagtaggcttgcgcgtgtgtttttcctcgtttgtcttcttgagttgtgtggggcatggttacgccggtgtgtggtgtaactatgtcggagcctgtctttttttgtttgcctaagcaacttgaacattaatgaaccaatttaatagcagtgataaatttaagaataatggtagtcgtgggtggttagttttaatcgtcagctctcctcctctgtttgctggttctgtgtggggttttcagatggtgacgaccaggagaaatgttaacaccggtgaaggcaaccaacccgagggcagcaaccccaacccccaaggcaacccacctccaccaccaccaccagacaccaacgccattctcacccagatcctcgcccaacaagccaacatgatgaatgctttcctccaccacctccaaaacccgccacaacagaatgctccaccaccccctccccaacactccaaactcgccgagttcctccgcatccgcccacctaccttctctagctccaacaaccctgtggatgctttggattggttgcatgccgtggggaagaagctagacacggtgcagtgcagtgatgaggagaaagtcgtcttcgccgcccatcagctgcagggacccgcatctctctggtgggaccacttccaggctacgcagccagagggacagccgattacttgggcccgcttcaccgccgccttccggagaacccatgtgcccgccggagtcgtggctcttaagaaaagggaattccgggagttgaagcaaggcaaccgctccgtgatggagtatttgcatgagttcaacaatctagcccgttaggccccggaggatgtgcgggaagatgaggagaagcaggagaagttcttggcaggaatggaccctgagctgtctgttcgtctagtctctggggactatcctgattttcaacgactggtggacaagagcatccgcttggaggccaagcacaaggaactggaatcgcacaagcgccgcttggcgaacttccgcaatcagcagggtgctaaccagagggtccgctacaccaatccctatccagggggatcctcctcgcagcagcagcagcagcagcaacctcgcccagcgccccgacctcaattcgtggtgcgcgtcccacagccgcagcagcagcagaatcagcaagggactcgtgcgccccgtcctcctacgccaactgtgcagcccgttcaaggccgcagggacgctcaaggtcagcagcgtctgtgcttcaactgtttcgagcccgggcactttgcggataaatgcccgaagccaaggcgtcagcaaggccaagcgcctccccgctccaacaacggcgggaaggatgtcatccgtggtcgtgtgaatcacgtgacggccgaggacgtgctgacaactccagacgtcatcgttggtacgttcctcgtccattccatccctgctacaattttgttcgactctggagcttcccactcgtttatatctgtgccattcgtggggaaaaatcagttgggggtagaaaggcttagaaaccctctgctcatcaccacccctggcggggttatgacagcaaagtattatagccctgccgttcctatagaaattcaggggattccttttccctcggatctgattcttctagacacaaagaacttggatgtgatccttgggatgaattggttggctcaattccaaggagtagtggattgcgcgaggcgcactgtcactctgtaccgagggccagaacaaccggttgttttctttgcacccccaacctctgtcagaagttcagaacttcatcagatagaactgtcagaaatccccatagtcagagagttcggagacgtgtttccggaagaactacctggtatgccgcccaagcgagagattgagttccggatagatcttgctccaggaaccactcctctgtacaagcgaccctaccgtatggcagcaaatgaactggccgaagttaagaaacagttggaagagttgaaagaaaaggggtatatacgtccgagtacttccccttggggtgctcctgtgatttttgtagagaagaaagacaagacgaagaggatgtgcgttgatgtcacgaccggaaataacccaacgggcattccttacgtgcgtgcattaatccttgtcccaggaggcaaggtacaccaaaagttgatacaaatcagagtttaacaagcggaagcgtaaataaaattattacacgggcaacgaaggcccagcacactcaaagacaacgaaaaacagcggaagactagggcgacgaccacaggcacttgacggcaggcacgagctagacaccgaagccttcatcttcaaggagctcctcatctgggcttgggaaaattaagcaagactgagtacaaccaccgtactcaacaagacacacccacaaatgcagaataaatgcaagggagtacaagggaaatataccatagaggggttagggttgcagtaaacagcatttaaagacatttagttgctcagggctattttgtaaacacgatcctagagctatacaatgttattaaatcaaggccgtgaaccctcacgaacctgccttaacccaaggcctacgatgattcagaccgaactggcaacccgacctgggtcccagctcgtcccaagccaacccaggccacccattccacattttagttgttgagcaaattttaagaattataacactgacttgggtacattgctaggcttgcccatatccgagggctcggctattcgaatagatttactctgatcagaggtg

SEQ ID NO: 59802 - DNA, 51717 bp, Oryza sativa
catagaaaagttaaagtccattaaacatcttatgaacactcttaaattcatacatgatactataataaattagataaaatcatagaaattatgagaaaaagataaaatattacatgtttagtagtccgggaaacgttctcactataaactagatgggtaccccgcacattgctgcgggagatttgtgtgataaaatagtagatatgagctgtagaaaaaaaaatcttatttactatatgattttctttcatgtgcttgtatattttgtactttgatcaattattgaaaagttataaatggttgagttgtatggtgtggcttttggggagaagaaatgcaatttgcacccttgatgaatcatccaagggctaaaaacaattaagatgatgtggcttcatgagagaagagagaattagcattagctgcacttagtgggatgaactttacagatatattggacaagggagtagccaatccgataagctatttagaaagctactaaaacgcttaaacgcttaatatgtatactatcaattataacttatgaggtatatccacactaccactatctgctaatccccaaatcatattgcttacgaggtatccatgcacggtgcacctaacgattagctgatatccaaaaagttgcggtatatctcaatggcaataaaattaataaaatagaaataagatgcatgcgcatgtttttttccttcgcatgggatcgagaaaatcaagctgctgatgcaaaggttgtttggttaactgcagtttatttatgcaatgaaagatgatgatttcatctatgtgggttaacaaattttaacattcatattattgctgtactctgtaaaaaattcgtttactgtccaaaattcatttattcgttgtttcacacatgcatttctaacatgtttctgacttatatatttttttcaatcatgtgttggaaagaaccttcaaattctttcaccgagagacaaaagtcatgatattcaaaatcctaataacaaaaattatgatagtttaaataagatgcccgcgcaactgcgcgggctaccttcctagttggataaaaaatggtcgaagctgaaattttagtaacaaaagttgatccaaaccataattcactatatatatatatttaaataaggggtattatttatacttctttgaaacagaggagtggtggtggtttcgccacccccaacctcaccaactgcctactatttgctatactatttttaaatgttggtaatagtggtgacactgaatctatcaccatcacgtgtttcacctttgtatggaccctataatgttggtgaaacttttttgcttctcctatgattaatcaaacagaaatagctctatgcctctactctagctaattcagtaagcatcaaaaactcatggtgaagtatagcttgataggtagatagttttaggatttaaaaatgaatgcaaaagtttattttctaaaaattcagtagtaacgcacgagcaaatcagctagtaacatacggggttagagagcttacatgtggtgaaattgtgggtaataaacagaatgcatcacatcgtggagatggttaacaactagcaaatataaacttactaccatgtattagcactttatgtctggtcccatctattttttaattgtagcatgactcatgtttgaagaatttttcagatgggtcccaccttattatctactttacacatatatatattgtggtgcctcttcatcctactattaccacatggcacgagtctaccttactacctagtttacaataaacattgaggatgtctaaagaaaaaaaaagtcatgggaccaaagaatcgacatgtcagtaataaatatatataaaaagaaaataatggccacaacatactaacattacttctcttttacataaaaatttggtgccaaacacagtgacacggattaaaaggagtacaccataagtatataacctaacatagagttactttcttcggttcacaatgtaagttattttagcatttcctacattcctattgatgttaatgaatctagatagatatatatgtctaaatttattaacattagcatgaatgtgggaaatgctagaatgacttacattgtgaaacggagggagtattagctagtcatcatttgttctcttcaccgaccgaccggttgggtcaacctttctatgtacgctcttatacacgatgtcgtcattatgtgattaacacaagaacgcttgttcgtccctcgcctacaatgaaaacagaaactacaggacgcaggtgactagctctgcgtgtcgccatggtcgcgacaccatgttattttcattaccacagaacaagcatttatatgcatatatatgcccgcattttgccattcatcctccacctctcgccgccaagcagcttcaacaacagcagaagggcagacgtgagaacgatatatacatatatccaacatgcagaggaagtcgagcggcggcggcggcggcggcagcggcatgtgcgacctgccgatggactgcatcgcgtgcattgcctcgctgacgtcgcccggcgacgcgtgccggctggcggcggcggccgcggcgctccggccggtggccgactcggatgacgtgtgggggagcttcctcccgccggagtgggccggcgacggcgacgccctggacggtaagccggggggccgcgagggggagagcaagaaggagatgttcctccgcctctgcgacttgcctgtccttctcgacggcggcaagctggtaatcaaaagccatttaattccttatctgcgttgtttgttaattctttttttttacctttggttccataattattgaagttttgaacacggtttggtcaaacatttataattttgactatcaataattttataaatatttagtttataaaggcacttgagcaatatatatagtagtactatataaaaataaaaatgtatttatttattctatataatataatagaaaaacatagttaaatatatattttagaaactatgtcattgttcaaaacattaggccatttccaatccaatgactagaatggtgtcatagcattaaataaactgccacctaggataaaaaatgaggtgacaagtgaataaatgaggaaagagaaggaaaccacgtcttgcatgggacatagtttctacacaacatccaagacatcatgtgagataagtagcattaaacttaagtatggaatagtgatgtttggaagagtagtgtctagtattagtttcttaattatgtgaagtttatggaaactatatctagtgtcttgggttgggaatagccttatggaaccaaaactagagggaggaagtactatgtactactattgcctcttttgtagggcctgttaagatcaatttgctgtggtaaatttttttggtaaaagttttggtggcaaaagatttggcattgaagtttgttagttggtgtctagatgacttagatgcatggtaaagttttaccattttactagtaaagacagatagagcaatgctcccaacgtattttttggtaaaatttgctactctagacttccaaatgataaatgctaaattgctaacttttgatattagtgtttagatccattttgacaaaaagtactcaaaaacagcaaaacttatgccattttagaggaactaaacagtgccttaatctcgttctatgaaatgtttaaactctgaagctccaaatcttaactgaccaattataagtaaaaataaaggggttgacaggtaaatatggaattaataggtttgtcaaaatatattaataggtggatacaatatattacaaaactatttttatccatttggattttattgaaattctatgtaaattgtaatgattaaaaggaaaattttcatagcatatagtagttatgggtaagtttgtcaaggctattatttaataactgttatttatttaaaactgtattcaaaattgtacgtaaaaaattattgaatatttttattttcaacacatacttgtggacaattattttttctagattaattttgtgaaccttaatatatgttttctattgataaaacacaattacggaatttggaaacttttcttgatatgatctgttcttttaatctagaccttcgtaattcatttcactgactgatagcacatagatagatagatagatagatagatagatagatagatagatagataagaagaatagcacaactaaatacataaatagatagatacttcctacatttcatattataagtcgtttgtcttttgtttctaagtcaaactttattaaatttgatcaagtttataaaaaaattagcaacatctaaaatattaaattaattttattaaatctagaattgaatatattttgataatatgtttgctttgttttagaaatactactatatattttctataaatttgattaaactaaaaaaagtcaaatgacctataatataaaatgaagggagtaatagactagttcataccagttttgccttcacactaacagtactgggcattcagttcactgatatccctgctctcattgcaccagagcttttcgttggagaagcgtagtggtgccaagaaatacatgatgcgagcaagagctctcggttttggatggagcggctatccctacggaggtctcgtctggatacaaaaccatccggattccaggtttgtggttggtgcacaaaaccaatgaagaaatcccacattatatgtgttatttttgcaaggctttacggaattaaatttagaaatatattgtttacctattttttatttaaattgttcggggtgtaattattttgggagaaatatattatcaatatcgcttcgcgaaaacgaggacgtggacagtacgtggcggcgcgagaccgagcggtcttgcgcagccataccgcgagaccccgctgaaccagtcggcgatcccggactgccatgccaattcatatggttaattaattagtgattaattatcatcataaatcaggtaattaatcactaattagacggcaccgttggacaagaagttcggtctcgttggttccttatgcgagaccgttcggtctcagctgtttcctcgcacaagaccgtgcggtctcgcatctttgccgtgcgagatcgcccgtgtcgttacgcctacatcatttttacgcaacggttatgcgaggtcgacggtatatttccgccaaaacatttacattccgaatatttataagaaaaaaacaaatcaacagtatgttttcaaatttaattctggctttatgtaaatatcatttactactatctccgtcccaaaatgtaacacctttggctatgaatctggacgcacggtcatccagattaatagctaaaaatgcttatatttgggacggagggagtacaaaatatcatgcatttccttcttgaatactaagagtattatcatccgtagaaatgatcttaagtgttgatttatgaattctgctatcagtagatatggtccatattgattagaaaatctagattggttctactaccacagaacattgtaaacatgtctttttttttgtcatgggatgtactccttgttgatttttctctcccataaatagcagacaacccttctgacgattatatgtccattattttcccttctttatttctaggttttctgaggtggccatcctctcccacttgtgttggttggacatctatggtatcttcaacacaaagcatctctcaaacggtacatcctacggagcttatcttgtgtacaatgtccaattcttgcacacagaagatcaaaatggaggctacaaagaacaagatgcaacagcatctgggtcatcatccacctccagcatttgcagtcatgaatgcaaccatcttatgccgcagaaacatctgcgctcactgttgttcaacatggattatgatggatcatcatttgtaaaaaccaacaataaccagaagaaagaactgaaatatgtaggcatttgtgtaagaagtgatggatggatggagcaggaaattagtacagagatatcagtggtaaaacagaacaatgaagagaatggagacatttctattgagtttaggggcttaaccggatcgcaccaatgccaaattattgtagaggggatcgaaattaggccgaagaactaacggttctccagttcatggataatcatgtcagctttcctagttggcgcagacgccaaaaatcttgggtactttcttatatatcatgaaaggtttatatttgggtaatctttggaaataaaacagttgatgatctaaaagtagtggagtattcattttgatgatctctacctttctctcttctttgttcttccaccgctggagaagtgatcttcagatctagtttacaacgcctttagtcctaggttacaaaccgagactccgatgagcattttttaagtaccggttgaaataactgggactaaagattcatctttagtcacagttggtggtgctaccaactttagtccagattggtgttaccaaccgggactaaagttctttttctttctttttctattgttctttgctgcttgcatctattgattttgagccgaaatcaccgacgccgtcaccccaaatccccacaaatcatccacaatttataggcccatctataaaatcatccacaaatcactggcccatccacaaaatcttcccaaatctaaaaaaatctataataaaatctaaaaacaaatcagtcatagccagcagacgggggtgaggaggaggagggccccgcccggccgccgccgccgcctcctccaccgggctgccacccggccaccctcccatcctatcgcctcccctcccgccggatctggcagaggggaggccgccgcctcgtgcgccgttgcccgcctctcccgccggctcctctcccgcccgatccgacgcaagggagggtgtcgccgtggagatgggagagggagaggggaaggggaggaggggatcagacgagaggggagggggaggaggagtggaggaggaggagaagaaggcgtgaagaggggaggaggaggaggaggaggggataaggcgttgttgccgatgccgagataaggaagagagagagagggggagagagagtgagagatgccaatgacgtgggagagagatatctaatcccggttaccaaccgggattaaagatataattttttttgtcccggttggtaacgaaactagactaaagatggacttttgaaccaggactaaagatgaattagtcccagtttgttgaaaccgggactaatgtgattgtggagattatggatatcccatatctacacggcgatgatatttgggctgaatataggataccgaatatagatagaatatcttatttgtatctcgggtttgtttctcaacttgtacatcaaggaaataccttgagacttagtcggttacgactgtattttatctgtatctgcatattccgttagggatatagattatcttttgtaacacggactccctcccatatataaggggggtccgggtgcctctaggggcagaggttgattttctccaaattatacaatcaataagacactcggcggattcatccccggacaggagtagggtattacttcttgaataagaaggcctgaacctgtataaatcttttgtctccaaacccatacacttctccagcttgatagccacccccttttattattgccgaaatctagtttcgacagttggcgcgccaggtaggggttgcgtcaagcttttcgccgatcagtgcaatgggttccgtctccggcatcgacgacctcgtcttcccacctgggcagacgtttcggttcggcagcctcgacttcgtcaccaacaacttcggcaagatctctctccttgactcggtgtcagaccagtcgggagagaaccggatttcagtcccgtttggactcccaaacgcggctgaaagttacttcaagaccatctcaatcgagttggcttcaaaccacttgggtgagatcgcatcttctccaacgtcaccagatcaagatgatggggcttacccaccgatcctgatgaagctccccgacgatttggcggccgtctccatcacgacagcgtctccatcccgtaggcctaggcggaagtcggcttcaacaccgatttcgcctagcttcagggaagtcggcgtcatcctccaaccactcggcacggtttcgacggatcagctggatggctactacagctctcccaccgtcgactcgcgccccaccgacatcgtggagtacgacgagtttagctctcgctacaacgacccggatctcgacgacttcgacggaagcctagatgacaactacacccctctctacttcggcgtcttcatggccgatgacgagacggaggagcaacgccaagcccgggagaccgaagcacgtcgcgagactgagcgtcgccgactggaggaggagcatcaagcacaagaacaagaacggctacggcgtgagcagcaggagcgtgagcggaccgcgaaggaggctgaggatcgacggcagcgagctttggaagcagggcgccgagcgcgtgatctcatcggccaacaagatgttgaagggacaccggttttccgcacccctcaacagaatgcggttgccgcgatcaccctcctcgacacccttctcaaggaaaacgagctcaatcaatctgatcacgtcgtcaacatcttgaaccagacgaagaccatgattgcggcttcggtcccagttaactccgaaagcgtccatacgccgaccggcagccgagtcccccacttccgatctcatgactaccgtcatccaagcctcagcatcaccggcgcaggatccaatcgcaggagcaggggtcacgacgagcggtccgttcactcacctcccgaccatcatagggagcgccgagtggaacggcctcgctcaccacctcgtcgccgccccgtcgatcttcgcgacacaatcatacagcgccgagcagctcgaggccatcatcattcgccggaccgccacgacgacgaccttgacggagtagcagccttcaccgacgacctgcgtcgagtggattggccagccggcttcaagccgactggaatagagaagtacgacggtaccactaacccagaatcgtggcttaccgtctacggtctcgcaatccgcgcagcaggaggagacagcaaggccatggcgaactatttaccagtggctttagcggattccgcccgatcttggctccatggattgccccgtggtacaattggatcttgggctgaattacgcgaccacttcatcgccaacttccaaggcaccttcgagcgtcccggcacacaatacgacctctacaacgttattcagaagtccggagaatcccttcgagattacatccgacgattttccgaacaacgtaacaagatctccgacatcaccgacgacgttatcatcgccgcattcaccaaagggattcgccacgaagaattggtcggcaagttcgggcgtaagcctcccaggacagtcaagcttatgtttgaaaaagccaacgagtacgccaaagccgaagacgccgtcaccgcatcaaagcagtcgggtcccagttggaagccaaacaagggtacgccggctacgggaggaggtggaagtaacaaccataaggaccgcaagcgtaagcctgaggaacttgtcgcaaccgccactcactcttctcgacagcgttcgcgcgtcaacacgttcgacaagatcatgaactcccaatgcccgcaccatcctaactccaaccacgtggccaaagattgtttcgtctacaagcagtttgcggagcaatacaccaagactacacggaaaaactctgacgaagaacaaagcacgtcgaggaagaaggacgacggcgacaccccggcaggatttcaagaccaccgcaaggagctcaaccatatcttcggcggccccctggcttatgagtctaaaaggaagcaaaagttgactgaacgggagatcaatgctgttcagcccgacacgccccagtatcttcgatggtcagaaattgcaatcaagtttgaccgctcggatcatcctgaccgagtggtccatccggggcggtaccccctggtactagacccagtggtccgtaatgtcaagcttcgcagaaccctcatcgacggtggcagtgcactcaatatcctcttcgctaagaccttggatgatatgcagatccctcgctccgagctaaaaccaagcaatgcgccttttcacggagtaattccaggattatccgcaactccactcggccagatcatcctcccggtcacttttggcactcgggaaaacttccgcacagagaatatcagctttgaagtcgccgatttcgagacagcataccatgccatactcggacgcccggcgttagccaagtttatggccgtcccgcactacacttacatgatgatgaagatgcctggtccccgaggagtcctatccctacggagcgacatcaagcaagccgtcacatgcgacaaggagagttgcgacatggcccaaacccgcgagatggcgtcagcccgagaggatatccgactggctgcagccacggcgagcgaaggagaagtgcccgctaccaagatctcaaaaagtggagaaagcgaagccaagactaaaaagattcccctagatccttctgattctactaaaactgctgtaataggtgccgagttagattgtaaataggaaagcgcgctcatcacctttcttcagaacaataaagatatctttgcgtggaaaccatctgatatgcccggtattcctagagaggtgattgagcactccttacatgtcaaacaagatgccaagcctatcaaacaacgactccgccgattcgcacaagacaggaaggacgcgatcaaggaggaattaaccaagctgttagcggcaggcttcattaaagaagtccttcatcccgactggctggcaaacccggttctagtacggaagaaaacggggcaatggcgcatgtgtgttgattatactgacctcaacaaatcttgccctaaagatccttttgggttgcctcgcattgaccaggtagtcgactcgaccgctggctgtgagcttctcagttttttggactgctactcggggtatcatcagatccgactgaaggaatccgactgcttgaagacttcattcatcacgccctttggagcatactgctacgtcaccatgccgttcggactaaaaaacgcaggagcaacttatcaacgtatgatccagagatgcttctcaacgcagatcggccgcaacgttgaagcctatgtggatgatgtagttgtcaagaccaagcaaaaggatgatttgatctcggatctagaagaaaccttcgcgagcatccgcgctttcaggatgaaattaaaccctgaaaagtgcaccttcggagtaccgtcagggaagctgcttggttttatggtgtctcataggggcatccaagccaacccggagaaagttactgctatcctcaacatgaaaccgccaagtacccagaaagatgttcagaagctgactggatgcatggcggcgctcagccgatttgtttcaagacttggcgagcgggggatgcccttctttaagctactaaagaaaacagacgatttccagtggggacccgaagcacagaaggccttcgaagatttcaagaaactcctcaccgagccaccggtcttagcctcaccatacccgcaggagccgttgttgttgtatgtagcagccacctccaggttgtgagcacagtcttggtcgttgagcgcgaggaagaaggccatgtccagaaagtccagcgaccgatttactttgtcagcgaggtcctagccgactccaaaacgaggtaccctcaggttcagaagctgttatatggtattctaattactaccaggaagctatctcactactttcaaggtcactcggtaacggtggtcacatcatttccactcggtgatatactgcacaaccgcgaagcaaatggacggattgctaagtgggctttggagttgatgtctttggacatatcattcaagccccgaatttcaatcaagtcccaagcgttagctgattttgtcgccgaatggaccgagtgccaggaggatacccccgcggagaagatggagcactggaccatgcattttgacggatcaaaacgactttcgggcactggagcaggagtagttttgatttccccaactggagaaagattaagctatgtgctttggatacatttttcggcatcccacaacgttgccgagtatgaggcgctccttcatggactgcggattgcaatttccctagggataaagcgtctaatagttcgaggcgattcacagctggttgtcaaccaggttatgaaagagtggtcctgccttgacgacaatatgatggcatatcgacaagaggtacgcaaattggaagacaagttcgatggactcgagctcagtcacgttcttcgacacaacaatgaagccgccgacagacttgccaactttggatccaagcgcgaggtggcgccctccgatgttttcgtcgaacacctttatacgccgacagtacctcacaaagatactactcaagttgcgggcactcatgatgtagctatggttgaagccgattggcgagagcccctcatacgatttttgacttctcaagaactcccccaagataaagatgaagccgagcggatttcaaggcggagcaaactttacgttatgcatgaagctgagttgtacaagaaaagcccttcagggattctgcaacgctgcgtatctttagaggaagggagacaattgctgaaagacatacattctgggatatgcggaaaccatgctgccgcacgcaccattgtcggcaaagcttaccggcagggttttttttggcctactgcagtgtccgacgccgacaaaattgtgcgcacgtgcgaaggttgccaatttttcgccagacaaattcatctaccagctcaagagttgcagaccatcccactgtcttggccgtttgcggtttgggggctcgacatggttggcccgtttaaaaaggcagtcggcggttacacgcacctctttgtggccattgataaattctccaagtggattgaagctaaaccggttgtcacaatcacagcagataacgctcgagacttcttcatcaacattgtgcatagatttggagtgcccaatcggatcatcactgataatggcagataattcactggcggagtttttaaagacttttgtgaagactttggaattaagatctgctatgcctcagtggtgcctcccatgagcaatggacaggtggagcgagccaatggcatgatacttcaagggattaaagcgcgtgtttttgaccggctaaaaccctatgccggcaaatgggtgaaacagctgccatcagtactttggtctttgcgaactacacccagtcgggccacaggccagtcaccttttttccttgtttatggggcagaagcaatgttgccgagtgaagttgaattcgagtctttgcgctttcgaaatttccgtgaagaacgctacgaagaggaccgagtggatgacttgcaccgattggaagaagtccgcgaaacggctttgattcagtcggctcgatacttacaagggctgcgacgttatcataatcgcaatgttcgatcccgtgcctttctagtcggcgacctggttttgaggaaaattcaaactacacaagatcggcacaagttatctcctctatgggaagggccatttatcatctctgaagtcacccgaccaggttcctatcgactcaagcgcgaagacggtacacttgtcgacaactcttggaacattgaacatcttcgtcgtttctacgcttaagcttatcattgtacttccctatcttgactgtcaacatcaagttttcttcttgacgttgtcagtcaggggctatcatcataataatggagtgtgattttttatcactttaatttgcttacttggtctatcattgccttgtttggtttttctacttagtctgcgaggactgaaagtttttaatagcttatttgggttttaggctcaacaaagcttgataaaagcttttaagaaatcaaagacttggctagatttatcaagcacagcataaatacaccagtattgtacaagttatgcctccatttgctacatttatactcagtcagaatcagtcttttcatcatcagagttattactacttggctgaaggtcggtattgcggaattgatctacaacgtcacttgcaatcttgtcagccgcgttttgagcattgctgataagatcaagagcagcttcttcgcttgtcccgtctgcaaagccatcaatggcgtcaatttcaatccttgggtacaaggatttggtcatcgccaatgccatgctagctcccatacttccagctttcttgatattcttgaaatatacatccggagcaactctcagcttgtcgaagatttcggttgcgtcgagtgcactcggaccactgttattgaggaacatagcttggacgagtggtgtagcgacattagcgacttcatctcttgctccttcaagcctcttgatcttaccaaccaggacgtcaaattgagcttgagatttgattttgcggtctacaaaacacatttatgatcaaaatctactgcattaaaaagagagaagttcagattgttagctggcagtaccttcaacctccttcaaggccgagtccctttgcgcagccagtcctaccttgtctctttccagggctttaatttgtttctccatttgagccattctggcggcttgcgctgtttgaaatccaaatggttgaggatacagttacgacagcgtaaattaatggggcagatctagagattaccttttgatgaaccactcagctcgaagtttgaatcctggagctgagcaattcggtcccttaattccttctctgtctttttggcgagctccttggcctcatgtagctgatccctaactgcttcaagagttcccaaatgaggaaccagcttttctaaagttacggtcttggcctcattgcgaagatggattctctgcatgatgattcatggtttagttttgctgaagagaaaacaaagtcatcaaaggcagtcacccggaagatttacattcacaatgcgagtggcttctccaagtgccttcttcagctggcacacttcctcatcttctttttgacgatttatgacgatgccggcagcttgtgagttctcgtcccaccatttgagcaagataggaggacgagagtcatcagtcacctttatgcgaggaatttcttcttcgtcatcgcctggtggtcctgatgtatttccaagacattagacaaataagctgaagttatttaaatcggcatcacttgagaagatgagttacttgaggatgttcctagctgagcgtggggagatccttgttctttatctggagacccgatcatcgagtcgttaccagcctccggttcttgagaagttgtcgtctgcgcttcaacttcgggagtttcttgatctagacctacatccgactggtttccagtcgggggctcttgggttgttgtagtttcagttgctgccgactggtttccagtcggaggctggtcactcggattggcattatcacctgaagtatgggcgccagtcggctggctttcggcagtcggctcagaatccttggatgaacttggttctgtcacagtcggatcaggatcttttccagttggatctatgtcggatggtttcctgcaaagtgttctttcaatattcagtattatttccatgagagaagcatgtcgaagtgaaatggtaccaagaggtttatacctggaagatgttctaatctttggccttggacgactagccagttttttcctgggagtggtatgctttgggagtttattgggcgagcctttgtccccagatttgttgccgtcatcaccttcgtcgtcattaagcaccagctttctcttgcgagaacttatctgcccagtcggattggaggtttgaggttgcggatctgatctgattgtcggccctccacctccctgaacggtgtgctggcgaggagaccggcgctgagtgattggggggtcagacttcatcaatacatattcctgaatgagatgcctccacggttagttaactcaatatgaagacaagattatgttttggtcatgagttgaagatttcggatacgtacctgcggaggcagattgaatgcgttatatggcacaactggcagctgatgtgagtagctgacgacgatagcgtttgagaagattttatacattctctccttcatgattttaaaatccagagaatctggttcttcacgattaggatcatgattgccatcaaactcgaatgctgcacgggatctttctttaattggtgccagtcggcatttgatgaagtgccgagtaatctgctctccttgtaagccttgttctttgagttttagcatgcgatccatcagctccaaggcttgggctgcttcatccccaatcggaagcgagttccaggtatcttggtacaccggaggaagacaagagtactcgggaagagcaggctcaggattctgaatataaaaccagtttgcatgccaccctttgtttgaggtcttgaagggcatagagaaatacttctggctcagagtccccctcagctgaaatccggcccctccgactacacatggcttactcttgtttggttggggcttgagaaagaagattcggcgaaacagagcgaagtggggcttaattcccaagaaggcttcacaaacatggacgaaattggcgatgtggactatggaatttgggtttaggtgatgcaagctgattccatagaagcttaatatcccgcggaaaaattttgaggtcggaagagcgaagccgccatagaagaaatgggagaagaccacaacctcgtgtgtatcgggggtcggaaaagcctcaccacatgctggccgccacccgatgatttccttggcagggagaacgccgtgcgccaccatctccttcaggttctcctccgtgacgtcggatggcgcccattggccttcaaagctttccttctcttccgccattaatttcacccgaatgtgctgatttgattcgagggatggctggggagaagtgagggattgaggcggtggatcacgggaaggattttgatgaacttttcgaaggtggattcgagtggaatggtgaaccctagtttgccggcgcagctttgtactgtagcagggagtggggaaaatggcgagagttccggcggggaagatgaagagtcgcttggatcttgggttttcttgttaagggtatcggaggtgcaaatgggcttaggcctgaacagtacctcagcccagtacttttaacagcgtggcccattgtgctccttagggacttaggcatttttttttgctttggcaatttatgcgcacaatagtgttgcccaatgctgataaaatcctttttacgcggtcatataattctttggaattattgcaatgcaaattaaaatgtgcccgacagaaaggtgttatgctgtttttgtaagcttttttaggctacaaaagctgtctgggttaacttggaatggcttgtttttaccatagtcatttccctggtatgttatatgcctgttttcattatggtaaatagtcatagcctaggctattagacttattcattaccataatttttataatatttggtgggtaatctttagagttttttattcggatgcctgtcaagtgtgttcattcgtgaaccttttagagtgttaaccactcggattccttttaattgtggctaaaaagcagtcggctaagaatgcctctttaggcgccgtgtatgcttttgtcatatgatgcatgattgtgctattattttgttctcaactatatgtttagtttgttaactaatcacatagttgggggctacacctaattaggtgcatctattcgatgcaccatattctttatcttttcgccctttacagtcttcgtcttcgctactcggcaggccttggcatgaaaagtttgaagcactcggattattatctttgagaaggctatgatggttgactgcaaaggtctcgggggctactgtggagattatggatatcccatatctacacggcgatgatatttgggctgaatataggataccgaatatagatagaatatcttatttgtatctcgggtttgtttctcaacttgtacatcaaggaaataccttgagacttagtcggttacgactgtattttatctgtatctgcatattccgttagggatatagattatcttttgtaacacggactccctcccatatataaggggggtccgggtgcctctaggggcagaggttgattttctccaaattatacaatcaataagacactcggcggattcatccccggacaggagtagggtattacttcttgaataagaaggcctgaacctgtataaatcttttgtctccaaacccatacacttctccagcttgatagccacccccttttattattgccgaaatctagtttcgacaatgatttttgccatccagataaagatcaattctccagtagtgttccttccaaatataaaattctaactatcattaaccttttttttatcattttcttatcacacctgatttaatttttacaacatgagatatcatcccttgaaactaattatctcacagatgctcaaaacacaattaatcgacaacactacccatctcgcccatatatgtatccgctctcacttctcctggagcttgaagaaggccatgagaggcgcatacaccctctccccggcgttccgggccatgacgaagtcggcgtgcgcgtagtcggcgaggtactgcacggtgagcttgtcgccgtcgcgcgagtgcgactggcccagggcccgcaggaggcggctcacgtcctggacgtcggagaggctgtccctgccgccgtagctgaggaagagagggaagtcgcccgggatcgccgtcacgtcgtacgctggcggcgtcgcctgcccgtagtgctccctgttgtcgccggcattgccgtagtcgtacttggcgatcgtgcctcctctaatcactgcttggcacaagcattttggttttaggaaaaatgcggataagatattatatttttcagcgtaaaatttaatatctctatatagctatgccaaaattattgcacatctttctggagtataggtatttgattttagaaaaaaataatatggacacttgaaataaaaagtatgatgataagttttttttagtgcgaaggtattgacgtatctagttaataattgtatggtttctcaagagatatcgggcagtaacacaattttaatgttgatttgttatactacctcttgttatcttcgtcatattatagagtgatgattatgtatctcgtgacaccctctcaaagccctcaaaaattctctaaatactgatgctaaaagtgtggtaccttgtgttaccttctcaaatactacggatgactaaagatgggaaaactgtcatattctttcaggtggtaggattctttaaaaatcatttgtacagactatttgtcagttctcatactcactctgagccaggtggatcatgttcttggtggctgtagcttgaggctcatgggcaaggaagacctgaacagaggagttgtcgaggcagcagttgtcacctgctccaatcgtcaaaatgcaggtcaataacatattagatttgaaaaaagaacacaattatattcggtcgtgacaacttatgcatatagctactattacctgtgaatgctgacatcagattgtagcaatcgatgcctggttgcttgcaaatgtcagtgaccaagctgtgaacgtattctctgcatagaaatataaattgtcacttgtcagcaagaaatgaatgaacagtaataaacacaattcaccaaacctcgtaaatatcgatataaataggaattctgaaaacatcttggtctgaagattggagaaatcgaaggcttgaaactaccttaaaattccacggtacttgagaggtaaaaaactatcaattgtttttaaaaaaattggtacccataattaccgaaggtactgagagatactaaaattttttaacatttaaaaatatggtatcttctggtactttattaaggactgtaaaatcactcaatttgaaattgtattttgtttaaaatttctgatttttttagaacttatttctgaaattttagatctaccgttggaccctacaagtgcctgtagcaaacagaactgcatttgctcgaatgaagcctatactatttgttcaaatttagcaaactaaacttcaaactttatctgaaaattcctttcatctccttgaattttttgaaactcggttttctgaaaagcaatgggaagaaattgagctttaccctgtaggatcgaactcactgagccccagccagtagagtgcctgcacaagcagagaacacacagaatcaatcagcaagctagcccgtttaatggccacgccattcgtcgtcgtagtcgtcggcgtcggcggcgtcagctccggcgaacttacctcagccaagaagacgtcggccgccgcgcgcgccagcggcgacgacatcttgtcgaggaaggcgatggggctgagcagaccggccgaccgcagcatcccgatctgctgctgctgatcgctcagggcagccaacgcgatcaacgtgccctgcatccacagttcagaagatcaaccaagggcaaaggatcgatttgtctgtgtgcctaaacttggtggttgattatcgagcggattatctactcaatcaattatagtgataaatttaatattttaaaaaataaacttgatatatagtttaaaataagttgtctaagcaatactgtagaagtacgtttacgtttaagagaacatatttgttcagaacgtgaagtacataatccgtttaaataagctgaaaaatagagttaagttaaaaattttttaaggatgaccaaaattcgtttggctgcgggaatttttacccatgtggtactgaaactgaaatgcattttttttttgttcctaacgccatttcacttaccaaagagtggcctacgtagtgcatcttctgctggccggcttggctgtacacgtactgcactactgctgataggtccttgctggacagctcgtcccatgaccagttccagtatgcctaggtttcatatgccaataaatttgtaaaatttcccattttaattagcggcataagcaagagcaagtaaaataaacacaaaagtattagtcctaagacgcaacataggttcagacgataaggtgaaatagagaagggatgagggagaggagccgtgtctactagtagtataatattttatatgaacaggctgatcgagagttttttcttcacgggaatccaataattataattttcttttctgaacaaacaaccaaataatatttctatttccaaacaaactaacccgaactgtcgagcgcacgctgtgcactgaatccttgtagtagcaagtatccataaaattaaataagtgtacaccataagattggcatgatacgatcatagataaatagataaagagtagcgtcctcaaaataaggtacgtctatattgcataataagtgagtgaagtctggacggtagagaatcagactataaaagtattaaagaattaattgataataatgtattgtatgtactggagagaatatatatactattttcagcttaactaatccctaatcaaaaggagcacgggtctttgcccgtgacccataacaacctctttttttttcttatataacaatacattttgttaatcatgtgtattatttacatcattagatggctatcatctcaaatttctaaaatattacttaatacttttaagatagatagtttgtttctcattttgctaagatctactccctccgtcccagaatatagcaacctatgatcggatgggacgtatcctaatactacgaatctgaacatcccggagaagttttttttctaattgttgcctatttatttagacttttcgcctagaagatattatcaccgtttatgatccatttgcacagtattcttatcgctaaatctattatatactaaaagtccattaaacttcattcaaacgctctcaagtcagcacgtgacactcctacaaacgctccaaggtcgtcatgtggcactttaaaaatcataaaaaatctaagaaaaaaataaaacatctagccattgattttcatttaatctggtaggaccattatttttaaccattagatctatcctctaaattaacaatcaaatttatatctccaaagatctaaattgttccatatctgtacgtgagtacgtacatttgtatcccgaaacccacacccgacccaaaaaaaattgtacgtgcacttctctttcctttttttttaatttctcacttagttgaaaaaccaatctaataattagcacatcttaactataatttaagttgtaaaaataaaaatatatgttatttcaagttatgttcaaataaaaaatatatctcatggaaacattcatgaaaaatataaataaattaaaattatagatatatcacttaacaacatgtataattctattagatttttatttttaaaagtaaaacaacttcgactgtgagtagcattctcaaaatttactcaatacctactagaaaaaaatattgatatgttaaaatgacattactaaatttattttgaatagtttcttttcatatattgctagaaaatcaacgacgaaatatattcttttgataccgtgtcgatgtcttttatctcctacctaggctttcaatggatctggctgagtttatttaggacacacaaaatgatgcacgtcataaaaaaaggattaattaggtattaaatattacaaaattgaaaatgggtttatttcatgttttaaaaatacttttgtatagaaagtatttagaaaacacgcatcgtttagctcaagaaacttctgtagtttgggaaacacgctcatcttaaataacaaagtagccaatcagataagcactttcgaagtcaaccttacatactaaaacacttaatatgaagtacataatatactttgtcaatcaggaacaagccaaatatatcaatcttatgctcccactaatcctatgtatataagttatatatagaaaccactgtccaccaatcgccaagtcataatagttatgaggcatccatgcattgtgcaactaataattagctgataaccaataagcacatgtgttatcaagtacaaaagataaaggaagtactaagtgagaaccatcaataaatgatatgtaagtagagatacaccaagctggaacaaataatagttgattacaagtagactacgactattatcaatagtgttcctacacacctgcatatacttctaagataccacaaagacactctaataaaatagagaaaatgtaagaaaattataataaatagaaaaaaacatttagccattgatttacacttagactagtggatccattattatcaaccattagaatatatctatgtaatccctcactcctaaataccggctaatccctccctatgtacgtacgtacacaagagatgtcaaaaagaagaaaaagtgtgtataatcaactcatcaagtagttttctctttctttctttgcagctctaaggttttttctgaaattatgtatatatatagtgaccacttctggtgaggttgtcgaagaagccacgccgctgcagtgctgcttcacaccatcccaccaaatctcttcaaagtatttattttaataatggtataaaagggaattgtgagcactcatataaatacatgcacatccaacttataaatacaattacacacctatcttatcagagaaaaatatttatcaaaaaaggaaaaagtacattcgtacaggtgactactatttgctagaaaaaacatacatacttacaataaaaaatatcacatggaaccacattatatcccatttaattatgacattctcatccaaatagtgttgataattagcacaaataattttgccaataaagattattccatcgtatattacctatgaatatgcatagatgaatcggatgtataatgaaagagaaaacaaacacatattaactcatacttttgtgaagaatgatgataggcgagttcacatataactgggatataaatatttctatatttactattacaatctattttcttataaaaaatagtgagatctgacttcttttagtattctttttacaaacaattaaataaatttcccgcgcatctgcgcgggttttctttctagttgaaataaacaagtatatgcaatatggcaatctgcctattgttcttttgtgttataatgttcttttacattgatacgatatattattacctacaaaaaaccactatttttgtttataatcgtgattgatcagttgtcaagttggcccctcatgtttaaatcttggcttcaccaatgcatgttaccatgatatggtactcctaacttttaaacataactttgtatagacatgtgttttaattttatagccaaatgttggttacgttagagaataaattgaagaatgtaccgagtcactagagacgagcgaagtgtggtggcggctatagacggtgccacggctattggcaatccagacatcgtacccattgtccgctagaatgtatcctagcgactcattgggcgagttcataagccaagtcaccccatcctgcaaagcaaacagtaattaactttggtgcaaaacatataggctctatccataacattaatttcctatctatcccatcaactgaatatatttttgtcgtaaaatcaagacaagtaagactaattcaatatttggcttcgaaaattctttaaaagatcattttttaaaacaaaattctcaaccacttgatttaactactcacagattctaaatttattcacacaccaatgtttacgtgctgttaattcctccacacgtaccatcatgagtccgtgctgcagaagcaccggcaccttgcctccgccgccgccgccggctgccgtctcgccgcggccgctcgggatcctctgcaggcttaggatgtacccatcttccgtcgtcacctgcacaaattattcccccaaatcaatcgattaattaattactataacacccgatcattctcaatttctcatcacgattgagtgctccgattacgatgatcacacgtatatacaccatccgtcccacaaagactagatatttgtgtttaacatttaaccgttcatcttatttaaaaaacttatgaaaaaaataaaaaaaatagccacgcgtaaagtcacctaataacaatcatataaaatttttaagtaagacgaagaaacaaaagatatatcaaaaacaaaaaaatagagtgtctgtgaaatcaacccgatgcattataaattaagcaattgattaattaccgtgtgctcttcacacgcgtagccaaacggtgccacccttgactggcacgtgccattggccgccgccacacgcgacgtcgacgacgacgtcccggcgatcggagccagccatgctgcagctgctgctgctgcgacggcgaggataattgttgccagagcctgcaggaggctaattggctgcaaaccgcatctgttgcctcctcctggcattgttttgtatagtgacagtgtgtgtgatcagtaagtagtatggttcgatgtgaaattaatttcagtttggtttcctgctgtgataaccttttatagctggatgactaggattatatcaggattaatttagttatgtacgtccatatgtgtgttctatgcatgtatattatatcgtctgtcattttcttcttggattaacgtgcgggcgcttcatgcgagatattatacatacatatgtgtacattgtgtcagagtcatatctcaatctataataaactactccagcttgcaggacgtttgttacaatttatttttcttacatgttgattttctttttaagaaatgggaaaataactatttccaatcaatagagataactaaaatatatgtcaatcaattctttggctctcttaataaaacatcaaatttagccattttcttagtaatgtccctccagtcaaaaatttcgctttaattcatgcaaattttgacccctcccacatgaggatgttaaggtggaccagtgattagcagggaagttgcaaagaaaatagtagttaaagcagcttttttattagaaacactcaattattgaatgacaattaattaattagctaatcctatatatctatatagttaatccccacttagtgcaattaatatgattttcctgcaatgtggttgttccacgtcaccttgattgcttttgaactgttggattgaagttatacggtaggattagatcgtttttgattggtctgctgctgtaaaacgtgagttgaaccatggtccaggcccaccaggcaaagcattgaaatttctcgcgtgcatgtgcgtctctgtgtcttccaagcgcctcatcttttccaataccgttgatctagctcgccccactataaattcttcattgacgtggtctacagaatcacaggtactatttttttacctcttttccagttcttgtgctttgcctcttctgatcgactgttcatgttcttctttttatttgctttcttaaactgccacatgctatattgccaatctttgtttcttttgagattatgttttccgattattgcatcatatatcatgtaaaattatgctaattatactcttctcatattaatcttataatatagctttgtcatcatatattttccatatgaatagatgcagaaatctatttgattccagattcaatagtgagccaaaagcccacaggttagactactaaactccctgtttattaagtttgcatcattttaagacacggtaagcataatataggcctaccatctcctttcttgacttttcaagttatattttggtaaaatagacagtttacctgtttatttaggttgcaaacaaaattagaaaatctcttcaaaggaaatgaaaggattgccaaggtagcccctcagcttcatgaagaaataaatgttaattaagaaggcatatgtttattagacaacatttttttttcctcttggagagatgaacagtgcccatgattttcctgctctttccttgattacctaagtaacatatgggtacccgcgcgttgctgctctttccttgattacctaagtaacatatgtgataatatagtatatgtgagttctaaaattttctttcctacctactatataattttttccatgtgtttatatattttttttacctttatcagttatccaaaggttataaatgattaggttgtatggtgtgccttttagaaaaaaagagatgcaatttatacacccttgatgaattatccaaagtctagaaacaattgagatgatatgaagatatgcaatttacaaccttgataaatcatctaaaggttaaaaataattgaggtgatatagcttcacgacagaaaagaaaattagcactaactacacttagttgggatgaactaagtgttgcgttttctagataagtggtattaaatacaaagatagagactactgaaacagtctagttaactaactttagaatatgggttgtatactttttagcacatagcatttcttctttcaattagtgaacaagccaccttacatttctttactgtcatacatttatataaataagtttccgcagcaacgcgcggagtaattttctagtatcaattaagacgcaaatcactaaatccatatatattgaatggcatatgaaataatcaaacaaacaacttcgtatatatgcagtagattttcgtttctattacacaagagacacacatgtatgtaggtgagttggtacatgtgtaggtgagttggtaaagataggtgcacgtgagggagatgtctcgggatcaaatccctacctgacaaaaattatatttgacttagaaaaaaagttactagtggttggggcttcgtatatgttgagattataggcatataatgatttaatatattccataaataaatcatggcattgcagatatatactagcattaacgcatcattagatctacacatgtaaactaagcagtaaaacatgaacagatcaaatatgcgcaacatattgaacacgtaccgaggtggtagaaagaccggctactcggcaggaacttttcgtgattgcaggcgtctacgaaggcgcgcaacacgcgagcgaagaggaagacgagccgtcgcggacgaacagggagcagtcgcgctaagcgcttcccaaaaaccttattgtcgccttctcccggtgcaggacgtcgaaggcagaggttccggagacctgctctcccgattgccggtgcacgccggcgagcgggatagagtaatctacgagcgacggcgtagcacagagtaggaggcaaaccctagattgattttgcgtgtgttgcgtgaagacggcgggtcggtttatatagagaagggttgcttgatcatggcgcccgcacgatctccactgcgcataaccgaaccggataagtcgcgcgtaacttatccggactccacgccgttttcacgcaccggatttttcggaacatttccaaaacaaaaacgaatccgaatttgcagcaaaataagactgcaaaaggaggctgcatctgcgcaaggtgaggaaccaatttttggcggaccattcgacgcgtacatcgtgcacgcgcgccgcctgccctgcccggccaggcgaggtgagcgagcgcgcgtgtgttccccctcttctctccaccacacatgcttcaagtggctaggagggcatcctcccttttaaggaggtccctctctcctagaataagcaaggtggtactaaactccacatgcatgccattccatgaggtgggcttttgtgattttccaaagaattaatcttcgagtgggctaaggcccatccattaattccaacaatcccccaccaaatctcaaaatcccactgagatttgccttttccaatgtactgtctatataccagcggttcgatggagaccgattaaggttgaacttctatctagaactccaagctacacttactcacaactttaacaatggattacgccttgaattgtaagtcttgtgcaagcaagtttcactcaaagtcttatctggtactagaccgtctgtagactacccctcgggtggagcgtataagtcatactgctaggtctttagtaagcttcctagaagattcacccaaaatcttcatagactgcgaccagcagtcaagctcacaaaggtgagttctttcaagaatgctctgcaggacagcatcttcgctaattaaagtcaacagaactcattaaggcatagccaacctgccttgcagctcacgagagtacatgcatcttcacttagagagggtatatatcggtactctcctctagtttactaatggtttgttcttccgaggatctaattcacgggatctccaatcacatagacttggttaccgccatagtataactcacatgggtctcaaacccatctccttcgatgcattgtctatcatatttcgtgatagtcccttcgtgaagggatctgccaggtttctagttatttggatgtaatccaacgttataactccggagtttctcaacttcctgacagacttcaatcgtcttttgacatgtctagacgatttcatattatccttagaactattcactttgacaattaccgtttgattgtcacagttcataaggatagccggcaccgttttttcaacaataggcagatccattaatagatcacgcagccattctgcctcaacagtagcagtatccagtgccatcaactctgcttccatggttgacctcgtcaaaatggtctgtttgcaagacctccacgaagcagcaccaccacctagtataaagacatatccactagtggctttgatctcatccacatcagagatctagttagaatcactatatccttccagtaccgtagggtacccagaatagtgaagcctcaattccatagtacctctcagatagcgcattactcgctcaagtgcacgccagtgatcatctcctggattagaggtaaaccggctcaacttgctcacagcaaaggagatatcaggcctaattgcactagctaggtacatcagcgagccattgatttgggagtattccagttgattcctaacaattctcttgttcttgcgaagcaacaagctaggatcataaggcgttggagaaggcttactatcaatgtagccaaagcgattcaagatcttctccacataatgagactgcaagagtgtaatcccattctcacctctaattagcttgatgtttaggataacatcagctactcccaaatcctttatatcaaatttttgagacaagaatgatttaacctcatttatcacctcaagatttgtcccaaatatcagtatgtcatcaacatacaatcacagaataactccctcacccccaccatggcgatagtatacacatttatctgcctcattgactgcgaagcctgcagatgtcaatgttctatcaaatttctcatgccattgcttaggagcttgtttcagaccatacaaagacttcaacaatttgcacaccttatcttcttgaccttcaactacaaacccatcaggttgatccatatagatctcctcatccagctctccattaagaaaagctgtcttaacgtccatttgatgaacgagaagaccatgtgaggctgctagggaaagtagcacacgaattgtggtcaatctggcaacaggtgagtaagtgtcaaagaaatattcgccttctttctgagtatagcccttagcaacaagccgagccttgtacttttcaatggtaccgtcaggcctcagcttctttttgaacacccacttgcaccccataggtttacacccacttgtcacctcccaagttccgttagcgataatggaatccatttcactacggacagcctccttccagtagtcagcatcaggagatgcatatgcttctgaaattgacttaggagtgtcgtcgacgaggtacacagtgaaatcatcaccaaaggacttaaccgtcctttgtcttttactccttcgaggagcttcactgtcatcctcctcagtgacatgttcatgtgtatattcagtttgttctggtggtgtgattgaactgggaattatttcagaaggttgactagaactactatgtgtatccttcattgggaaaaagctctcaaagaagatagcatcacgagactccataattgtaccaacatacatgtcaggtacctcggatttaactattaaaaatctataggcaatgctgtggtgagcatatcctggaaagacacagtctacagtcttagatccaagtttgcgcttctttgttattggtacattgactttcgccaagcacccccatgtgcgcaagtaagaaagtgatggttttctcccaatacatatctcatatggtgttttgtccttatttctgttaggaactctgtttaacacatgattcgaggtcaacaatgcctccccccaccatgccttaggtagtcccgcggtgtccaacatggcattcaccaagtcaggcagtgtgcggttcttcctttcggcaatcccattagactcgggagaatagggaggcgtcctctcatgtataatgccatattcctcacagaataagtcaaactcgtttgagaaaaactctccaccacgatcagacctaagtctttttatctttctgtcaagttgatttttaacttctgccttataaattttaaaatagtctagagcctcgtctttcgttttcaacaagtacacatagcaaaatctagtagcatcatcaatcaacgtcatgaaatatcattttccaccctttgtcaacaccccattcatttcacaaagatctgaatgtaggagttctagaggtgccaagtttctctcctcagcagccttgtgaggcctgcgaggttgctttgattgcacacaactatggcacttagaacctttgacaatggaaaacttaggaattaaacacatgttggaaagccgagacatcaagccaaaattaatatgacataaacgtgagtgccagacattagcctcatcatccacactggcacaaatatggttcatagacttattgcagaaatcagaaagggaaaagcggaacaggcctccgcactcataacctttaccaataaaatatccatgtttagacacgactactttattagactcaaaaaccaacttaaatccgtctctagttagacgggagccactaacaagattcctgtcgatagaagggacatgctacacgttcttcagctgcacgatctttcccgaagtaaacttcagatctaccgtgccaacaccatgaacagaagcatgtgacccattccccattaggacggtggaaccccgtgcgacctgataagaagaaaacaatgagatgtcagcacaaacatgtacattggccccagtatcaacccaccaattagtagactgattaactgaaaaaacagtacgtaaattaccatacccgcttccatctccagtgttgccaatggtcacattagcagacttagaagtctgccctgcaggtgccttcatccccttgcgctgtggacacttcctagccagatgaccaggttggccacacacaaagcaagtcctctcatcctgattaggattgttgttgttcttcttctgcttcttgaagttggtggtctgctgagctttgtatttccccttgctcttgttctgggccttgtgcacaacattggcactggactgcccaccatggcccttagacgcagcatctttttcccgagcttcctcctcaacatcaagagacgctatcaacccctcaacagagtattcctgtctcttgtgtttgagtgcagtaccgaaacttctccaagatggaggaagtttcgcaataatgcacccggccacaaatttgtcgggtaagacacacttaaggagttcgagttccttagccatggtttgtatctcatgagcctgttcgactacagaacggttgtcagccatcttgtagtcatgaaattgttccatgatatacagatcattgctagcatcagtagcaccgaatttagtattcagtgcatcctacagctccttagcgtcggtcatatgcatatacacctcgaccagacgatcgccaagaacactaagaatgcatcccacaaagagagtagtggcttcctcgaattgcttctgctgttcagcagtaagaactccttcaggtttgctagtactcacccagaagcatttcatagctgtcagccacagagtgaccctgatctgccatctcttaaagtgcacaccggtgaatttatccgacctcagtgcatcggcaaaactagccatagtaaaatcacattgcctataataaggtttttggattgttgagattataggcatataatgatttaatatattctataaataaatcatggcattgcagatgtatactagtattaacgcatcattagatctacacatgtaaactaagcagtaaaacatgaacagatcaaatatgcgcaacatattgaacacgtaccgaggtggtagaaagaccggctgctcggcaggaacttttcgcgattgcaggcgcacgcgagcgaagaggatcccaaaaaccttattgtcgccttctcccggtgcaggacgtcgaaggcagaggttccggagacctgctctcccgatcgccggtgcacgccggcgagcgggatggagtaatctacgagcgacggcgcagcacagagtaggaggcaaatcctagattgattttgcgtgtgttgcgtgaagacggcgggtcggtttatatagagaagggtcgcttgatcaggacgccacagagttggaggcaaaccctagattgattttgcgtgtgttgcgtgaagacggcgggtcggtttatatagagaagggtcgcttgatcaggacgcccgcacgataaatcctagattgattttgcgtgtgttgcgtgaagatggcgggtcggtttatatagagaagggtcgcttgatcaggacgccacagagttggaggcaaaccctagattgattttgcgtgtgttgcgtgaagacggcgggtcggtttatatagagaagggtcgcttgatcaggacgccacagagttggaggcaaaccctagattgattttgcgtgtgttgcgtgaagacggtgggtcggtttatatagagaagggtcgcttgatcaggacgcccgcacgataaatcctagattgattttgcgtgtgttgcgtgaagacggcgggtcggtttatatagagaagggtcgcttgatcaggacgccacagagttggaggcaaaccctagattgattttgcgtgtgttgcgtgaagacggcgggtcggtttatatagagaagggtcgcttgatcaggacgcccgcacgatctccactgcgccctgccaggcgaggcgagcaagcgcgcgcgtgttccccctcttctctccaccacacatgcttcaagttgctaggagggcatcctcccttttaaggaggtccccctctcctagaataagtaaggtggtactaaactccatatgcatgccatcccatgaggtgggttttcgtgattttccaaagaattaatcttcgagtgggctaaggcccatccattaattccaacagtatatacacaggtaataatgggtgccgggtacagaacatccaacagagatgagttttgtgtcggattcattttcgtacaccgataccaagttacgaaaaagcactgatgccattttctgtcgtagtgacacaccactatacggatgtcacttgtcactcacacataccatgagagtgtctccctaacacttactcacagagacacagatctaacggcatattcttagccttactaaaaattcctactgaaatcccattcatttgtgtataatatttgtggaactgaaatttgatttttgatggataatgtcatgcacctacgacctcaccacctcagcaccgcatcaacatgtgtaatcggtggactccgtctctcatatatcgacctgtgtttgtcacagcatggagacaagacaaaagatttgatgattgcaatgagaacgctaaccaatcaggttcttgatcatgagttcttgtgcctgtaggagtattttattagcaaagaggttaacatcatcttggttagttacggccttatagcgtactctattactactgttattgcacgcacaagtatacgtcgaattgaagctttttattctgagaaacagaagaacgcaaaaacaaatttctagttaatcttttaattctacaactacattttcataaaacctagacaaaaaactagattatttaaagaatttttttatttttgaataagttacagcagtcagaaactctaccctattttgcaatatatcatgcgagtgcatttctggtattggtaatgcgcacggtgaacctaaaacacccacagagtgagcttcaccagttttttaacgggtgaaccctcccgagagcggtgtatgcactttcgtacaataaaaaaaaatgtccaatcactaattacgtgcgtagcctttttctaggattaaagtactcacgggaaagactaattgccaaattatttttgtgttatttcgttgggtgcctcatcgtttggcaaattcatatgcttatcagccaaaatttaaattttcaacgttaaatttggagctgattttaggggtttttttcatcgaagtttatttttcagcctttgtttttagatcgctaagaacacatatataaaagttttattcacaaattgattttcgtttgcaaatatgccatttggcatctttagaaaatattcagaaaatatatctagaactactttgatcgaatctctctatatttgataagaaatatcaaaatgtgttttaaactttttttaagcaatgacaaacgaacaatacccataagacttgcggcctatcttaaaatcacatatagatcgttcttaaattagccaaagaaagcaaaaaaacaaaaacttatatccgtttttgctatagtaattcctatttttttaatatatgacgtcattgtctttttagatacgtttgaacattcgtcttagtcttatttcaaaaaattatgtaattatcatttatttttattgtgacttgatttatcgttaaatgttctttaagcattattaacttaaatttcttcatatttgcaaaaggaataaggaaacgaatgataaatgtttataaaaaaattaataacattatatattaaaaaaggtagtagtaaattaacgaatatgtgcatgctagtaccttaggtgtagtccttggctcctggcttcttcattgggcctaggaagtaaaacctaataacttctttttatttataagtgatatgtactttaaatgagcttttattaccgaagttttatattagaccactatttatcatttttttactttggacaatgtatttccttttacttttaaaataagacttcattacagagaaaatttatggtccttgagacaaagtatacctcagactacctaaactttgccctaaaaaaattttggtacctcaacgtatccgaagatactaattttaaataaaaaatacggtacccccagtactttcccaagaatggtaaaactacccttcattataaattcattactatgcaaatgattttcatggctgagcaccctttggaggtagatcataagtgtttgcgtctgcaaaattgacccatattttcgcatacagctcctcaagagacccacatgtaaaaatctatcttcgcaggcatacctcttaagaagccttatgcgaaaataggactacggacctcttaaaggtccgcctagatgtctgacttacctcctcgtgtccttcttagcacttcaaatttttcaagtcattcttgtcccctcttgtctgtctcacctcctcttctctctctctctctctcaaattcctctctcccgggagagaactttctctcctctctctctctccccaactcccctcctgggtggcagcggccactgggcgcacgacggcgggcagcggtggacgacaacggcggccatcccccgctttggtccacgcggatctagcgaaagagcacagcggacggcgagcggatccagcgagggcatgtggcaggcggacaggccttgcccggatccggcaacagggttcacagttccgacgaaaaccagtcgaattccgagaaattttgaggtttcgacaaagctcgaaagtagaagccgtctgagatttcgatgagtttcatccaaattcaaatttgaattgataaaaaaagaaaaaatcaaataaaatcttataaaaagtatgatatgcatatagaacctactgggatataactttttgaaaaaaatgattcatttcgtgtatttactgaaatttatagtaggaaagaaaagaataatgaattaaaaaaaataaaaaaaatcactttacctccttttctagttaccgattgaaattttgatgatttcgctcggaatttcataaaagccgactggttttcgcgagcgtatcggtaaactcaaggaatttgaattcaaattttagtttatgaaatttgttcggaatctagcagttttccaccggattttgcgaaaaccgtcattctaccatagcccaaaacagaaggccatctcggaatcgtaaaccctggcagggttcacaattccgacgaaaaccggttgaattccgcaaaaattcaaggtttcgacgaggctcaaaagtagaagacgtctgagatttcgatgagtttcatccaaatttaaatttgaattgataaaaaagaaaaaatcgaataatatcttataaatagtatgatattcgtagaacctattggaatataaattttttaaaaaaattgatgtatttcgtgtatttactgaaatttacagtaggaaagaaaagaataatggattaaaaaaagaaaaacaattttagtttaacttttttttaagtttccgattgaaatttcgatgatttcgctcggaatttcgacagtacactccagtcttaagtaggctcaactaaaacactcggtaggtccaaattaaacattccaatcttcagtaggcttgaatagaacaaccccaaaagaccaaaacccagaaaatgggtcgatcctgtcccaatccagcaatcctcctcattcctcgatctccaaaatcaataccagtaaccctagcggccacccaacgctgtggctgcgtgcgtggctgcacctcgtgcttgcgctcccaccatcctaccgcgagctcatggcgacgcggcctcaccgcagcttgcccgtcgccgtcggcctcgcggattacgaccagggccggccctggccctatgcagcgaggtgaccaccgggggctcatgatgatggggggcccataatggtgaggggccaacacctaatactagtaatctagtacgtcatccgatgttgagatcaatgatttttattctgaattaaaggtgttgcaggtgagtttgctagattctttgatgtccgcgtctgagattctgaagtttgttatggatgtagatttatatccaaatatttcagttgccaatcgaattctcttaaccgtacctgtgacggtagcttcagctgaaagaagtttctcaaaattaaagttgttgaagaactatttgagatcaactatgtcgcaagaaatattaaatggcttggctatgtgctcaatagagaaggatatcttggacactattgatcttaataccgttcttgatgattttacatcaagaaatgtcagaagaagtatctttccataggaagcaatggaatagggttctattcttcattaagttaataaataatgatattagttccaagttacaaatatattattattttagtcgactttatttcttgataattatcaagcatgttaaatttaatatatagatgtacttgttttcgttttgcaagtaaaattagcgtttatatatatcaataaattttatatgtagcttagagggcccatcacgatgagttcgcctagggccctcaaaatcataggaccggccctgattacgactctcacaaggtcgcgcctgccccactacacccatgcggctgctggccgtgcatcctgccatggccatggaggatgaagaagaaaggaagctttgtgctctcttattttccgtcgtcgctcgactttctactctcttcgggttctccttcggtggttcaaaccaagaaagtactgaactgatgaatgatgttgcgtttgtttgttggggtggtacttagatcatttgcaaattgacttagattgcatattttctagctgcagacttttgatttgaagtcttcactcacgagttaaatgagctggctcgagctgaacagggtttctagctagctcattaggccgactcgttatccaaacgagttgagccgagctgactcgttatcctaacgagccataccgagctgacctgaaccgagtcagttggatattcacccctagatatataaaatactgaatatatggtatatcaagtcatctttgtgtgtcatcaccgttagtcaaaatttattaagtgaatctggttttcttgtaaagtccaaaatgcccatacttctctttacataaacaagctagtgaaccataacaatgtacgttacaatatctgaaatgagaatatccggtcaattgaacatatatactccctttaaaagatattaatagttctgacagtggatctgccatcacctcatcaaatatgctattttttttatttaccaactacgtactctgtcatgttttctaccaactactctatatgctttattgttataaaataatttctctacacaaacgactctatcttatcttacatttgcaaaaataaaattacaaaaaaataatcataatttgttttagctagtaaaaggaaaatgcaacaatggcaaagttcacacttggttcccgtggctagcttcttcttagcgattaccaacggtcttcaactcttcatgttgctgttttttcttttaaccaagctaccgcagtggactagtagtctagtactggaggtccccgcagtccatgtgcgtaatttattctcacatgaaaaattgtctccttgacctgtctctcattacaacagtgaagctagaaaagttactatcaagagtaattgaaatgatcagggtcgtccgtcccggtgcaaataattaagtccatttccagtaaaatgtatcatttttatgttttcaagagtatcacataaataataaggtatttaattgatgattaaaatatcttatacaacgttgtttcaactttgttgtttcgtacatagtacatgcaagagataaatagtgttaaaaacagtggagacataatttcatccagatgaaactcatttcatctcttacttccttaatttcttacaacatcattaacattgctgacatagtaacctatttaatgagaataaaactcccactaaaaatagcccaaaacaaaatataaggatttatatttagcaagctaactttaaaaaaatagtctatgtgtaatacgaaacacccccaaccattcttgcataacagaaacacactcacatgtttaaatcagtgacgaagctatacagtgtttgggggtgcacatgaacctctaaattcctaatttctcacttaaaaagactacaatatacagtgttgtaataaaatgttctagattttcaatgatagtatacccccttgtcttcccccttatcttgatgctagcttcgcccctgctttctgcaaccccccctccccattagggccaatgaacctgtgaagttcaattttcgaattttgctttggcaatatgagcccgggcaatactcaatccaattttcgtctagggcactgcctgctggcaatgatgcgaacgatcgagcgtgggtggagtcaaagcctttagtacgacgtgggggcatgggccgaggcatgcatggcccgttggcctgggaataggatgataagcacgtgtgctttcattggtcttggtgccaatctaaaatacgacgataaaaataaatggagaaagtatatagaattattattgaggtatatgcatgtacgcaagtatcggttctaaatatggcttgacgaggcctaccaggtcgtataccaaattctatatggaatcaagctttatacatatggcagaggacttaagtagataaggaaagagttccgataagaaaagaaaaacagtcctactcgagcattataaatttataagatttactcggatcgtatctatatttgcctccctaattctatccagacaatggagcatccaagggtgtaaatataaaacccccagaactagagaggacacaccgagactaaaacaatacaagtcaacataaagctacaaaagtcaacacatatgaccacacaagaactatatgatccacaagtgccacaaaagcctatataagttcaatcgcacactctatatatgctaatgtaaggtcctcatcagtggcgaagccagcgatgccatcaaagtccggatgattaatagtgtttttcggtgatcgattaatctttatagatgtcaatggctattgatagtaaagatggtaccggcgaaacccgggcagtcgcccgacctgcccgagagatggctccgccactaggcctcatactttggcctaccagttgaaggtggttgtcacgtccggaaattcactagtaatttccgaacttatttgtgcataaaaccctcgtccaggaatcagccgaggtacacaaactgacaatttaatatacaaatccatcataataataacgttacatacttacagaagaaaaaaaacagcagcggaattaacggtctagcgatggcttcagctccactcccacaggcagctcaactgggatataagccaaacgtcttctccttctggatcctttttcttcaactgaggttgattgattattgcaagaatgagcatatgatatactcaacaagccacacagcaaatatgcaagtgcacaaggataccaaatgatggcataatataggctcatttgcaaaagcagcatttagcaaacatttaagagtagtaaaacagtagagtaattaatcatcaattttaaccaacactgtacagcaccccaatgctgcacaggcccaaccatcctgaataaccatacccggctgtacagatctaactctaaaccaggagctaaacaaattattaccagttatagcatcaataattattgtgagaggtgtgagactaaccacgaaaaacattgctcaacctgcccatgaccgcgggcacggctattcgaatagttttactctggccagaggtgtaccactgtacccacaagacacagcctcaacatcatgtctaccatgcgtcgcgatactggaaagtacccgaatagaggctgtgacaataccccctacacaacacaactcaccacagtgcaccattcctggatcataatcacccctctataaatataaccataggcatggactccccagcgacccccacggacttctcgccgcttctcagtctggtgccccgcaatgaatcatgctgtacaaaaggtaaagccgttgcccacgctggcttgtggttggtacggttaatgtctcacaacagtagctcgcgaaccggtccttaattgtcatgagcacgaccttcaaaaccatgtgctcacaacccaccattgacaagttttaattatcaattaattatcataacacgattaaccatcgtgagctaccattaaatataatcataaataataacgtagtatgattcatcccattaatgagctaatgtttctaagcatggctaagcaattatatatatttatagcttttagctgaaccaaaccaatatataaggttcaagctaatcaatttgttacccaagatatcaaggaataaagtaatcaatgcaaattggccataacaaaggaataggttcacaccacccggtgacattcgaaaataaatgcacagttgaaataaatagagaatttaaatataggatcaacatgctcaaaggatttgtgtttagtatctgtgtgacttgccttgcaataatcggtcttcaattaatcttcttgaacacttccgacgcactcacgaaccttcgcaacgacggaaacagcaagctaacacgcaaaacggagaaaaaactaataaaaaccaaataaacagtatataaaaaataaacaaacatgtagatcatgattttagatgaatttagagactcgaacggcctcattccgagttcatatgaattagttatgaattttacaagattaaactgattttaagatttatttttagaagggaaaagggctttatgacatcatcgatgatgtcatcaacggcctctcgggacattacggtcaccggcgatctaggtcacggcggcgagaacggagggcaccaacgcgacgagcacgacgcggggaactcactgaggggcggcacgacgacgaacgaagacggaagacggccggcgacaaactccgaaggcggcaaggtactgatcgacgacggcagcggcttttcggcgacgagcagcggcaacggaggggtggacgggcttctccttggtgctgcgatgccgagggaggtggcggcacaagtcggggacgaccgaggcgacggcacggcgcggatggaggcgaagcagatcggtttgacgtcggcaatggccttccggttgtcttcggcttcggggaagtggaggccgctcttcctctcttcgatgcggtcccgatggaggcgacggcgctgaccggtgatggcggagccgacggctatagccggctggagcggcggccggaggaggagagagatggctagcgtggggagagagatcgggcttggaacgcaaggaatcgcgccgggaaaacctgggtttggtggagagataaactcgaatcgagctcgattccgcgttgatttcttcgggataaagtccaattcttgggggaaaagatagaggaggataggaagaatatttcccctcaactaattcaagaaacggctcagagaatcgagcgaatcgggcggaggaatcggcagcggtacacacggctcggcggctgcacgggttatgtccaagcttgaagacgacactgtagcagggacgcgaattagactttgactgggcttctttttctccagcccgattgaaggagggacaagaaatggacttcagaggaggaataaagccagctgaaaggaagggagaatgggccgaggactgaaggtgaacttttccagtttcagccggaaaaggaaaaggggatttgaattacttttccaattaaattaatcactgaaatgatctttgaattgttaaaaatacttccaatgctcaaataattccaagaaaattcttgaacatacttggacactcaaagtatttaggaatattaaaaacagaccatttaattattaatttaatatgtggataattactgaaatgttctttgtatgattaaaattaggaattgagctccgagaaatccgagaaaattccagagagtataattaactatggagaatttaataaaaaataaatccatccatgctttatatttaggaaattttatttcccgcatttaacttctcttataaattaatgaatatttaatataaattctaataataatttattaaataatttataaattctaaaacgaaaatcaggatgtgacagtgatctagtgaaaacattgtcctcgggactagccatccatctccatcctattcaatgggtttactaaacagtcgtaattataggtccaaatgagaagactaacaaactggaggttaatttaatgttgacgtacggatcatatatcgaacctcgttgtatgcattgaacttgatcggcttccttcgattcgaacttttatgacttacttctgttcgagcaattgtaaaagatgagtgaccattgaccagttttcactcatcctataattgatgttacagtatcagtgtattatccatatctttctgatccttaataagaaaaggttaattagattcgtgctattataattttcatgattttaaaatatatcattataattcatctatttaaaaccatacgattataatttgacaagtattcgaaatataccactgcttaccccttcaacacattgaaagagaattttggacaaaattacccatttcttcttccttaatccatcccattctccttccaatcttcctcccatctctctcggatctgctcgactcgtcgcttgtgttgcagatggctgctgcttcgcgtggaggtggcaggggccggtgttagggaggatgcgaacgtggtagctcacgcatgcccccgtggagggtgaatcgcttagggaagcccggggaggagctagttgtgcccaggaggacttcagtagctttaattcttctgtgctgtggggttaactagtggcggaatagattgcatttactagatgcttaatcgcaagaaaatggcaggcatccgtgctttggaagtggtagcgaaatactgaaatagcagctggggtagtggaacgggaaaaaaaaataaatagtgattccactgctgcaccgtggacgatggacgttggtggcgacgggccacctggcagggctcagaagcaggaagcggggcttccgctgcagctccggcgattgcacgctgtaacgaggtcgcgcgtggagaccgggccacggtagaccaccaccggtgccgccagatttcctggccgacttcatttcttgctcatgtgcatctttatccagctgcataactctcattgtattccggaagctcgtaacatggggcctgataagtcccaatttacagtttcttctccgctaataaaaccaactccctcaactcgttcaaaaaaatgagattctgtataataagttgttgatattcaataactcctcgtaaaaaataatcagagaaatctaaacatttatcgatccatccataaggcagatcggcagcaactcctccgatgcgaaagtaattatgcatcattcgcatacatgtagcagcttcaaatagatcatatattaattttctctctctaaaaatatataaaaaaaggagtctgcgcaccgagatctgccataaaaggtctaagccataactctcactactagaaaaatcatttgttgccacgaaaaaaatcgtggcatcaatattaaaattatgacaatagatacatgttgccacaattttaaaatcattgctagccatggtaagaaataacgtggtaataggttattgcaactatttttatttagtggtaataaattatattgcaacacttcacatcgttataataaaaattattgtcaccactccatatgtggcattagttctacgtaccaaattaaaagttcaaatattaatctatcatcctatctatttatttcacgcgtgctctcctttaccaactcacctacgcatcaattctgttagaaaatgcatatcgttccatttgagcctacctaactgagatttaaatcatagatttgaatatctaaaagatttcaaatgaaaaagttatcacctataaaattgtagatctcgtcgagagctgtaatttccaccaacgagatcaaccccccatgcatccgaccaccaacgaggtcgtcatactcatcctggctagggtgctttgccatagctgccgcatccactgggtcgctcggaactcgtcgagctcatcagtggggaagagataggacgaaccaacgaagagaggcaccaggagagaatgggatgaatggaggaagaagaaagggcaatccagtccaaaatttaatttcaatgtatcgaagggtaagtagtgacacaatttaaatacctatcaaattataatggcatgactccaaataggtaaattgtaatggtatatttcaaaacagtaaaatttataatggcgtggattcaattaaccctaaaaatattagtttttctagcaagataggtataaaccaatgaagacagtcaaagactcaacgggataggctaaaattggtggagatgggtgaacgccgaggagagttaaggaagacttgtagatatgtgtgaagaccagggtttaaagtttcggtttgaaatttccaatattttcgaaatttcggttcaaaatttccaatatttctgaattttcggtaatttcgcccccccccatggcaagcccacatttcacccaaattttttttttttgcattttttgtgaatttggttaaattttattcaaattcattcaaaatcagtcaaaatttcaaataatgtaggccaaacaatttccaaaattttgaaattgaaaactctggtgaagacttgtgaggacttcataggagtgcaaaggtggatggagagaaggtgaaaattgggttgggtaccctaccagcaattttgaaagggcgaaagatgtgtagatgcattttaaatgatgtcttataagtgtttttagcgaattatctcttgaaaccaagaggtattttataaaatgtctatataagaaaatagaggcactttctagatacatgtgtgcggcaacttctgagtaataattgttatcccttgcaaatccttaaacacattacctcttgagtaatatttttttaatgcactaaccatcttaacccatcttaatctcaggtcattattataaatgtgtgtcttgcaatagttatatataattgcttagcatacgttggtacttgaagaagtgtctctacttatgttaaaacacctttaaaaatacctttacatatgaggcgaattttaacgtaccaaactgacgcctctacaacaaaaatttcataaacatacttaatagtacctctaaattatctctagagtaaaagtattctagacgattttaaaagtacctctgatatctctaagatatggaacttctgattttagtagcaaattaaaaaccgtttttactaaagtgactttatctaatgtttttgttgtagtggccgcctaatgaaatgtgacactgaaaatatattataattcaaaatatttttaaaaaaattatgactaagaacttctattctatgtttactttatgcttatgatttatctagtgtccagatattcttttccaaatttgtcgatcatctaaaatattctcattttcttcatttttcacaaataactttgctgtgtattttcaaagcaaaaccaaccatttgatgaaggatcgaagaaaaaaaaataattgtaggtgtagaaaatttacttatggtaaacacatcaacatagttaaacgccccttcaaaacgatggttattaacaataatctccaaaataaattcacattcattaatgtatttttttaattacgtacactagctccatttaactctgtagttaagccgacaacggtttatttattgtcgtgattaattgcaattaatgcattaccgctgttccgtatgcagttgacacgtacgtctccctgactagaacacgaaatcaaggatcgagttcatgaggggagccggtcgccgtcgatcatttttcaagagacaggcacgcatgcaggtcgctgatcgaaattaaaccagctctagcttcgtgtttgatctgtgactagtagttgtgattaatccgtcactagctagtaattaggcttagtcctgtgcccctgtcaatgcatgtttgcaaaattgcaagcggatggatatatgtactatgcgagagagcgacgcagatggatgaatggatcatagatcggagaaggctgaggtcgcttcagagtttgaggtggtaatttttctcttttttcattagcacgctttggctgtgttggagggagagaggattgagatgattaggaagatacgtaaaacgaggtgagccattagtgcatgattaattgagtattaactattttaaacttcaaaaatggattaatataattttttcaagcaattttctatagaaaatttttacaaaaagcgcaccgtttagtagtttaaaaagcgtgcgcgtggaaaacgagtgataatctcccctatcacctgtgaacgaacggagcctttgtaagcttctaaacaaacttctagacagtgtggttttttttaaaaaaacttttttgtttatagaagtcttcttaaaagcaaatagacttatttgctaaatttataacaactaatacttaactaattataacttaattatagaagttgtcgtctcttaagatccaaacgaattcagcctaagatcaggtacaataacaaactataaatcagctataagcacatgcggagaagataaaagatgggagagaagagaagctgggtaaatatttgtgctagctacagcacggactgttagtgatatagtatatatttgtagttaactattgtatgaattatctattagattgactatagatgatttggagttagtagttgtgtgtatggcatatgggaccgatattaataatgtagaagtatatatttgtagttaactattatataaattggctattaaattgattatagatgatttggagttagtagttggctatactattaaacttgctctaagaccttgtttagttcctacacaaaatttttacaccctgtcatatcgaacgtttgaacacttgcataatgtattaaatatatgctaaaaataactaattgcacatattgcgactaattttgcgaggtgaatcttttaagcctaattacttcatgatttaaaaatgttgtgctaagtaaatatttgctaatgatgaattatttaggcttaataaatttatctcactgtttactaacgaactatgtaactagtttttttattagcgtccaaataccccatgcgacactctatataatacccgatgtggtgtgtcaaaactttacgcccgtggatcaaacacccctaaactggtcaattaagctagcaggtggtcgttgattaataatgtttgaagcattagttgcttagttggggagaagaggtatgaccagtaataaatgggatttattatcagcatttgtatcacacattcgtctctctcttgattgctccatcgatctagctactagtagtgggctagtggctgtggtcgcagcgctgatcgatggtcctaggcatggggggatatatgatgatgaattgatgatgcgtgcccatagcgtggagagagacatggatggatcaacgggtggatggttaagggtgctttactattatttttttccctcaggctccacgtagccatgctttactattatttttttccctccggacttcaggtcaaaattgccggtgcgaggttttttaatcgaagtttatttttagtctttgcttaataagtaagaatacatatataaaatttttatttacaattttttttaaaaatatgtcgcttggcttattctccgaataaactaaacgatagggcatttaagtacatgctcggttaattaagagaaatatctcgattcaaaaccctgagcacaccaaaattactacctagcaaacctaattaactattacaacaagactagcaagctcaacacataacgagtttgtttccttttacattggtaatgaccgtcattgtcatcccatcgttgcacctatgatcaggcggcttagcccgtcgaaaagaagaactaggaatgtaacccgacttgcaccgaagcccaagttaattggatccatgtcatcattacgtacattgcgctctatcaacaccacaactccaacttcacaatcaccagcttcatcgaggtaggactaggctaaacaagccccgtcagcctatatagtatagttgtcagtcctgcatccccttaggaaggaagtgccgactgaaaggcgctatcgttgctcccattttgaccagtctagccaatgtatatatagcttgaggtggaaatccaaaacgatgcttaattctatgaagatatattaatggtccaatgttatcggtcaatctagtaagccaaatcaatctatgtttggcaaaattaaaatcgccaaattccacttgcaaaattttgtttccaaggcgagaagcttcaggaccccttcgggtagaactttgaaaaattctacatgcttcataatttgtccatttgagctaagaatttctgtggttggttccagtgtgctgtgagttgtgaaaaaaatatcaaaaaaagaaaaataaaaagtcgcatttctctcctcagcactagagagagaaagcaaaaaacaagaagaagaggagccgaacttgtgtgagcattcctgccccccccccccccccccaaatccctgttgtcatccccaccttcttgttatcat

SEQ ID NO: 59803 - DNA, 13334 bp, Oryza sativa
gcaggagaagctctacgccgagatcaacgccacctgcggcggcgacgacgagctcctggagcggaacgtgagggacaaggacaacaagatgccgtacctcaacgccgtggtcaaggaaggcctgcgcaagcacccgccgggccacttcgtgctgccgcacaaggcggcggaggacatggacgtcggcgggtacctcatccccaagggcgccacggtgaacttcatggtggccgagatcgggagggacgagagagaatgggagaacccaatgcagttcatgccggagaggttcttggacggcggccatggcgccggcgtcgacatgcacgggaccaagggcatcaagatgatgccgttcggcgtcgggcggaggatctgcgccgggctcaacatcgccatgctccacctcgagtacttcgtgggatccatggtgatggagttcgagtggaaggaggtggaggggcacgaggtggagttcgccgagaagcgggagttcaccaccgtcatggcgaagccgctgcgcccgcgcctcgtgcccaggaggagttagacagtgagacagagtccagaattggtttagttttgtgttcattagttagtgttagcgtatatttactcgtgattaagttatgatccaaatgtccatagtgactagaagtatataattaggtttgaattaagtgccaaaagtgtgttttgttttagcaaattttgagcagtgcgtactcgtttttatcgtgctaatttacacgttttatatatgaactcctatcgaatcccaatcaaaataagcagagaggtttggactagagacaagacagcatgacttacgcacaagaaaggaagggtgaaaggttcatcttttatctcctatatactatcagcaattcaaaggaaagagtgtttttttatctcttaccagcaaattcatatcaccaattcgaatatccaaaacaacataggtgcctatgaatttcttttaacaacaatggaagaacaactttgagcctgtgaaaaactttaacttgtttacctcctagaaattgatgcacctaaaaaacttgtttagaaacatcttacaaaactaatgtggcacaatgtgattgaatattccttttctcatacccgctataacatatcagatcactaagagagtaatagatttacactagttggagagtgttagagtatatggtagttaaagtcatattaggataggattggtttgtttggattccttctatatctgtaattcttccttatctcttccctatgtactcctatatatatcgcccccctgaggctcaatacaatgtgtccaatattcacagtatcccctcttcctgtactatccaacatggtatcagagcgggcgatctagtgccgctctcacgcttccgccaccgctgcccccgggagtagcgatctcccgagggcggccacatttttttttctttctctgaggtcgttgtcgccagagggatcgccctcgatctccttcggtggcccccgtcctgttcgtcgtcagatcgatctaaagccatcttcagatcgttcgtgcgtcttcgcgtcatcagcatgcagcagtagcagatcgcatccgcggatcccgtcgacggcgcggctctccacgtcgctgcgccgttggctcccggtcctgcctcctctgttgccgtcctctccgtcgacctctctcctctaccgaggctgctgatgccgggggacaggagccacgtcctcgccgatcatccatgccgtggatctggcggccactccaggccaccgtttcgtccgtcgccccctggtcttctccaacctccgcgccagccgtcgtcgacctcgccgcccttctcaaccccggcgcacagggggagggagtgctcatcactgtcgcttccacacggcaattttctgccggcccctgcagctctgctgctggtctccaccacacaaacctgttgacaggttgttcttctccactgtctctcggtgtctctatatgctatgatcctgtgcgtggcagccatgtgaggagagagagactagatggatggtgtgaagatatacagcctattgccttggttgacttggtggtgacttgcgtcagattcaaagggttgtgatgtgaacggctggtatggactgctgctattgtgttgctgcttgtattttttcccctttcccaatcagtgattgggtttgcgtcgcccaccgcctcgttgacatctgcgcgtctccgacatcggcatcgattctgcttcaacttcatcgttctgcctcgcgcatcttcggcttgatcacccattccagcgcccagctacaacgacttgtacaaccgatcatcatcgagcacgcgtctacgccatcaagcttcgggttgccgctgcgtcgcccccctcgggccacagtgccgctgcctgtggtccacacctccactggttgttacagtgttgagacctgagaggcaccctcctcagtgtggcctcaccaccggtggacttctcgccgctgcatcgacatcgagctgcgttggtcccactacttcgccttcgtcttcgtccagcatgattcatcgccagtgtcgccgtatcttcctcgactatacttcgctcttctccggcaactgcgtgctgctccggcaattctccctctacgccgttctcgcgccgcgaccatcctagaggccttctctgctagtctcctccgacattggcgtataatttctggtggtcccctacctagcccgcacggtattggtaacaccgttgtgcgcgtttgtcccgagtcgtccccgggtctggcaaacctggtgtgacgtcttgtccttcatggttcgactatatcggctcttcgacgtcatcttcctcaacgaccgtcgcgatcgtgtccccgtcatcatctcccgcgcgtcctcgcgcacctcggttcacaacgctctcccatgcgtccacgaccactctacggcgtcctatgtgcgctccgcggctcggctacctcgacatcatcggctccccgacttcggctacatcgaccacggctactctacgcacggcttcagcgaccacggctctcccggctccttcgctttggctacatcgactatggcacaaagggctattatccgtgttgagcactcttgccggtttattctccagtccaagtgtccgcgctgctcacgcttggactgaggggggatgttagagtatatggtagttagagtcatattaggataggattggtttgtttggatttcttccatatctgtaatatttccttatctcttccccatgtactcctatatatatcggccccctgaggctcaatacaatgtgtccaatattcgcagtatcctctctttctatactatccaacagagagtacgtaatagattgaccttaggagagtgacagattaacgatttgcgatgaacaaacttaatctctgaccctctgtatcaaaattcaagcacaagcaaccaacacatattgcaattcagtagtagagatttgattggtttatttgttaacctgtacggaattcgaataaaaaactggtgccaaatttgtcagattttgatgaacacggtctagatttaatcgctctgatttatatttaaacaaggaaaaagtacaccgaaggtccctcagcttgtcatcgagttacaaaatcatcctccaaccgtaaaatcagatatttcacatctcctaactaatcaaaaccggtcacaatcggtccctcggcggttttgatcccggttttattctacgtgactgctgagtcagcacaggacccacgtgggccccacatgtcagcgtggccacgtcagcctatctctctccccgtcttccccttcctcctctctctatctcactcattcttgtctctgtggctctaggcaggggagcaaggcggcagcggcggcgggagcaggggagcaaggcgtcggcggcggcagcggcggcgggagcaagggagcaaggcgtcggcggcctccggtctccccccaccctcttcactctgtccaaggcggcggcgacctccacgccccacttcctcaccgacgcgacgagcacctgcacgatcctcgttagcgggctgcccccggaccgctggtgcctgtacagcggcgtgccgatgaagaagctgacggcgacggccatgacgacggccgggatgccgaacccccacccccacccgacgtgcgtctgcacgtacaccagcaccgacgacgccaccagcgcgccgatgttgatcaaatgttctccatacagtaattattcagtaacctgtatagaaattgatgactactatgtgattacttaactaatagtacctgacagaagaagctcatattattagagtctgaatagatggaagtttggaggcattgcttgtcgctgttattcaaatgtctggttgctgataaataacaggaaaggaagcttagaactgctgtataaatgaagtcagtgtgtggacatcttcagtgtagaattttaaccagagaatcttataaggcttgttctgaaaaaggtgatggatgctgtcctcgacatgtattagaaccagttgaagaagctgctcttgctccgcttctccccctcgtcgttctcgtcgaactggtcgacgccgaacgacgacacacacggcttgatccctcccgttcccagcgcgatcaggtacagcgccaagaacaccacccccgtctgcgcttggtgcggactgcggagcatctcatagcgcgcggcgaggaggcgctccaatgagccgaagcgctctgtgagtcgctggtacaggtgtgtgcaggtcgcgagcagctgctgctactgctccagctctgcgaaaccttccggcgtgtgcaggtcgcgagctactgctgctgctgctgctccaggccagcgagctcgcaccgactccacccccaccgccgccgcgtcgccaagctaccccgccgcccgtcgccggccgccgtttctgcctcgccctgccagccggcccgcacgaggggggcggggaggccggcgagctcgcgccccccgagcccgcgcgccgccacctgggagtagctaagagcccccgggagccgccgtccccggccgcaccaccctccggccccgcgcgccgccatgggtgctagccctagcatcggcatccccatgccgcccgtgcgagagcagagagcgagacggaggaagaaaggagagaaacagagaaagagaaagagcggaaagaaagcaggcgctgacatggacaccctgacatgtgggacccacgtgggtcccacgctaactcagccgccacgtcggataaagccagagtcaaaaccacttaaggaactcaagtgaacggttttgtaagtttagggatgtcatatacctggttttgcggttaggggatgattttgtaactctatgacaagttgagggaccttaggtgtactttttcctttaaacaaaatgaatagagagtaagcccaacagcaaaaaacatgttagcccaaaaccaacgaactgcatcttaggcccatttaaccagtcgaacatgttatctcaggcccgtttagcccacaaaattgcaatatgaatactagcagtctagcacaactagctttggctgcgttcgtttctccaataacaatagttggatgaaattttggatactgatggtacacttttcaaactactaaacggtgcgttttgtgtgaaaacaattgctctaaaatatcagattaatccattgtcaagtttataataattacacgttattaccacctcgttttacgtgaaacacttaatatttatcctcatcttcattttcaggatatccagagaggaacacacgcttgaaaaatctgtcacgtgctagttaattagcaaaaccgaataaggtacttataaaaactaaagtgtcattccttcttactaacatatatctttagggagagctcccaccttttcgcctcaaaagggaaaataaatatgtgcgcctaagttgatcctgatgcccttaaatccaaagttcaaacatgtggggtggcttcttaagaaagaaaagaaacctaaatacttggatgtaatcataaagattcccaccgaatcttcaccgatcaattgagattaattagaaatgacgatagccgtttaagcggagaaggacggcttacattattgctggttaccattcaaaacagaaagaaaacagtggcaccagattctgcggttttctacagagcttttttcttaaaaaaaactagacacaatatatacacaaactattctaacacacgcacactcacccttataaatgtacacacgcacaccttatccttatcagcatctccagaagattaggctgtcatattttaatattgacgaagccactgcgggcgtctcgttgtcgagggatacgtcttacacatgcacacattattcttatgaacatctctggaagactaggttgtcatatcttgatgtcgatgaagtcactacgggtgcctcgttgttgagggatacgtcgtgtaccattaaaaaaaacaattagccgtaaatatgagcacatgtgtcaagcctagaatttaaacccagatggactggtttcaccataagaaacttaaccaattaagttacgctcacttcacggagccctttgtcactctcctagttgacaaataagttttcaatgactggtccatacaggaatatgttcttccattatttaattttagttgctaaacatgttttcacatactataagttgttcgtccattatccatttttctaataggcaccttgttttgcatctttgaaagcattttgaatggctgataggagataaaaaaatgacccctttttttcttcgattgtgtttttgcccttctttctgtccaagactactataggataccaattcactacgtgcagctgtcatatgtttttgataaatctaggttacctattaatttagagtaatttagaaattatacactaagttttataagtatgtgatatatttttgttggttttttttaattttgggaaggtaatatgctttgataaatatgggtctcctattaatatgagagtaatataaattttcgacatgacctgcaccaaacagtaatgtaattagagattatacatggttcttttgaaagtaagtgacatatgtatatgaatttaatttattatttggtggtggtgatatgacgataaattcttggcacctattaattttgatttaatcttgtagttatggcatatgtttaagttaatcattttgtatgcagcgagaattgcaatggatcgacgataaatgtaccatgcgtcttgttcaggcctcctttgaattggaggaaaaatataggaaaaagaaaggaattgaaatcctacactatttatgcctttgattcataggaatgagaaaaggaaaaacgtaggaaactttcgtattcctacgattctagaggaaaaacatagaaaatttaagacaaaattggttatatagcatcgaaagttcacccctttccatttttaacactttcgtcaattctcgatcgttttctatccgccttgatcgttattgactcagccactcacacgatatgacctttttacccctcattgccatgcattatacatgtacttgtgaggggtagaaacgtcatattgcgtgtgtggttatgtcaatagcgatcaaagcggatagaaaacgatcgagaattgacggaagtgttaaaaatgggaacgatgcgaactttgggtgctattatagtgagctggtatctttcggtgttataaaaccaaaaacgtgaacttttgatgctatatatctaattttgtcaaaatttaacatccactctaacctcttggaaaactttccttgagtctatctctttcatctgattcctgcagtccaatcaaacggtcatttctgtgtttacaattctctgttttacacttgcgttgaatacatttttgtttgtcaaagtttcagaaaaacaactgtaccatatattaaaaacagagatatcagaaatttgcacaaacaaatcacacttcaatgttccctattgatttactgattcatcaaaccaaatgccatttgatatcagcattcacctcatgacacgtaaaaaacctgacactgatactccaaattactccctccgtttcaagatgtttgacaccgttgactttttaatacgtgtttggccattcatcttatttaaaaaatttaagtaattatttattcttttcatattatttgattcattgttaaatatactttcatgtacacatataattttacatatttcacaaacttttttaaataagacgaacggtcaaacaagtaagtcaacggtgtcaaatattttgaaacggagggagcaaatgagcagtgagactctgattagtgcctgactcctcctgggcacaaggcgcggacgcagcggcttcgccatggcggtggtgaactcgagcttctcggcgaactccacctcgtcgccggccacctccttccactcgaactccatcaccatggatcccacgaagtactcgaggtgcatcacgccgacgttgagcccggcgcagatcctccgcccggcgccgaacggcatcatccggatctccctgctgcccgtcacgtcgaccccgtcgccgtcgccgccggcgaggaagcgctccgggatgaactccattggcttctcccattctctctcgtctcttccgatctctgccaccatgaagttcaccgtggcgcccttggggatgaggtacccgccgacgtctatgtcctccgccgccttgtgcggcagcagggtgtggctcggtgggtgcttgcgcaggccttccatgaccacggggttgaggtacggcatcttgttgtccttgtccctcacgctccgctccaggagctcgccgtcgtcgccgcaggtggcattgatctcggcgtggagcttctcctgcacggccgggttcttgactagctcggccatgatccattgtagcccggtggaggtggtgtcggtgccggcgttgaggaactcggagcagagcgtgacgatctcgccgtcggtgagcgagcggttgccctcctcggggatcttgacgtcgaggagcgtgtcgacgtacgagtgctggaacgtcgtctccctcgccggcgggaggccctggctggcgagcttcttgtactcccggcgagcctcgatcagcggcacgaagagctccttctgccgccgcagaagggcgtgcccggcctcgaggcggccgcggaagaggtgcttggtgatccacgggaggaagaagaagacgctcgtcttcttcgagatgtagagcagccacgcgcgctcggcgtcctcgatgtcgcgcacggcgtgctcgtggagccgctcgccgaagcacatgagcaggaggaggcagaacacggcgtgctggaacgcctccgttacgttgggcggcgcgtcgccgccgccgccgctgacgccggacgtcgtctcacgcagcttctccatgaggacgcggcgcgcccagacgcgcgccggcgtgaactggtcgacgcgcgactgctgcagcgtctgcgacacgaggttgcggcggagcagccgccacatggcgccgtagttggagcgcgtgatgattctcgctgacgccgaggagcatgctggtggccgtccgcggccggtcggccagcgtggcgccggcgccgacgagcgccgcgtgcgccaggtgccgatccgccacgaagatggagaggcgccacccgatccggagcgtcacgacggggccgtacttgtcgaacagcttcagcagcaaaggctccaattcggccaccaagttccgcagccacagcaggttgccgaacagcggcacggccggcgggccaggcgggaggcggcggcgccgcctcgaggtgacatcgcgcaggaagacgaggagcgggaggagaaggacgccggtgaggatggccaaattatccatcagcgttggcagctgttttcgcttgcgttggttgtcggacgaggctaaactgttgtgtacccatacattttataggtcttcggctcaagtcagtagcagtagactcagtactatgggatgtaatatgttaatcttattcttttaataaaactagctgggtggcccgcgcaattgcgcggctagcatccaaataaaatcatatattttttaatatgattttacttaaaatttattaaatagctatctcattgtcttaagactttgaaagaccaaaccttatcatcctcgtgtttctaattatatagtttttaaaagtcacatcagttgctaccccttatgtcatcttcttctttatttgtttgctcgatctaccactatttctattcattcttcttggaacctttaaaaattgaattttatagtttttagagtttattgtcacattgggtttcgtttttataatttgtagatgtctcgtcaaacgttgtcattatactcctctaccgcccgtccactgtttcttctttttattgtcattgaaattttaaaaatcaaagataattatcatttgggtttatttttactttctagaagtcccgccaaaccgtcagcggctttgccattgtactcctctacagctcacccgcagcctccgttctttattgtcattgagattttaaaatagaacatgattatcattgtttcttttttactttttggaagttccgaaccttaaaaaattagacttgtagttttattatttttataatttttagaagtcccatcaaacgatgccactatgcccctttacagcccgtccgccgcctactctttattgtcgttgtgattctaaaaatcaaacataactatcgttggaattcattttttattttctagaagtcccgtcaatcgtcggcggctcagcaactatactcttatacaccccgcccgctgcttctcctttttattgtcattaacattttaaaaatcgaatatgattatcaatggggtttattttttatactttctagaagtcccggcaaccgccttacttgtttgcttcacggcctgtctgatgtccctccttttaatcgtcattaggattatatttggtgttttattaataatttttatatgtcgtatcaaccgccaccactctactcctttctaggctgttacttaatttatctcgtcatgtgttgtagatggtcttttctttcaatagtctttatttttatcacaaattttagttatttataaattgtatttctaattgaaatcttatttttctttttctaatttcagaatttatttttttttaaaaaaatagttaataccgtattgtgttcctttaatgtttttatttttattttcaatttcagttgtttgaaaattgtattcctacttaaattctcttttaatttttctaattttggatattattttatttttttaattcgaaattttaattattcttgtattgggttcttatatggattcttctttcaatattgcttattttttattccgaattttatctaattttcaattgtattcctactttaactcttcttttattttcttttgctaactttggatttattttattttaattcgaattttaattaatctcatattgggttcttatatggactcttctctttaatattccttatttttaattccgaatttcaggtatttttaaattatattcctacgtggactctcctttccttttctaattttggattttattttatttttattccgaattttaattaatttcgtattgggttcttatatggactcttctctttaatattccttatttttaatttcgaatttcagctatttttaaattgtattcctacttggactctcctttccttttctaattttggattttattttaattgtattcctacttgaactctcttttattttttctaattttggttattattttattttttattctaaattttaattaatctcgtattgggttcttatatggattcttcttttaatattgcttatttttaattcctaattccagctaattttaaattatattcctacttgaactcttcttttattttcttttgctaattttggatttatttttatttttattccgaattttaattaatctcgttctggattattatatggactcttcttttaatattccttatttttaatttcgaatttcagctatttttaaattgtattcctacttggactctcctttccttttctaattttggattttattttatttttatttcgaattttgattaatctcgtattgggttcttatatgaaaatttctttcaatattgcttatttttaatttcgaatttcagcttttttttagattgtattcctacttggactcatctttcctttttctaattttggattttattttatttttatttcgaattttaattaatctcgtgttgggttcttatatagaaacttatttcaatattacttatttttaattccgaatttcagctctttttagattgtattcctacttggactctccttttctttttttttctttttctccgattaatgtgggaatttctagcctccacagcgaacgtggtgtcttcttttcgagctgtcttaataatataatagattttagaacatgttctgtacatacggttttgctaactagcatatgatgcatgttttaagcagccttcctgtttagtttttctttttgactgtcagaacttaggtttacattcgtgctgtggctggaattttatttagaattgatctcaacaccttgggctcgttcttttccacaactaaagactgcaacttagttctttttcattagcatgcttctcgaaccgttaaacgatgtgtattgtaaaaatattaccgtttgaggctaatccatttttctctgtgtcaggttgtgttagctatccaagcgaattggtgtttcaagcgcatagcaatgggagatagaagattgagcttatatggaatagcaattgtgttcgcacatctgaaaaaggggggatgtagcctagtggttgcagtgacctgagtaacaccctaaggttctgagttaaaatcttcatatgagcgaatttcaaattgagttatttgcagtgctaagttctcaatttaaattgttgcatatatccatttggatgtagatgctggataaaaaaaactattctctaacaaaagttgtgttcgccgaatccactttctgctgaacactcatggatgtaaatgtgttatcacacgtgggattaagaccttgtccagcaccacatggcgggcagccctaatgggctatcgatcgcccgccaatgggggtag

SEQ ID NO: 59804 - DNA, 13616 bp, Oryza sativa
catagtagtatagtagtagtataaaatagtatagtagtaataaagagggaggatagtatacttgtagtagtacatatgagagactaaggggttggcctggtggtggcgcgtggtggtcagttgctaatcagtcgtccactggttgtataggtcattgcatttgcttcggctcctggcttcggcttgcttcgctaaccggcgaccctctttcggcaatcaccggcgtccagccttcgcctctttgtgcttcgccgccaggtgatcttctttgatggcattttggcaggcttggtcaaaggcccttaaggcatgcctctaacattaaccaatgtctgacttgtcttctttcaacctaactgaaacatctaggttaggaagacagccagaaaatttgttttgtattcgtcatatatgaatctagtatatttttctcattttagagaaatgagcttagccttattaacgagtgcgataaccagccaaacatctagtacttaaaagaaagcgagcaatcaaagagagcatgtgattttttctttccattctcattcattggggatcatttggtaatcccatctctggcgtccatcatcgatgttcatagcaaggcttccgtatgtcctgctgcagttttagttcgatgttatcaccactggagctacttgaagaactactggcatcaccggtaagctagatcatctgttgtttatcattattattgccagctttattcttatagccataggatttggttaagcatgttttagccattgttccttcaatagtggtagctaaagatgactacatcggcctctctatgattttttttctttcgagtttgcgtatttggtctcattatatttgttaagaatcttacatcattttatcctgccctgtaggttagtaccataatccaattgactaacaaaagcagaatgaacaatttattaatgtcgaactaccatcgagaattactgttaaaatgcacactgtcagctgcaagtctacaacatcatctatttcatgatggattgcattgggtaagctattttttttcttaaagttgagtaacatatctatataatgaattataaaaaatattgagggcacacattttgttttattttgcgcagttaatatgatcattctgagatttctcaagtgatgtctctattttacaaacttcactctatacatggccaatcttagttttactattttcctcttcttagtactccctccattactagggggttgttcgcttgaactaaattgcagccagttgtgactgtagctgcctgcagtacagtacaagccaatataaattttactgcatttgttgtaggtgttgtggttgtacagccgcaactatgtccaccgaacacaccctaggttggattttttaggacagagggagtatgcatgagtaggatcaatagaaccgaaatttcgtttcagaattttgaacccaacatgagtacaaattcccttgacattaagatattgcgcaataacgcgtggagtatcatctacttctacaataagttgcatctcgatcctgctttcgctggtttcagtttgatgctctactgtttctatcatgaagtgaaggtacaatcactacttgttgaggttgcaaacttgtgatatccttttctggttaatctatttggatttggacaaagggaatgcatgcccatctcgacttccagttccaccggagcagctttgcctacctttatgactttactatctaatgaactgcagaaatgataaatatcacaggaacaactccgatccctcagcttaccagttgctgcacgacctccattttttttttacgttaatggacacccaaggccaagggcacatgccactaatttctacaaccacaagatgccaacttattctttctcgatttaatgctgagtatgtttcttttttcgaataagaatgttgaatatgtttcgatcatccagaatttggcctgattagtatcacacgacacaaaatcaagtgtacccacatatgagtttatctgagaggagagaagttggtgaagctcagttttccttttttctgtaaatactgttgaagcaatagaattatttaaaaaatagtcttcatcactgctaactactccttgaggaagggaggaagggcctcttgagacacaaccaagaatagggccagcagctgctaattccttccccctcatgatattgcggaggacatggaattctctgcaggacatcagactgtacaaaatatcgttccttgcatagtagacacagtttcctctgatcaaagggaagtcttgtgcatgaacggcgaacccttctccccgccccaagaagaccgagtagccgccgaggtccgtcaccttctccccaaactccagctgccaccgctccgccggcgccgtccactcggcggccggcggcttgtaaacctcggcgaaggacgggagccattgcacctgaacgccggcggcgccggtggcgtcgtcccggcggcgatggagttgaggtcgtagacgacgaggagctgctgccagtcgacgaagatcagcttcccgtcgtggaaggcgacgctctctatcctggaggtggagtagttcggcctcggtggcgtcatgaggctccacgacgcgtcccctggacgccagaagtacgtcttctgcgagtcggcgcgtggcacgttctgctggctcgcgagcgccatccactgctgcggcggcggcgaggagagcgggtcaccggagaggaagacctggaggacggagcgcagcggcgggagctcgacctccgcgccggaggtgggatcccagagcaccagccgcgcgcgtcggcagctcgtcgtcgtccgtcagcgcgagccagccacggggcatgccgcagcagcgcgggacgccggcgggcggcgaggcgccacgcaggtccacgtgcccgacgccgtcgaggtgccacacggagtaggcgcccaccggcgacatccgccgccacgggcggatggcggcgacgagccacggccggcgggtggcggacgggagagcggtggaggcgcgccagtgcgcgcacacctggtgcacgtggacatggtcggcctccgtcaccagccggccggcgatctcctcgagcagctccggcaggagccactgccatccgctctccgccatctctgatcaacttcggattacgtacgtgaatgcaggtacaatcttgtagtgatcgaatcgcaatccttttgattaagaactatgcacggagaaaaatctatgagtttcttggcgaatccgctgtttccttccatacataaagacacgtcttgcaattgcaggcccgcgggctctatgtttgggtaactatgatacgtgtttgggctttagaatcgatttctagaaggaataagtccattttacgtttctcatctttttatcgttcaatcgtatccctaaattccattgctgagaaatcttagcccccaacttataaaaccagattaaataaagtccatggtatatggatgtatgttttggctgacaaaacatcctagtcggcaaaaaaaaatagaaaaacatatgagacccacatgtaagtaaacttccacctctcccccacctatccctctcttttgcaagagtttgccgaccaggagaggggtggtgtctggtgggagaggagcaagacgacagcgacggtgacttagatcctcaccggcgagatccacgtgggaggtcgaaggaggagacgcgcgtggtggagaggggatggagcgatgcaacccttcagttgccaaggaatggtggacatagtgcagcatcgacagcggtgcttgggcaaaacgcaacacgatggctcccaatctctctagcacggtggctgatggcatggaggccaagctccatggcagcaatgctgcctcgtcaagctcatgtgtcctcctgcgtcaccatagccttcccgagctcctgttgttgcattgtcgaggttctccgtccctaagccgctttcagcgtcgacgcgcaaaggggctccccagttgacggcgtcaaggagggctcgatttggctattgtcgctctaattcgccctccgccatcgctgcctcctggcccacctcgctcctccttggcgagcttcgccgccggttctccatctcataacatatacccatcccccccccctctcgtcggccaactaccacggctcccggcgtcgctgaccattgacgaggcaacaaagctcgagctcgcgggagaaagtggtgcctcatgctccccctaccttctcccgagccttccttggcctccacttaggggtgtaagtggctaatccgcaaaacccacttatatgctaaattaaaccgcgaacctgcttatttgacctataagtgggttcgcggctgacccacttacacccctacctccacttgctccttccccgctggccaccgctaggaggaagagaagggacaggtggaaagaccagagatgtggtcatgtggagaagagaggagagagggagattagaggaagaatatagaagcctgacatgtgggcccacgtggatcccttgttgtcttagtcgggttgattgtaatcaattcgtcacgtcaaccaaaccgaccactcataccgccatgggacctaatttaatctggtgttgctagttttggatggttaagatatccaatatattgcagtgcagggaacgatttgaacttgtcgaaaacatgagggatgtagaatggactttattcattcgtacaatgcagtaacacacgcacggcctggtccaacggcataagagaatcgttgtcaaataaaatcatgagatgccattttcattatcttaatttaccatttattacttgtaaatcatgagatcgttcagatccgatgccgcgagagccccgaagtcatagatatgtccatcagatacctccgtcgtgtagccatcgacttcaaaaggcagaaaaaactttgaatgagctttcaccaatatgcagtcagattatgggcacctgataatgacgtaaagcaatgacacgctctattatttacgcatgcagaccagtcgctgtaggcggtacattacaattgtaaatataaaaacaaactaataacaccccccccccctccgttttttaagtagataccatggatacattacactattttataaaataaaactaatgattaaatattattttaaaacaaacggcatcatctattaaaatatggagataattaatacaacaaagttatagggctaactctatgcatgattccatttctggatcttctggtccgtagctatctgaaagttgaaatattacatgtgtttttatataggcgtattaatcaagataatacaattaattagtaccacctagctaagctatatggagaccgacattatttgcaagttggaagaggaagaacccaaaatttcaaaagctttcgattggatctgctttttcaacgaaagacggcacaagatcttccaacaatattctattggcaccaatttgcgtgtcaagaatgccaatgaaacagctcgcggcggagacgacgacgttgatatcagctctgtgattgattctgtctacaaaatttctcaccgatatcatgcctggatcgatggatcagtacaaatgcgtatcaatcaagtctcgcacgatgcgtgcgaaagacaacacatttcgactctcgttagattttctccctagtgatgaatgcttctctgaacgttgaatgagcaatcgaaatgcatgcgcatgtctgcttgctttttttccactgccgttattatacgtcgtagaactacgtacctggctagtcccatttgttcttttatccttatgagctttgtaattaaaagttgctgttgcgatgaaatcaatgtaattagtactccctcggtagtgctcactccctccgtttccatctgtttcatgttataaaacgacttgactttgattaaaattaaactactttaaagtttgatcaagtttataaaaaaatagtaatattttcaacccaagataaatttattatgaaaatatatttaattattgatttgatgacactaattgaaattagtattataaatattactatatttgcctataaacttagtcaaacttgaaatagtttgactttagttaaaatatcttataacctgaaacggagggagtattaaatatatgacgttgttggttttattcatcattttttaaaagaataccattaataattttaaaatatttagtttgaaaacataaaatcatattccttcatttttttaatatatgatgtcattgacttatgttataatatttgaccattcgtcttatttaaaaaattataaataatgcttaaagtttctttagtggtaaatcaagaaaaaaggaaaataatatttacttatattttttaaataaaatgaatggttaaacatgatataaaaagttgatgacatcatatattaaaagacggaggcagtaccagtatattgttggaaatatagtcattaatcggcatattttaatccaagaaaatgaaacaatgatcatggcataagcagtgtaggatgatcttaacataaccagtagcatactatgcgcatcatgaatgtcaggaacaggaacataccagtaacgcgataacatgctagaggcatcatgtagaacaggaacaaaaacatagcgcacatagtatagcgctaacaatgggaacaggaatagcgctaacagcagtagcaggaggagaagattataccccgagaatggccctccgctggatggtgaggcagaattgcctccgttgttgtagtcgttcacggcatctcctcctggcgcaccagctccggatccagatccagctcctgtcggcggcggcgtaccacctccgccagcagtggcggcagcaactccagacatggcgatgagcagtcgtgcgggaggcactccccaaaaacctgatcacccgcctacccggtgcagatctcaggcgaaggtgtggtttcggaggcactactccttccaatctctcgtgcgcgcaagagatcagaagcggggaagcgagagcaactcaggcgcgaagaaggagaaactaacaccggggaaagaagcgaagaagtcggatcggactcgcggcctccttatctatcaggagaaagaacgtggacgcgctgttgcggagggaattgtggctgcaagaggatagcgacgtgacgcacgcacgccgcgcctcgccctcgccctcgccctcgcccatggcccggcccggcgcgcgcgcgcgcgcgtgtggcattccgacccccacctcaactggtcaacaaggagcctctaataactccctatttaggttgagatatttctcgcttaaatcctgaggtggtattattatcctcaacatttattatgggcctttgagatttaatattataaattgggcctagcccaattattctaacaatccccaccaaatttcaaggctcataagaaatgttcccaatgttgtgcctgtttgatataccagggttttggtggagactgttaagttgaacttccacctaggaaatgagctacatcaaaccacaactgaacaatggactatgccttgaattgtaagttttgtgtgatcaggtttcactcagaaccttgactggtactgggctgccgttcgcatcccctctgtttggagcatataagtcaaactccaggcctttcatgagtatctagagattgcccaaacctcatagactgtgactagcagtcgaactcatataggtgtgttccttctgagatgttctgcaggtcaatatctctgcttggaaaagccactcggatcacattaagacataagccatcctaccatgcaggaaagaagagaagcacatcatgaaaatgagcccttttcaagggtctcttctctcagtcacacaatagtttgtttcaccatccaaattcacgggatctccgatcacaatggacaggtttccactattatgcaaccttaggtgggtatcaagcccatttccctcgatgcactgtctatcacattacgtggtagccccttggtaaactgatctgccagatttctagccgtttggacatagtccaatgctatcactccggagtttttctgctttctgacagatttcagtcttctcttgatgtgtctagatgacttcatgttgtcctttgaactgttcactttaataatcactgtttgattatcgcagttcattaggatagctggcactggtttttcaaccaccggcaaatccatcaggagttcacgaagccactcggcctcaactgtcgcagtatctagtgctgtaagttctgcttccattgttgacctcgttaagatggtctgcttgcaagacttccaggaaacagcgccacctccaagtgtgaacgcatatccacttatggcttttatctcattagcatcagatatccagtttgagtcactatacccttctagtacttttggatacccggtatagtgaattccatagctcatagtgccctttagatagcgcattactctttccagagcctgccaatgatcatctcccggatttgagacaaaccggctcagcttgcttacagcaaatgagatgtcaggcctcgttgcgctagccaagtacatcaatgaaccaatgatttgagagtatctcagttgatcccttgctattcttcggtttttccttaatagcacgttaggatcataaggagtaggagctggcttgcagtcactatatccaaagcgactcaaaaccttgtccacatagtgggattgcacaagtgtaatcccaccctcatctcctctttgtagtttgatgttaagaataacatcagcctctcccaaatccttcatttcaaaactcttggacagatagtctttgacctcctcaatcacattaaggctagtcccaaagatcagtatgtcatcgacatataagcacaagatcaccccttctcccccaccatagcgatagtatacacatttgtcagcttcgttcacaacaaagcctgcagatgtaagcgtggtgtcaaacttctcatgccattgcttaggtgcttgcttgaggccatataaggatttcaatagtttacacaccattccctcctgaccttctagtacatacccgtctggttgatccatatagatctcctcctccagctctccgtttaggaaagctgtcttaacgtccatctgatggacgagaagaccatgagaggctgccagagcaagtagtactcgaatcgtggtcaagcgagcaactggtgagtatgtgtcgaagaagtcctcgccttccttttgggtataacccttggctacaagccttgccttgtacttttcgattgtaccatcaggcctaagctttttcttgaaaacccatttgcatcctacgggcttacacccatatggatgctcaacgacttcccaagtaccattagacataatcgagtccatttcactgcgtactgcttccttccagtagtcagcgtcaggagatgaatatgcctcttctatggttcttggggtgtcatccacgaggtatacaatgtagtcatctccaaaggattttgcaaccctttgtctcttactcttgcgagtatctacaatgttgtcctcctcaggattttcctcaggcgtttgatcatcgtgttctatcggtgcaaagtgctcatggggcatgacagtttctttactagaagtgctaggtgtatatttcataggaaattcattctcaaagaatgtagcatctctggactcaagaattgtaccagcatgcatgtcgggtactccagagtttactattaagaatctataacccacactgtggatagcataaccaagaaacacacaatcaacagtttttggtccaagtttccgctttttggctataggtacatttaccttggccaaacagccccatgttcgtaggtatgagagatttaatttcttcctttcccattcctcgaatggtgttacttccttatgcttcattggaattttattcaggacatgacacgcagtcaaaactgcctcaccccaccattccttggaaagccccgcagtatctaacatggcattcaccatctcagttagagtacggttctttctttcggccaccccatttgattggggtgaatagggaggcgacatctcatgaataattccaaactcttcgcaaaaggatgcaaactcattggaaaaatactccccacctctatcagatctcaaccgtttgattttcctttcaagttggttttctacctcagctttatagattttaaagtaatgcaatgcctcatcctttgttttcaatagatacacatagcaaaatctagtgcaatcatctatcagtgtcatgaaatatttctttccccctttagtcaacacgccgttcatttcgcacaaatcggaatgaacaagttctagaggtgccaaattcctcgcctcagatgccttgtgaggcttgcgaggttgtttcgattgaacacaagtatggcacttggaacctttgaccaaagtgaattttgaaattaaactcatgttagctaagcgcgtcatacaaccgaaattcacatgacagagtcgcgaatgccacacattagactcatcattctcgctaatatggttcacagcattatgattattacacatgtcattcaaagaaaagcggaacaagcctccgctgtcataaccttttccaacaaaagtcccatatttagatacgacacatttattggactcaaacacaagtctaaaaccttctctacacaatagagagccgctaactagattcttctttattgaagggacatgttgcacgttcttcagctgcacggtctttcccgaagtaaacttcagatcgaccgtaccaacaccatgaacagccgcaagcgacccgtttcccatcaacaaggaggaacctctcccgacctgataagaagaaaacagagaaatgtcagcacatacatgaatattagcaccagtatccacccaccaatcaggtgaatgaaaaacagagagaactgtaggtaatattttaccataccccgatgttcctccgccctcgctaatgatcatgttggcagacttcctgtctttgcgctcaggacagtccttggcccaatgcccagacttgccacacacaaagcagtctccctttgcctttcccttgcctttcttcttaaaattggttgcagccttgggtttgacatcaggcttgactttcttgttgttgtgggatgcatgagggttcttcttctgtaccatattggcactagaacctccctcaacctttttgccccggacgtactttgccctcgccttctcctcaacacccaaagagccaatgagatcaggaacactgaactcttgtctcttgtgctttagagaagtggcaaggtccgaccaagaaggtggtagtttggcaataatgccacccgccacaaacttgtccggcaactcacagttgttgttctcaagttccttagccagcatctgaatctcataagcttgttctactacagaacggtcatcgaccatcttgtagtcatagaactgctccatgacatacagctcactgccggcgtcagaaactccgaacttggcctcaagtgcatcccacatgtccttcccagaaggcatgtgcatgtacacgtccactatgttgtcagcgagtacactgatcaatgctccacggaacaggcaatccgaagcctcgaacttagcctcttcgtcaggagaaagaggtggttcacttcgtttgccccgtgaaacatagaagcactgcatcgctgtcaaccacaatagtgcacgtgctttccatctcttatagtttgaaccatcaaaagcatgtggtttcagtgcagcagcaaagccaactaccgaaaatgacctatcaggtttttggattgttggaaatatagtcattaatcggcatattttaatccaagaaaatgaaacaatgatcatggcataagcagtgtagggtgatcttaacataaccagtagcatactatgcgcatcatgaatgtcaggaacaggaacataccagtaacgcgataacatgctcgataacatgctagaggcatcatgtagaacaggaacaagaacatagcgaacatagcgcacatagtatagcgctaacaatgggaacaggaatagcgctaacagcagtagcaggaggagaagattataccccgagaatggccctccgctggatggtgaggcagaattgcctccgttgttgtagtcgttcacggcacctcctcctggcgcaccagctccggatccagatccagctcctgtcggcggcggcgtaccacctccgccagcagtggcggcagcaactccagacatggcgatgagcagtcgtgcgggaggcactccccaaaaacctgatcacccgcctacccggtgcagatctcaggcgaaggtgtggtttcggaggcactactccttccgcactccccaaaacctgatcacccgcctacccggtgcagatctcaggcgaaggtgtggtttcggaggcactactccttccaatctctcgtgcgcgcaagatcggactcgcggcctccttatctatcaggagaaagaacgtggacgcgctgttgcggagggaatcgtgggaacgtaggttagtggctgcaaaaggatagcgacgtgacgcacgccgccagccacgcctcgcccacggcccggcgcgcgcgcgcgcgtgtggcattccgacccccacctcaactagtcaacagggagcctctaataactccctatttaggttgagatatttctcgcttaaatcctgaggtggtattattatcctcaacatttattatgggcctttgagatttaatattataaattgggcctagcccaattattctaacatatgagctaatcttttataaatatttctcatagtattataattttattagatattaaccacgagagagcgatgtggtatctcaaatcggtcaaggggctgcttttgatgccacggatcgattagacagagaagaaaaagtatgatctccaattcactttggagatactgccaattgctaacacgtcagttcatgcgtttgcatttgccaccgtatatagacttcaaagtgacgggatcaaagaagtctttgtttgtagggaaacactttgtttcgtatgtgcgacactgttttttccccctgtcttttgcatgagctcgtgcgtggaattaacgtacgaacgaaattcatggactcctggatttcatacgaaaggaagaaaaatcctgatcaaaagacatagtaccaataatgatcaatatattcaggaaaacgactagacatatccactttttcggaagcagtcatagaagactggggcatgctgaaatttctgctacgtatacgtactaagttttctcataggaaaaatatgccgtcatatatagtactagcatatatgcattgcatgttctattttctctgttagttatatatggtcaatatccgctggtcacgttaataatgcgaaaactgctgacatctgcgttcattgaccagctaatctcctttgtgcgtagaaacggaaaa

SEQ ID NO: 59805 - DNA, 33801 bp, Oryza sativa
attcctgcagccctaatttctctcccaaaataatttttgtctcggcaactatcctttgatttgattaactgtatattttgcaagctagaaagttcgcaattgagatttttaactatatatgtaattcagtttcttttggtccaacagcggttcataccatcacccgtcgatcgacagttcggtgaaacctttacatgactaccagcaacttttgatatctgcaatcggcgttaactgtataatttcgcaagcagctccgaagttaacaaagcgttctgataaaactgcagcgagtacaacttctacgggccttgccgatttcagcatgcttttatttgttactggcgtgtacataaggatgatgcactctaccatgagcaagtttcttggcttggagacttacatcaccgctgcttccctagtgatggcagattatgcagtcctacttctgatcaacactagatatatcggagtattcatcattccagtgatcctgcttgtcttcatcgcagcactctgcaccaaattgtgggacaagtctagtccttacattcagcaggattacagaatcagcagagtttccttactacatgtccccaacactgagtggcttctgaagttggcaacgctgccgtgctggttgcagcttttgtccagcacaatactgaatccagataatgaacagcaagacgataccattgtgttctcgcagttcctcctgttcttcagctccgcactcggtgcgcttgcagtgatggttgccaaattacccgcaggtgtcagccccggtgcagctcaggttcttccagtcctgcaaaagacctgcattgttctgctgctgataacagttcacacgatggctgcagaatggattggggaagatgtcatagtagcctgcattccaggactcgttgcagtgctcgtgtggttcaccgtacatttcgaccatgacgcgaggaatgcaactgcagttagcatcgacaatgtgttgtcttacagatcgcaagccgtcaccattctcagctctaccgtagggcttctcgcatacctgactggctcatatgctgcgtacgagagggaacttgtgaaatcccggtgcaggtggagcttgtgcatggttagctcctcctctgctctttcacacgtcaacttgtggatgcttcagcactggccggaaagaacatttcacttggaagagctgctaaagctgttcaggttttgcaggaaaatttgcttgagcgcaacacttgtgctggctttgatgtcgatcggtggatgggttcgtaatctaatagccggttccatagctattgtttcagcgttggtggggtttgcgcttttcgtaaccatgggtcgtaagcctgagcctcgtaatgtttgtaggactaggaagaacgctgccagcaggtttgggcaggacgatcaaaatccatcctcgcaaagattttcgaaagaatctcggccgtccgggggtttttttgcacctgcctttgagtcttttggagactttattgacaggaaattgggaattgcaaattaagtcaactagttgccaacctggcctgtgcattgtattggctattattatgtaaatatttgaaaggaatattattcgtacgtattgttgaaaatatttcttaatttttatttttgcttcaaatgtattttacatgactgccaatcgaacaattggttttttaatgacacaaactatttaattatgttgagaatttaaaaactctatcagttatcattattaatgtaataaatcataaaaatgtagcactcggaacattgcatataatttacaatataatgactacttcagttccaaattgcaaaaaaatgttttccacatttgtatcattggtgtatgcaaatttctctctttcatggattaacatctcaatctaaaatttatagacaggtgatggcatgttgaatcctaatcggtctagtttcagatgatggacctgttcactttgatgccaaaaaaaacattaccaaattttggcatagttgccgaaattttggcaacttgccaaaattttggtaggatttcttatatagttaccaaaatttagcagcaaactaaatgtagccactttttttttgtaactttaccaaaatttgataaggttgaaaatggcatcaaagtgaacaggcctgatgtcatgttgagtcaagataatattttgctatatattatctatgtgagtaccaaaatatatgagtgttgcaacgggtttaagcaattctaattactagatgatgtcccgcgctttattgccagatatatgttagttattgaagaaatgatgaaatgatttgaattgaaatattataaaaatgatttgtacatgatgatttagcatatgtatgtttagttttagaatgaaataaattatagatataattactgtatgtttgcatgttgagctttatatgcttaatgggttgatgtgacatgcttgcatgtaggttttatgagtgctaataaatactattcttgcacgttgagtattgtgtgattaataggttgacgtggtatgcttgcatataagttttatgagtgctaataaatactgtacttgcatgttgagttttatatatttatagtgggcattaactttatagaaataagtgatatgtaatactttgtagtgcccatcaacagataaacagtcaaatacaatgatagatatatttataacttgcatatccaggggtgaacaaataatgttctaaattctttgaatgcaagtaattttgtgtacatcttacttaatactatgaaaaggaatattttaacctaggtaagaactaagaaccaaaatacataattaacccaataaacagaaaaggggctgcctatatactatcacaatgcatccaccttattgtctacctctccctcttctggcttagattgacgcgcttgagcagatttgtgcagccaccgtgccgtcgccatgctcctctcgtcttccctcgccaccactgcccccaccttgtaattactcttgttaccctcggccccacctccgaccatgcccacagctggatccatccctgtggcttaagcaccgcctcgccgcccaagaccattcatctaaggctgagagaaaaccccctcatgctggtaggttttatccattttgtaatggaaatgtacaatgtctctcccaaatataaattggctgcaaccactgtgtgcaaatatcccactgtaattgctgggaattccgaactttatgtgcaccgcacttctgaggttggtttagactcaggaactgtaatgcacgaaacttatgaattgttcaaagatggcaggcatcctaaacaagctactacctccatccaaaaaaattggacactctaccgccgggctgatgtcctgaaatttcgtttagatatttaatcagcgaaagtggggctcacatgtttctaatttttttgggtcgatagattcctcacataagagcatcaccaacagatacctataatttcctctagaaaagttgtttttcggtttcttaaattgaaaataggaagtagaaaaattgatctctataagagaacacctaaatttaattccaaaaactagaagtagacctttctgttaaactagaagacaccaccgccgctggatggcgtgggcatgcaaaatcaccgagcgtgaacattttgcctctcgtgcgggaaagggagtagaggcgcgggagcaacagattgggggtgggagaggcgagacgacgctcctcctcatattgaccgagcgagttttcgggataaggggattccaaaaattgggcacgagattaggggatctgttggagctgttttttttttgacgaaatccctcaaaattagttttgggaataaaataggggaactgttaaagatgctctaacaccgcaaaaaccttatcctcacgtgttatctcgcctactccatcgctcctcaccccgatcccaatccttctccacgcctctcctctccactaccagcattgacaatggcgaggcgggcacgcgttgagtcgccagttgtcgcggcgctcgttgattcgccggccgtagtggctgtggaggccatacgtgagaggcgtgcgccgattcaccggtggtgggcacgcgccgagtcgccggtcgtcatggctccggaggttgtgggcatgcgctgattcgcctgttgtcgcgtggcgggcacaattggcgtctgtagtggcagtggaggtcatggcacgactgaccagaagggccggacgaatgcgaagtgtggcggaagcagacctccactcagcgtaggcgagacgaggaaggcgaggaggacgcaggcggcatggtgatgggggctcagcgtcgaatcaaatcctggggacaatttggtcattttaccttgaagctaattttggctgtcaaccttaagacgccaattttttttggacggaggaagtagttatttcatttgatgaaaattgtacaaatgttgcaatatttattgaagtagttttctttttcatctgcaattatcttcgaactattctggtagttctgaacttctgatggccaaattttctaatcgtcattatagggggggcctaatgggtgatcgatcgccaggcgatcgcccaagcgatcagcccccctcccctatactccatacactcctccctcctctcccctctccctcctccctttcttctcttcctactacagtacaccacacaattttttttaaaaaaacaaaaagttagaaaaatttatgtataaaaatactatatataaaaaatttgaattcaaattaaaatttgaatcgggtatgtaaactttagacttataaactttaggtgtataaactttagatgtatagaaatactatatatagataatatttgaattcaaattcaaatttaaatttgaatcggctatgtaaacttttgacttataaacattaggtctataaactttagatgcataaaaatactatatataaaaaatatttgaattcaaatttaaatttgaatcagatataatttaaattcaaatttgaatcgggtatgtaaatttttgacttataaactttgggtctataaactttaggtgtgtaaactttagatgtatagaaatactatatataaaaaaattgaattcaaattcaaatttgaatcggatataaaaacttttgacttataaacttttggtctctaaactttagatgtgtaaacttaaggtgtataaactttagatgtgtaaacttaaggtgtatataaactttaggtgcataaatttactaaaataggaaagtaatgcggtgccaaaaaaggaaactaggtggagggagggaggggagggggattgatcgctaccccccgtcccaggcgatcaatcgccgattaggatttccgatcgttatacgctatagtatactatgaatcttaggttatttataagggcgtgactaaacagctaccggtcactggtttgtcttatccagctaccactccatccagtataaatcccccttcaacttaaaagatacaatagagtgtgtttttttaacctttttaataacttatatcttttaaatcacatattgtttttaagatctatttgcatcattgtactccactcaaaatatgtgacaaaacaagatccatattgaatatattcaaatattttattaattgaaaagtaaattattacatgttatgaagtaacttccatgttatcaggaagtaatttttacatcttatacatgattaattgtcattagttactccatcaatgttttttacaatccatcaaaggtttttgtcgatgggggatacccatagaccgaatatagagggtattggggtccgttggtacgaggatctacgtaatacgacatcaagcaaacagaagacaaggattatactatactggttcaggccccttggaaggtaatagcactaatccagttggtacgggattatatgatggaaaccatagggtacaaagggaataacagaactcgatgataccgacaagagcgtagtcaagttggtctgactagatctcccagcgacttggctcctacgcgctccggctctgtagagtgtggggggtgtgttggcagtaatattcgatgtcttaggtcctgcccagggggtcccttatataccgcgggtcagttgatctccaagtaggactcggagatataggacccctcacgatatggtaaagactcagtctcgtccgagtaggactcctcccatccgtatattttgtttctatcacgtgacagatttccttatcgtatacggaaactatccgtatacgcgtgggtatgccgtatcggtacccactgtacatccaaggatagagggtataccttatccgtaacccaaacagtagcccccgacttctgcttaaatgagctcatgttatcaatcgcgacttctgatgtcggaattgttgtcgttatcatctggtcgatcccggtgtgaaaaccgtagagacaaagagtcatcgacaacgccgcgcgaagttcaacggtcatgagcgaatttaaattgaagtctgaaaaaccaccgtccgcaacgtacccataattttctggcagcaatctctctcctttccttggaatacgcaccatcgggagtgcgcttatttaaaggaaatttgggaatccatttgaagtccgtttgccagaaagctctcctgccctctagcgctcttcgtcttctccgttccccgtaaagaaaaccctagctcatttccttcatccagttatccggcgatcctctggcagcgatggatcttgagaagtcaacttcgaccaccgcgtccatgaagaagctgtaggacgacggtgccctccccggtcgcgggaccatgcaaagggaggctggaggtacagaacctgaaaccatcttgggccgcatggatgtagtcgaagattatatttcttgcggttttcttcctccgccttccgagtttcttcttctcgccttgaacttctatggcctttctttgcttcacctaaaccccaactccatcgcctttctgagcatcttctctcatatttgcgaggcctacattggggtagtgcccttccttgatctcttccgcttttattatgagctgcgctggatggaatccaacagggtgtctgtatgcgtcggattccgacttcgggatgacctgaagtcgcgttacatccccttccagtgcccctcttctcgcagcaaatggcagacgagatggttctatctccagatagaaaactcagatcccgtcctcgtggtccctaaggaccagccagaaaaaaatcccagagtggcccgccaaacccgccctgactccgaagacggcggttgtcgggatatcattgatgatctccgaagacggcggttgtcgggatacgaagtcgctgccgacttcataggtcggcggattcaaccgctgtaggcccgtgcccatccggcctttgattactccgggccagaggacaagacccgggtctctcctcggggtatttttcttgcatttttaatattgttccgagtgcatctatttctcctgacttatcgagttcccgttctcgatttataggtctggacagtgacaccgtggggcgctgcgttggccaaataatgatcagcgcaccctcgggggcgggcgacatccccgtcccacttagcgacaaggactcggccgagcgcgccacgacgattaatgtgagtgtactcgataattcctttacattttctgctcgagatcgcgtcatgacttcacgttgtgcaggctctccttctgacggacgtcatcggacccctcgtggatcactaggcagcgacgtcactgaagaagcgcgtcaccaaggaggcatctgacgctgctgctaccaccacaagcggcagcaatgttcctaagaaaggaaggaagttctcctccgtgatcgggacccaccggaaggcaacgagcccggtggtaagcttctgtttcgcctttgagtgtgtaatcagggcgacttagcctcacatcatgttatcttactcaggactcgggcgcgtctccaccgcctcagcgaaggcagaggttggtgatgattggggagaagtaagtcaatgtctttgaggttttttcgttctcaaagtttcgattacctcgcctcatggggaagagaaaaaatcttggcagggcggcgtgggcaaaggcggcgcaaggcgggactgatgctgcttccaacgcgtcccctgcggcgacctcgacagaagtcgtggttgcttctaaggactaggagacggcaccgagtagccccgtcgtcggcctcgcgcctacccatcgtctatccgccgattccctcacctgggaggagctccaagcggagatgttgcgcatcctccgggctggcgttcgcggtgtaggccgcgagatcgaggaggccaaggcggcggcgttgtcggcaaacgaacgtgccgatcagctggcgcgcgatctggtggaggccgcgaggacctctaaaagatgagggagctggtggccggcaacaaaatgcagcggcgcgggcttgagcaccggatgtcagagctcgagggccatatgaccgacatccggggttcgctacggacgtcgttcactaacctgcaccagctcgccggggagtgtggtgtcacgactacaatcccgacacaccctgatgagttctcgctgacgtcgtcgctcgtggaactggctatggcgatggaggagatcccctccaagcatgaggccaggatcggcgaggagacgtcaaacgacatctacactggggcgtgccatgtccttgtgtgtatgaggctggcgtatcctgatttagaccttaagaaggccttggatcggggggccaccgatgacgcgcgcaaggctacaatggaggaagtcgttgacttgggggagtctgtcctcctcctttttgaagagtaggatatttgttttcccttgtactccttaatcttcatgctgtaaaactttatgtgggctcgaactgctttcagttgtttcccttgtcttcttagcatgtgattctgagtacctttatcattgtagatgtgttgctgtcgaggatgtccagcagcgtgggcagcctgatgtaccagcggttgttctggcgctcacacttgagccgcacgcgccgctggtggaagtcaataagagcccgttcgtggagacgaacatggcgatgacgtccttaggtttgtgcctttatttccttcgctcctcgtgctcgaattgacttaattagccgtgttctcgaaagagaagagtagcttgacttagtcctttccgtgttgggcagattttgagaacgcgttagctgaccgagatcgtcgaatccagtattggaagacgaaactcgaggtggccgagaactcgagagagccatggttgaggtgaagaaagaccaggccgtggaagccctccgaggtcgcgaggtgtggttcaactcatacctcaagagttgctgcacggcggtggcggaggtttgcaaggagctccgagttccccgcggagatcccgaggagtcggccgctggttatatctcgtggttgaacggggcctgcgcacagctcgaagggattggcaagcacatcgacgagaccctgaagtaggagtgtcgtcgagcgagccgctacgccggtggacatgtgctggcctatatccgagatcgtcgcccgcagctgcacctcgatttccttcgcaaagggttttcgcgttctcggaggacacctgcggagatcgatggtcttgcgcagtcaatggcgctgcttgccgagaaggttttctgctccatggatgggcgttggccgtcctggtagcttttgtatctctgggtatgttgtgtatgagtgtttttctcacattgcaactacggttagtcacttgagccattcactctccctagccccagccttgtcggagaatcgttctcggaggataaggctcctagacccttgacctgccttggttgaaaaagcactgaccctagcccctagccgtaaagttgaaaaactcaatttctgatcacacgacttggttaatacgcacggtgagaactcttacatgaccagatcttacatggtcgtttgtctctgcataattcgaaaatgccttatccgctctgggcgtccccagccgaagttcccttaggttcctcggaggccttgccaggacagcgtaaagggacatgaggataggtttcaactctaggtgtcgtcgtggtaagggatcattgggaaggaacactttgacaatattctttacctgaaatcaactttattgaaatcgcaaggtatctgacaaatatggatactattgatttatacataaagtttacgtaattgatccatgttccaggaatttgctaactcgtgaccatcgctgtctgcaatcttgaatgcgcccggccgcaagacttgcgtgatcgtgtatggtccttcccacttgggtgagagcttgttgcaccctgcttggctttgaacccgttggaggacgtaatcgccgatcgaaagtgtgtgtgctctgatgcgcttctcatggtatcggcgaagggcctgctggtagctggctgatctgatggcaactctttctcgatgttcctcaagtagattcacatcgtcgcttcgctgctcctcctgctcctcgttggaatacttctgaactcgtgtgctctgatgtcgtagctccgtggggagcatagcctctgagccatacacgaggaagaagggtttctccttattggatgttgtcggtgtggtacgcatggcccatagaacagaggggagttcttcgacccacttcttgtcatgtgacatgagtctgtcgtggacgcgggtcttgatcccttgtagtactatgttgtctgccctttcgacttgtccattgctccgagggtgagaaaccgtggcgaagcaaatctaaatcttaactcccaatccgatgcagtagtcctggaagtcggcactaatgaactgggagtcgttgtctgttatgatgcggtgaggcaatcagttttatcttcttttctcatactacatgaaaaacaaaattgaaaggaaaaaaaacaatcagtgcttaaaacagatttatagaaagttacttctgaactattcaaaagttacttccaattaacattgaagtaacttttaaaaattgttaaacttacttgtactgatatgtgctgattaaatttaatttctagatagagtcatatttttatccgtacaacgaatttacttctaatgtcgtgacaaaattactttctttttgttttaagttacttttataatatatgcaaattacttttagactttattgaatttatttttatatgtctaagaagtaatttagtgaaatctaaaagtaatttagatatattatgaaagtaatttttaatttttaatcaaaatataatcatgtgagatcttgttataaagatttaattgttacgaacataacggtgtaatcggatcgtagatcggatgagtagtttaagagaaaattttatttgaaacataggtggttcctatttgtttgatggactagtagtatgttttcagtaaagtaatggcttcagttgtgccgtgccgtaagactaaaccaagaggtttctcggtttagattttgggtatttataaacaagtacctaatcattatatggaaagccaacaaataggtaacacagtggatattttcttcccgtggaagacagtatttaattggagttcttcgtctccgttatatttggattaggtaagtagcacatcctctcaataatcacagattcaacagttgacaggattaaacttgatcaatcatttgtagattttaaatgaatcacttacagagttgagataattaatggtgatattgtcgttataatgtttttcgaccttctctttaaatcatttggatcaatagccatataagtgagtgtaggcaatagtgaatggcatataaccaatgtaaagaacttaagatcaatatttctagtgattttgcagaaccaatttgccatggtattaagaattcggaagtacaaataacgagatttcactgaaaatatcaccgcccattatcatcagccctgaacaatacaaatcttaaaaaaggtttccatcaattctcaaagtaggaagttaattttattttgtaaacaaggaaagtacaaaatatacactagattgtcttagtattgagaaatattttacagtacttgaggggtgtagcatacattctagtcataatttgtgatctctctaatttgatacattcctagtatcgagctataggaatagttaagaaaaagagctacaagaatacaacaaattaaccataaacatcacatactatagcattcttaaaaccataatcctcttacttaatattcctaaaaggaaacatagcttgcactgattttgtgagtcggtgtagtagctgacgaagggaaagaaacgattttgtgatttttcccaattcacacaccttcctgacgcacaacgactcaagctcaacaatgaagacgccatcttcttccgtgccaaccaagatggcgctgggaccttcggcaactacagccaaacacgccgctccttgccctcactacgccagatcctcacacctctgacgggatacctgtgacgggcaaacgaattggtcagtagtgaccattacctttgacgggttatacgggatgccgtcaccggtgaggcatctgcccgcggcccgtcacaggtatcccctcacctgtgacgggccgaaaggaaaacccgtcagaggtataccagtgacgagtttttcttccaacccgtcactggtatcccctcacctgtgacgggccgataaattagaagccgtcagaggtgatgggccgccacctgtgacggctttcatttctggcccgtcacaggtgagaggataccagtgacgggccgttgaatagaagcccgtcaaaggtatgagcaatacctttgacgggctttttttatctaacccgtttgaggtgtgttgggtctataaatacccccaaactgccaactgctttccatcccgaccattgtactgttcacaaatcggttgggagggcaaggggggcgattttttgctaaaattcaaggtaaaaaacacattattctccattcattctcaacatatcgatcatcatttatttttcttcgtatgttgttgatttcagatggatcgtagatggatgtactatgcgcatcgttcgtctaccgagtatagagagggggtcactgaatttgtcacatttgcggataatgacagaaaaagtaggatgagcatgcacatgttgtgcccatgtagggactgtaagaatgaacagatgatcgaagacaaggatgaagtgcatgctcatttgataatgaatggattcatgaagaaatatacctgctggaccaagcatggagagcaagaggcgcctgatgtcgcagctgaagaagtgttggatcaggatgtagagaacaccgccgcagctcgagaaggcatgttcgtaccttctcctttaggtggagagaccatagatttggacactcaatgtctatctacaatgttgcatgacattgaagacgcagaggacaacgacagagattatgagaagtttagtaagttggtggaagattgccagatgccgttgtatgatggatgcaagtcgaagcacaacaagttgtcatgcgtgttggaactcatgaagcttaaggctagtaatggctggtcggacaagagttttacagaactccttgagctgttaaaggatctgttgccagaggggaacaatttacctcagacgacatatgaagcgaagcaagtattatgtccgttgggcctggaggtcagaagaattcatgcatgtccgaacgactgcattttgtattacaaggaatacgctgacttggatgtctgccctatctgtggggcatcaagatacaaacgagcaaagagtgaaggtgaaggaagtaagtcaaagaggggaggcccagcaaaggtggtgtggtatctcccaattgcggagcgcatgaagagaatgtttgcgaacaaggaacaagctaagcttgtgcgctggcatgccgaagaacggaaagtcgatactatgctgaggcacccagcagattcagtacagtggaggacaatcgataggatttaccaggaattctcaaatgacccaagaaacatgcgtttcgcaatgtgtacggacggcattaatccttttggtgatttgagcagtcgtcacagtacatggccagttctgcttgttaactataaccttcctccctggttgtgtttcaaaagaaagtacattatgcttgccatgctcattcaaggaccgagacaacctggcaacgatatcgatgtgttccttgaaccgataatcgatgacttcgaaaggctatggaatgagggcacacgaacatgggacgcatatgcacaagagtatttcaacctccatgcgatgctgttttgtaccatcaacgattatccggcccttggcaacctttctggccaaactgtgaaagggaaatgggcgtgttcggagtgtatggaggaaacaagaagcaaatggttgaagcattcacacaagacggtctacatgggtcacaggagatttctcccaaggtatcacccgtataggaatatgagaaagaatttcaatggacacagagatacagccggacccccgacagagctaacagggacagaggtgcacaacttagtgatgggaataaccaacgagtttggaaaaaagaggaaagttggaaagcgaaaagagaagagcacatcgaaggaaaaaacagaggagcatgtggaaaaacaaaagacaaaagagaggagcatgtggaaaaagaagtcaatattctggagactaccatactggaaggatcttgaagttcgccactgcatagatttgatgcatgtcgagaagaatgtatgcgagagtttaatgggattactacttaacccaggtactacaaaggatggtctcaacgcccgacgagatctggaagatatgggtgttcggtcggagctacatcccataaccacggaatccggcagggtttaccttcctccagcctgctacactctctcgaaagaagagaagattgatttgctaacatgtttgagtggtataaaggttccatctggttactcatcaagaatcagtaggctcgtttcactgcaagatcttaagttggttggaatgaagtcgcatgattgccacgttcttatcacacagctgttgcccgttgcaataaggaatattttgcctcctaaggtgcgacacacgatccagcggttgtgttccttcttccatgcaatcggccagaagatcattgatcccgagggactagatgaactacaggcagaacttgtgaaaaccctatgtcatcttgagatgtactttcctccaactttctttgacataatggaacatcttccggtgcaccttgtgaggcaaacaaagtgctgtggtccagcattcatgacgcagatgtatccttgcgaaaggtacctggggatccttaagggttatgtacggaaccgttcacaccccgaggggagtatcatcgagagttacaccaccgaagaggccatcgaattttgtgtggactacatgtcagaaacatcttcaattggattaccacgatctcatcacgaagggaggcttgacggtgttggtactgttggaagaaagactattaggttggatcgtaaggtgtacgataaagctcatttcacggtactacagcatatgactgaggtggtgccgtacgttgacgaacaccttgcagttatccgacaagagaacccaggccgatcagagagttgggtcaggaataagcacatgtcttctttcaacgagtggctgaagaaccgaattgccaggttgcagaacttgcctagtgaaacacttcagtggttgtcacagggtcctgaatggagtgccaccacctggcaaggatatgacataaatggatacacctttcacacggtcaagcaagacagcaaatgcacagtgcagaacagtgggttatgcatcgaggctgctagtgacggtggtcgtcgtgatcaatactatggtagagttgagcaaatattggagctagattacttgaagttcaaagtcccgttgtttcgttgtcgatgggtcgatcttcgcaatgtaaaagttgacaatgaagctttcaccactgtcaacttggctaacaacgcgtacaaggatgaaccgttcgttctcgccaaacaagttgttcaagtgttctacatagttgacccgtgtaacaagaaactacatgttgttcgtgaagggaaaaggagaattgttggattggacaatattgcagacgaggatgattacaaccagcacgtccatggcataggtcaagaaatacctctagaagaggaggaggaagaagatgaagttcaatatgcacgtgtcgaccatgaggaaggattatttttgtaatttatgtacgtagtttatgtctacatgtctgttatctgtatgactctatatatgttcggaatgatcaatagtatattgcttatgaaatagtcaaataaaataattaagtgaaacacccactagaagtgaaataaaataattaagcaagtattagcattggaaataatataattaaagtagtataataatgaagtgcaattactactgttagtgaattaaaataattaagtataaaaaaatatgtagtgtatgtgaaaatatgttaaggaaaataaaagaactaagtgaaataaaataaaataaaattgctctaggcaaactcacctgtgacgggctctatctgtagggccgtcacaggtgacctcacctgtgacggcccagagtgctgggcccgtcacaggtggtcttacctgtgacggctccacggttggcgcccgtcacaggtgaggccacctgtgacggccacatagttggagcccgtcacaggtgagtttgactagggttgacctagggttggacatcttctagatcgatccagatccggcgcccactctcactcactcactctctcgaccgccgcctcgcctctctcgacctctctgccgccctctacgcgccctcctctccaccgccgccctcgccgccgccaaatccgccgccctctccgccctctccgccaccctctccgccgcctcctcctctcgacctcgacctcgacctctccgccaccatctctgccgccgccctctacaccgccctccccaccgccgccgcctcactcactctctcgaccgccgccgtccttctccatcgacctctccgccgccctctctaccgccatctccgccctctacgccgccctccccaccgccgcctcgacctctccaccgctgccgcctcactcactctctcgacggccgccgggacctcctctcagtcgccacgccaggaccgtcgtcgccgccaccgggatctcctctccgccgcctcctcctctcgaccgggacctccacggtgagcccactccccccgcctcccctcgtttactattggtcgccgattaaccccctcttctcctcctcagcgccgccgtgccaagaagccgccgccgcgccgccgtgctgagaagccgtgcgccgtgcgcctgccgggactcgtcgtcgccgtgtgccgcctcctctgctcgtcgtctcctctccaggtacccctctctctctgatgcccatgaatggaatggtgcagtggatggatgaataaatgatgcaatggaatggatgaatgaatgatgaactttggatgaatgatgaactttggatgaatgatgcaatggaatggatgaatgaatgatttaagtgccattttgacatgtaaccattcatggagtgtgtactgctttatatgttgttttgttcccttttgctagaactattgaattttggggataatgtttacatttagctgaaaaaggatggattgatagattggcaacagtgttaggggttatgttcccttttcctataaataaagcatatacagggtttgaaatttagttcaaatggaaaatacaaaatgcatggggagttttggtggattggttagtgtagtccatggacggaaccgacctagtcaccaaaatttttcatgcattttgttttctataattctttgataattaaggacctttattaggtgtagggtttgaaatctagttacaagggaagaattgatagattggccgcagatttaatgtagttccgaggttatcaaaccatcacagaatacaaaatgcatggggaattttggtggataggccagtgtagtccatggacggaaccgacctagacaccaaaattctccatgcattttgttttctgtcataatttgatgattaaggaggatttgcagattatataaacttgttgatttatataccctttttgtctatgaataggtcaattgtatgaattgttgtttatatacatgatttatatacccttgctgctgctgccacaatgattgtgggctgttttattatctagacttgcttgaattgaatggatgaattgctgtttacatgaagttagtagtactgtctccttttttatctacacccctgctactgcccctacacttgttcacttgttccttattaaatggccagtgtagagtagttatatacctctacacttgttctttttttatgcataagaacagattttgtgcacttgctctttttttatgcataagaacagattttctgcacttgctcttttcttctggattgataaatggccagtgatgaattgctcaataaaaacagattatctacacttgttcatttttttatctattcttctttttgcccctgttgtggctcaatcagtaatgaattgctcaataagaatagtttatctgtacccttattgtgggctgttttttaaatttgcatgattgactcagtggataagaacagagtatctacacttgttctttttttatgcataagaacagatttgctcttttgatgttatgatttcctctttttatcccttcatgcaaatgaatataattgatgcatatttctgagcaaaactgaggccatatctttcagtgcaactgctgctgtctatgtttgcccttgctgtctatgtttgcccatgctgctgcctatggttgcaactgttagttaagtgcaacttgaatgtggttttaagtgccatttggacatataaccattcatggagtgtgtactgctatatatgttgctagacctattgaattttgtggacttgcatttatactcctcctgctgctgttttatgtcaatcatgcaaattctgtacccttgctgctgctgttttttaaattttcatgattgatttagtggttatatacctctacacttgttctttttttatgcataagaacagattttgtgcactctctctttttttatgcataagaacagattttctgcacttgttcatttttttatctacaataatatatgcatgatttatataccactgctgttgttgcccctgtacttcttgttaaatggccaaggatgaattgcttaataacattctatctatacctgttcttttctttatggataagaacagattatctacacttgttgatttatatacccttgctgtctatgtgaatttccctctgctgttgctgtttatgtgaatttccaccctgctgttgctgtttatgtgaatttccaccctgctgttgctgtttatgtgaatctccccttgctgttgctgcccctgtggcatatatacccctactgctgttatatggccctgctactgctcttattgctgctattatatggccatgctgttgctactactctaatttcctgcacttgctcttttccttatggataagaacagatgaactacacttgttctattttattgataagaacagatgaactacacttgttctattttattttctatttcctcttttttctgcacttgctcttttcttctagattgataagaggagtatatctagacatgttgttttagttaatttgcccctgctgttgctacccctgtggcatatatactcctcctgctgctgttttatgtcaatcatgcaaattatgtacccttgctgctgctgttttttaaatttgcatcattgattcagtggttatatacctctacacttgttctttttttatgcataagaacagatttcctgcacttgctcttttccttatgattttctctttttatcccttcatgcaaatgattgtaattgatgcatatttctcagcaaaactgaggccatatctttcatagtataccccgtattacattggatctaatgctatttagtctaatggtaggaaatttataatctttttcgcgaaagttaaaccatgtcaacgcccggcgcaaacccgccctccccaacacctgcgaggatccaggaagaagcaaacccagccacagaggcagttgccgaaggtcatcccgcgacaacggcggtccaacaacccgaaattcatggtaatttataggataaattttcaccacatgaccacataaattttagctagcaccccttagcaaatattgccttctgtttgtgctgcagaattgccgcaggaccaacatacgtcgatgtcgggcgagacaagtgcaagtaggtctagtagaaatccgcggtcacaaaatatatggccgaccacagtgcaagttataagagaggttgacgctagtggtaggcccacggcgcccaggactgtcattggaagatggtctaactgctgcgggatagcggcacgtgagaacttcgggatcctccataaagatatcgggaaggtcacagaagccgagaaagagcgagcttggacggcaatggagaaatggttcacatttccagccgaagcaaaggataggctcaagcggaaggcattacaaaagatgggcaaagcttggaagaattggaagtcgaagctcttcaccgagtatgtcaacccgcccggcaatcatacgccgttcgatgaataccctcaaataaccgaagcggtgtgggaggaattctgctctctcaagaccacccaagagtttagggaatccagcgaggcacatcgcgtactgcaacagcggaatgagcacccgcatcggctgggcaccgcagggtacatcggcaaggaggcaatatgggcccaagaagatgcagccgctgcagcagcgaatgtacctgccccgttttcggacatccctgaacaaagagctcgcaactgggcgcgggcaaggggtaaggtcaacccggacggctctgtcacatttgagaacaaaagtgatgccgtcgtctatcaggaactggtgagttcactacttaacctaactaatttccgttcgtataaagtacaagttcgtataaacgactatcttcttttctagttgggcttggttgctgaacaagcttcacaaagcgaggttgagtccgcgccgaagaggcgcgaagatgacatcctcacaaaggcgctcggaaccaaagaacatcctggccgaactcggggaattggtagcgatgtgccctggaagcatggactccctcagtacagctcccaatacaggaaacggaaagtctccaaggaagagagggacgctcgtttgaaggccgaacttaaggttgaggtcattcaagaactagaagctagcatgaatgcaagggtggaagaaagggttaacaaggtgcttgccgacatgaatataccccgagtcacaacacctgctgtgcaaccaactcctcgtatacaacacgacgcgagtccgtcacagcataggagtagttgtgcatccacagaggtgccggcccctggtctcccgatcgcaccactagctgcagtggaccacatcgaggtaattattgttatccgatccatatctaataaaagacatttacacattccaatattaaattcaaactttcaccttatgtagggcgcagcacagtgtgtcctactagcgagagtccacccaactttcgctcctgaagtcgctgagggcatggctttcaagccctcggttacagacaaggtccacggcgcagacctgctagctgggtatgccaaggtgtccatcgatacagtaaaggacacctggtcaggctatccgctgcccgtgcccccaaatgatgaaatcatgactttgggcgatgcgcgcaagacattcatacaatggcccaaagaagacatagttgtgaagatgactcctcgtccaagtcgaccgacggagcttacacctcccaagtctaagctatcaattgaggctccccgtggaccggcattgtcagtacctcattctcccggtggagctgatatggacttggcagatatagctcaaagcttggctccaataaagaccacaagaaaggccgatagctccccaccacttgtcaagggccagaagcgtgaacgaggcaaggggaaggtcggggagttggcgccggagccaaaaaggggcaaggctgcgacgtcgatgccggtgagcaaatcggggaaggtcgtgagggcgccagcgcaatttgagctaggcatgccattggtggaggacaatgtgttagctgtgatgggtattgcttgccgagagctacataagcaatacatggagctaagcaatgccaagcggaaaatgagggagtcatccatagttggacatcacgaccaccagccgttcctatcgtcgcctgcctatataactataggctttgatgacctcttcgaccttttcaggatccggaagttggacactggtcttctaaaatgctactccttgtaagtgcataccttctatacttgtgatatgactggactatatctcctaattaaattagttctaatacgtaaatattttaaggttgtgttggatcgagagtcgtcgccatggtaatcaggttgggttccttgatccatccatggtgaatgaggttaatttacaacagagctccactgaggtggttgactatgtcaaccggtgtttatgggcccatcaagacaaggagtacatcatgtgcgcacacaaccaagagtaagaggacaatacccttcgtgtatattgtttttgaagttaaggttcttagtactaacgctacatgaccactgcgcaggcgacattggattctcctagtcatcgtacctaagtggagtagggttacctaccttaactccaataagtccaaagattatgatttcagtgaaatcaccaaggccttaaatatggcttggggtccatatgtggaaaagggtggtaggcacaaggagggcaagaatgaactttatcatgacaccaagtttgcatgcgcacaacagatcggagaccaatgtggtttccacgtgtgccacaacatgtcaacacttctaagagaggtgaaagatttcgaccctgaggttgttgctaatggcgaataagctcatttcaatatctacattgctattcaaaacgtgctaattaacctcttatttattaaacagaaaggtagagctggcttcaagatctcacccatcaacccccccgctatcagaggcgaattgtgcgcctttattcttgcagaaataatgaacaagaaaggacgttttcatgccaaatagactcatgaacttggctagataatttattgtgatgtaaaaaagatgtttttataatttctggcgatgtaaaaaattatgtttttatagagtgcaatgtaatttactttcatatgtgcaatatttatggtactttactaaattgtcatcacatttgatcaactacgatttatgttgtactattcatctgttttctccttttttttcccttattgacaggttgtggaggttcacaacgaacagaatacaagaaattttggtaatcatttgaggactttcatggggtatgaattgtgtgctataataaattaaattgttgcatatgtgatgttgtaaattgttgctttgtgatggatctgtgatatgtgatgcatctgtgatgttgggcagttggggaatatgtgatatggagggggggtgactggcacctgtgatgtttctgtgtttcagagggcatggctagcaattcctgaggctagccaatatttagcatttattttttttctggaattaactcatcagtgacggttcggaagaaacatccgtcgcaggtaacttcacctgtgacggactcgcaaacgtcggaccgtcacaggtgacccacctgtgacgggcttttactttcgggcccgtcacaggtgggtcaccctgtgacggctactatataccggagatcatcacctctgacgggcctttatttaggggctcgtcagagatgagacacctgtgacgggtcctaacaagccctagtctagcttagaccaacacctctgacggccttctattaacttgcccgtcagaggtggatgtcaccactgacggccggccacccgtcaaaggtgactggacttaccagtgaccactgatcactgaccaagcccaaaaccgtcaaaggtgagggtttgggcccgtcacaggtgaccttgaccagtgtagtgagcgaaggatcgtgctagggagaaccaaaagccgtatcctggtttttatgacgctgtcccatatcctcctaattataaaattcctgaatttaccaagtttagtggtgaggatagtaggactacatatgagcatgtagatcaattcttagcgcaatgtggtagggctagtagtatggatacatgtaagttgcgcttgttttctttatctttgtccggtactgttttgatatggtttacttctttaccggcatattctattggtacttgggctcaattagaacaaaaatttcatgattattttcacactaatgaaactaagcttaagttgtctgatttaacatcggttaggcataaatacaacgaatctgttgctgattatattgaaaggtttagagatattaaaagccgatgttttagtttgagaataactgacaaagatttggccaacattgcatatgatggattgcttgattctattaaagagaaattaaatggccaaatatttcttgatgttgatcatgtgttgcatgaagctctggctcagaaaagccaagtggatgataatagtttaaatgctagtttagatgatagtgcaatatcatgtatagctgagccaagagatggttcggattgtggtaataatttgtgcaatgatgccgtgacaagtatagccgaatcaaatgttggtccggattgtcttactaacttggatgataatgttacaaccattatagccgaaccaagtgttggttcggattgtgttactaatttagacaatgatggaatagccgaaccaaataatggtttagattgtgttgctagcttagagaataacatcattgaaaatatagccgaactaagtgacggttcggattgtatcacaagcgaaagtgaaatagcattgtcacctaagatcgaatcacaaatcggtcatgtggatgttagaaaagatgatgacaatgtcttgcgggatagtggtgcaatagaatccaaagtagttatgcatacatatcaaaggccgtatcctgaatatgtagattcggtcccatacccgcaaggatttgaggtgcccaacttcacgaaattcacaggtgagaatgctaggactacaatggagcatatcggccactttattgatcaatgtggtaaggccggtagcgatgatttgcttaagttgaagttgtttcccctttctttattaaactttgcatctacatggtatagtttgcttgctcctagttcaatttctacatggtcacaaatggagcatgagtttcatgattatttcaaagatgcaagtttgatggagcaaagaccgattgatacttcatcggtcacttgtgaaactatttcggttacatctatgcctaaaaccggaattgttagtgatcctctccctattagttctattaatgttgacaaaaagaaagggaaaagtgttattattggggatcctcggcccaagaataggatcaataatgcaaaggccggagatcataaaattgccaaggatgagtcatctagttcccaaaagaccaaaaagccgaagctcacttttgagatgcttatggctaagtacaagaaaggattagccggtcagcgatttgataatcaaacttgtgattcaaaaagaccaagatcatctcgtagaaagagatttggtcaaacatcaaagcaatcggagccatcaaccataccaactccatataaacctccgattgtgatgccatggtatccatatccaatgtcactatatggttatccttttatgtattatatgccatggatgcctcaaccacctatgccgtgtcatcaaggatggaagcaatcacctaggacggtaccaagtcattctaactcaagacaagaccgtttcccacgaaagaatcggtccggtggatcaaaggtgaaaaaggtgaagaaggtgtgggtgagaaaagaagccaaagctccagaggtcgttgctatcaaagaggagtctcaagatgttcatgtacctactggagatgcggtggaaaccacgcaagcaaaggagatcgaagccgacgccgtgactatcaacattggtggtctaaccgagacagctggccggtctaaccgccaatctacggccggtctgaccgaccttactggccggtctgaccgacggcttgtggccggtctgaccgggctcagtggccggtctgaccggggggcaatggagaagagtgggaaaattgagagcaacataggagcttccacttcgaccaaaaatataaagaatcattgtttagctcctggaaaataaccacagccgaagtggataccttccggcttatctcgctctcaaaagaggaggctacaacgtcttcgagtcataggtcaaaaagaagaagaggccgaagatgtggagaacaagacatgcaataatttggagcctcgaaaggcacctaggcaaatgtggagatccaaagaggtaaaagttaagagaccagtgatttcccatagtagagataaatccaatttgatgatagaaaaatcaacggtcgttagagataagtctcctacacatgatgctatgggtgttagtgcggtatccgtcttgccttcgaaatcgcgcaatctagaaaagccgattttgcttggggggcaagacattaatatgctcatcagggaaccaagagaagatgaacggcgatggatacaacatcacatctttgagccgccgtttgttggatgctaaggcaaggtatgagtttattgtgtttaccattatattatatgcctatgccatgttattagaacattgcttgttatctagcacatgtgtgtttttgcttatcaaattgatattatacatacatgttgcaaatgccagttctaggtagtagaattggtaggttggcatataatttgtttgaagtatgatttggctcatgactctttgatatttatttaaaaccaaatcatatgtgtttttatggatcaccatataagatatagatttcatatttattgcgccatgaaagttttgcttattagtaattcggctaatgtcaatggtcaatatgatgatttgctttagagtgattttctttaggaacattggcattgttaatattttacatacatgctcaagccgattacttacatttgtagtttattggaatctatgcatgtgacacatatgactttggtgattcattattgatcatacttcaattggctaagtgttttgatgccatgatgattattgtttcaaaagccatttgaattaatattcatctagacatgttagttggatgttataatttttcatatgtctagagaggagggattttggtccaatagtttgatacactaagcatttggttataatacgaagaaaggagtattttttactagaaaagccggtgcttgatttttatgtctttggatgaaattggccaaatcatagaccaggggcggtctgactggaattacacggccggtctgaccagtgatgaccagtggtctgaccggctctgcatggccggtctgatcggcattccgtggccggtctgaccgatctcgggcaaagagctggggggcacgttacaattgattaaaaggccgaattaattgtgaattcggacatttgtgcccatgagttagaaatagcttggagaattcctttgattagatatttgaaagatcctacacttaaggttgatcgaaagattcggtggcaagtgttcaaatattatatcgccgaaaaatagatggagtattacttagataatgatcaatctaaagttgctaggagagtagtacatgaagggattcgtggaattcatcaatcggccgtaagatgaattggttgcttagaagagtggaattctattggccgaaagtaattgatgattatttcaagtgctacagagggagtgaagcttgtcaatggatcggcaatgttcatttggcgtatgtcgctatattgaatcctatcattataccatggccgttccaaggtagggctttggatttcattggtcagatttatccttcgttatcaaaagggcattggctcgtgctagttgcaatgggttacttcactaagtgggccgaagccgtgccactcgacaatgttacttgtacgaaggctaatggataagccgagtcgagtaataaaacattgttgaaattgccgttttgccagttgaggtaaatcttggctctcttcggtatttcaagcaagacgacatgtcggttgaagattacaagaccttgatgggaagcaattttgaagacgtcattgacaagcgtttgaagacttcgaaggagatgaagacacttcaagacggtgttttcagagagcaattaatgggagatagcttgaagaaatacttcccgagcatttggtaagatgcttaggaagtcctatggccggtaattggattatcgccctgagataacatgttctatgcttttaggttcacgtatgttcaccaaaaaggcaggggggcatgtgtttacacccaaatttggcacctatggacgaaatagggaaaaattgccaaagtttggaaagtgccgggtttccttcacagggccggtcagaccgcaggtatatgggcggtctgaccagctatagggccggtctgaccgcaggtatgtaggcggtcagaccgtcagggtccgagtccgagtctgttttcgtcggatctcgggtttccttgctcgggaaggcatgtttcgtgtttcctttggtttctatcccgagttggacatggagaagggcctgtagagggcaagaccaacccctatttaagggacaaggtccggttcattgtaaaacccctgaatacaatctacttgaatcgttattttactatgttttctattttaccctagtttagtccatctttgtcggtttgcgccgtaaaccgtccgccgccgctgcgagagtgcgacacctctttgtaggtttgtcctgaaaaccttccgttttgcccacgagacgggtagctatcctcatatcgatctaaatcggcctagaggctgattttgatctctaaatcggctccgctagccggtttagcttttccttttgcaaaacccatcttgatttggccctttggctagatcgtggtggttggcgactccatatcaccgcaaggcgtttaggtgttgcgatcgtgcttgtcgacttgtcaaaaaagttgccaacacataccacatagtttgcacggtttatatggagttggtatggttgatggctctgattgctttgatgtttgaccaaatctctttctacgagataatcttggtctttttgaatcactagtttgattatcaaatagttgaccggctaatcctttcttgtacttagctataagcatctcaaaagtgagcttcggctttttggtcttttgggaactagatgactcatcctttgcaactttatgatctccggcctttgccgaggatccccaataattacacttttccctttctttttgccaacatcaatagaactaatagggagaggatcactaacaattccggtcttaggcatagatgtaaccgaaatagtttcacaagtgaccgatgaagtatcaattggcctttgctccatcaaacttgcatctttgaaataatcatgaaactcatgctccatttgtgaccatgtagaaattgaactaggagcaagcaaactataccatgtagatgcaaagttcgacaaagaaagggaaaacaacttcaacttaagcaaatcatcgctaccggccttaccacattgatcaataaagcggccgatatgctccattgtagtcatagcattctcacctgtgaatttcgtgaagttgggcacctcaaatccttgcgggtataggaccgaatctacatattcaggatacggcctttgatatgtatgcataactactttggattctattgcaccactatcccgcaagacattgtcatcatcttttccaacatccacatgaccgatttgtgattcggtcttaggtgacaatgctatttcactttcgcttgtgatacaatccgaaccgtcacttagttcggctatattttcaatgatgttattctctaagctagctacacaatctaaaccatttcttggttcggctattccatcgttgtctaaactagtaacacaatccgaatcatcgcttgattcggctataatggttattgcattattatccacgctagcatttaagctattgttatccactcggctttcctgagccagagcttcatgcaacacatgatcagtatcaagaaatatctggccattcaatttctctttaatagaatcaagcaatccatcatatgcaatgttggcctgtcgcgaccgagaaaattgccttttcccgaacgctagtgtattaatccccgtcccaggaaaagccggggtacaccaaacaaacatgatacaaaaggaacatctttattatatcgataatatttacattattacaaaggcacttcaggcctgacaaacaaaaataaacagcagcggactagcgggcctacggctccatcttcacaggcgctcaactggggtataagtcaggactccacctaaaacttcttctccaaagcttctcttactgaggggggggggaagatagagcaagaatgagtacaaccaccgtactcagcaagccacaccgggagatgcacgattaatacaaggggggtacaaggggtaataataatagggttgggttttgcagtaaacagcatttaaaagtcacttagttgcccaaagctattttgtaaacacgatcctagagctacacaatattattaatcaaggccgtgaaccctcacgaacctgccttaacccaaggcctacgatgattcgaaccaaactggcaacccgacctgggtcccagctcgtcccaagccaacccaggccaaccattccatattttagttgttaagcaaattttaagaattaaaccactaacttgggtacattgctaggcttgcccatatccgagggcacggctattcgaataggtttactctgatcagaggtgtacatctttacccacaagacacatctttactccgtattccatggccttggaacccgtcgtaaacatgtgacataacccttcacccatcctagccgtgaacaaaagtaccgacccaaccctgcctacggccggtatcccgggacaggcaggccaggattgagcccctagcaacaagatctagaccgggtgcgccacacacataggggtgagaccacccgcgtactagtccagtgccatggcatctcgactaacgggcactgacccgtgtagtcttcatttgcctagacatctcaattaccgagccgcagctcgcgtagccttcatttgcctcagagatatccatcgtcgcaacgacttcatccatctctatccgtgtccttttgttcaggactagactgagcaccgagttaagccttacccattagacatgtggttagtacggtagtgctttgcaacagaggcccgaagaccggtccttatagtggccgagttgctactagcaaaaccatgcacctcgaacgtagcctaaaaccattttgggagttttgaatagagggggggggtgtgtgttcaattccatcacaagccaatcattccacagtgtccaaatgatatgagcattcccaaagtctaaagttaataaaaccacctaatgttgcctaattaatcagcgaagcatctacctaaattcatactagtggaaccgttaatagagtacccactagttggggttttgtttatcctagggtgaacaaggtaataataaacaatagcaataataataaggtcataacaaaggtaaataggcatggctaaataaaatagtgataacgtgggaatttaaataaagcgataatgcattaatttaaatcaaaataattttataaactaggattcaatatgctcaaggatgatgcgacttgccttgctcagagagagcggccttccgaaccttcggcgatgaccgcgaaccacgcttcgggaacctccggaacgacagaagctacgcgaaacacacaagcaaagctacaagcctataaagaagcaataacaatacataaaaagaaagcacacggttctttaggttataacaaacattaggagacttgaatgggtcgattcagagttcgtatgaccaagatatgatcatccgaagtttaatgctattatatggagatttacggattattataattaggttttgcaactataaaacatgtggaagcgctagcctggaagagacaggaaggctgcgccgttgacatgcggaccccacatgtcaacctaaaggaccgcagtagaccgagtacacagagacggtccacgggtagacggaagcagaccccgtgtgtcaaccgaggtgagtggccgacaaacggactccactagacaccacgcgggctgcacacgtggaaacaacgcggctaccgagcgggcacactaacacggacactacacggtcaccacccgcacacgtgaacgactaccgacacaggtacacgggtaccggggtcgacagccgcacaacgggtacggggtgacaccaaaaggacgaggacaagggcgacgagggagagatccttaccaccacgcgacgaggcgtgggaacgacaacgacgaaggagcgcggcggagacggctcggggacgacggaggcgaacggcgagggaacgacttcggcggcgatccttggacgaaggtgagacgcggccggcgcagggcttgacgacacggagacgaggacgaagatgacgacggggctgcagcggctcgcttgatgaaccacggatggcgaaacacgatcgggaggacgacgaccggaacgggcgaggaggcgacgagggcagccggcagcagctgcacggaggtgaggacgacgtggaacacgccgctgcgatgcccacgacggtggcggcgcagcgagacgacgagccggcgaggaggaacgactgactggaggagtcgtcgacgaggacgaacggagacgacgataacgaacaccggcggggttcgggtggaggggaggcgaggccgaggacgacctttccgctgcgatgccggaggtggtggtggcgcggccgacggcgcacgggtggaggaagggccgaccggggaaattccggcgaggcggatggagaggccggcgcggcacggcggtgttccggcgaaacagaggagcagccggaggagagga

SEQ ID NO: 59806 - DNA, 812 bp, Oryza sativa
ttcatcatgactacagaaatgaacaatgttgctacatcttgtaataatttgtggttttcaattgaacaaaacatccatcaaatgatatctacagcaatatattttgcacttctgagcacacaataggtttgagtgtattcgagtcatggtcattgatttaagctttttatttcactacataaccattgatttgagtgtatctaaggagttctgtttccacaagtactttatgttaatggtgtctccttatgctttggccatccaaactcattactgttgtttaatatttttagtggttagtggtgtccaaatctttctttgtgtacatcatactatgtttttgtagtctattaaacttccatcctatcatctgacttgttatattccaggatgcttgtatacgaatatgtgaataacgggaacttagaacagtggcttcatggtgccatgcgccaacatggtgttcttacctgggaagcccgaatgaaagttgttcttggaattgctaaagcgtaagaaacaaaccatcgtccccgtcaaaaagaaaagaattgttcttcactttagctcttttatatgtatatgtttagttgcataacccattttccataactgaattggtatacaggcttgcttatttacatgaagcaatagagccaaaagttgtacaccgggatatcaaatcaagcaacatactaatcgatgaagaattcaatggcaaactttctgattttggcttggctaagatgctgggtgcagggaagagccatatcacaactcgagttatgggaacttttgggtatgttgatatt

SEQ ID NO: 59807 - DNA, 13406 bp, Oryza sativa
cgtcgagggaatggagaacctgccaccgaatagtagccctgctgtctatgttgcgaaccatcagagtttcttggatatctatacccttctaactctaggaaggtgtttcaagtttataagcaagacaagtatatttatgttcccaattattggatgggcaatgtatctcttaggagtaattcctttgcggcgtatggacagcaggagccagctggtatggctgtagtctcatccctgctttcttaagtagacatatatacatttacagtatttggtaaataaacaagattttatgaatcatatatgattttggggaaaacacaaaactctctttgttggctgccttgaacatagttctgttcacacagttatagcaccttctttaaaatgaagaactttgttgcatacacataaggccaaaccacataatgaattttgtttatttctatctttgaatgttagcatcgtttttgtttaatgcatgatcgccttcctatatatttgtagtatgtcaacattgtattccatgctgagcataacaaatggtttgttaaaattcaggactgtcttaaacggtgtgtggatttggtgaaaaaaggagcatctgtatttttctttccagaggggactagaagcaaagatggaaagctaggtgcatttaaggttcagtaaccaaacttaggttacattacatctaatgagatttttatattcagtatataatgttaaccttctcatggtgtactgacgtggttataaatgtccccagagaggtgcattcagtgtggctacaaagaccggtgctcctgtgatacctattactcttctcgggacagggaaactgatgccttctggaatggaaggcatccttaattcaggttcagtaaagctcattattcaccatccaattgaagggaatgatgctgagaaattatgttctgaagcaaggaaggtgatagctgacactcttattctaaacggttatggagtgcactaaagaaagatggtgtttttttttattatatggaacctattcaaaggcacagacaggctttcaaggctaagcttgttacaggtactgatactagttactaattactttcgtaatcagtataaataagcttgtgtagtgtaatggcattgtacatttctgcacttggtaaatttacagaagaggcaagtaatattttagaggattgagtttattcacccagtcatatagttgaagaggcaagtaacctgtaagagaggactgaacattaacacctcttgttcgattaaaaatgaccaaagagcatcaaacatgtattcgaggctgttactttagatatggcccattaatttgtttagttgtctatgtacatcctagttggtgtaaatgccagttaccatttctatgatctaaaacaatcaactcttttagtatattttcaaaaacgaaaattcagtacacatgtatgaatcttaatattcttctctagctcgttacaaaagcaacaaaggcaccgtgtcagctggttcacattagctagtttgtacttagcattatccactagcaccttattttcatgcatatcatgctaatttgcttgcccacgttgagtgggaatttttttcatgttttataatttatatatgttttagacttctagtccacaatttatgtacttcatgttcctgagcctctagtatggctgatagcagactaggtgctgagtgctgtccttttttgcagactgaagagagaagaaatacaagactgtccattgttagtcagatttgtaaaaatagactctgatgtagtttacttttgcccctattttatttttaacaatacaaatatataacagatcctaagaacttatcttaatttaggagaagttgctcgtttcattaaattaaattgtgaagtaaaaatgtgtgctcgagtctgtcaatgcaatcctgtgttcttgtttgaagatatggtgtagggcaggccaggattgaacactgaatggtaagactgcttctgccttcagacgttattgctaaatttttagctacttgcagttagtgctgccacgccgattaagcagtagaacaaagtagttttgtcgtgcacaaatgagttatatttcattggaaatcgaagcgaaaacgaatcaaaagttagaagaaaaggggaaacttggtaattactccataaagagagtgcattttattggtaagatggtatccggaagctgtgagctccgggctgtatgtattctggcaaatttgatatgagatgctcgattattggcttaagttagcgatatcaaatttggggaagcaccaaaggaattattgtgaaggagttatgggtgcgtgacgttatctgctaggttcaaatccttgtggctatgaatatttatctgctaggttcaaatcctagtgactatgaatattaatgggtaaggtaagggatttattgttaattttagtttctttaagattgtgccatcggacgccattcggtaactgtaataatgctttgtattggattcacttgtgttacatgcacgcactaaacatgtgctttaccttttcatctgtttttgcgttctgggctagaaactcaaacgttgaattttccatggtctgctcaacttgacaattactgcgtgtcaagcgatcttatacgcatactatgcgcacaagtgattgtatacggatatgatgacagtataacgtgtgatattgatttttttaataaaaaaatgatgttcctttccttgatgaaggaacaaagactttttttaaaagaagggtattactaaaaacaaaaatgacaaaaacaaaatatcagtgcacatggcaagtgtgctcggcaattttttctctgtactttaaacaaaaatacttctatatgttcttttttataagggtggcacaaatcttttaaatgagccaaatatctacattggatttattaaaaactgtataaattataatttatactctgaaaggttgtgtgcatctctcttggagaaaatgtataagttgcaaacaaacattaatccacgttatgtaactttttttcgccggaaaggccgaaggaggcctgacggagcgtggggctcctcaccgggagaccgcgcaggcccccctttgccggttcggccggggactcagggtgaaattctaagctctctgtatgtggaaggttcgcgaccgtcgaaagagcataagacacgggcgatgtatacaggttcgggccgctgagaagcgtaataccctactcctgtgttttggggggatctgtgtatgaaggagctacaaagtatgagccagcctctcccttgttctgggttccgaatctggaaaagtccagtccagtccccccctctaagtgggcaaggtcctccttttatatcttaaggggataccacatgcaccatctccctcctttctgtggggacttaccctaccttttcataaatggacggagatttgtatagttgccgtccgaatgaccttctgataggacggcccatacctacctccacttccgccgaaagcaggtgcgacgtgggattatggctgtctgctgacgacatgaccagtgtcagactggtcacaaattgctcattcctgtccaccacgcgtcagtttagcaatctacatgttggcccttcttcacacaacatcttgcctgtaatggttaggatgaagcctggcatatatctaaccaggactaacgtgccatctctaggaggtaacacgctagctccagctggggacgagcgcctagaagccctcgtcctgacgggatggggcgaggcgtgcgtcagatcgcctgtcgccacctaacccgcgatctgaccggtctgtgactggtcacagaccggataaacgagtgcactgcacttcgttacatgccgcgtgacacgctcagccaaaccgcaataaatgtggttaggtgagccccggtgtgctcacctaacccatacacgcggagcaaaaacccacgaggggtcggggcgcctcggccctcggggccgaggcgggtgcggtccgaccccctcggggggactaagaggagggcgaacacatcaccctcgggcccgacgtcccccgagggtgccaggccacgtgggcgattgtgtctgcctcaaacctctagtcatgatactcctgatcccatgtcaccgacagtagcccccggcgttatgccagggcgatcgccctctttaagggaagcggtcgggcgtgacgccactcctaaggcctggtgacaggtgggaccggtctccacaattgggcagaaacccaacggtcacaaatcacgcacatcggcaatggtaactctactatcaataatgagcggtctcttcaagactgccacattactcgagtagcacacgaatctggacatggcgattcgtttcgtctggagatatggtaacgtcgctttggtcggcgagcgtaattaacgcgcgcacgatatgatctatctcgactgccacaaccgcatatccacctcatgcgccgcaagcgggcgaatgggattagtggaagcgtgggcgcgagaaacgagggggcgaaatagtgggcgcgagaagcgaggagccgggcacagcgttggcaagagtataaaggcactgaggaaaggatctgtttccttcctttcgccatcatttcccttgtcttcgccgcttgcgccctaactccttctttcctgtgctctactttcgccacacgcgctcgctctcaatcttctcttcctccggcgccatggcacggggctccgctctgctcgatggtagcgtgctgccgccttcccgcatcgtgagcgagaggcaggctgggctgccgcgccgcttcatgccggaatctgccaccggccgggagatagtcacgctgggtgagggacgcccggcgccagactacccggggcggtccgtcttctttctcccctttgcaatggcagggctggttccgccattttcttctttcttcatggatgttctgaagttctacgatctccagatggcgcacctcacccccaacgcggtgatgacattggccatcttcgcgcatctgtgcgagatgttcattggggtgcgcccatctcttcggctgttccggtggttcttcaccgtgcagtcggtgtcgccgccatcggtagttggtggctgctacttccagccatgggggccggtgctgaatcgctacatcccctgcgccctccgcaagaagtgggacgactggaagagcgactggttctacacccccctcgccgacgaagcgcgcctctgacttccgagccagcccccggcgcaggcctccagctggcgggcgccggtagatctgggggatggctatgacgccgtcctcgaccgcctggcgggcctacgatcccaggggctcacaggggccatggtgtacggcgactacctccgtcgtcggattgcgccgctccagcggcgcgctcggggcgcctgggagtacaccgggtccgaagactacatgaggacccaccagggagtcagatgggactgggctcctgaggatttcaagatagtggtccaacgggtgctgaatctcaactccatggaggcgtccctcattccccaaggaatcctccctctctgcagcgatccagaccgcgcctccatcctgaccattatgacggcggtcggggcctcagaggagtgagctccaaagggccacgacggcgcaggcgggagccgtaggggggatcaatctaccccgggagggggtcgtgcttctgggtctcgcgacggaggcccgaggagcagccgccctgccgacgcccgggggaagaggaagcagggaggaacacctcccccatctcctccccgagggggcggggcggtgcgtgccaacagcaggcgcccggagggggccgcgccgacatcgcagcccgagggggagcgcaagaagaagcggctccgcaagatgggggagacagaaccatctcggggaaaccttatttcccctccaaagtggtcgtttaaccgaccccctcgcaggttcgtctctcacccatcgtggctgtattcattctctcaacgcgagttttcactcacccatcttgttcgtcttctggtcttttcttctgtttcagcgagatcccgtcgcgtccctcccgccattccaagtccggccagtctgaggccgaggatccggcggccgcagaggcccggaggcgggaatctgaccggcgagaggccgcggatcgcctacgggaagccgaggaggccgcccaggaggccgcccgggctcgccagggcgaggaaaccgctcgggaggaggccgcccgggcccgccaggccgaggaagccgctcgggaggaggccgcccgagcccaccaggccgaggaagccgctcgggagaaagccggatttcgccaggacgaggcaatggcgacttccgaggcagctcgcgatgaggtcgcgggcgcgtcgcttgagcccgcttcctcgggcgacgctcaggcgacaacttccggggcagctggcgacgaggctgcgggcgcgtcgcttgggcccactccctcaggcgacgcccaggaccaaccaggtctgagggacatccccgagtccggcacttccatcggcggcccgagccgcgtggcatcctctccaaggcggctcttccccacgccttctatcgccccgctgagcgcagagccccttctgcaggccttggccgccgcaaacatcgcggtgttggacgggcttagtgcccaggtggaggccctgcaagcagagtgggcggagctcgacgccgcgtgggcgcgtgtcgaggaggggcggcgctcagtggaggccatggtggaggtgggccgcaaggcacaccgccggcatgtctcggagcttgaagcccgtaagaaggtgttggcggaaatcgccaaggaagtggaggaggagcggggggctgccctcattgccaccagcgtgatgaacgaggcgcaggacaccctccgccttcaatacgggagctgggaggcggagctagggaaaaagctcgacgccgcccagggggtgcttgacgttgccgctgcccgagaacagcgggcgggggagaccgaagcggcgtcccgacggcgcgaagagacccttgaggcgcgcgccatggcgctggaagagcgcgcctgcgtcgtggagagggatctggcggaccgcgaggccgccgtcactatccgggaggcaacactggcggcgcacgagtccgcctgtgccgaagaggagtccgcactccgcctccacgaggacgcgctcaccgagcgggagcgagctctcgaggaggccgaggccgcggcgcaacggctggcggacagcctgtccctccgcgaggcagcgcaggaggagcaggcgcgccgcactctggaatgtgtccgcgccgagaggaccgcactaaaccagcgggccgctgacctcgaggcgcgggagaaggagctggacgcgagggcgcgcagcggcggggcggctgcgggcgaaaacgacttagccgcccgcctcgctgctgccgaacataccatcgccgatctgcagggcacgctaaactcgtccgccggggaggtcgaggccctccgcttggcaggcgaggtagggcccggcatgctttgggacgccgtctcccgcctagatcgcgccggtcggcaggtgggcctctggagagggcggaccgtaaagtacgccgccaaccatggaggcctcgcccagcgcctctcgaagatggccggggctctccaacggctccccgaggagctcgagaagacaattaagtcatcctcgagggacctcgcccaaggagcggtggagctcgtactggcgagttaccaggccagggaccccaatttctccatggatggcgctggatgagttccctcctgggaccgaggacagcgcgcgcgcaggtccgggatgccgccgaccatatcgtccacagcttcgagggctcagcccctcggctcgcgttcgcccccaactccgacgaggaggacaatgccggtggtgcagacgacagtgacgatgaggccggcgacccgggcgtatcggattgatcccccaagcccccgccattcttcagttttttcttcttttccttcttctaaggccttcgggcctcttttttgtatagatcaacttaatctgtaatcaaaaatgaagaaatttttgtgtcaatttcatcttgctgtgtgtatgagatgaggatgatctgtgacgtggtccttttgcgtcttagcttgattaagggctcgtgcccaggtcccagtcctcaaaaggcgtgggtcggggctagtgcctggggagatccacatgtcgagactggccaggccgggaacgtggtgaccgagggttatgggtgacccgattgtgggtttttgccgattcccccccggagttcaccacgccccggggcacggctcggttctgggccccgtttggcgattttagccgacccgagcccccgagggcaggattgagcacgagtgacctatttcaagtcaagattcttcaaaaggaaaaaaaaacacagatacagcctttaggaaattgaaactgcttttattgaaatactgaaataagagaaataagaatgtgcatgtgtggcagcccccggccaaccctgcacgcccgagggggtgcggggttggcccgagcccgaaacctgacacccgacccccccctcaggggtagaagcgacgaaggtgttcgatgttccacgggttaggcagctcaatgccgtcgcccgtggccagccgtatggagcccggccgggggacgccgaccactcgatacggaccctcccacattggtgagagcttgctcaatccagcacgcgtttggacgcggcgtaggacgaggtcgtcgacgcagagtgatcgggcccggacgtgacgctgatggtagcgccgcaggctctgctggtagcgcgcggctctgagggccgcgcgtcgccttcgctcttccaagtagtcgaggtcatctctgcgaagctgatcttgatcagcctcgcagtacatggtggcccgaggagacctcagggtgagctcggatgggagaaccgcttccgcgccgtagacgaggaagaaaggcgtttccccggttgctcggcttggtgtagttcggtttgcccagagcaccgctggcaactcctcgatccatgaatcgccgtgcttcttgagtatgttgaaggtcttggttttaaggcctttgaggatttctgaattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaccgggccgtgatgcccttaatgaatttaagtgcggagtgcttatcgatcttgacgaccggataagcctcgggccacttagtgaacttgtcgatcgcgacatacagatactcaaacccgcccggggcccgcctaaacggtcccaggatatcgagcccccagacagcaaatggccacgaaagtggtatggtctgcagggcctgggccggctgatggatttgcttggcgtggaattgacacgctctacatcgccggaccaggtcgaccgcatcattgagagctgtcggccaatagaaaccctggcgaaaagctttaccaaccaaggtgcgcgaggcggagtgggctccgcattcgccttcatggatatcggcaagaagcacaacgccttgttcccgaggaatgcacttcaggaggattccattagccgcgcgccgatagagggtcccttctaccagcacgtagcgtttggagatgcgatggacgcgttcactcccttcgcggtcctcgggtaaagtcttatctgtgaggtatgcttggatctcggcaatccaagcaatcaatctaagggagctgggagcgctcccctcgggtcccgaggcctggacttcaacgggcctcgggggccggtcaggcgcgtccgtctcccctaaggggtcgggtcgcgccgacggctgggcaagcctttcttcaaaggcgcccggtggggtctgggctcgcgtggacgcgagccgtgagagttcgtcggcaatcatgttatcccgtctgggcacatgccgaagctcaatcccgtcaaaatggcgctccatacgccgtacttggcgcacgtaggcgtccatctgcgggtcagagcaccggtactccttacagacttggttaacgaccagctgggagtcgcctaacaccaggaggcggcggatccccagtccagctgccactctgagtccggcaaggagtccctcgtactctgccatattgttggtcgctcgaaagtcgaggcggaccaagtatctgaggacgtctccgctcggagaggtcaacgtgacccccgcaccggcgccctgaagagacagggagccgtcgaactgcattacccagtgggcggtgtgaggcagctgcgaggggtccgtgctggcctcggggattgagacgggctcgggagccggggtccactctgccacaaaatcggcgagagcctggctcttgatagcgtggcgtggttcaaagtgcaaatcgaactcagaaagttcgattgcccatttcaccacccgtcctgtaccgtctcgattatgcaagatttgaccgagggggtaagacgtaaccacagtgacccgatgcgcctggaaataatggcgcagtttcctcgaggccatcagaatagcgtaaagcatcttctgggcctgagggtatcgggttttggcgtcccggagggcctcactaacaaagtagacgggccgctgcacctttcggtggggccgatcctcttcgctaggggccgcatccctggggcactcttcgtccaagcagcctcgcggggcgcacttgtcttctgtgctgatgacctcggggtcggaggataacaggggcggccttcccacagtggctttggggccgtcctgggggtcaggggctcctggcgtcgtcggacaagcgggcaaagggccaactccggtcgtcaggggccttaggcctccgttcggctcgggggcctcttctccctgctctttcccgggtcgagtcagcacagggttagcctcggggtcaaagggcgataggtgcggccttcccacagtggcctcagggccttcctgggggtcgggggctcctagcaccgtctgacaagcgggcagagggccaactccggtcgtcgggggcctcgggccaccgttcggctcgggggcctctcctccctgctctctcccgggccaagtcggcacagggtggggaagcgcgaaatgagaattgtcctcatcgcgctccacaaccaatgccgcactaactacttgcggggtcgccgctaagtagagtagcaagggctcgtctggctccggggcgaccagaactgggggagagcttagatacgccttcaactgggtgagggcattttcagcttccttcgtccaggtaaacggtccggagcgtttgagaagcttaaataagggtaacgccttctctcccagcctcgatatgaaccgacttagggcggccatgcaaccggtgacgtattgcacatccctaagtttgctgggggggcgcatccgctctatagcccgtatcttctcggggttggcctcaatgccccgggcagagaccaagaacccgagaagcttgcccgcaggtacaccgaacacacacttatcggggtttaattttatgcgggcggagcggagactctcaaaagtttccgctagatctatgagtaacgtttcctggttgcgcgtctttacaaccaagtcatcgacataagcttcaatattacgtcctaattggctacccaaagaaattcgagtagtacgttgaaaagtaggacctgcattctttaacccgaagggcattgtcgtataacaataggttcctatgggggtaatgaacgcagttttttcctcatcctccctagccatgcgaatctgatggtaaccagagtatgcatctagaaaacacaaaaggtcgcaccccgcagtggagtcgacaatctgatctatgcgaggcagggggtaaggatccttaggacatgccttgttaaggtcggtgtagtcgatgcacatccgaagcttgccgttcgccttgggaacgaccaccgggttcgctagccactcggcggggttgacgctgccatcatatttttcggcgatggtgggccggaaccttgggggccaacggacattccgaagactcgccacaaaggctctacagccgacaccaccaaccgggggcacggagggctgattcccgcgtccgtgttgaggtgacactctggacgaggaagcgccctccgttgcgtgggcagcacttcggtcattacgccggcgctcgatgctggtgcgggcgtccggccccccacgcagatctttctgggtcgaaggagtcgacgaaggagtggcggccgaatggcgaacagcggctgccgctcgtcgtgccctccgtcttgacgacgcggagccggtggtagcagcaccagaggccttggtggcggaggaccgcccaccagcatctaggcgctgccgtaccgtcatgactaatttggccacgtcgtccagccatcgttgggctggagactccgggtcagggacgacaggcgggtgacgtaagagcgcgcccgcagcttggagcgcgccctggggcgtgctgccgtcgccgtagacgaggaggcgacgctccccatctcgccgttcttctccatcgcccgcgatcggtgaagtcgcggatctttcgaccctctcgagcgcctccccccgcttaggactttggcgtggagggagcggtggagtacgagctcgacggcgtgggttcggctccccgtcgtcgccactcacactcggagagaggtcgtgcgcctttgcttgctcggccatcaggctgaacaggaaaagcttggcgcacacggaagagtacgagagctcagaaaaacacacactgagtcccctacctggcgcgccagatgacggagcgtggggctcctcaccgggagaccgcgcaggcccccctttgccggttcggccggggactcagggtgaaattctaagctctctgtatgtggaaggttcgcgaccgtcgaaagagcataagacacgggcgatgtatacaggttcgggccgctgagaagcgtaataccctactcctgtgttttggggggatctgtgtatgaaggagctacaaagtatgagccagcctctcccttgttctgggttccgaatctggaaaagtccagtccagtccccccctctaagtgggcaaggtcctccttttatatcttaaggggataccacatgcaccatctccctctttttggggggacttaccctaccttttataaagggccgg

SEQ ID NO: 59808 - DNA, 41269 bp, Oryza sativa
gaataaatgaagcacataagagatgtaagagttgattatagtaatacactcgacaatgtgcattaagaaagaaagagtacaatcaatatagggataaaaacgggtaaggtgtttagcaaaaatataaaagggagcagggaagggagttgccggaccctaattgaggaccggaacggggcggcagggggctcaggacatcggaacggacggaagacacaagagggcgggcctaggagcggaacgttctcgcgagttgacggcactgggctcgaggcgcggcggcggctcctggcttggcaccggcgcgcggtgggcaagggcgcccgcgcaaggcaataggcacgcgacacgacgacgggacggcggcacggcgacaggcaacgcgacacggcgaggaacgccggcgcgacgacgggcaacgtgacggctacgcggcacgccagtggcacggggcgcgagacggcgagcgcgtggcgcgaggcgacggaacagcggcgcggcaatgtgaccgcgacaggcgacgcgacggcaacacggcacggcatcggcgcggggcgcgagaagaaagccggcgatggtgacggcgcgtgtcggctcgggcacggcagccggcgatggcgacggcgcgtggcggctcgggcgcggcagccggcgatggcaacggcgcgtggcggctcgggcgcgacaggcggcgatggcgacggcacgtggcaccaggcggtgatggcgacggcgcgcggctgctcggggcataaggcgcgcgcggtaggggaaagggcagggctagggaacctcgtcgagcacttacagcgcaatgaacagtgatttttttctatttttccaatttggttgtttttcctattcaaatcttgtcccaatatttctaattttcacacaagtgaggttctcccaatgtttgagttattctaatcggagggttcacccgagattaatattatccctatttatttttatataatttgcttgaatttaattagagtaaattcttatcccatcgcacctaaatttaattgttaccaatatggtcgcgataatattttatttatttccaaccttacctaatctttattttaaattatattttaatcagttattttgccaatctaattttagggtttattcctaatgaattattccttatttgcgatcggtaaactttgaaaccaaattccaataaaataggcaaataaaaatcggcatgatgcaatttattaaaaagtttttgaaggcccatatttttagagttttgattttcgttggtcgaattttcagggtgttacagagagagaggctctgcctccgggatttggacgcacgcggcttggagcgaccgagcatgggcggctgcggggcacaggcgcggcggggccgacgtggcggcgaccgggtggtcggccacgcgcgagcgcgcgcgcgcggctgcgagggcgcggccggattcaaacggcaacggcgggaaaccggcgctggtgggagagctcaatgagagagagagaaagagagagagagatagagagagagagcgaggaagagaagagagggaatggctctctcgcgtgcgcagcgcacgagcaagcacgtgaggggaggagcagcagaggggagagaaccaggctgagaggagatgggccgaaggagggaattggcccacaaaaatccgagggacgcaaaatagactttgacagagagattgaatttggagagaattggaggttagaaatggaatttggatatctttagagtcagacgaatatttggcaaggttttgagatttggaatttgaattccgaatttgattacttggactcagggaaacaaggaggagtcaacaacgggattcaaaaggggaatttgatatttttaggattgggacaatttatttggcggggattcaaaggatgcgattgacctttggaataattgaattggaattgggatcttgaggtggaggattttgttgccgacgagaggaaataacgatggatttgaattgagatccacggcacgacttagactcagcactcaaagaacgaaaattttcgcatataggattttggcgaattagtttttaacgtcccacgaaaagcggagcgttacatgttccttcacttacgcattgattttgtcttatagttgttctttgtatttgtctctcttcttataacttgatgcgtcttgtggaaaccctatcttccaactcgtctttgaggacaaaccccttacacgtccagagtgttcggcagtccccaacgccgcagtaagctggtctcgctccctccgtgggacgaactgtcctgctctttctttctcgactatctgctgcaaattagtagtcacttgttctatgtctggagtctcgaatagtatgtctccctcatccgagacttgacctgtgttgtgcgcccaaacccagttcttgctacgttccaccatggggtctaccagcagaggtttgccggccgctgcaaatctctgcttggtctcccgccattgatcgacgtgcccagcgtatccgattgacccctatctatgggtatatttgttcttcttcgcgaggtctgacattttttttcctcaaagccaatgcttcaactgttgtatgatctttaacaaacgtattccagtcagcctgcaatatatgtccaaattccgtgaacggtggcagattcttctgatcataatcccgatttagatcggatccaggagggtacacaaaatacttctgcaactcattccagagaagtgtcttgatgttgtcgtccaccgtttcccataacttgacattaatgggacaacgcgtcctgattagagtgccacaggtgttgctaaacttggaccgcactatcggtggctcgacgggcttcccatcctgatcgagagcaatcatgttgtaaatttccttgggtaatttattcttgcttctctcaccacgtctttttttcccactcccgcctgcacttatggatgtatccgtacgttcaggtgcagacgtagcagtgtccatctcaacttcttcctctctcctggtcctcgcgactttacgtttcgagcagcatcagacttccatctgcatagtataggtaactctctacaccattaggttcatgtcacatcatagttagtaaataatatatggctaacgatgttcagcacttatggcctgttccataggtatgtagtctggatcatcatcgcgaggggcgacttgtgttatttccattggaaacgggtcacttggtttgcgccacgtttctttactaaaagtgtcatgctgcttgttgctaccggattttttaggagcggtaccttcttgaggcgctattggtgcgttcgatggaaccttatcgttcgacatcttccaacttgacgtaaaaaaaaattggcataagtcccaatttaacataatttgacatatgtcccaatttgacttaagtcccaatttgacataattccaattttaacatatgtcccaatttaacataagtcccaatttaacataaatcacaattttaacataagtctcatttcaacataagtcccaatttaacataagtcttaattttacataagtctgagattgacacaagtcgcaatttaacataattccgagattgacatcagacccaatatatgtaacataagtgccaatataacattcatcccaatttaacataagtcccaattttaacattagtcccattttaacataagttccaatttaacgtaagtcccaatttaacataagccccaattttaacataattcccaattttaacataagtcgtaatttaaacaatctcacaattaaactaaagtccacaattgcacaatttcacaaaagtcccaatttaacaatccacagctaaacattctcaaaattaaacaatccacaatccacaattgcacatttcacaatccacaattaaacaatacacaatgcacaattgcacatttcacatttcttttttttaaaggaaatagtaccgggggacttgggaccggaggagccggcacggcggtggtggggaggtattgccggtggtgacggcggtgacagagaggggtaggacttcggggaggacccggcgtggccttggcggtgaggggccgggatgatttgcgaaggagccggcggtggcggggaagacttggcggcgtcgaggggccgggaggacttggggaggagctagcggtggcggggaggacatgacggcagcgacggcgagggggccagggagaggtcctggcggcggcaacggtgatggcgagggggacgacttcggggaggagccggcggtggcggggaggacgtggcggcagcgacggcgagggggccggggagaggtcctggcgacggcgacggtgagggggacgacttcgaggaggagccggcagaggacttggcggcagcgacggcgagggggccaaggagaggtcctggcggcggcggcggtgacggcgagggggacgacttcggggaggagccggtagaggacttggcagcgagggggaggtcttggggagtagccggcggtggcggggaggacttggcggcggcgacgcggcgaggggggaaattttggcagcctggcggctagggttcgcgggtgccaggacttagaaaattttcgctccccgcgctccctataagaactaaacaattagatgaattcttaggatgtaatttcaaatcacaaaatgatttaggttaaaatgacccaacaattcgaattaagcgattccgcgaactttgttgtcaatttagaaagagtgtttcgcgttcaacgtttgtgtgaattatttggatttcatttgaattctaactgaattcaaattgttccttcgtacgtaattatagagcctgagggagttgcggatcaaagtgaaggtcaagacccgcaagactttgagcaaggcaagtcatcgctattctttgaacatgttgatcccaattgcgaaattattttgtttacaaataagtttgcatgcaatgataaacatcctacttgtgattatgccatgccttgattattgtttacctttaaatctttgtaaccataaatacgtattagtccttagtcaattatgacacttgcttagaactgctattctagacttatgcacactcatattttatcaaatgctatatgtttggggcaattatctttgggaagataattgagatgcggcatgtggagacgtgagcgccacattgccatgataacaatggcatgatttgagaaagtaggaatgaaattaaatacatgttttagactggggtggacggtgaatttgggtggtatccgggaaaggctagtaccgtccccagtcaattaaggaccgagccatgaagttaagcatgaaacgaccccgtacaaccacacttctcgtatggggatagacctagcagagtaaatagctgagcagaggcagtacccaagcatagtggtttcttgatgtgtgaggcaggggctctacagtggcattgccattggtaggactgccatatgataatttaaaacatgattataacttaatgtgtgtatgaaaagctttccttcccgggtgcgccagaactcctctcactgctagaaactgtgtacgcctagagtgcatgaggatgaaaagttcatggagcgggtactgccaatgcgaggttatcgaaaagctttgccgtgacacgtttcatgtgttgagacgaggctcatgtgttgggcagtcgcggagtgtgggtaaagtgtacatccactgtagtgtgagtaaaccaaatctattcgaatagccgtgctcgcggttattgagcaccgggacatgtattacacttggctagactctaaattcttaactggtgtgggatgggttattgcatgatgaattttatgctgttggagccacttcctgagaaaggggaaggtggacgtcctcagaaaatcatgacgattcaatggcgggaagctatccttaggatcacaatggatggtggacagaaccgtcgttgtttaaatataaacactggtactaaaatttgatcagtcaatgctaggtcttaggcttgtgaaaagaattacaaaacttgctttgcgcaaaagaaccatagccatcctttgaaatacccctatcatgtgtattgttgatgtggtggcttgctgagtatggttggtactcacccttgcaaatataaacttaatcagaggccggagatgaagcttcggaggacccctatgcctattaccaggagggtgatgaagacgatggagctcaataggtcttagtgacggtcgttgcctgtggcaatggcatgccgctgccttaattccgctgcctcatctatttctgcttttaggatatattccggactgctcggtccgatgatttaagactacgcctgcgggtttatgttgtaataattcgcactagactctcgtgtatgtgcatttggtatttcagctatgaactcgtgtgtaccagactacttgatccagggaaatggtactgtttacacgattgactcttgttataaaaacgggggtccacacttttactcttaaattcaaggatatatactggttgtaaattttttttactgacaagatttaacatttgtaatatttttatactctcaaaatcaacaaagagtaaaatctttactcctgattttagatatttgttccggtctatcaaaaagtatctcgtggtaatggtacctcatgataccaaatcgttttcgatcgttggatctaacaatgaccatcctgcccagttagatccaacgatcggaaacgatttagtaccgtgaggtaccggtacctcgaggtaccttttgttggaccgaaacaaatatcctaattttatgcatgtgtagggatgacgtaaagagagagaggggaagaggagcccatcgactaaagcagaaaaggacaatgagagacaagaggtttttatttttacaaaaaaaaacttgttaaaacctcgcgcgttgcagcgggatattttgttgtgattgttggtttcatttggtaaactgtagtgttataaaaacggtaataagttcattttaggtccctcaatttgtcgtctagtccgaaattcgtccctaaaccgcgataccagatatggcacgtccgttaattctcaaaaccagtgcaaataaggtcccaaggtggtttatacaatggttttggctgatatggcacttacgtggcattgataaaatcagaaaaaacaatgggaaccacatgtcatcaattgttcagttaaaaataaaaaaatacagtgggaccaatgttatctcctctctttcacctcttctctccctcctctctctccctctttgtgttcagaggagagtggcatggcgagtggaaacattgttgagttgtgatccaaattcatttgcacttaataaaggccagcttctgccgtagctcagaggcacagctgatgcttgcttgaagtttggcaggactgataaggggcttgttggatatgtggattcagattttgctgcagatttagataagagaaggtcactcacaggttatgtgtttaccattggtagttgtgctgtgagttggaaggcaacattgcagcctgttgttgcccagtctaccactgaagcagaatacatggctattgctgaagcatgtaaagaatcagtttggctgaaaggattgtttgctgagctttgtggagttgattcttgcattaacttgttttgtgacagtcaaagtgctatatgcctcaccaaagatcagatgtttcatgagaggacaaagcacattgatatcaagtaccattatgttcgcgatgtagtccacaaggtaagctaaaggtatgcaagataagtactcatgataatcctgctgatatgatgacgaaacatgttcctgttgctaagtttgagctttgctcaagcttagttagtatagtgatttagcccgagaggctattttggcgccgaaagtgtttttttgtctttgttgtgttcagggtgaaggattgattcatgctacaagaaggaatttgtctcgaggtggagtttgttgagttgtgatccaaattcatttgcacttaataaatgccagcttaggccagcacctggggacgcctgggggatgcgggggcggagcccccgcggtatggatcgtcatcctttttagggttccaccatatatatacctattgtaagccgccatgcggtgatgtaacctcacctcagatatagtgaagatattttgctggctggcgcccgtggtttttttctctcctattttgggaggggtttccacgttaaatctcttgtcttctgtgaatgatatattgttcttttatcgtttgttcgcctatcgtttcctaacaagcatgagctcattgcggcagtgttctagtaggattctggccgccgctcgtgctcgcgccagcgccagaaccctaagacgtcgctggagccccggcgcactttattcacggcgcagagtgatgccaccatcgacgacctaggctgggccacctcaccccgtcaaacgagctccggcggatgcttgtcctggcggtcgatgtctataactcgatatatatgtgaactgacatgtctccttccaaatcaagagcagcagcatcagcttacccactctttgctctccctcactgctatacacttaatggaaaaatggtcatttcccacaagttcaaattatcaatacaaagctagttgcagtgtccagttcttcgatcaccatctaagctctagctgcagcatataattcagagctagtggccatagcacgtactactagcttgatccgtggctacggtggcgtcgctagcgagagacccgaagtggcgggtgatggggccggatggcgcgatggtgagggtggagcacaagaacggcttttgggccaccatggcgggtttggaagatcggcaccgacgaccatcggagggcggtgcacggagtcaaggtcggcctcacgctcgccctcgtctccatgttctaccacactaggcccctctacgatgatgccagcgccgccgctatatatgtgggtcgtcatgaccgttgtcatcgtcttcgagtacaccgttggtaattgtgtgaccgatcgttgactgtcagcatcacacgtatgtcgcaacgacgtagatggaatgtggcacgtgcatgcgttgcaggtggctgtgtgtacaagggattcaaccaggacaccatgacggtgaatgcagggacagagagggagtggcctcgacgaggtggaggccagcgggcacggaggcagtggagggggtagcggcacgggagaaggaagagggtcttcatcatggcgaaggtggtggaggtcgcacgagtggcggccagaatcccacaggagtgccgcctcaacgagctctgccgcctcgtgcttctcctcgctcgccgttcggcgcgctctcctctgaacccaagagagagaggacggaggaggaagggagagaagagataggaaagaaagggatgacgtgggtcccactgtaattttttatatttaatcaaacaatcattgacatgtgggtcccgtggttctttttaacttaatttgtcaacgcaagtaggcaccatgtcaaccgaaatagtcatccaaactgcttgggacattatttacattggttttgggagtagggggacgtgtcatatctggtattgtggtttagggccaaatttcggactctgtgacaaattgacggacataaagttaacttgtttcataaaaatccctcactgttgaattgggccacgatcaacttagatgggcctccagtggtggaaaatatacatgggctcatgtggtggctgtgtgtgactgggttgggttgtgtttaatttgaccatatgctatgttttttcatccaacggttcaaaggcaatcaaatctactgatccaacgactgagaattgacgatgacgtgaaaattgaggtttgagtttaggatcttaattgcagttagtgggttataattttacagtaagaagtgatgtgcggtggggttgaggtgttcgatctggaccattcttcaattgatacattaaggacgttgtatatttgcactgagaccggggtttgcacctgatacttcccgtgtataattgacacatatattgactcactaatataacctcagcaccatacaagctttaaaaggtcacaatatatttatctcaaaatggacttggtttcaccaatatacgcctacaaatgtggaaatttttagcacgaacgataaacagcagtaatatttcctagttcttacaagcatggttgacttataaatagtactacagcatacttaaagtagacaaacagtgcataaaaaaaacatattgctcccttaaacaacattgtcatgttctggcctcctgatgatcccagcatgagtgagaagtgcccagaggattgttatcagctcgcctcccctggcaatggcctttgcatgtgcctttgtattgtcggaaggagcaacatatagcatcatctctgaccaaaactcagcaagcatattccaccccttgttttcattctgaattccatcaaccagctgcttgccgagttgtacacctttgcacaccacctcattgctctttgatttttcactcagtaattgcatcatgcggtcaaattcgaaacacctcatatcagtgctgcccaaaacagagtcggtgatcttcttggcagatttatacaattcttttgaccatggagtgtcatctggcagtagctctgggcacgatgctagcaaatatgcacagtactttgacaagtgaatggcagtgatcatatcatcattctcatcaggagagctatgacgttctgaaggatcatgcatgtgcctgatctcaaagatgcaagttgcaatgtgccaaacaagaataatgtcagatgtcccttcaccattgcaagcccaacgaatatcgtcacgcagatggcacttctgcaaagatgctatgccattgctcagctgcccattgctacctttaagtgagttgatgagagcagccttcaccggctttggtatcttggtaggcttcattgctttagacagcctgaataggtgcctaatatgacctttcctcttgcaaggatctaatagagaggtcatgcccattttgtcaccccagtaattcatgagcttgcatctgcaccacagaaaacaagcaatcaatcgtctcatgattcgagacttttgccatgatggctttgctgtgtaggcgcaaaccagggtaactttggtccagttagagcaaacgtaagatatgatctcccatacctcaccaagcaaaactaccagaagaagggagatcgttggcaccaacacgaacaagatgcttccaatatcatgaaatctatcattatcttgttcaccgcatgttaattcgcaggacattaccctgtagtccttatactctggaagaattttccaagccagtgtaatcacgatgaagatgcaaaatgccatggtaaagagtgaggtcatgatgctcataatgggcaaccacttacccaaatgggagatcgggtgggacgagtaatagaaatcccaagcaaatgatagctcatctgtgataaccctgaacacagcttcaggatctgcgtctgccccatccgtgagcaatataccacgaacaaagtgaaaggccttctcagaacctgcctcaaccagtgggtacctagcaaatcgccttcgcagaagcttaaacaatgagaatgacatgcagagatgtttcagtgctggtcttggccccaaaagagcatcattcatttctgccaaatgccaaactttgtcaatggttaccaagttaccattgcttgtcatcgcacttgtcccgttctggctaaaagtgctacgtttgaagtgataaccatgaggtcctttctcaatctgttgtttgtcttctcccattaccacgagtgctaaaagcctttgtattgtcacctctgcaacttctgatacctgtagtctgtacaattcttccatatatccagcaataagactaggattttgtcccatagcgaaggagcgccgtgccctcccgtatgcaacaaattttagaataatcttgatgaaaccaaggcccagtaatgttgatatgatgatatctggcaattcttcggtttttttttgtgtagtagtacaacacaaggaagaaggtccaaatctgtcgagcaagcatcgctattgattcaaaattcccaccttcatttccattatgaacggcagtcaatattgaacttgtattcatcccaaccattggcagcagcgctgcccatagtagcagacagaatgcgcggttgtcaacgcattccaaaccgtgaaacaagttgtagtacttgtctctgccgacgtaggagacaacataggagaggattggtaggactagagtggatgctcccagaaaaagatagcggttcaaagcaatatgccggtaacgacggccataagagccagctcccacaaggatcaccaccaagaatgcattggcgacgaagagcgcattcgtcgtcagtacatctttgtttatgcgctctatcaagtcgtttgagcggaagccacatgtggtagacgacattatagcttttatagatcttgcaaccttgttgtgacaatctggtttacatatattgcacattcattagggttagactggaaaaagagttagcttataattaagaaattaaccacaaagttatattttttgtgtccctatttattctcacatgtttgaagctcttacctgacctatatggaacaaatcactaaaataaacaaaaaagaaaaggaaaaaagaagaatgtcccaaaaataccaccttgaatttcaatgttagaaatattccactctaaaacatgttctccttgatttatgccatcatagacttgacattaggtcaaaaatattttttgtagctctcccaacgttaaatttaactggacagtgtaattaaatgaaagaaatcaggtttggggtggcatatatatttttagctatgatattctgggtgacatatatcaaatctatgtattatataccaaaagtccactaaacttcctataaacgctccaaagttgtcacgtagcgcttcaacaagcattcctaggcccgccatgtggcattctacaatcccaccatcgattttatgtcgcgtcccaaatcgaccctaaaatagatcctctaaattatgcctagaataattaaaatacttatgaaatccttcaaaaattaaaatgtgcaaagttaaaagtcaaataaggcttggaggatttttgtatatttcctaaaagcctaaaatgtgtaaataaattttagtggaattttcagagcacaaataataattattaagaaataaacaaagttaaaatgattttataaaagaaaaaccttaaaatcccccccctccccctcttgggccggctcggcccatctcccttcccctctccctcctcctccccgcggcccactcggcctctccgagcgcgcgcgccgctgacgggcgggcccgcccgccaccctcactgacgggtggggcccacccgtcatccccgacctcccgccgctcccgccgctccgcctgcgccaagcgccgccgccgccgtcgaatccgccgcatcccgccgtccccgcgtgcatttaagtggggggaatcactccccgtgatcccctctccctttccccccaattttccctccctctctcccttggattcgtttggaaacccctcccctaatcccaccggcgccattgatggagcccgagaacgccgcgccggtttccttcctctctcggccgccctctctctcccctgccctatttaaaccctccccgcgcttctcccgtccgtttccgcctctcgccgcccttcctcctcgccggattcgagctcgcgccgtcgctctctctctccgccgtcgccgccgagctccggtccgccaccgtcgtcgccccggaccgcctcccacctcggcgccgcctccttcagcttcgccgcatccttgccgacctcgtccacccctccgtttcgctcgccgaccaccggagcaccaccgaccccgtcgacccgagccgcgccaccgcctccctccgctccggccgcctcctccgccgccgccgtcgccccggggtgagccgtggaccgtcgcctcctttcccccttccctcccctctctcggccgccgctccgccgcgccagtggtcgccggcggcgaccatcggggcgcgggcgccgcctcccgccggccgcgtcgacgtggccaccttcgggcgcgccgcgcggttgccgcgtggggcccagccgtcagccgcccgcgccctcggctgcggctgacgcgtggggcccacggcgccggccggagtgagcccgggtgcacccggtccaccgtggaccgtgaggctgccgcgtggttcccacccccgtggacctggtccgcgcgcccctctctcccggctgacacaataaatcccttttaaattaaaatttaaatgaagaaattcgtaaatattcatttaaagagcatataaacttcaaatggccataacttggctatttgaactcggaattggaccgttcaagtctctaatttttccttaagaagtcaagaacccatttttgtgctttgttcctgcttgttatatggagtttattagagtaaaagcccttttcttttccgttgctcgtgtagacgctgcagcttcggaagatccgctcttcgtggaggttgaagccgacgtttgggaaagcgagcaaggcaagtcacatcatctttgaacatattggatcccagtttgtgaaattattttgatttaaattaatgcattatcgctttatttaaattcccgcgttatcactgttttatttagccatgcctgtttacctttgttatgaccttattattattgctattgttattattaccttgttcaccctagaataaacaaaaccccaactagtgggtactctattcatggtgccactagtatgaatttaggtagatgcttcgctgattaattaggcaacattaggtggttttataactctagactttgggaatattcatatcacttgaacattatggaatggttggattattgcgaaattggatgcacacctccccctctattcaaaaccctcaaaatggttttaggctgggctcggggtgcatggttttgatagtagcacctcggccacgtaaggaccggtcttcgggcctctgttgcaaagcactcccgtacttccacatgtctagtgggtaaggcttagtttgtggctcagtatggttataaacaaaagtacacggatggagagggacgaagtcgggggtcgatggacatctctaggacaaatgaatgctacacgagctgcggcccggtagtcaagaagtcatggcacaggcctggtgtcctgctgctaggggctcagtcctgcctacctgtcccggaggttccggccgtaggtggggttgggtcggtactcttgtctatggctaggatgggttggaaactatgtcatgtcttccgtccatatgccatggtggtatgtggcacgtggttgcacgtgaggaagacgtgtcttgtgggtaaagatgtacacctctgatcaaagtaaaacctattcgaatagccgcgccctcggttatgggcaagcctagcaatgtacccaagttagtgttttcaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacagccttgtttaataatattaaatagttctaggatcgtgttttaaatttagcttcgagcaactaagtgtcttttaaatgctgtttactgcaaaacctaacccctatactataactccattgtactccctcgcatttatgttgcacttgtgggtgtgtcttgttgagtacggtggttgtactcagtcttgcttaatttttcccaaacccagaagaggagcccctggatgatgaaggctttggtgtttagctcgtgcttgccgtcaaacgcctgtggtcgtcgccctagtcttccgctgtttcccgtttgtctttgtgtgagctgggccttcgccgcccatgtaataattaactatttacgcttccgcttgttaaactctgaattgtatcaacttttggtgtaccttgcctcctgggacaaggaataatacacgcacgtaaggaacgcccgttgggttatttccggtcgtgacattttagaaggactggatctatgtcaaaatcgcgtgcacaagggcgtctcgggaccaatcagacatgcgaaaaattgtgcgcaaggacgttgtgggcccaatcgtggaagcgcgcaaaggcgcgtatgaaaaatgggcttaatcgctggcctgatcgctgcatgtggcaaggggcacatggaaacgtgcaagcccaaataattcacgcacgtctcagataagagggacactttggcgtaagaaaaaagaaaaaggttttgacagaaacataaaattaaaaacaaaacataaaaataaaaacgattcaaacacgatgacgtgccgaaattccggtgaaaacatcttcaatttttataatagtagattgaagttttaaaatttttataaaatatctataagatggtaatatgaaaccattgtaaaaaaagagaataaaatattttctctcactattaccaatccttgaactcaggatctcttggacaaatcatttttgtcttcaataaactaaccaacttaacccgtgtcattaattgtatatttgtgccttgagtattgtttaacaaacttaccaaattattttgcaaaaaatgtattatttaacagtttgaaaagcgtgctaatgaaaaacaaggaagttgatgtttggtgttgaagaaaagaacagagcctcagaaatatctctacagagttttaaatatttgattaaaatgcctttacatattgttgacggtcgttatcgatcagtttcgatcgtcaatattaccaaaatagaagagaactagtgatgcttgcaatgcataaatatgttagaataataatattccactagtattaggtatactaaccttttgcagagaatgacactaaagtggaggagaatcgacatcaacatggaagataaatcagtctgacgatgtcgagaatcagacttatgcatgaatgggccaagaactcagaattaacacgtcaaactgggccaaaattcataagtctacaaaaaggagcaacagaggtggccgccagccgaaaggtgggctggttgggccggcccctagttcgaccgaacctccctcgcctccgttggatccaggttttggctggacggttgagatgaagccccaatgacggttggagggtattaccgaccattccaaccgtcacaaccgtcatagttcagctataaaaggagctccccttctcacttcactcacacaccttaagcaatagctctctcatttctctcaagtttagtatagtagtatctagctggtaaatagaattagaataggaatcaggagtccggaagtcttcggaagagtttgggtatggctctagtagcttttctcttctcttttgtaagctttgtacttttattagaatactcttctaaatacatttatggtattgaaatactttccgagtatatgagtacctactttacattatgttcatgttatgctgaatatacggctagcttatctgggagatgctttggtgcgggtacaatgtttgcttatgcaattactctatgttatgatgatgatattagagtagtatctggtagtttagacgtggtgtctagattacgggatatcattatttagggttatatattgcggatgagaggtgggccgctgatggtgacagttcagtacgggtattcctctgcgctggtatataatcctaagttaattccctggggagggtatttctccgtatttagctccggttgtatggtcatgacaggctgtcgtaaggaactcggcagtcaggggtggcttctcgaagtaccaggagggcattggatcgaaagtattagctagtatatcagttaactagaatgtatgtatactatgtatattagaagtataggaatagattatctttctcttttctaaccacttagcttagataatatattatgagaatgagtagttaatgcttgtgtgtcactctacctttaaattatcttaacccttgcttagaatatgattataacaagtaatatataaattgttagtcaagttctctctacatgattttcccacgtgataaaataaatacgatacccttggaatattctcgggtgaaatgctacaatggtatatctgtgcgcttgcggatgaactctgtaaccatactataccaggagtatttctgcgccattgttgggaattatatttctagtaatgtcgttaagaaataccaacacttattaggcgcattttaaagtgtaaaaaaaatgcctctataaaatgtgttgaaaatatctctacaatgtctctagagtacacattttctaggcaatttttaatgtgtctataaaatgtttggggtaattgtgttcttgcccttgctttccgattcaattgtacttttacctttttagggattgtgtttttacctttttttcaaaatgaagtagctgtttgaccttgatcatgacgaaaaatttgataatttaacactttttttatttcccaattgttttagttagcacttgtgaggataacatgtggtaccatttgaacgattaaaagtaggccaggatgtcaaataatcgaaaccaattttaaaaactgttaaattatcaaatctctagagtgtggccagaattttcgagtaaaacaaatgggggagaaaataaaaaatgattttgtaatttgtgaatgactgttatacctctcgtgagtaaataaatcactcaagtagctgtgtgaatcaggctccgcatcccaaaaccctagaggatttggcggcggcggcggcacgaacaaagcggcggtgacacgaacaggtgacggggaggcacggcgacgacgcgacgtagggatgaagtatcaggcggcggcgaccgtggggcggcacgaaggggaggcgcgtgcgccgcggaccgtcgccaggactacgggcggacacaaaggggaggcgcgacggggacaacgggacgcaggggaggcgcacgcgcggccgaccatcgtcgggactgcgccgcggaacagcgctgctggaggcaagtaggcgcagaggtggcgggcgggtacggtatcgacacttcgacagcgaccaagtcggccacaacattttgccgctgggtgcatcggcggaagaggaaggtgtcgaccgcatcgtctcatgcgaatcctggacctcctccttgttggatcccagctttgctcaaagctagctaccgctgccaccgaggaactgggagggtttaatcagtggcagatgtaggaggggataataggggtctgaataaactatataaagctacaaccacccttcctatttacatatagcaaaaaaaaaaaaattagcggggctgaggagactgaaatttactccatatttctatatttttcatggattatttgaggagactgagaagagtgggttttgggggcagacctataacattttatacttgttgggtatttgaaatttgttctttggaaaaaagctttgagaattagttgaaaggtctgcgtatatttgaatgtatgatttaatttcaattaagacacttgagtggagtatattgttgtagcaatattaaaatattaatatcatgtactaaatacctcgaaggacacgtgcagatagtggtaatcaaaatttggtcgattaatgggaagtggaaattatattctgaatattgtacaggcaattgcacttgttttcataaagtaaaaagctagagtgaatcatcgttagcataattaggagtttagtgtgtcaacagatttataattcttacgtgtgttaaatgggcacattagttgatgcatacgtacgtcggtacgtgttatgtgtgtgaggtggtgcgtgtgcgtcttccacatagtactagcattttattaagtcgtatatttgtgcaactctaaccttctctccattagatgtgtctacatgttaattataataataagcttaaatttgtactaccatcatacaatgcaagcgtaacatacttgacagaaagtacgtgttgcttgaaaattaacatttttttatcatgatttgcaattaataacatcaaatagcttccatacaataattaccacaacaattgtctctctgtattgaatattgtaaatagacttgtaatctgaaatgcccaattcatgatttgttgaacaaaatggtgagtgcagtgcttagggttaggatttctattcatcttctgtattaccatttcccctttccatgtgttccgttccgccttattcgttgttgcttgagttgccgtcttcttgtcatctccgctggtgcacgagtcttgtactcctctcatattttgcttattctctacttcgtacatatatgtattatgtaatagaataggtgttcatagatgaaatctagttccaacgcaaatattttttttgagaagggtatttttttacccggcctctatatccaaccggatatatacggccattgaaatatgaaacttagacccaaacaacccaatctgaaattcgctccataggagatttgaactcaggaccttgggtactacttcggtcactgtaaccactaggctagatgccctttcgttaataactaagtattatcattaacaactaaatattatcataacaataaataattggttatcattatgataaatttctgaaatttagcgtaaaacccaaagttatagaatttagctgtgcgtaaaaatatattccttcacaatatatttttcaaatacaattggttggcattttgtggtttataaacctccaaaatgtatcagcttataagaaacaaaacatccacgccactccactctgtttgtgtgatctctctgagaaattttccactgtgacaaagagaggttaggtgtgtcagggtagaataaattgttgttatgagaatgcgtgaacagtgtgataatgtgattgaatatttgaatgggcacatgaattactacttttaactctatcagtatacacgtcaccttctcttgctaatgacacctcatcattcttttccacactttatttcctttctcattcgtgcatcccctgcttgaagggtctagaaccctctgctttttacctctagtatttaagttcgatcgaaccgttaaaattgatttcacgttttttccttagctaatccaacggctatatttctaagatgatgtggcacattcttgtctcatttcactagtgaagattcgaaaagaaagagtacaactagagaggatcatctttcgaatcctcggtcctgactactacttctgacacaaaccatcttaaaaagatgattagcgtggtggataacgagtcagccctgatcgttaaggttcgacttaattaggcttggttcgatcggattgttttaacaagccaaaggtaattaactcggttcatctcgtgagctagctcgtgaaggttgttagattcattaacacatttatatcatctttataatctgaaattgaccactttatcatatattaacacaataataaacactagctaatataaagaaatcacaaaatagatagtttggaaataactagctaaatgactaaattaacaatagctaaaaagcactaaatatgcatataaagatacgaaacgatctaatcaagcagcttaagagcttaaagtctcatcatgactataagtttgagctgataggagacacgagattcgaactttctttttaccacttaagtttgtgggagatgtagctgtatatttttcttcactccatttattttttttatatataatgtcattgacttttgatatgatgggcttatttggtttggagccaatttttgccctaccaaaatctaggtagtaccaaaacattggtaaattttggcactaccaaattgggtagtattcaatttgatctatggtgggtaaaatttggtagtaaaacaaacatctacttgctactattgaagttgccaaaattttagtagggtagtaaattggtatcaaaacaaataagcccgatatttgatgattcgtcctatttaaaaattatataagtattatttcttttgtcgtgacctttttcattaaagaccccttaagtatggcatgtactttatcatatttgcactaactttttaataacataaatgctcaaatattgttataaaagccatagatagcaactattgagaaattaaggaggtagtatttaattaattaatttttatgagcctacagttttggtagctgagaagcattttaaggcattcctaaggatataatgggggtgcaaaccagaataaatgacagtgggtgtatgagacccactactacacaaataattttcctgtacaaacacttcaatagattgtagatagatcataagtgttcgcgtctgtaaaattttattttcgtatatggccctcttaaggtgtcgttgcaaaattaggatgattttccagacgagccacttaagaggtcacacggaaaaaaatattttcgtagacgagcttcttaaggatctgtccataagtctgatttacctcctcttccttctcagcacttcattttttttttaaatcatccttatctcctctcctgtctcctcatactcctcgctctatctcaaactcctctctcccggacagaactctctactctctctctcccggaccagacggcggcagcggggggccctccatggcctagatccgcgcggatctggctgcggccgtcccctgccctgaccagtagcaggagagcccgaccagctagcattttgcgattttcttttcagattttttatttttgcgtgtggacgacagaagcacctgtacggaaaaaatgggattttcgtggcgtgtgggtcacccgtatggaaaaatagcgattttcgtagacccggcacgtgaaaatcacttttgactcgtatggaaaaattactttttactagtgacggatgaattgtaccaaggattgagcctgcttaccgtgtcaaaatcgcgatgatcaatgtaacactaacgcagtatcatgaagccaacatatgttttccatcaaagaaataactcatatttaacttggagaaatccctacaaaagattggattacattgtcaactctcaaggcaagtctgcctgaaggaaaaacactctcaagactagtgtgaaattgatcatctcaacaaaaacgcatacattaattagaaaacagaaatgggcaaaaagaaaagaacaggagaacaaagatagagattaattacacttcatcagtgttttgaaagaatctgctttccgatcgaggaacttcaagggcagtagtttcagcacgtacgggtaacatatttatactgaatgatcaagcaagaaggagagcaaacaacgcccacagcgaagtcgaaacgacattggatttgatgaagtgaagtcaacgttagccacagttgcaaaaataatagatcgagaccggtattctagaacaaagtggcttggctgtaagtctccagatcttttacggtgtagtatccatcattaacttctaaacagttaattaggaatagaaactaatattagcacgtgtagtttagtaattcctcaatcaccatccctcggctggcccaacatgtctgtctaactctagtgaaagaatgaacgcagcgagtttgcgggcgaggagcagcggggaggcaccctcaaggcctcaactccctcacgcaggcacgggtcatgggtgttgtgaatagaattgattgagcgagagagattgagtgagagagaattgcacataagaatatagagaatgaatgagcgatcatttattgataacaatggttacaatatataggggggagagaggcggcaacagaagacgcgataatttgggaaccatcgcgtccgttgttagaatcgccgtgaggcgagaagaggtgtggggcacgaccaaccatcgtgtcccagaatttattgctgctctatctatatagatggatgagatcacccaaatatttcagaacactctcccttgatcgaatccagctttgatcattactcatttagtgttccagatatctgtaaagataatcttagaaataattatagttaaatacatcacgtaaaactactcgaaaacccagtgggaaaaataaggagagaaccgtgatatatattatggactattttagatctatgagtaaagctcatagtttgatccaaaatagtataatgtctatagttatcatttagtaaaaacccagtggggaaaagccaaatgataagacatataagcttatattgatattacctcgttaaaaactttggatgagaaaacctaaagggtaaaactcatacaaaggaaaaagagtataatatgacgaaaataggttattttccagaggaagatactccccctgaatcctgcaaatttttaagtcgtctcataccaattccttcgacacatttaaagaatgtggagtatggtagagattttgtgaataaatcagcaagattatcacatgacttagtttgcaagatgtttatctctccatgttgctgaagctcatgaggataaaataatttatgagcaatatgcttagtgatgttgctcttaatataaccagtttccatctgaacaacacaagcggtattatcttcatagataatggtaggtgattccaatgaaccaataccacaagatgttaatacgtggttaaccattctgcgaagccatacacattcacgtgacgcctcatataatgcaattatttcagaataatttgtggaagtggctaccagagtctgtttagaagacttccatgaaatagcagttccaccctgtaaaaatacgaatcctgtttgtgatctggcgttgtggggatcagatagatagccagcatcagtatacccaattaaagtcgaatcctggttctttttaaagaaaagtccaagatctcttgtgccattaagatatcgaatgacattcttaactccagtccaatggcgtttggtaggagcagcgctgtatcttgctaatagatttaccgagaaagcaatatctggcctcgtactatttgcaaggtacataagtgcgccaatagcactaagatatggaaaatcaggaccaagtacatcctctccatcttcctttggtctaaatggatctttctccacgtctagagatcgaaccaccataggggttttggaaggatatgacttgtccatattaaatttctccaaaattttctgggtatatgcactttggtgcacaaggattccaaaaggtaaatgctcaagttgtagacctaagcaaaatttggtttgactcaaatccttcatttcaaattccgtctttaaatgatgatgtgcttcattaatatcttgtgtattgccaataatgttgagatcatcgacatataccgagataatacaaaatcctgtgggggactttttgataaagacgcacgggcaatcatcatttttagtatatccctttagtgaaaggaattcacttaatcggttgtaccacatcctgctcgattgttttaagccataaagtgacttctgcaacttaacacaatacatgttacaatttaccttctgattcgggatgtcgattccgccaggaaccttcatgtaaatatcagaatcaagtgacccataaagatatgctgtcactacgtccatcaactgcataaatagacgattttgtactgccaatgatattaaatatcagaaagttataccactcataactggagagtaagtttcgttgaaatcaacgccaggtttttgcgtaaaaccttgtgctacaggccttgctttatatctcaccacctcgttgttttcgttccgtttccggacgaaaacccatttgtatcccacaggaaagataccacgaggagtaggcattacagccgagaatacatctcttttgtaaagcgaggctaattctgcgtcaattgcgtccttccatttgttccagtcagagcgcttttggcactcttttatatacctaggttctggatcaacttggaggcactcagcaatttgttcagaaaaattagtgtcgacaattatagctcttctatcaaaagattctccagtttcagagtaattgatggcaatttcatcaacccttatagactcattgtgatctcccgaaacaatgtgtctatggtcttccgaattcctagtctcagcattgtgcaccaccgagctaggttgtagactatcacgatctgcttgacatatagtatcaatttggtgtgtaccaactaaaggttggtttgcatttaccgtctttctttgcttattagcaattgtttctcgctgagtggccatacttcttcctctctttttagtgagtggaagttgagtgcttttatttggtacctccactctttctggcgcattctgagcgggaatgaaagatttagtcacacctttataattggtaaatgcatctagcatgttatttgcaagtctttgcaaatgtataattttctgaacttgaagttcagtttcagtagtacgtgggtctgaggctggaataccctgggcatcccaatcaatttcctggcattctttttggtacttgaattctccccctaatgccgggaaatgttcctcatcaaagatagagtcagcgaaccgggcggtaaatagatcacctgttaagggttctaaatactttatgatcgacggagatttgaatcccacatagatccccactttcctgtgtgggcccatagcggtacgctgtggtggtgagatcggtatgtatacaacacattcgaacttacgcaaatgggaaatacttggaggatttccacgtactagctgcattggggaagtttcatgatatgcagttggtcgtagttggacaaggtcagcagcgtgcagaactgcatgaccctagcacaacgaaggtaatttgcaattcattaataatggtcgagcaataagcttaattcttttgatcaatgattcagccaaaccattttgtgtgtggacatatggaacagagtgctgaacctgaattcccaatgccatacaataatcatcgaaagcatgagatgtaaattcggcagctttgtccatacggattgattgaatcctatgttcagggtaatttgccttcagccttataatttgtgacatcaatttggaaaaggcatggtttcgtgtcgatagaagacacacatgagaccatctagtagatgcgtcaatcaaaaccataaagtacctgaacggtccatatcttggcacaatagggccacagatatctccttgaatgcgttcaaggaatttaagtggttcggctctgattttgagataagatggtcacaaaatcagtttcccagtagcacatgcagtgcatacgaaatcagaggatttgagaaatttgtcagtgatcaaatgatgaccaatagagttgccaataatttttctcatcatcccgataccggggtgcccaagtcgatcatgccaagtgtggaatgcatcaacattttgaaaaattactttgtacgcaacatgtgcaatgggcttaatgtatgtatagtacaacccgatgtgagagatggaattttctcgcaaatgcgtttgccatatccgttttgtttggttaagagaagaaattcttctcgattatccatatgggtttcaatgtgaaacccattttgacggatatctctataacttagtagggtacgggttgaatcaggatacaataaagcatcctcgattgtaatttgtgtacccattaggagtgtaataattgctctttctgagccaactatcacagtatcgcgcccagcgatagtcaaactttgccttctctctttttgagagtttgaaagtatttgatctccctaagtatagagtttatggtaccactgtccacaagacataattcctctccaatcggagcgatatccttagacatctataatgaaagaagaattgcatgattaagaattctttatccaatatatatacatagatacaataattaaaacatcaaatacatagtatgacgtttacatatgttaatagtacatactctaatgactaacaagccatacaaccttacaatacaagggagttcgtacttatttacttattacaaccaatattatttggcaaacttataggatatcaatatactgtttcaagcacactgagataagggcagcttcatctccaagtgggacgcatcgagatcattgcaaatctccaagtgggtccgttgagcagtattcgatgaacatatcatccatcgtagagagtggagcgacatcttctgggagaacattgaggttgctctctggttcagcaggagcctggtgagaacttgcaacctcagggtgctcttcatgtgtaatattgaagtgtgcttcaaatcttgggttctcagaagattttttgtccttgagggatttttggtacaagaggataagatgtttcgggatgcggcagtctttagcgacatgagtgtcagatccacacctgttgcaatgcttgttgccattgctacgaggttgtggtgccttacccttcccttttcctttctttcgacccttgaatttgcgcctgttgttgttgcgtttgcgctttccagtcagattcttatgattattcgaagaatttcccttgaatcctttcttattctcagcattattctgtacattgaagtgcacctcaggtagtggagcagagcccggtgggcgctgttgggcattctttaaagaaagctcatggtgtctttctgcctgagtcaatgtatgtataagcagagaatgtttccagaaattgttagcgcgatactgttgagtcagtatcctgtcctccggaagcatagttggatagagttttttctatcttttctgcctccgttggctcttgttcgcaaaacttcaacctggaacaaatgttatgaacagcatggttgtattctgccacagttttaaagtcatgtaggcgtaaatgaacccactcataattagcctcaggccaaatgagttccttttgcttatcataacgctcttttagagctttccaaatgttgagagggctcgtctctaacatgtattcatgtttgagatccttgtgaatgtagagtctcaaaagaaaaagggctgtattgagcttcctgggctcaattgccggatccccatcattgggttcctcaattgtctttagaatcccccgagaggcaaaattgattttgatatcagaaacccatatgggatagttagtcccatcgagggcgagttcgtcgaactcttttgtttccatgtccctacaatcatggttaacattatcaatttacagaggtaaattaataaaaacatgatattaaggttgtaatctcaatgcgaaatgtaaaacttcatattctgtaatgtttcgaaagatgtaggttatggacctgacaatttttagttagaattcgaaattaggtggcacaatgtggataatcttcaagtaattaaacagtggagtagatctcttaatagtgggcaaggtatacttgctgcctaaaatacggtctccaggcaaatatattatggtgaatataccgtagccaatgtttagaactccactaccttgtgttcaaccaaatttcaaataatctcatttctcaaaacatattcttggaaaagaacacatgtgggtaatcatcgtgagatgtagacctctgtgagatgggcgaggtgctcgctgcctaagttatgaccagtgcggccaatttctagggctccatcgggtaatcatctcaaaatatagaccactttatgatgggcgagatactcgctgcctaagttatggtcgatatgaccaaagtataggactccatcgacatgtgattaatttccaagttaaagtgtgaagtggaacatgcattaaatcctccattaattatgttggacataattaagagaatttgctaaatcaaaatacaaaatttatagagaaagtagagcgtgtcttgaaataatatgcaaaaggcatgttattaagacaacaaataaatttagtgaaacaaggtatttaaataaacacctatgttaataaacacataacatcagtggtctataggaccattacataattgtttgtacaactgatgaactgtttcgactaaattacataaaatatagggactaaagtgaaattgctgctgaaaataaaaaataaaaactaaatttaaggggtaaatgggtggtgggccgaaatcaataggattcagcccacccccgctacagtgcaaccggcccattgggcccgaggggaaaagggggcgctggaggggcgtgggggttagggttaaccctaaccgcccctgcagtttgtgccgccgccgccgccatgatgccgccgagtcggcgccgcctcctccaccttgtctgccgccgtcgtccgccgccagttcgccgccggttcgccgccgaccgccgccagttcgccgccgcggacaccgccgtggcgaagccgccgacgccgccatgggggcgccgccgtgggggcaccgccgatgcagccgccacctccaccttttccgccgctgccactcgcctccaccgccatctcccatccaccaccacctccaccgctgccatccaccatccgccaccgccgcgtccccctcattggccggcggcatgccgacgatcccgactccttatcggagtcggagaccggccggatccgaataccgttcccccccacgccgtttggtatcgtgcggctccgggagccgtggggaacagcgatgaacgtatgacggaggccgggacggcgtgcagcggcggctccagcgtggcgatgtgttggagacggtgtaaagagaggcggctcccacgtgcgcaccgccatggttccggtgcggccgaatcctggtgccgcgggagtgggggagcgtcgaaagctaggcgtcggttgcgatgttgatggaggtggggaaggagcggttggtggtgatggagtggcgacgaacggggccaacagcgactccatctccagtgggagttcacacggctcgccgggcattgtcatcaccgccgtccatccatggtaggcacaatactgtaccccttgcacaaggatccagcgaggtgcttcggcaaccggaggcggaggaggtgcgacagggatggggggggggccacaaccggagttgcaggcacacgacgagggtagtggcggcggccaccaaccctagccctgcctccgcgggatccccggcgcgtcctcctcatcgatcgacgaagaagaaggtgaagccggcgtgcgcgctgatggcgagggaggccgaaaacggcatccatgatccaatgaaaggtaggcatcgtaccttctttgttgattcttctgttcgcttttctattagatcaaaagcgatgtttcttcctttcacttcgcgatctccttcgcgagagcgaaagtgatgataacgtgttgtgaatagaattgattgagcgagagagattgagtgagagagagaattgcacacaagaatgtagagaatgaatgagcgatcctttattgataacaatggttacaatatatattcgggagagaggcggcaacagaagacgcgatggtttggaaccagcgcgtccgttgttagaatcgccgtgaggcgagaagaggtgtggggcacgaccaaccgtcgtgtcccagaatttatcgatgctctatccatatagattgatgagatcacccaaatatttcataacaatgggggctcgttggttcaaaaaaagatcagatccggtgttacggagcaaaggtgaagtgggctgccatttcccatgatttctggccagtgaagaataatttttctcttctcttatatttctgagagaaaagatgaacagtgtattttcaaaaaaaaaattctgctgcaacaccaatatcaaaaattcatattgatagtacaaacttgttgcaattttactgttgttttttatgtgcttttatctctcttttttctagagaagcccggcttctatatccaactggatatatgcaatattttttaaattgggaacttcgctcctatgaagatttgaacttaggatcctgggatgctactcaggtcactgcaaccactaggctgctcaggtcactgtaactcaggactttaggatgttactcaggtcactacaaccacttgagaaattgatgcgcttagtttgaggaatccgtagttaatcgctaagcatttaattaaccaccgtatgaacatagaaatgcctccaacacactctatcgggacttcgcattgcaggctggatgggatcataggaggaagatacgcttttgtcttccgcaaaattaaccacggtatctaattaccattttaaccaaccacttttcgtacctggcccaattttttcatacctttttataggtataccttttatttttgtgcgttagagattaagcgtgatcatgagctcaaaccaccgaagaaagtttcgtaagtcgaacaatgaaaacaagaagtttcgtaagtcgaacaatgaaaacaagactgatgagcagttggctcaacttgcatagcgcagatacatatataattacttaacttatgcttcactgctataatgaccgtcacagatataaccttaaaggtttctaataaatcatttgagtttttataatgtgtaacggttcgaagtccatcggattgtgattgtgttgggaactatatagtatgaaccattagtgaatagtcatcattttgaaaagaggttagagatcattagttctcagttcgtagttacgaatgtttgctgcttttatgtaattatatgcacacaatatgaatccttgcaaattaaacaaaatttgcaacaatatcaatccttggaaattaaataaaatttgctactgcctccgttccaaaatattgcaatataggatagaatttaatttatcataaaataatgtaactaaactgaaccgatttaacacattctgtaaccataaatctcgacataggttctatccagattcagtggcggatattgagcctaggcaaacctaataatagagaagaactacaattaaatccatacaaccacgtgcccgatttagcatagatcgagttctaatttatgaagaagacaaccaatgcacgaaattatattgatgaaatgaaactcgttaatggttaatgttgaatacttgacattatatgtatatatagctagtcattttgctagtttatgtgctgatccactgatctgacaaccattattggaactagttaattaaacatgtaatttgctattttactcaaatgtacgtggctgaacgcctgaacttgtatctaagtaattaacgtaaactgataactactgcatagtacggccacatccggcagagcccgggcacctgccgaggctagccgggtcctagctccaccactgtctaaattcgttattttaaaatgggtcaaatcttatcctgaatagcaatattttagaatgatagagtaggtgacactctaaaatatattatttggcgaaggacgatctaaaacgtaaatttgctcatggattaaaaaaaaatatgattctttgctacataacaccaccagcaatattttatcatttttggctacttgtgaaaaaaaaaaagagtaatgaacagaatgcccgggaaaaaaaaaggcttatcttatgtatccagttcgcccaatatgtcaattgtcacctctcttgaatctcttagaactgtaatcataagaaagtagctgtgctaatggctatcacaacgctcgctactacagcttcagtttttccacgtggccaaaatcaatattttcatgcggacgggcggaccgcctacgcccaaaagtctgcaaaattcgtatttttgcatgtggccagcgcaaccgcatgcgggcgcttaagccaacggccggcatgcgaataggaaaaatcgtgaaaggaatagaaattatgaaaaacaaaaactactcagaaactctaaccctagaatcctatcgttgttgctgccaccgtcgtatttgtccttccgtcgtcgccgaaattgtcgtcctcctcccatagccaccgctgacaaatccgcgcgggaataggaggggacgcgtgatccgggctggggagggccgctgccaccatatccaggttggagagagcggctgccgccagatcggcgcggggagggtcaccgccgccggattcaagggggggggggagggtgtccgccgacgttgcccacgcccgttgtcactgtcacgtcgtcccatcgccgctgcctctgtggcagcggcaccgcccgaggtggtcgaaccgcccgcacacggccacctccttgtctgctgcggaaccgctcgagatctctgagccggccgctgcccgccaccggccactagaaggagaggagagaaagagagaagagaggaggaggtgaaaataatattaggaggagaggaggtgaaaaaatattaaagttgctgagaggcaaaagagagaggaggggagaaaaatttgtggagagggggtattttcgcacgtggaccatttaagaagcccgcatgtgaaacgtcttaggaggaccgcatgcgaaaataggctcatttttttatgctgccattaaaaggctcatcagagaaaatatgtttttgcatattgtcctcttaatgaagccatatgcgaaaatggaggttgattttttttttgttcagatgagaccaattacgagcccgcacaacttataagggttattggatgatcaatcttctccctaggggcattctggtcattttaaaattttgctctctccaaattaactagccagaaatgataaaatattttatgcggtatatatcttgcagagaaaaccatttcgatcagaatagggagcagccatgtttcttgctgatcaagctcgacagagggtgatttgttgctattttatttaaaattttgggtacttgacgctttccccggctctaaattgtcttcgaaggctagtaacatactccctcctgtttcatcaggttacagcacgttttgactttggtcaaagtcaaattattttacgtttaattaagtttatagataaatatagtaatatttataatattaaattagtttcattaaatcataataaatttgtcttgggtttaaagtgttactacttttttctacaaacttagtcaaacttaaaatagtttgactttgactaaagtcaaaatgtcttatagcctaaaacagagggagtagtagatatcctttactctattgttgtgttaaataatatttcaactatatagaataatcatttttaatcgatatttattttctagatcgaccgtttcacaatataagactttctggtattacccacatttatatagatgttaatgaatctagacatatatatatatatatatatatatatatgtctagatgaatataggcaatgctagaaagtcttacaatatgaaacggagggagtaatacgtatttgtctagatatattaatagaattcactttatgtatgcaaattatcgacgggggataccagtagaccggatatagagggtattgaggtacgctggtacaaggatctacgtaatatgacatcaagaaaatagaagacaaggattatactggttcaggctcctcggaaggtagtagccctaatccagttggtatgggattatacagtgaaagccacgaattacaaagggaatagcagaactcgatgataccgacgagatcgtagtcgagttgatccgactagatcacccggtgacttggctcctgtaggttccgacttcatgggttgtggtcgttgtgttaactctgagattccatgccttaggtcatcccggggggtcccttttatatcgcaggttagtggtctccaagtaggactcggagacatcggaccctgcacgatacagtgacgacccagtcctatacgggtaggaatctttccatcagttaacttcgtgaagaatttgcttagcgtatacagagaacgtccgtacacgtgcaggtataccatattgccgcatagcgtatatccaagggtagagggtataccttatccgtaaccctgacacaaataatatattagattttatgcatcaacctaagtaattaaaacatcaatcatggtggatataacttattagtatatgcattaattaagcttctcgtctttcttttttcttttggaatatagatggatcgacgatgtacaattcaaaacgtggtaatgtagagtacattaaaggactcgtaaaatctataacgagaggcctttgatctggtcttacgcagcgacgcctagcacggccatccgatttagtcgagaaacattagagtttagaatttgagagaagcatcagagtgttagacatccatgtctttttcccttctcataaaattgtctctcaaattacttatccgatctacaatccggttacaccattatgttcgttgcaatgtaatctttacaacaagatatcacatgatcatattacgatgaaaaattgcaaattacttttataatatatctaaattacttttagatttcactaaattacttcttagacatattaaaagtaaattcaataaagtctaaaagtaacttacatatatttataagtaacttaagaaaaaaagaaagtaactttgtcatgtcattagaagtaaatatgttgtaggtataaaaacataactctatctagaaactaaattaatcagcagaaattatggaattgactaaaaacaataataaaagtaatcaccacgtaacattatgaatcaaatctaaaagtaatttatatatatgataaaagtaacttagtatataataaaagtaatttacaaacataaatacttttttcttcataatataatcattaagatctcgttgtacagatttaattgtaacgaacacaacggtgtaatcggatcgtagataagataagtaatttaagagaaacttgttttttgaaatttagatgggttacgaggatgcaagtggcaggtgctactgcttttagtaagaagggtaacaagtggatacacactgtactacttttggtaactccctgtagccgtgtcctaaaggactagatgcatttctcatcgcctttgaggaattcaggttgcaagtaaatgcaggcactactagaaaacgcattatcgccggcagtggaaatcggttttcgcaggcagggccgacctctgcttgtaagcaaacgacggtgaagatcatcgatcttcgcaggcggggcgtccgtccgcctgcgaagattattttcacaggtggacgttagctagattgatccgcctgcgaaaatatgtagaagccgactgcaaaaaaaaaacatccgcctatgaagataggtagaaaattttgaaatttgatacaataataatttgcccataaattacttttttattatttaatagaaattcttgcaggaagattattatatacatatattggaaagattatcaagtatttggtactgagaaatctagatatattgcataactgaaaagtgttgccaaaattatatatattacaatatttttttacattgtcacttcaaatacaccatctagttacattatggcatagtagtgctccactctcgaaatttcttgaattcgtcacttgtagatagggcaccctctgggtcgaaaaactctcctttcacatgacaacactcatggtggatgaattggcacagatcgcgctggacattcgtgatgcttgtattgtcaaagctcgttcgacgttctattcttagcaactgcatgcattgaagataaacaatatattagtatcataaatatgtgaagctgtctaatgcatagtatagagacttacatcctccgcgttaaccttgtacctcccattaaccctgaggaattcgtacgcgtaatacccgcaaaagacagttcctataggttgcttgtgacacttcaggacatatcataggaaaaagagttaaattttgcaattagtgaaacaattggaatacattaagtgagtgaagtattaccggccaatatgtatgtactagcagcttctcccttgttcgggtctgttcttcacccttgaacttgtagtagttgtacacactgtatggatgtcgtaccgtttcgcattaaggaggatatttaattataaaacattcatataaaaatgtaagagtcaatcacttactactgtaagattgttagaaattctttgtatgactggtgtatgtaatcgagagggtccaagactaccacggttccatccttctggtggatgattaaatagatataatgatcgctacatattaaaaaacaacttagttagttagtaccggctaaaataagacacatgtgtagaagttaaatgtaccggacttacttaaaattataagcggccatgacgactctcttattttgaaagtgcaagaaggctcgtccaatatactatgcgacaataatcactttctccttgtgcaagcccttcttgtattcagttatctcttgtggagtcttgcccttcagctgatctgaccctggtgctagcctcacggtatgttgtgtttgacagatccgagttggatccaagaagctgataggtttatttttcttcttagcatccatgtattgcatcctacagaagaagtttgttagagtaagttcaatagtatagccaactactagcttcaattcatctatagccaatctaatagctcattcatacaatagttacatactacactattaatacctggtcccacctgtcattcacacactgtgtcttggagtccgtgttacagctggctacaaatctgtagcccgctgcccttctctctcctcgtttatcttcttaaaatttgtttacagctggcttatagcctgctattgtacctactcttagtaataattacatggatttgtattgtacatatttttcatgtaattaattaaaattcatactcacatgcacctaacagcaacatagttgacgttcatcttgtcccgatgatatatggcatggagatcttcgaaatctagccatacgtaacattcgccgccgaaacaatctgccggtgatcgagctgttatattgcccaagcctttcttgctggcatccatgtagaaggtatgtaaccttctcatctcctatggtccttcgtaaagtgcccaatccggcaagagtgctttcccattttcgtatttttccgagcaatcatcagttggcaagtatggcctggctagtgcagcagccttctgggggtcatcatctctgagtttggcacgttccttaccccctctgaagatggttaccatgaacttctcattgttctcatctttagacttggagtcgtggctcataagcactttaggcaccttagaattgtcagtggccttctcagggaccggggtttcttgcacctcggggtctttcgcaggagaagggtcttcaaatatttctggctctgtaccgtcccattccaatcgtactacttcttctatatatgtcccgactgatgccacaatttgcacctctggttctgccactgtaatctccattgggacaacggcactacaatctccatgggcacctccggcactgcaatctccggtggcacttccggcactggattttccttatgcatctcgggttcctccgccttacctgtcacctgcctcttcggaggaggtctcggaggtttttccacccctagttttggcaccatgggttttcgcgtggcattggtgcacaatccaaaggatatgtcattctagtgctagagaattacaagttctgtcgcgaccgggaaaattgccttttcccgaacgctagtgtattaatccccgtcccaggaaaagccggggtacaccacacaaacatgatataaaagacacatctttattatatcgataatatttacattattacaaaggcacttaaggcctgacaatcaaaaataaacagcagcggactagcgggcctacggctccatcttcacaggcgctcaactggggtataagccaggactccacctaagacttcttctccaaatcttctcttactgaagggggaaaagattgagcaagaatgagtacaaccacagtactcagcaagccacaccggcagatgcatgattaatgcaagggggtacaaggggtaataatataggggttaagctttgcagtaaacagcatttaaaagttacttagttgcccaaagccattttataaagacgatcctagagttacacagtattattaatcaaggccgtgaaccctcacgaacctgccttaacctaaggcctacgatgattcagaccgaactggcaacccgaccctgggtcccagctcgtcccaagccaacccaggccaaccattccacattttagttgttgagcaaattttaagaattaaaacactgacttgggtacattgctcggcttgcccataaccgagggcgcggctattcgaatagattatactctgatcagaggtgtacatctttacccacaagacacatcttcctcacgtgtagccacgtgccacataccaccacggtatacagacggaagacgtgacatagtttccaacccatcctagccatagacaagagtaccgacccaatccccctacggccggaacctccgggacaggcaggcgggactgagccccctagcagcagggcaccaaccctgtgccacgacatctcgactaccgggccgcagctcgtgtagccttcatttgccctggagaatgtccatcgacccccgacttcatccatctccaatccgtgtacttttgtttataaccagactgagccacaaactaagccttacccactagacatgtggaagtacggtagtgctttgcaacagacgcccgagcttaatccttatagtggccggggtgctacttcccacaactg

SEQ ID NO: 59809 - DNA, 17634 bp, Oryza sativa
ctgtgtttaccaaatagtcagaaagaataaaaacttgatcgatgagtgtttaattaatttaccctccatctgtgtatgtaaaatccctcaggaagtccactgaaactgaggctttccacaagaggtggcacacctaagctcacaataccacatacgcggtccggatggcagagggcaagatcatatgctggtttgactccaaaatcctttgcaacaaggaacacctttcaaccatgaaatgatcgtcactcgtcaggatacagtacttcttttcaaaaattaagccaatttacaaacttatcaataatcaagtaaaataatgcatggatgaaaccataaccaattttgccaatggggcaagttctaatttacatcagcttctgacttatttcatgtttgccatagttatcaaaatgcgttagagacttggggttcatcttagcatttgcataaacttttattggatctcaatgttttctcctgcctgtactcaccttgggaatcgacagcgagtctagaatggccaagaggtcattcatcaggccctgccatgacgcctgtgttaggtcagccggtggctccgagaggccatagcctgggaaatcaagtgcaatagcacggaacccggctgctgctgctgcaatcatctggtgcctccatgagtaccacacctcagggaagccatgaacgaagagcagagttgcagcttcacctggaataaccaaatcaagaagctgagctgcattctttcggaagagcaaaaaaaagcagagagatgctgatgtcaacaaaaatgaggtaagattcagaccttttccaatgtgagctatgtgaagcttcaggcctctgatgggcaggtaggagtgctcaatcctctgatccattgatatgttctctccaacgtcagtctgatttgcttgagattatataggattatagcaatttatgggccgaacttttggtcaggctagtaacggatggatggcacaaagatgcgcacactttgtgtgaagcatcttctgctgatgtcttctgctgtttttgtcagtttgtggtagccagagacaagatgctgatgtcttctgctgtctgtattttaatactccaagcaacgctgcaaaatgttaactgaaaaagattccctctgtacgttcatcagtcaaataacgttactgaattttcatggtctatattactcgattttgactattacttgttcaaatacagtcattaaattgatttatgttatctttcacatgtgctgaagctttggtttgaagcaattgtttgcataaagaaaccagcagtaacaaatagcaaacagttcgttttactatctgcttcattctgataaagtagggctgtaaaaaaagctcgaagctcgcgagctgcttgagctcggctcgctgtagactcggctcgagctcgattcgtcaacaattcgagccgaactcaagcctagctccaagcttgcgagcttgacgagccgagctcaaatagctcgtcgagcccaaatttccctctgtcaagttcttaaattttcaatacaacagctagtactactcctactcccaatgaaaagctgtatagaaacagagcgtgcagggctgcaccgtgcaggcactagcctactagtactactttactctgcagcactagcctattagtactactagcatgcatgcagctctatttaatagtactactagttgtcatatcatgtttgaaaaagctactagtactagtagtactcgacaagcatgcatgcagcctcctttcatctgtattggttatttgagggcacacgagttaggctcaagaaagctcgaggctcgagcgagccgagctcgagcccatttctaagcttgcagtttaaacaggctcgactcgagctcggcttgagttggtgccgagctcaagcctatataggtaagctcgctcgagctcggctcgttgacagccctatgataaagtctcttttttttggaaggtgataaagtctgtcttttaagatttatcctgatagtcagttgcaaagatagtactaacatgctaagtataatgaaaagtttgagaaattctcaagcaattggcaaattttgattgactgacagttgatggttgcaaacaaatcaagacatttgcaataaaagaaggggagaaggcattcgtgatcctcaccttgactattttaaagatgtaattaccattatcttaaaatagaaaccgagtaataaatgagacacgaccgagtgaatttttgtataggggattgagcgttgtctttaatctgattagtttactatatttagggcatttctaaccctccacctagaatggtgtctatgacattaactacattgtcatgtaggacttttagtttatgtgacactatattaattaagagagagagagtggagagaggaagaaactgggtctcatgcaagacacagcttcaacacgagaacctatgcactagacactatcaagttttacatttggagagaatagtgtcttcataatagatgaagaataaatatgattggtagagaaaagagatgatgtatttattaatggcatactttaagaatccatgggttgtagagtgtagtttctattgtgatgtcttattgacatggcactatagacactgcttatgaatactatgggtttggactgcccttagaattgaaaagtaatagctaatcacaatttcaaaatgtcggaatccagtcatcacaaatgacgatcgaagatggaagcagctgtagaatgtcaacaggttacaggcccctaatgtcattttcgctctaatgttacagttcatcaatgtcaatcaatgaatatggtttaggccatgcttagaaggtgggttttttattgcgagtttgtacggaagtttgagttaggcttttcgagtatgacatatgttgttttaattaaggccctgtttagatgggactaaaacttttaagtccctatcacatcggatgtttgaaaattaattataaatattaaacgtagactattaataaaacccatccataatcttggactaatttgcgagacgaatctaatgagcctaattaatccatgattagcctatgtgatgctacagtaaacattctctaattatagattaattaggcttaaaaaatttgtctcgtgaattagcttttatttatgtaattagttttgtaagcagtatatatttaatactctaaattagtgtctaaagacagggacttaagttaagtccctggatgtaaacaccacctaaatgttggcagtttgacattcagtgcatttcaataaatagccggtgtggtatgtaagtacataaccaactagtagaagattttaatgcacatgacgggtctataattcaattttttgcagaccggaaaaacaataacgttacagcaaaatatgatggttagtcctaaatacatctaattattatcaaacgcaataatcttcaaccacatatgctaagttattttaagctataattacccatggttatagtcactaatcacagcgtccaatagtcacaaatgaggataaagaagatggaagcagcaacatgtaacaggcaaagataagcatttcactccactttgcagcaaagtcaatccatgaacatcagtacatcacataggtcatgtttagaaggctggatatttttatgagtttctgtagaagactgagcaggttcaactaaaacctaacttgccaagtgccaactcaggcaacgtaatcatcaacaacaagtcgcatgtggtgatttcatcaatcttaagatatgtcggctctgttttcaaaggtgtttataggggtagcgcgtttataggagtaaatgtgcacgtgcatataggcgtatgcgtttgtgtttcgaaaaaaaaaagttaatccataaatatgatataggtcatgttcgaaaggctagatacttttatgagtttctgcagaagattgagcaagttcaactgaaacctaactcgacaagtgccaaccaaggtaacgtaaccatcgacaacaagtcgcttgtggtgatttcatcaattttaagatacgccggctcggttttcggaggtgttcgtaggggtagcttgtttataggagtgagtgtgcacgtatgtgtaggcgtatgtatttgtgttttgaaaaaaaaaagttaatccataaatatgatgatataggtcatgtttagaagtctggatatttttatgagtttctctagaagattgagcaggttctactgaatcccaacttgcaaggtgccaaaccttgatgattttatttataaaggtatcagttccaggctacttcttggattccagttcataaaccgtttgtcctgaatccctgaccttcagacaaatcagaaggtgccaatgcagaagagacactaaatcttggtttgttttcatcacctccaagaaacagaaaattctcctataaaaccgaagtgatcactctcctcccgagctcgaaggagcaacaatggcggatcagatcgagcacctccacctccccatccgtggcctcaacctccacatcgctcaagtcggcaaaggcgagatctccttgtgtatctacggacattgaactgttccatgtgttcttcacaaattttaggtgagattttgcgttttgggtggtgaattttgattttgattcttttttttttctggatgcagatgagctcgggacggtggtgttcttgcacgggttcccggagatatggtactcgtggcgccaccagatgctcgccgcggcggccgccgggtaccgcgccgtcgcgccggactggcgcgggtacgggctgtcggggcagccgccggagcaggaggaggcgacatgggacgacctcgtcgccgacgtgcttgccatcctcgacgcgctcgccgtgcccggggcgttcctggtgggcaaggacttcggcgccatgcccgcctacgacttcgcgctccgccacccggcgcgcacccgcggcgtggcgtgcctcggcgtccccttcagccccgccccggcctccttcgacgccatgcccgagggcttctacgtcctccgctggcgcgtacgtgctcgccgccgccgccgccattgccgccgtcgccgtctgttcttgctgctgacgcgaacgcgatgtgtgtgtggtggcaggaggcggggagggcggaggcggacttcgggcggcacgatgtgcggcgggtggtgcgcaccatctacatcctcttctccggcgccgacatccccgtcgccaaggaagggcaggagatcatggacctcgccgacgcctccacgccgctgccgccgtggctcaccgaggccgacctcgacgtctacgcctcgctctacgagaactccggcttccgcttccccctccagatgccttacaggtacacaagccgccgccgccgccgccgcggcggcgcagccaccgtgtccaccattgtcagcgacgaacctcgaaaaaaattacctggctccaatagatagtaattatttaattattgacttatatattactccattcgtttctaaatatttgacaccgttaactttctagcacatgtttaaccattcgtcttatttaaaaacttttgtgattgtaagtatatttaacaatgaatcaaatgttaggaaaagaattaataattacttaaatttatttaataaaacgagcagtcaaacatatttaaaaaaatcaacgatgttaaatatttagaaacagagggagtagtaattactattatgcaatttagttagtactcccttgtcccttcgttccattttaagtgcagccatgattttatcatccttcttatttaaaaaatttttgaaaaaaaaattaaaaacataagtcacacataaacaactatttatgttttatacagactcatggttacatttaaaataaaacggagggagtattggataatttacatggatcctatgaccccgggatgttgaacatgagatcgtcactggccattgctgatcgttgcatgtctccatggatggatcgtacgtgcagggcggtacataggaggccaagccggaaggacgcgaggttcgaggtgccggtgctgatggtgattggggagaaggactacgcgttcaagttcccggggttcgaggccgccgtgcggggcggcgccatggagaggttcgcgccggagctgaagatcgagttcctcccggaggggagccacttcgcgcaggagcagctcccggagcaggtcaaccggctcctcctcggcttcttcaccgagcacccggttgccgccgattgagatcctctctctaccttcgaagtgatcacgcgtttatcactgacatgtgaatctagagtttactggactcactcacatgttagtaataaagtcacgtaacttacaagatagactatcttaacgtaataaaatagggacgtctagaagcaaagtgtaatattgggatcaagtattgtactcgcacacaatttataatccacgtgtaatagtgggagtgaatgtgaccgtgggaataatttgtaatttaataattttaaagtttaaaattagtactacctctattttatattgtaagtcattttaatttttttgggttaaacttctttagatttaactaactttgcagaaaaatatagtaatattttcgaaaaaactatcaagttcaatgttaaatttaaggaaacttatttagtgttataggttgttaaatttaaggaaacttatttagtgttataggtgttaccatattcttttttataaatttggataaatttatataatgtttgataagaaaaatttgaaacgagttataatatgaatcgatggagacaaatatatctcaattaaggaagaagaaagatggtgagcaccaaccagggctagcttcctgccagctatctgccgatctatttaatgcaccgttttctattatggaaaaattagtaaatgaactactctcccgtgtgatattaagttcatattttgacttcttccattcattccaaaataaatttattttttaagtaatcattgcatctaaatttgtaaatttagataataattgaattcggagtagataaaatagagaatagttgctttgggatttgataaatagggtattttatctttttatttcgcattggtatgtgtcggtgacatggggccgggggtatcgtgactagaggcttgggtagccgcggtcacccacgtggcctgaccccctcgggggggtcgggcccgagggtgacgtggccacccctccctctgtctccccgaggggtcgggccgctcccgtttcggccccgagggctggggcgccccgaccccctgtggttttggcgccacgtgtgtgggttaggtgagcaccgcatttatagcaggttggacgagcgcgtcacgccgcatttaatgcagcgcagcgcacgcttatccggtccgtgaccggtcgcggtgtgtgaccggtcacagaccggtcagatcgcgggttaggtggcaacaggcggcctgtcacacgcctcgccccgtcccgtcggaatgatgagagcttcctggctctcgtccctagccggagccggcgtgctaactcctggagttggtatgtcagtcccggtcagatccattccaggcttcagcgcaagtatggcaaggaagtcgctggccattaaatgaaggttgaaatgggcgtccaccgggaaagcgggcgagcggggcaggaggcgtgcgcactgcttgtcagaggtcacttccggctgtagactagccctcattgtaaaaagcatgtttcccttcttaggcagcgagaggcccatgtggtgacccctgaccagagaaaaaggaggcccaggcttagaaagagagaaaaaaaaggagaggggagttgggactctggcgaatgggttctagagcctgaactctctctcgctctccggctctctgtattccttcacatacagatccaccagaacacaggagtagggtgttacgcttctcagcggcccgaacctgtctacgtcgcccgtgtctcgtgcacttcctctctcgctgacgttcctcagatcgagggcgaagaacctcacttagcgcccccggccgaaccggcaaaggggggcctgcgcggtctcccggtgaggagccccacgctccgtcagtatgtatgggatggatgaaaaataaactcattttagaactaagtgagtataataacaacgtttgatttttaatgtatgaattaatagcgtcaaaaatattaaggatgatggtagtatatgcggtaaaaacgtaaagataattcacacaccacgaacgaaaccttctccaccttctgtccacgagttggacatgcaccagcagctagccagtacaaagaaaaaaaaacgtacagcaggtgcggcatccccatctgaccccgcgcgactcacctcacctcccccgtgagttgggatcctctcctgtaatgtatgtgcggtaagtgccaatgacatgtgggcccggaataggtgggacccacatgccagtgacacgtactgcaggtgcagtacagcagtggatttgcatcccccacctcacactcccaccaccgtcacgtcgcccctctgctctctgcactgctgcggcgaggagctagctcgagccggccggaagccatggccacggcggagcagcggcagatcgagcacgtccacctccccgtgcgggggctcaccctccacgtcgcgcaagccggcaaaggtttgccctgcgcgcgcgcgcctcgccgccgccgccgccgccgacgatcgtcgggtgaatgattgttgggctgctggtggtttgcaggggagctcgggacggtggtgttcctgcacgggttcccggagatatggtactcgtggcgccaccagatgctcgccgtcgccgccgcagggtaccgcgccgtcgcgccggactggcgtgggtacgggctctccgaccagccgccggagccggaggcggcggtgtacgacgacctcatcgaggatctcctcgccatcctcgacgccctcgccgtgcccaaggtgacgatgaagtttgatttttcacagatttttatcctcttttcgtagcttcagattaagaaaaaaaacttcagattttcagttttgagtgcgtggccttttgctatagctcgtaaaatgtaaggtataattcataattggttgaacaaaggttcgagatttcgattttttttgtagtttttttttaatcctggataatttgtaagtagaacgcataaactttcagtgtcgtgatccgtaaggtagaaatttggagaggataatttgtctgctattattttcgtcagttgatactactatcagttccaccgaattgatttgaagctggtaaaaaacccacgttggtagcaccaacaaccaagagtgtattgaaggtcagaaaattcagtgcaacatattaaggtgccatttttctattcattctaatataatcggcaatgcttttgccgcctacctttaaagaaagtgccatttttctgtctaaaagataaggatatcaatttctccctaataaagaaatcagctccttataaatttgaaaataaataatgcctatttggtttcttcttgataatttatatgtttctttgggttaggcattccttgttggaaaggattttggggcaatgccagcttacgactttgctctccgtcacccaaaccgcacatgtggtgtgatgtgtctgggcatccccttaggcactgctggtttgtcctttgacacattgccagaaggattctacattttacgttgggcggtaactccgaaactgtcatgataatttttttagtgcactatttgcttataatgaccatgaaaaagaaaaatatatcttacagcaaccaggaagagcagaagctgactttggcaagtatgatgtaaagagagttgtgcgcaccatctacatactattctctaggagcgagatccccatagctaaggaaaatcaagagatcatggatcttgcagacttatcgacaccccttcccgagtggtttagtgaggaggatcttgatgtctactcatccctctatgagaattctggttttagatatccgctacagatgccatataggtaaaaatattttcttcggatatttgtactcgatggtactaagttcaccaatatttgatagttcgagatttgtgccatgcttgttaggtctctgcaccagagaaaaccaattggagatgcaaaattccaagtcccagtgtttattgtcatgggagaaaaagattatgtctttaagttccctggtatcgagtctgctatgaaagacggaactatggagaagcatgcaccaaacataaagatcacctacatccctgaaggagggcattttgtgcaggagcagttccgtgactatgtgaatgagctccttcttggcttcttgaaagatcatcctgtggttatataaatgctattgtagcctcagttgtgcttcacccgtagttcaagttggcttagaaaacgttgtgctatatcatggtatgaatttgtcaacaaactaaggatcagctatggctagtttgttactttcagtaatgcctatttgagcttgttgtatctaggttgtcctgctggtgttactagcaatgtaaagactaaacccattgctatacttctaccatgacttttgcaagccaatgatgtgaacttataccatgattttagaaagtcttactgtaaaagacggagtacgtagttactatgtatacggatgattaatcataattatataaaaaattaaaaaattaacaatcactgtaataagtacttatcttttatgattgatttagttttagagaaatgtttgtagatcacctatctcatattagagaaattttgacctaatcctcttatattagagaaatattattccggtggccgtgcttcctcccttcctcatccttgtaccaaacacaataactcaaactgtcatccctctttcagcctcatcaacccaataaataaataaatatagacttaagtctactttaacccaaaaattttgtgtgtgcgcgtgcttgtgcgtgtgcgggggagtggtggtgggggttgggggccgtggttgaatctttttttaaatactaaaatgagtactcatattcgttttctttttttctgttaaatactaaaatgagtacgaatagctcgaatacaaaaataatcatggattatctcgaatccagataagggcaaaatataattagacacaaaaagaacaaataattaaaaaaatcatattgttttggtgtaaacatataaaggcaattctgaaatgtcatctactccctctgtttcaggttataagacgttttgacatttggtcaaactcaaactgtttcaagtttaactaagtttatagataaatatagtgatatttataatactaaattagtttcatcaaatcaataattgaatatattttcataataaatttgtcttgagttgaaaatgttactactttttcctataaacttaatcaaacttaaaatagtttgactttgactaaagtaaaaaatatcttataacctaaaacggaaggagtagataactaagagtgccaggtagaaggaaaaccttctctacctggcgtccactagttcgatatgtagcagtacaaaaacgtactctctccagactgataatacttgttgttttagataagggtgaggtcaaactttagaatagttgattagaattatttttaaagtatttgtttttcaaatatcactatagattaataaaatcatatatttgttaacatttatatatatatatatatatatatatatatattataataaaaaataatggtcaaagttgtttttttagaccgtatccttatccaaaacgacaattattatcaacccgtagagatgacgcatccccacctcacactcgcactgtcacgacgtcgcctctgcaatctgaacttctgcggcgaggagggagctcgagccgcccggaagccatggccacggcggagcagcagcagcagatcgagcacgtccacctccccgtgcggggctcaccctccacgtcgcgcaagccggcaaaggtttggccgcctcaatttgcgttgcctgcgcgcgcgcctcgccgccgccggcgatcgtcgggtgaacgattgttcggctgctggtcgttgcaggcgagctcgggacggtggtgttcctgcacgggttcccggagatatggtactcgtggcgccaccagatgctcgccgtcgccgccgccgggtaccgcgccgtcgcgccggactggcgcgggtacgggctctccgaccagccgccggagccggaggcggcggagtacgacgacctcgtcgaggatctcctcgccatcctcgacgccctcgccgtgcccaaggtacgtaagctcctcagtttaatcgatccttttacgaatttttttagcaggtttccagttttgagtcctactcgtgcatgcagactgtgaagctgtgtaaggccttcttgctataaaacttgcaaacggaaggcataattcaaaacagaatttttcacttcttgtgtgcatcctggttagcaatttgtaacgaaacatataaacttccactgtcatacacagcaagggagatatttggagaggataatttgttttctgtcgttaactagtactgtagtctagtattcagttggtaccacgtcggtaagcaccaagccaccaacaatcaagattcaagagtatgttagaggcatgaaaaatgagtgcaagatattaaggtgccctttttctgagtaaaagataaaagataagggtttcaatttctccataatgaaaccagctgcttataaatgtcttgccttcagtaaaaaaatcctttagtttgttgtttgctcctgatagtttatatgtttcttctgtcaggcctttcttgttgggaaggactttggggccatgccagcttatagttttgctctctgtcatccaaatcgtacatgtggtgtgatgtgtttgggcatccctttcggcgttaatagttcatccttaaacaccttaccagaaggattctacattttacgttgggcggtaattctctaactatcatgccaaaatattgtgtgcaagattcgcttatagtgacagtggaagaactcgtcttgcagcaaccaggaagagcagaagctgactttggcaagtatgatatcaggagagtcgtgcgcactatctacatactcttctctaggaacgagatccccatagctaaggaagatcaagagatcatggatcttgcagacttatcgacacccctccccgagtggtttagtgaggaggatcttgatgtctactcatccctctatgagaagtctggttttcgatatccgctacagatgccatataggtaaacatcaattcatcagttgtcagcactcataacactaagtttatcagtgtttgatagtttgggatttgtgctatgctttgttaggtccatgcatcaaaacaaaccaattggagatgcaaaatttcaagtcccggtgtttgttgtcatgggagagaaagattatgtcttcaagatacctggtatcgagtctgttatgaaagacggcagcatggagaagcatgcaccagacctaaagatcacctacattcctgaaggaagccattttgtgcaggagcagttccctgagtttgtgaatgagcttcttcttagcttcttgaaagaccatcctatggctgtttagaaactccacattgtgcctcacccttactacaacttcgctacaagaacactatattgttcgatattatgatgtgaattatcaatgaaggaactggtatggttgatgttactttcagcaacgccagttatgtttgaacttgttataccctgtgtctgcggctagtgttgtcagcaatgggaagattttttttgtttttttctcctggctgttaatgttataccctgatcttagcaaatcaaggcattagtactttgacacaaaaacatgcttagagaatcaccaacggttcccttattccatcccaatcctagttttttggaattttggtgaaaaataatgcctccaatagatgtcctatttgaatcctaattgtttggaaaccctttgccgcatcctttgttctatttacttgagggagagcgacgtcgtgtctgtcgtcccctatctctcattcgcacgagatttttctcaagggtgagcgtcacgagcgcatgtgagcgccaggagcacgtgtgagagggaggaaaacgggaaaattggtgttagtttaacagaagtgcccacctttagttttgggatattttaggctttctcttggagagatcaattttttggctacctattttcacttcaataagccaaaaaagaaatctttgggggaagattatacataatctcctagtgatgttcttagggactctttgaaatacagggttccaataatctaggtgattttagtgccacattttcctgaatttgggttatcccaggatcggatcctatatcccttattaacactcccgataatctgggtgattttagtgccacattttccagaatttgggttatcccaggatccgatcctatatccctaattaacactcccggcgattctacccaactaggattaaaaaaacgcgaatattagggaaggacctaatatcaaataattagaaggggtgaggcttcgaacccaggtcgtctattccaccaccttgtggagctagtcggaagactacttgagtgtttctcaaaagagggatgcaacaaaggacttttaaggaggtcacctatcctagtactctaggattactatatgattcttgaaaatccaactaattaacattctttgaactaaatacaccctataagcgtacatatataaataaaaaacaaatctataaattaaatgttgtgtcgtttaaattccaattatatcttgaaccacatgaaaaactcacgttacctcttgggtcacttgattacatgcaaaaagaacaaattttaagacaataaggcctggtttagttcctaactttttctttaaatttttaacttttccatcacatcaaagctttcctacacatacaaatttccattttttccgtttcatcgttccaatttcaatcaaactttcaattttgtcgtgaactaaacacatcctaattagaaataaatgatgtgaaacccaatgcgtatttcttagtatttattgggaaaagaaaatacttcctccgtcctttaatataagggattttgatatttttgtttttaccatttatcttattaaaaacttgtgtaaatataaaaaaataaaaagttgtacttaaaatactatggttaataaagtaagtcacaaataaaataattaataatttttaaaaaaaattaataagacgaatagttaaaccgtacgaatagttaagaggacagagcctacttttgtcaacgagttggagttcgacgtggagcagcaatgaatagccgcaaagtacggtagcttttcccatccacgtcacacttcacgctgtcacgtcgcgatctgctctctcttcccactgcagtgctgccgcgtgagcgtgaccgcgtcgtcgtccacggcgagctcgacaccatggccgccgccacggagcagccgcagcagatcaccgagatcgagcacgcccacctccccgtgcgtgggctcagcctccacgtcgcgcaggcgggcaaaggtacggccgcctccgcgcgctagccctcctcccccccccccccccccccgaccacttcgttcgattccttggcttgctttgcccgcccgccgcgccgcgccgcgcgcgccgccgtagctagcccaccaggtgtttgtttggctgtcgcatgcaggggagctcgggacggtggtgttcctgcacgggttcccggagatatggtactcgtggcgccaccagatgctcgccgtcgccgccgccgggtaccgcgccgtcgcgcccgactggcgcgggtacgggctctccgaccagccgccggagccggaggcggcggagtacgacgacctcatcgaggatctcctcgccatcctcgacgccctcgccgtgcccaaggtaagcgcctggatcagtttggctttttcacaaattttatcctctttgagttactgagtaaatgagaggcaaaattcataattggttggacaaagtttagaagtttcgatggatttttgtagtgtattgtttgagtcatggataggttgtgaccaaacaaacaaactttcaatatcgtaagggagagatttggagaggataattgataacactatcagttctaccgaattgatctgaagctggtagatgtagcaccaacaatcaagagtatattagaggcctgaaaaatgattacaagatattaaggggcacttttttttctgtataaaggatggaaggatatcaattattccctactaaaccaattcctctttttttttttattttcttgtgataacttatacggttcttcgtgtcaggcattccttgttgcaaaggattttggggccttggtagcttatgattttgctctgtgtcacccaaaccgcacatgtggtgtgatgggtttgggcatccctttcggtaacgatgcttcatccattaacaccttgccagaaggactctacatttttcgttgggcggtaattgtcagactgtcatgataaaacaataagtgcatggtttgcttgtaatgacagtaaaaaaaactcatcttgcagcaaccaggaagagcggaggctgactttggcaggtataatattaagagagttgtgcgcactatctatattctcttttctaagagcgagatccccatggctaaggaagatcaagagatcatggatcttgcagacttgtcaacaccccttcctgagtggtttactgaggaggatcttgatgtatactcatctctctatgagaaatccggttttcgatatccactacagatgccatataggtaaacatcaagtcattaattgtccatactaagtagtactgagcttaacaatatttgatagttcgagattttgtgctatgcttgttaggtctctccataagaggaaaccaattggagatgcaaaattccaagtcccagtgtttgttgtcatgggggagaaagattatgtctacaagttccctggcgtcgagtctgctatcaaagacggcactatggagaggcatgcaccagacatgaagatcacctatatccctgaagggagccattttgtgcaggagcaattccctgactatgtgaatgagctccttcttgcattcttgaaagatcatcccgtggataaatagatgttattgtagactcaattgtgcttcacccgtagtacaagttggcgatggaaacattgtgctatatcatgatatgaattgtcaacaaataaaggatatattatggatggtttgttactttcagtaatgcatgtttgagcttgtgttgcgtttagtttctcctgctaatgttgtcagcaatgcaaaggccaaaatgttattatattttaacctagtattgcacttaaaccatcattttagcaagccaatgatgtgaa

SEQ ID NO: 59810 - DNA, 12759 bp, Oryza sativa
ccgcccattagcatttccgccacatggcatctcagtgtcgccaccgtcgatgagggagatgggcatacatgcatggtatatcggtttgcactttttatttcagcgaaaatttctgtagcaccaaaatacgaaatttcatgatttttggcattttagaccaaaattatttgaaatttcgactgaatttgaatagactttgatcaaacttaacaaaaaaaatttgacatattttaaaattccggtcgatataatgacttgtcggtggggttcgaaatttcagaattttccgaaattttgaaccaaaatcgctatcactagtcatgcgagcacgaagaattagggaacaattcaatatgaattcgggttaaacccatttatgcccaaaaataccagtccaatccaaacccttttttcttttttttttttgcctcagtccaaaccgctccggtccgttagctcactcaacccatctccacccaaataaagcccacccgtagtgaaaagggtaaaatccagaagaacaccacgcacaagcacaaccttgaaaatctgaagagcacacgaagccctaattaaccaaaacctccgccgccgccgccatggccgccgcggtcgccgcctccccggcgcaatcccgcaagacggagacctacaccgacaccaagcgccgcgacgacgtccgcggcctcaacattgccgcggggcgcgccgtcgccgtcgacgcgcgcaccttcctcggcccacgcggcatggacaagatgatctcctccagctcctccggcggcgaccaggccgtcatcatcaccaacgacggcgccaccatcctctcccgcatgcccctcctccagccggccgcccgcatgctcgccgacctctcccgctcccaggacgccgccgccggggacggcaccaccaccgtcgtcgtcctcgccgggtccctcctccgccgcgcccagtccctcctctccgccggcgcccaccccaccgcggccgccgacgccctccacctcctcgccgcgcgcgccgtggaggtcctccacggcatggccatccccgtcgagctctccgaccgcgacgccctcgtcaagtcggcatccaccgccctcaactccaaggtcgtctcccagtactccaccctcctctccccgctcgccgtcgacgccgccctcgccgtcgtcgacccggcccacccgtatctcctcgacctccgcgacatccgcgtggtgaagaagctcggctgcacggtcgacgacaccgagctcatccgcggcctcgtcctcaacaagaaggccagccatgtcgccggagggccaactcggatcggggacgccaagatcgccgtgatccagttccaggtctcgcctcccaagacggacatcgagcacagcgtcgtcgtgtcggattacgcgcagatggatcgaatcctccgcgaggagcggaattacatccttggcatggtgaagaagatcaaggcatccggatgcaacgtcctgctcatccagaaaagcatcctgcgtgattcagtcaccgatctgtcgctccattatctcgcaaaggccaagatcatggtcgtgaaggatgtcgagagggacgagatcgagttcatcaccaagaccctcaactgcatgccaattgctagcatcgaacatctccgcgaggacaagcttggtcatgcacatctggttgaggaaatctcggttggtgatggtaacaataacaagattgtcaagatcactggcatcaagaacatgggaagaacagcaactgttcttgtccggggatccaaccagatggtgatcgacgaagctcagcgcagcctccacgacgcattctgtgtgatcaggtgcttggtgaacaagaggtttctgatcgctggtggtggtgctcctgagatcgagatgtcgatgcagctggctgcttgggcgaaggagctgagagggatggagagttactgcgtcagggagttcgccgaggcgctcgaggtcatcccttacacgttggcagagaatgcagggctcgatcccatctccactgtcaccgagctccggaatcgccatgccaagggcgagaagaacgccgggatcaacgtgaggaagggtcggatcacgaacatcctggaggagaatgtcgtgcagccactgctggtgagcacgagcgccgtcacgctggcctgcgagtgtgttaggatgatactgaagattgatgatattgtcaccgtgaggtaaggttaattaattatgtggtggctgaccgtgctggcctctgctctattttgtctgtcatgttatttaggagatttgatattttgacaccttctaaagtggcacgctttcgttgattcagatggttcgaaatatcatgcattctcacaactgtcaataaaatcaaattggtacaaataaagtgtcaaaccatcaaatttgggttttacaattttatttgtttgcgtgccttttctgtctagatgttctgagcgtatgtatttgacgtctgtggaagagaattatatgttgtatttgcctctacctggatgaaactgaagtgtagactgccggaaacgccagttagcgagcaacccaattcggcgagacgcagtccaaattctcaccgcgcgagccggtttggatgggccgaggtcggcttggattaggcccatttaggcatttagtgaacatattagatacagtctattttgcctccctcaaagtgtagccctagcttgatttatttcactcgaccgcagaaccggatatagagcctctctcaagtctcaagtctcaactctcaactctaaaaacctgttcaatttaactccttaatatggcatctatgtaaactacagataaaagtaaaaataaaaattcaattggaccacatgctagtgtcataagtaaccccctctctcacaactatttcttccttttcactctactgtggtgtgtgtgagagggccagcgagccgaaggcggatcgaacgtggaaggcatcggcggcccaaggccttacgtggctggcgagctgaagacggattgagagaaggaggcatcggcagcccaaggccttacggggccggtgagctggggctaatagagctaggaaggtggcgacccttcgaactagggaggcatcgacgacccaaggttttatggggctggtgagctggaggcagataaagcaagggaggtggtgacgcttcagagcttcgtgacctaacgtagtgtgacatggttagtgttgtcgatgaaaaggcctcacggagtatgacggggacgagtcgacggtggtgctccgtccagctagcaacgacgctcttgtggactcacagatcgagttgttagcatgagttgactaggtcaacatgccacataaaacaaaagcaatatccaaaccaccaaacctctaaataagacaaattgaacaggttatgagagttgagagattctctatatctgattttacgattgagagatatggatcaatagttgagggaggtaaaacatatttttttttccaacacataatcgaattaagctaaccagcccacatagggctcattattacatagaaaactaaatttcgttaaacccgtttaattcatcctcctgcgcacgagctgagcgcgaagtggctttgccatgacggtggtgaactccaacttctcggcaaagtccacctcttcgccggcgatctccctccactcgaactccctgaccatattggccacgaagtactccaggtgcagcatggcggtgttgagccccgcgcaaatcctccgcccgacgccgaacggcatcatgcggatccccttgctgcccgtcacgtccaccccctcgccgtcgccgccggggaggaacctctccggcatgaactccattggattctcccattctttctcgtctcttcccatctcggccaccatgaagttcaccgtggcgcccttggggatgaggtacccgccgacctccatgtcctccgccgccttgtgtggcagcgcgaagtggcccggcggatgcttccggagaccctcgaggatgacggccttcaggtatggcatcttctgggtgtcctcctcggtgatctcgtcgtggtcgtcgctggtcttggacttgatctcgtcgtggagcttggattggatggatgggttcttgaccagctcggccatgatccattgcagcgtggttgacatcgtgtccgtgcctgcgtcgaggaactcggagcagagcctgaccatctcgtcgtcggtgagagcgcggtcgccgccgtcctcagggagcttgatgtcgagcagcgtgtcgacgtacgagtgctcgaacgtcgtcgtctccttctccggcaccgcgcgttccgcgagttggttcttgcgctctcgccgcgcgctgatgagcggcatgaagagctccttctgccgccgccgcagagcgaggctcgtctggatgcgcccacggaagatgtgcttggtgaccgccgggcagaacgcgaagaccttcatcttcgtcgcgtagtgcaggagccagccgtgctgcgcgtcgccgatggcgcgcaccgcggcctcgtcgagccactcgccgaagcacatgagcacgaggaggcagaacatggcgtgccggaacgcgtccgccagcacggcgccgccgcccaccaacccgtcgacgagcgcgcggcgagcccaggagcgcgcgggggcgaaggccgcgcgggcgcgcgacgggtgcagcgtctcggcgacgaggttgcgccgcaggaggcgccacgtcggcccgtagttgccgcgcgagatggtgttgccgttctcgccgaggagcgcgcgcgtgacctccggccggtccgcgagcgcggcgccgcgctccaccagcgcggcgtgcgcgacgcggcggtcggcgacgaagatggacaggtgggatcccacgcgcagcgacacgacggggccgtacaccgcgatgaggcgccggagcaggggctccaggtcggcggaggagtggctcagccagagcaggttgccgaggacaggcacggcgagcgggcccgggggcacgcggctgcggccgccgcattttcgcagcgagaggaggatgaagagtgcgactaggaaggcgaggaggagcatgagccactgtgatgcgtcgacgttggccatggcgatgacgtctcgctccttgcgttgtcaagatgctcatgctccgcttcacttgtgggtggagttgattggttcgatgtccatggcacacgggcctcaaatccattctagtgggggaaaaaacaaaaaatagtatgtatactttaatagtattaacctcaaatccattctacatagtgaggaaaaaaccaaaatattgacaaaattataaatatttttttctacagctaaaatgtaataaatttgaggttaagattttatacgtaggtacaatactattgaaaatacatgtacatatttttctcgatttttttgtgatatttgtttgttgatgtgcatggtgtgtatatgtgatatgtttcctttatggttaggtctatcttctaaaatttaatcagcaaatatcattgaaactgcatctggagaagcttctataaataaatattattaaaatgcgccagcagattttgaaaatttaacggcacgtgtttaagatctctaatttttttctcggctaacctagctaaggacctgttagttccaaaaacaaaaactttcacgctgtcacatccaatgtttggacatatatatgtatggattattaaatatagaaaaaaataaactaattacacagattacgtgtaaattgcaagaccaatcttttaagtctaattgtgccatgatttaacaatgtggtgctacagtcaacatttgctaatgacggattaattaggcttaataaattcgtctcgcagtttcctagcggaatctgtaatttgttttgttattagactacgtttaatacttcaaatgtgtagccgtatatccgatgtgataaccaaactcaacaattttcaccaactaaacaaggcctaaaccatactacagcccaccaaaacaagcttgatcggtcattagcttgccgatgaaggagacattctaactctccttaggggtagggattttctagtcaggttagtttgctaagcactaagcagagctaatttttgtagtaatttgctaagccgtttggtttaaaaaaacactcaattagtttattagtattaattaagagtgaactattaaaagcttcgtaaatggattttctttggattcttagaaaactattctaatgatttttttttaaaaaaaaaacctgcatggtttagcggcatgaaaagtatgaccgttataaggagcggccaataagacttccttagaattaacactggtaaggctgcgttcgggaggtgatgttaggcccgcgcacacaaaacaaagccatgcattttatcatgattaattaagtatttatattttttaaaaaatagattaatatgatttttttaaagcaactttcgtatagaaactttttttaaaacaccgtttagtaatttaaaaagcgtgcgagagaaaaatgagggaggtgagttgggaaagttgtggaaagaacacaacttaaatcatggtaggtagatgtataacactttaaattgattaatatgtatataacttaaagtacaattgtatcatggcaatcctaatcttccatctcagctagttttcatagcattaaatatattgctatataagaaaaaactaaggtggcaaagagagttaatgaggagaaataaaaaaaaaaagatgaacaaaccagctccatataggatccgagaataaaaaataagaggattagtggatgaaaggagagagaactgaggtgattggatgatgatttattttaaagaaaccacccattagatactccctctattgagcattgtcaattgattatcatataacctttttagttattcccaaattatcatcatattaatatcaattctctaatctattcgttatctatgcatgaaaggcaatggatattggtgcatgcatctatgcacataactcttcacaataacatgcaatgtctttatttatcattggctagaaaatggtgcatgcatcgaatttgttatcggaataaatatagtataagagggtcattgtcttttgttagtcttggtgtgaataaagtctgtcatatttgttaaaaaaatgtaatatgatgatcaattggaaacaaatggagtttacagtttcaatacctaatacataacgtttgtatgatatggtatgtatggaaattagtcgataatatttttccagtataaaaaaaaacaatgagctgccgaaaatggcatcgctataaaaggataagtcatttcattgtccacttgcgattttgtgatagtgtaccgtatagtatcgtgcggatcacagtatccttaaaacgtcaaattgctacggacagaaatagtactatattactatcatgaccgcagagaaagtagtactgtagaaagtagggagtggattctaatccttcaaggggatatcccctcgtatacctttttcttttaaattcgatgtaaatagttgtgaaaaattctgaaaaaatttgacaatatagagcataatgatacctactagtccactgaaattcatgttcaaattcgatctacacatcgagaaacaaaaaaacaaatttagatataaacagtacactactattcatacgctgaatttgtcttttttatatctcaatgtgtgagttgagtttggacttaagattttgtggatttgtatatatgtgttgtatgaatgttgtcaaatttttttagaatttttcataaccgtttagatggtttttaagcaaacgatggaacatcccctcgaaggattagaatagtttcccgtacaaagtaccgcagtaagccagtaacgttctcctccgtcgttgactcatatatactccctcctccctccttctcaaaaaaaaaaaaaaactctagccatgtataataaggcctatatagcacaggatcctttgatcgtcgtaggaaatttagggctacttttgaaaacgagactgaaaaaacgttcgaatagtaaaaatataagatttttgatatgaataaaagtgtaaaatagaatattacaaaacataaaaataatcgtttaattggatcgcatcaaaaacgcaaaaattagatgagagagaaaaactcaaaaggaaaattctctgagttctacctcgttaaattttctccaaaacttgtatgataaaagatattcctaggaatttcataagattcatttgtattcatttcttttgattcaaaaggactgtaaaaaaaattctatagaaatgaaattctccaaaattcatacaacttcctttgaattaaaggggagcattttttttcctctactttaagaacgatgcagatatgcaattaaccaaagaaggagtgagataatcagagattaaccaaaatgattgtttgactagataagaaataatggatgtcgtgtaatcatcactactgattttgctatgttccaacaaccagccccagtgtttcacttattaatatgcttattcgaatcatttattagcaaataaaaagcacatgccgtaaaaaaactacgatgaaaaaaaaatcaaattcaaaatgaatttttggcttataagcataagcataagccaaaatagagacccatttctatccataattcctaagttatatatgtatatattctccgtttgttttgtacatgaattcatgcgttttgtagtattcctatattttcctttgaatgttttaggtttcttacgttctaaacaggccgactatcattcacaacaagggtggcgtccgcatgttctaaggctgagcgcaggaggataaaagaaagttggtgaagtgctgtctctctagcagttggtgtggatcgttgtctgcagatgcagggtcccatagtgtgggaatttactctgttttttagctttttgctgttgcatcgtgtaggattgggtgttgtaggaaccccagaaaatgcaagttgtaagacctgttggtgtcattttcttaatgaaatgggagaggttattctctctttctaaaaatctatatccatctcgtacaataaaaggcacgagagatttgtgaaagaaagtccagcagaaaatcaatcggcatggcgggacgaatacaggttggccatatcaatgcagttgcaggctcatttatgtagtaatccgtagtactattacaaatggtctgatcaggcacgtaaacgcattcgcctttgacatgcaatttcgcacaacacgcacgcctagtgtcagtgcttttgcaaacacgcaaaagaattacacgtcaatataattgcaaaaggattatacgtcaatatattagaagaaaaagagtttttatttcacaacgcaatcacctcgtgccactgctaatgcctctgtctcaaaatatacaaaaattggggttaaaaatgggtactaacaaagttcatagaattaaataggagaatatagtaattagttgataagagacatatatatatatatatatatatatatatatatatatatatatatatatatatatatatatatatatatatatatatatatatataaaattaaatggtgaaaaatatgattagttgggaaagaatatgacgaagaagttattgtatttttaaacaaattttaaagggaaattgttatattttgggagcgagtgacgcaatccggattctcacgggggcccttagtaaaaatgttacacgtatgagagtttattttgattcccttaacatagtaccctcatagacatcgtccccaacctcgactcctacaacacctttattctcatagacactgaaaatgtattttaatgttttaagaggatatcccatcgttaaaaattataaaaaaataaaaaaattaacatgtgatatatcaccctataaatatgtaagtttaaattcattctctacgagttataaccaaaataacatatttaagtagaacaatcacaatcatatttttttcaacttatagaggtgaaatttaaacctagatatttgtgaagtggtatattacattttaatctatcttcataaaaaagttgaggaatgtgttataccggttttgtggctaagggatacgattcgacaaagggcaagagcatagggacgcatgatagacttattcctttagtaaacacatactttaattaactaattaaagtgtccacattaggcccattatttgtaccgagtactaaaaacttgattaaaagcccatttaatcgacgctcctgagcaccagctgcgcgcggagtggcttcgccatgacggtggtgaactcaacttctcggcgaagtccaccttgtcgccgaccaccgccttccactcgaactctctcaccatgttggccacgaagtactccaggtgcaacatggcggtgttgagccctgcgcacatcctccgcccgacgccgaacggcatcatgcggatcctcttgctgcccgtcatgtccactccctcgccgtcgccgccggggaggaacctctccggcatgaactgcatcgggttctcccattctctctcgtctcttcccatctcggccaccatgaagttcaccgtggcgcccttggggatgaggtacccgccgacgtccatgtcctccgccgccttgtgcggcagcgcgaagtggcccagcggatgcttccggagaccctcgaggatgacggcctttaggtatggcatcttctgggtgtcctcctcggtgatctcgtcgtggtcgtcgcttaccgtggccttgatctcctcgtagagctttgcttggatggatgggttcttgaccagctcggccatgatccatggcagtgtggttgacatcgtgtctgcgccggagtcgagggagctcagagcataggcataccatcgctttgtcggtgagagcgcggtcgccgtcctcaggtagcctcaggtcgagcagtgtgtcgacgtacgagtgctcgaatgtcgtgtcattctccggcaccgttgctggtcgtttgcgctaaaactaatctgcagttagaaaacaatccgactactaaacggcaaagccaataatattgaaaattaaatcgatgaaatcgccgagattaatcccttcggctggattgaatccgagacgaaaaaaaaacatgcttgacgaaatcggtaacgtcggagattggttccatcgcactcatcgacaggaaactcgacagccccctacctggcgcgccaactgtcgaaacaagatttcggcaatataaacgaggtagcgcacgagacctaaaagtagaaggacgcgaagacaagaattttagagggactgactatccatttgtcgggtgatttttaacaagaaatcacctaatttttttctacccttagatttacatctaacaaactacaaaaagaaaataaaaaatacatatttacttacacatcattgttatcaaaattacaatgcacttgcatgccatatcaactgaatttacaaatgtaattttagttatataggactgtaattttacaatttaaagaaaataacaaatacatatttacttatatatcattgttatcaaaattacagtgcacttaaatgtcatatcaactaaatttacaaatgtaattttagttatatataactgtaattttacattttaaagaaaatacaaatacatatttacttacatatcattgttatcaaaattacagtgcatttacatgtcatatcaactaaatttataaatgtaattttagttatatatgactgtaattttacattttagagaaaatacaaatacatttttacttacatatgattgttataaaaattacagtgcatttacatgtcatatcaactaaattacaaatgtaattttagttatataggattataattttgtattttggtttcaaacgagagagaaggagagagaacaacacgcatgtcaatttttcagagcgtaaaaaaagcgagactgaccgatcgacgctggtacacgcggcccaacagaatcctatgcgggttcgcgcttcccagcccaatatatgcgcacgaattttggcacacattgaatggcctaaaaaatgacaaatctgagagaaaaaatcacacgacaaatctatagcaaaatcgcgggactgactatccatttgtcgggtgatttttaacaagaaatcacctaatttttttctacccttagatttacatccaacgaactacaaaaagaaaataaaaaatgcatatttacttacacatcattgttatcaaaattacaatgcacttacatgccatatcaactgaatttacaaatgtaattttatttatatatgactctaattttacaatttgaagaaaataacaaatacatatttacttatataccattgttatcaaaattacagtgcacttaaacgtcatatcaactaaatttacaaatgtaattttagttatatataactgtaatattacattttaaagaaaatacaaatacatatttacttacatatcattgttatcaaaattacagtgcatttacatgtcatatcaactaaatttacaaatgtaattttagttatatatgactgtaattttatattttagagaaaatacaaatacatttttacttacatatgattgttataaaaattacagtgcatttacatgtcatattaacttaattacaaatggtattttagctttataggat

SEQ ID NO: 59811 - DNA, 7814 bp, Oryza sativa
tgcgcccgcccccatcgccgccgtcgccgtccctcgccgccgctgccgccgccgcgcccgtccaccaccgtcgccgccgccgtcgtcgtcgccgtctacaagggacgactgcaggtggccggccgcgcgtcgggatgctcctctccccaacgggatgtccagttatatctagcaggaatcacctgatacctggtaggtatcatccgatacctagtaagtatcacgtgatacatagcagaaatcgtcggtacctgacatgatacctcgcgagtatcacgcgatacgtggtagaaatcgtctgataccttacaggtatcacatgatacctcacgagtatcacacgatacgtggtaaaaatcgtctgatacctgataagtatcacatgatacctcacgagtatcatacgatacgtggtagaaatcgtatgatactgtaacaccctaaaaaaaaaaggcaggcaagctagcagcagcagctgggccaggctcggtagcaggccggcccaagcggcagtagtagcaggtcgctacagtaccgtcgtggtactgtagcagccgattagtaccacctcgcctaactagcttgaggagcaccaagatataaggacgagagcctagaggctgttaactctgattctggaatttttgctttaaagcgaatttttgctttaaagcgaggatgaaaaacgtagtgagttgcagtattaggtgtggtccaactaaatgagccgttttcgggccctgcacaaatggtatcagagcagactctcgcggttgcgcgtgcgggcatatagcgcatgtgggctccgtgtgaggcacatggcatatggcgccggcattggacggtacggtcgtgcgccaaaagagggcggcgtgttcgacagttcgacggggtcgtcgaacccctgagggtgggtggaatgtaacaccctaaaaaaaaaaaagaaaggcaggcaagctagcagcagcagttgggccaggctcggtagcaggccggcccaagcggcagtagtagcaggtcgctacagtaccgtcgtggtactgtagcagccgattagtaccacctcgcctagctagcttgaggagcaccaagatataaggatgggagcctggaggctgttaactctgatttcggaatttttcgttaaagcgaggaccgaccacaaatagcgctatctggtcccaaaactaatgattcggaaaccgacatgtttatactgtatcaagcttcggaaaccgaccacaaatagcgctatctggtcccaaaactaatgattcgattcggaaggagtttatattacaaaataataggggaatttacaaaattgtggctaactaatacaacagaagctataaaatgactcaatcctaatgttttaaaattgtggttttactatagacttaaaccatctaacaaatctagacttgaaaactaggttaaaatattgtggttttactatagacttaaaccatctaacaaatctagacttgaaaactaggttgaaatgaaactaacttatatgattgaactttcggcttcggcaagaactccaaattaactctgaaagaagaggggttgaagcaagggtgagtataacgtactcagcaagttgtggttttactatagacttaaaccatctaacaaatctagacttgaaaactaggttgaaatgaaactaacttatatgattgaactttcggcttcggcaagaactccaaattaactctgaaagaagaggggttgaagcaagggtgagtataacgtactcagcaagctattatatttaagtatgaatgtatgaaataatagtatttgagtagagctagatctatttgcagaaagctgagaaattagaaggagaaagtctataatgtgttgaaatgcaacagtatttaataaatctggagttatatttctaaccaagatgccatagtgagtcccgatgctcaatatccgtgagcacggctattcgaatagtttcagagatactcatactgcagtagatgtacgctttacccgcaatccatgacatgctaatattcatcagcttagtcatggcaaagcttttcggttactaacatcagtggcacctgttccatgaactctcatcctcatgcgctctgaacgtaacgttatcagcagcgagaggagttctggcgttcccgaggtctttagagagaactggttgagagacccccgtcgtcccaaccaggttttcacaatacacacacagcgcgcaataatcaatatatttacccgcgcctcggtaaatattataatcgccctgctcggcgtaaatttgcctcctgcgcgaggacttaaagaagaaccactatacagaggtaccacctttgttagataacctactttgctaagtctgtccccattctagaattgcggtcgtactcgttcgttcttcacatgtacttggcaatcttatgtcggttggaacagtactagccacccggaaatcaaccatttctaccgtactgttccaatctaagttcattatattttatgcaatctaactaggcatggctaagcaaaatctagcatatatctggtttgctatatgttcaagttatgcatttaaaatcatgaatggctaatgcatggaataatagagatatagaatataggataataatgctcaaaggggtggaataataacttgccttgctccaacgcaaacaaatccgagataggcaacctgattatccgatcctcgaaacatcacaggttgccatccaaaagataatagactactaagaaatacgaagaactaaattcaataaaagccataaaataacaagaaaacgataaatggttaggacggctagggtttggttgtgtggtagtcgatgctagagcataacgactaggtttggtatcttctctagccggtgtcaacagacagcataacggttagagggataggaggtttgtgtgggtttagtggggcggaagtgttactccgacaaccgtgagtggtggcggagcggctaggatcacacagagcccgagagctaactgtgcggcgtgctgtggaggtcgagggaatagtgaagctccgaccgctgtacgcatcaaggcgtggggtgccaggagcaacacttcgaccttgggtttgggctttgccgggctttataaccaacggttcgacgtcgaggatagaaaaccacgaatgtccccatggaaggcataaagttccaaccgacggctttttagtggctaaaggggtaatttgggacaaaagaaaatatttgaaaaggcaaatataaattcaaacgatatttgaatagattcaaataaaattataaaatagcaaatttggtgtcaaaagatagggtttgaatttagataaatttaggtccaagttttattggaatcggatctacggtttaggagatatgggcttctaaagattgggttttgaattaaatctagaaaatgagaaaagtcactgtgcaggggacccacctgtcaggcttttctttttcttcttctttttctttctctccttcttcctctcgttttcctttcttcttcttccaggctcccagccgagtaacagaggagggagaggattgggcgccggtgctccggtagccggggatcggcaacgtcggtggcggattgcgttcccgaacaacgcgcatccggggaaggcagtttcaagcgaagggagttagagaggaagccggaacggcgagtggaagagcttgcctccggcggcaaaagaggtggctatggtggcttgatgaagtggttagggaagaggggaaataggtaaaatggattctccttgtcgaggcgaacccgatggtgcaagtatttggttggcaatgctccagtgagggagatcggccgatgactggtgagggcttgccatggcaggagagagagagaagcagagcttcaagctctgttgatgtgaggaaaaggagggtacctcgccggctatttataggcggcgaaggtcggttgcttatggcggttttggaggagtaggtgaaggcaaacacgatgatgcatcggcctgtaggaagggaagtcggcgccggctctgtcttcgattggccgatagtgtcggttcggctcggcggctgacggcggcagcgtgaggtggcggctgacgtcggctgcggttgcttagcagcgacggaaagacggcggcggcagttgatgaacacgacatggcgacggtggcggcgcgacttggcggcgacggaagaggagcttgcggcggcgtgcgccgtgcgcgtgtacgacacgcactgggaggagggggcggttcggctggggttggctgggccgaattgggccggctcggcttagctgggccggcagcccgagagggaggaggaaaatagaagataaaagaattgggccaaaaggaagaaagaacggagtttcggcccgatgacaaaaaggaaaaagtctaatttgaatacttaatatgcaaaactaggttttgcaaagaatttgaattcagaaagaattcacaaaagagatttcctaatatatttgagtgcaatatttagaggtggagtttgagggaatttatttggaagcactcaaataggaagggtgagcgatatatgaataaaatttaatatgtaaataggaaggtgggaacaagatagttggagaaggataaatagggttttagcctcaaaacatatggcatgggtttcaaagaattgtttgaggctaataggaaatttgaatgacaaagatataatctattttcttagcacaagagcaattattcacaatattcgtaataatattattcttgtgccgaggaggaaatcaagccacaggaattaaattgacggctagattggaagaaggaatttggatacaaatttggaaaggggactaaggataggtttggaatcaaaggatagattgacaattaattccaataaatttggaattgcttcggttttggttcaaggatagtgttggaggatttcttggaccatgattcataaaaataaaaaggggttttcaaactaaatttgaataaaagaattttagtcaaaagaaggtttttaaattaaaacccaaaatcaagaaactccttaatttaactaaatatatttttaaaggaaagacacaaaagaaattaaataccagaaagagatttaatgcaggttaattttaggaggtctctttaattataatatcctaggtttaggaggttaataaaaacgtaagaaccggtatgatgcataattagaaaatagctaattttcagtatgttacagatacttgataagtatcatatgatactttgcaaggatcacctaaaacgtgtgtaaaatcatctgatacctgataggtatcacacctgatacctactcgggatcttcccgttagaaaatgggattccgttatatagcagccccccaaagaaaagatggatagtacgcagcgcagcgattcggaagtatgtgtacgacgaggagggcgattctcaatttcaccacatcgagaagagaaaggcggaggctggcggcggcggtggcgacgacgaccttggcagtggccgtccaaggcgatgacggcgacttggactacgccacgatggtcgcgcgcacggctcatttcctagcggtggtccgtggtcgagcgctacgcccggatggtgcacaagctagttctgggactaagttgacgagtatcatgtgtggaatgcgatcgtctcgacatggagcacccgtcggccgcggctgtcgacgatgacggtgacgaccggcctgcccccatcgccacatcgacgacgtgcggtggactgacgcggtggagcggacacggtcagagatcgaggaggcgagcgagcgcgagtgcgtcgcagtctacgagctgtggaggaaaaggtggtggcagtgtggagccgtaggtgggatttgggagaaaacaacacccaatagctgggaataccgcgttagacacttagaaaacgcggtagcaggcagccgtcgtagccgtcgaggaagacctagctcaacaaggcgtcggagacctcgtcgccgcttctgccagctacttgattccgctctagtcctggaggcgcgcgaagtcatcgcggaggcgtggctgcgtcccaacgacgggcaccgatgacacgccattcccggcgcgcgtgggagagggagaggagggagagggagaagatttagctagagacatgtggggcccaccgcccacatgggtcacactcatcgcgtcagtcgggctactatattgtcgaggaccaaagttaacacggtatggtgaatttgaggatgagttataccttttgtttcggtatagggaagaattttagactctacaacaacttaaaggacttaagtgattctttccagcaatctagcccaactggcaagctggcgggctggtcgccgtcgatgaaggcctgttcagttcccactattagggctttttcggattagaggatcttcacgtgattttcggaggaatactgtgcataggaattttttttcctttcttgtcattcagatcatgaaaactgtggttgtaggaaatccaaagaaaagtttcctttgatgctgatttcacatgaaaagtatatgaaaaatccgtccaccttaagctctttttttttattcctgcatgcaaatcccaggcaattaatttcatgttatccgaatgtcctcatttttttttattcctttgtttttcattcttatgtttcacacttagattcctttcctgtttctatactttcccaatcctatatttttcctatcctataatctgaatgaacccttaatcatgatttggaaattccgaaccctggttattttacatttcacaactaatcatgcatatctattcataatttcagaaaagattacagtaaaaagtaccaagtaataagctagtaactagttgatacccccgcgctttgcagcaaaatatgtggataaatgcatgttataccatttctataatgtataacatgcataaatccacatatctctagcaaagcacgaggtatcaactagtgggaacaatattttagctcaaataaatatggaaaaagtactacacccctgaactatcgaggtcgaccgaattacacccccgaactcaaaaaccagacattctacaccctcaactattgaaaccgggcaaattaccccccctagcactgttttaggtggttttgggatagacttgctgacgtggcagtccagtcagcattttatttttttaaaatggtgggacccacatgtcatacactctttctctcttcctccatctctctttctctctcttcgtcggccagcagcaggcagcgccgcgcacaccggcacgccatggtggagaggcgagcgccggcgaggggatgcgatgggcagcggcgcgcgggggcaggccggcggtcggcgcgaacggcggcgcgcggcgaggtggaggggatgggggagaggtgggcgccggcgtccatcgcggagaggcgggccgtcgtggcgccggccggcagcatcttgaggacaacagcgtgaggccgcggcggcggtggtccaggcggagcacgagcggggcgggcagagaggaaggaggtgaggaggccagggagcgggctgaggagggaggagaccggcgagggagcgggaggccgggagagtcgtcggagtcatcccccagccgccaccgtcgtcgtcgttcgagccgctcccgccagagtacgatgagcccagccatactcgttgctgcgacgaccacctctggcccgacgacgaccgccgtgccccgctacccttccccgacacctg

SEQ ID NO: 59812 - DNA, 23868 bp, Oryza sativa
ccgaccgccggcctgcccccgcgcgccgctgcccatcgcatcccctcgccggcgctcgcctctccaccatggcgtgccggtgtgcgcggcgctgcctgctgctggccgacgaagagagagaaagagagatggaggaagagagaaagagtgtatgacatgtgggtcccaccattttaaaaaaataaaatgctgactggactgccacgtcagcaagtctatcccaaaaccacctaaaacagtgcttaggggggtaatttgcccggtttcaatagttgagggtgtagaatgtctggtttttgagttcgggggtgtaattcggtcgacctcgatagtccaggggtgtaattcgtactttttccaacaaatattaaacgaagataatatcctaatgaataggacacatacagaaccaaaagatactatgccatatcgttcgtattctccattgatagctttgttatcaacatatcgtattgactgggcataaaaaatgatcatgttaaaaaaaattgctactatcagcatggagcaagatatacttagttgttgccacttaccagtatagcaggccaaacgggcggcccggcccagcacgacacggcacgccgacggcacagcccactagggcacggcccgttaggcacggctcctgtagcgggccgtgccgtgccggcccacgtgccaaggccacggcccaagcacggcccaagaaggtgctgggccgtgccgggccggcacggctactgtagtggcacgtgggctggtagccggcccactagtacatgtggcccataaaaattgaaatttgaggggaaaaaaagaaaaaaggcagaaaaaacataatataaaggaaaaaatgataaatataggataaatgtgaggaaaatttaggaaatatatcataaaatatatggtacaaataggataaaatgtggaaaaaaataaaaaatatgagaaatatatgggaaaaattagaaaatcgtaggaaaaataaatgggccggtgggccgtgccatgcctgggccgtgccgtgccggcacgctacagtaaacgtgccgtgccgtgccgtgccagcccacgggctgaggcatcggcccaaacacggcacgggataacgggccgtgccggcacggcccacaggctggcgtgccgtgccgggcctgggccggctacagtactgccgtgctcgggccggcccggcttggcacggcccatttggccaggtatacttaccagtgcatgcctcctgaagtgaaactattcctaccgcttcacctctgttttaaaataaaactattttttcatctatctttttatctcaatcaattataactattcttcgttcgtttcttcacctacttctacttttcagccaattatgttttttcttcattattttcacatatgttataactatcggtatccaacttcagaaatacttatttgaatctgttcgcacatttttttaagctcgatctactgatctacactcttgtataagtaagatttaccttccttaactctgttaccagacgttttatacttatgaactctttaaaccagatgtgctaagcacgtattaccattctataccaattttcatttcatcatatcagtatttgattgatcctttcaagcttcctcgccaagtcaatcgagatcatgactgtgatacgatcaagtaaataaagtagtataaaacgattcatacgacgatttttcaagcgtaaactaacagttaaacacccctataaaacaggcgccccgaagtagccagcacagtacgaggtggccgtcgtcgagcacctcgatcgctcgcgccatggacgcctggcagctgttcgtccccgcgatcgccatcctcatccccttgctccggctcatcctcttccgccgcggcgacgacgggagacgcggccgcctcccgccgggtcctccggccgtgccgttgctcgggagcacggtgtggctgaccaactcgttgtacgacgccgagcccgtcgtcaagcgcctgatgtcgcggcacggccccgtcgtctcccttcgcttcggctcccagctgctcgtcttcgtcgccgaccgccgcctcgcgcacgcggcgctcgtcgagagcggggcctccctggccgatcgccccagccaggccgcctcggccaggctcgtcggcgagggcgataccatgatctcgcgcgcgagctacgggcccgtgtggcgcctcctgcggcgcaacctcgtcgccgatacgctgcacccgtcgcgcgcccacctgttcgcgccggtgcgcgcgcgggtgcgccgcctgctcgtcgacaggctgcgggaggagcacggcgacgcggcggcgccacgcgccgtcgtggagacgttccagtacgccatgttctgcctcctggtgctcatgtgcttcggcgaacagctcgacgaggacgcggtgcgcgcgatcgccgtcgcgcagcgggacgcgctcctctacctgtcgagcaagatgcccgtcttcgccttcttcccggcggtcaccaagcacctcttccgcgggcgcctccagaaggctcacgccctccgccggcggcagacggagctgttcgtgccgttgatcaacgcgcggcgggagtacaagaaacggcagggcggcgccaacggcgagccgaagaaggagaccacgttcacgcactcgtacgtcgacaacctgctcgacatcaagctccccgacgacggcaaccgcgcgctcaccgacgacgagctggttatgctctgctccgagttcctcgtagccggcacggacagcacgtccgccgcgctgcaatggatcatggccgagctggtcaggaacccatccatccaatcaaagctctacgaggagatcaagtccaagaccggcggcggcggccagcacgaggtctccgaggaggacgtccacgacatgccgtacctgaaggcggtggtgctcgaaggcctccggaagcacccaccggcgcacatgctgctacctcacaaggcggcggaggacatggacgtcggcgggtacctcatccccaagggcaccatagtgaacttcatggtggctgagatgggcagggacgagaaagaatgggagaagccaatggagttcatgccggagcggttcctccccggcggcgacggcgagggggtggacgtgacgagcagcaaggggatccgcatgatgccgttcggcgtcgggcggcggatttgtcccgggctcggcatcgccatgcttcacctggagtacttcgtggccaacatggtgagggagttcgagtggaaggaggtggccggcgacgaggtggacttcgccgagaagcgggagttcaacaccgtcatggccaagccgctgcgcgtgcgcctcgtgccccggagtacactcgaataattaatccattcctcgattcctagagaaaataattgtgcagtatattatatagagtaaattccttgtttgctcctgaaaagttacccaatctcttacatgcccctaccgtttggaacttacttgattccttctataccccaaattttcgattgaatcctctacatacccctaccgtttgggttccgtcagatgtttgtgttcatgtgtgtgttagcttgtcagtattttcataaaatgcgaaaatgcctctgtcaaccctaggtaacacagggccacatccgatccccaaatcctccaaaatagtatagttcccacacgcacggtgccgcacatcgccagctttcagccatcgttgcacgcgcatcgccgcccttctcccacatcccggcggtggcagcggctctgcatcccgccgcggtctcggctctgcttgcggtcagcggtggcggctgggtccgcatcccatcggtggcgcggcggggtccgcatctggtgggcggcgacggctttgcatcctgccgcggcgacgagtccgcatcccgccgcggcctcgactctgcttgcggtcatggcgacgccgtctcctccctgcctcctccgcgccctccctcttgtcacctcaccctcttctcgggggctccgacgccggcctattacctccttgctccactgctcctcgccgtcggtaatgatacgcccttgcgttgattagcaaaatgcgaatagctgctgctgctgctagtgtttcttgattgatttgtttgactttatgcaggcggatgccttgaactgttatgggcttgtgccattatgctcatgatgtaaaaagtaatatatttgtgtactgctgatggtgtatgaatgcttttagatgtattttcattttcttcctattaaatggtgctaccgatcctcttgatatgctgatgaattgcaatggtgtttgagtaaacggctaggggtactgtcttttacccccaggctgtgtcggttagtggtcatgaaagatccaatgtcatgttatatttttttataaaatactgaatgctataacaaaagaaaatgaaattaattttatgcactaattttttagtctcacggaatacatactgtgcagtcatgaatgtttcaaacccagctgccaaacatgttcttagttttcagctcctccaacctcaagggtattatagacattttcaaccaaactaaccagggaatgctgctcaatctaacggtaggggtatgtaggggatccaatcaaaaattcaagggtggaatcgagtaagtttcaggggcatgtaagggattgaataacttttcaggggcacacaaggaatttactctattatatacggtacatatacgaatgtaagggaacaaacggccaaaatcatcgcacgtagcactggcagcttcctttctttaatgaatattctgtgagaaattttacgattctcgagagataccaagagaatatcctatgtgtgtactccctccgtttcgaaatgtttgacgccgttgactttttatcacatgtttgaccattcgtcttattcaaaaaatttaaataattattaattattttcctatcatttgattcattgttaaatatatttttatgtaggcatataattttacatatgcacaaaattttttgaataagacgaacggtcaaatatatgctaaaaagtcagcggtgtcaaacatttcgaaacggagggagtacgttgtgagtttttcgctcagtcagattaccttgatgatcctggcatcgtctactctgcagcgttggtgtgtaaaataatgaatggtggaaactggaaagtaactcctctggcattgccggccatctgcacggcgcccccgtgtctcctgctacgcatacgatcggcccgtgcgagccttagccgtaactaattgggccgtttctcgcgaatcgcgggaagtttgcccagcccaagccttaggcgagacaatccagcccagcgtgaggtctcggcctgctgctttaattggaaaaagtatacctgagaccccttatcttgtcgacgatttatttataaaatcatccatgaaccaaaaaccatatatatgacatcagtcaacttataaaactaaatcactctaagtccataggcggttttgtttgacatgacaactgaatcagtgtggaacccacatgggcccacaggtcagtggctacttccccttctctctcccccagtcatccccttctttggcgatagttgatgggcagaagggctgacgcggcgggcgcgaccgatggccggcggggaagagcacagctggcgaagggtagggagaaccggggacagatcgatctgtgccgccgttgccctcatgtccgatcacaaccaaacggagattgctgtgcaggtgtcactaatggttgtgtttagggaggatgatgtggggaggacatggcgggcatggctcggctattccgaagggaggcgatgctggtacggtgctgtggctagcgttattagtagatgttgagaggtgaggggcaacggtgatatgacgagacgatgaaggtccacgaaggtcgccgggagaaatttttcccgagcttgggatgacgcgagtggtggaacatgtttcatgccgagccgccgggaaagaggaatgggagggtttcctatggggttgatgcgagctcatgctgaaggagacacaaagatatggacgacttgccttcttaccggggagatgatgagaggggcgagaggattcgagagagcgtgagatgggaggaggaagaagagcacagggaagaaaggggaaggtactgacaggagcaggacgtcgtcgcgcgtctccggttcttcccacccgtcgtcggccgtgctcctgcctcaccggccgccgaccatgcccctcatgcctgcccttctccacgtggcccgtgcccaagaaggagagtactagaggagagagagaagagaaagtagttactgacatatggttcccactttgacacagctgttgcgtcggacaaaactatttaaggatttagagtgactcggtttcgtgagttgaacgatgtcatatttctattttttttttcggggacgattttgtaactcggcgataagatgaagggtctcagatatacttttttcgcttaaattttcttcacatatacgactgtaaagtttgttgatccacggcattttctatgtttacacattacgccgtgtcctacaccatggtacggtactacggtgtgaactactgttgctttctccggtccgtctctcttgcctgccactggagtctacacaactagccatggagtagcattgatgccatgaaaggctagctgaaagcaacacgatgcacttgctaagatacgtcgtcttcctcacggttcggacgtctgatggtcgatctccgacccgcggacatcatgctcatgctttctgaactgcttgcgcatccgtatcaaacagcttcttttcatcacaacgaagatatgtctcatcatccgggttaagcaaccgatcgatcgccttacaacgtactacgtgcccaaacatgaatgagttagatatattgtttcatctcaattttcgcaagattcggtcaataggaacaccttaattacaccggctatttttacatttcaccactaatcatgcatctctattcagaatttcagagcatggaagtaaaaagtactgaactaagtagagaaactaattaattaagaagcatcatatccatatcactatatcgccactgatcattcagaacaaaggttattgtattgtactaggtagtgtttaattaagaactccactagagtagtaagaagcatgcatttggattgagctaagctactgaaacggtgaccctaacgcatacatacatggtgatctaggcccttctgggcacgagacgagcgcgcagcggcttcgccatgacggttgtgaactcgatcttctcggcgaagtccacctcgtcgccggcgacctccttccactcgaactcgctcaccatgttcgccacgaagtactcgacatgtagcatggcgacgccgagcccggcgcaaatcctccgcccaacgccgaacggcatcatccggatctccctgctgcctgtgacgtcgaccccctcgccgtcgccgccggcgaggaaccgctccggcatgaactccattggcttctcccattctttctcgtcccttcccatctccgccaccatgaagttcaccgtggtgcccttggggatgaggtacccgccgatctccatgtcctccgccgccctgtgagggagcaccatgtgccccggtgggtgcttccggaggccctcgagcaccaccgccttcaggtacggcatgtcgtggatgtcctcctcggagacctcgcgctggccgccgccgccgccgccgccggtcttggccatgatctcgtcgtggagctttgactggatggatgggttcttgaccagctcggccatgatccactgcagcgcggtggacgtcgtgtcggtgccggcgttgaggaactcggagcagaggttgaccatctcgtcgtcggtgagcgggcggttgccgtcgtcggggagcttgatgtcgaggagggtgtcgacgtacgagtgctcgaacgtggtctccttcttcggctcgccgttggcgccgccctgccgtttcttgtactcccgccgcgcgttgatcagcggcacgaacagctccgtctgccgccggcggagggcgtgcgccttctgaaggcgcccgcgcaagaggtgcttggtgaccgccgggaagaaggcgaagacgggcatcttgctcgacaggtagaggagcgcgtcccgctgcgcgacggcgatcgcgcgcaccgcgtcctcgtcgagccgctcgccgaagcacatgagcaccaggaggcagaacatggcgtactggaacgtctccacgacggcgtgtggcgccgccgcgtcgccgttctcgtcccgcagcttctcgacgagcacgcgccgcacccacgcgcgcgccggcgcgaacagccgcacgcgcgacgggtgcagcgtctcggcgacgaggttgcgccgcaggaggcgccacacgggcccgtagctggcccgcgagatgaggttgtcgctctcgccgagcagcctcgtcgacgccatggcggggcgatcggccagggacgcccccttctcgacgagcgccgcgtgcgcgaggcggcggtcggcgacgaagacgagcagccgggacgcgacgcggagggagacgacggggccgtgccgcgcgatcaggcgccggaggaggggctcggcgtcggccagcgaattggtcagccacaccgtgctcccgagcaacggcacggccggaggacccggcgggaggcggccgcgcttcccgccgccgcggccgccgcggcgggagaggatgagccggaggaaggggatgaggacgaggattgcggcgacggcgacgtgccacgtgtccatcttcgagtgagcgcgagcaccgcgtaccgtgtggctacttcagtgggactcattttatatggttaacacgtgtcgtaattagcacgttattaggaggtttttaactgcttgtgtttaagtaaattcggttgtatttatcggtttattatgctttatgccaccgtcgcgatctcgattcgacttgcggacgaagtgaacggaagggtccacctccgctgacgtcagggatgatgatgaacaggaataaatacgaagaaaaaaaattctagaatattttcttatgcgacaccttgtttccacatgactcgtatgatccaaggtctaacgacatgttcaagaaaagagcagataaaagaaaaccaattctgaatacgatttctctctcgagaaaattgcatccaatccaacaagtcatagtttgttcagacttcaggactctaacacataataattttgaattaagatttgaaaattacatccgaacaacccgtagtttgttcagactcttaaactcataaaattatccaaactcaatcgtattcagcgttgacttgatgcgtctccctataaatgtaaagccgttttgtctcacccgacgtacaacaacgacaccaatcgacgacgacgcagatggataacctggtcatcctcgccggcgtcctcctcctcccgctcctcttcctgctccgcaatgcggcgtcgtcgaggcggcgccgcctcccgcccggcccgccggcggtgccgctgttcggcaacctgctctggctgcggcactcggccgccgacgtcgagcccctcctgctgacgctgttcaagaagtacggccccgtcgtgacgctccggatcgggtcgaggctgtccatcttcgtggcggatcggcacctggcgcacgcggcgctcatcgccgccggcgcgaagctggccgaccggccgcaggccgccaccagcacgctcctcggcgtcagcgacaacatcatcacccgcgccaactacggcgccatgtggcggctgctccgccgcaacctcgtgtcgcagacgctgcagcagtcgcgcgtcgaccagttcgcgccggcgcgcgtctgggtgcgccgcgtgctgatggagaagctgcggggctccggcgaggaggcgcccaacgtcatggaggcgttccagtacaccatgttctgcctcctcgtgctcatgtgcttcggcgagcgcctcgacgagcccgccgtgcgcgacgtcgaggaggccgagcgcgcgtggctgctctacatctcgaggaggatgagcgtcttcttcttcttcccgtggatcaccaagcacctcttccgcggccgcctcgaggccgcgcacgcgctgcgccggcgccagaaggagctcttcgtgccgctgatcgaggcctcgccgggagtacaagaggctcgccagccagggcctcccgccggcgagggagacgacgttccagcactcgtacgtggacacgctcctcgacgtcaagattcccgaggagggcaaccgcgccctcaccgacgacgagatcgtcacgctctgctccgagttcctcaacgccggcaccgacaccacctccaccgggctacaatggatcatggccgagctggtcaagaacccggccgtgcaggagaagctctacgccgagatcaacgccacctgcggcggcgacgacgagctcctggagcggaacgtgagggacaaggacaacaagatgccgtacctcaacgccgtggtcaaggaaggcctgcgcaagcacccgccgggccacttcgtgctgccgcacaaggcggcggaggacatggacgtcggcgggtacctcatccccaagggcgccacggtgaacttcatggtggccgagatcgggagggacgagagagaatgggagaacccaatgcagttcatgccggagaggttcttggacggcggccatggcgccggcgtcgacatgcacgggaccaagggcatcaagatgatgccgttcggcgtcgggcggaggatctgcgccgggctcaacatcgccatgctccacctcgagtacttcgtgggatccatggtgatggagttcgagtggaaggaggtggaggggcacgaggtggagttcgccgagaagcgggagttcaccaccgtcatggcgaagccgctgcgcccgcgcctcgtgcccaggaggagttagacagtgagacagagtccagaattggtttagttttgtgttcattagttagtgttagcgtatatttactcgtgattaagttatgatccaaatgtccatagtgactagaagtatataattaggtttgaattaagtgccaaaagtgtgttttgttttagcaaattttgagcagtgcgtactcgtttttatcgtgctaatttacacgttttatatatgaactcctatcgaatcccaatcaaaataagcagagaggtttggactagagacaagacagcatgacttacgcacaagaaaggaagggtgaaaggttcatcttttatctcctatatactatcagcaattcaaaggaaagagtgtttttttatctcttaccagcaaattcatatcaccaattcgaatatccaaaacaacataggtgcctatgaatttcttttaacaacaatggaagaacaactttgagcctgtgaaaaactttaacttgtttacctcctagaaattgatgcacctaaaaaacttgtttagaaacatcttacaaaactaatgtggcacaatgtgattgaatattccttttctcatacccgctataacatatcagatcactaagagagtaatagatttacactagttggagagtgttagagtatatggtagttaaagtcatattaggataggattggtttgtttggattccttctatatctgtaattcttccttatctcttccctatgtactcctatatatatcgcccccctgaggctcaatacaatgtgtccaatattcacagtatcccctcttcctgtactatccaacatggtatcagagcgggcgatctagtgccgctctcacgcttccgccaccgctgcccccgggagtagcgatctcccgagggcggccacatttttttttctttctctgaggtcgttgtcgccagagggatcgccctcgatctccttcggtggcccccgtcctgttcgtcgtcagatcgatctaaagccatcttcagatcgttcgtgcgtcttcgcgtcatcagcatgcagcagtagcagatcgcatccgcggatcccgtcgacggcgcggctctccacgtcgctgcgccgttggctcccggtcctgcctcctctgttgccgtcctctccgtcgacctctctcctctaccgaggctgctgatgccgggggacaggagccacgtcctcgccgatcatccatgccgtggatctggcggccactccaggccaccgtttcgtccgtcgccccctggtcttctccaacctccgcgccagccgtcgtcgacctcgccgcccttctcaaccccggcgcacagggggagggagtgctcatcactgtcgcttccacacggcaattttctgccggcccctgcagctctgctgctggtctccaccacacaaacctgttgacaggttgttcttctccactgtctctcggtgtctctctctgctatgatcctgtgcgtggcagccatgtgaggagagagagactagatggatggtgtgaagatatacagcctattgccttggttgacttggtggtgacttgcgtcagattcaaagggttgtgatgtgaacggctggtatggactgctgctattgtgttgctgcttgtattttttcccctttcccaatcagtgattgggtttgcgtcgcccaccgcctcgttgacatctgcgcgtctccgacatcggcatcgattctgcttcaacttcatcgttctgcctcgcgcatcttcggcttgatcacccattccagcgcccagctacaacgacttgtacaaccgatcatcatcgagcacgcgtctacgccatcaagcttcgggttgccgctgcgtcgcccccctcgggccacagtgccgctgcctgtggtccacacctccactggttgttacagtgttgagacctgagaggcaccctcctcagtgtggcctcaccaccggtggacttctcgccgctgcatcgacatcgagctgcgttggtcccactacttcgccttcgtcttcgtccagcatgattcatcgccagtgtcgccgtatcttcctcgactatacttcgctcttctccggcaactgcgtgctgctccggcaattctccctctacgccgttctcgcgccgcgaccatcctagaggccttctctgctagtctcctccgacattggcgtataatttctggtggtcccctacctagcccgcacggtattggtaacaccgttgtgcgcgtttgtcccgagtcgtccccgggtctggcaaacctggtgtgacgtcttgtccttcatggttcgactatatcggctcttcgacgtcatcttcctcaacgaccgtcgcgatcgtgtccccgtcatcatctcccgcgcgtcctcgcgcacctcggttcacaacgctctcccatgcgtccacgaccactctacggcgtcctatgtgcgctccgcggctcggctacctcgacatcatcggctccccgacttcggctacatcgaccacggctactctacgcacggcttcagcgaccacggctctcccggctccttcgctttggctacatcgactatggcacaaagggctattatccgtgttgagcactcttgccggtttattctccagtccaagtgtccgcgctgctcacgcttggactgaggggggatgttagagtatatggtagttagagtcatattaggataggattggtttgtttggatttcttccatatctgtaatatttccttatctcttccccatgtactcctatatatatcggccccctgaggctcaatacaatgtgtccaatattcgcagtatcctctctttctatactatccaacagagagtacgtaatagattgaccttaggagagtgacagattaacgatttgcgatgaacaaacttaatctctgaccctctgtatcaaaattcaagcacaagcaaccaacacatattgcaattcagtagtagagatttgattggtttatttgttaacctgtacggaattcgaataaaaaactggtgccaaatttgtcagattttgatgaacacggtctagatttaatcgctctgatttatatttaaacaaggaaaaagtacaccgaaggtccctcagcttgtcatcgagttacaaaatcatcctccaaccgtaaaatcagatatttcacatctcctaactaatcaaaaccggtcacaatcggtccctcggcggttttgatcccggttttattctacgtgactgctgagtcagcacaggacccacgtgggccccacatgtcagcgtggccacgtcagcctatctctctccccgtcttccccttcctcctctctctatctcactcattcttgtctctgtggctctaggcaggggagcaaggcggcagcggcggcgggagcaggggagcaaggcgtcggcggcggcagcggcggcgggagcaagggagcaaggcgtcggcggcctccggtctccccccaccctcttcactctgtccaaggcggcggcgacctccacgccccacttcctcaccgacgcgacgagcacctgcacgatcctcgttagcgggctgcccccggaccgctggtgcctgtacagcggcgtgccgatgaagaagctgacggcgacggccatgacgacggccgggatgccgaacccccacccccacccgacgtgcgtctgcacgtacaccagcaccgacgacgccaccagcgcgccgatgttgatcaaatgttctccatacagtaattattcagtaacctgtatagaaattgatgactactatgtgattacttaactaatagtacctgacagaagaagctcatattattagagtctgaatagatggaagtttggaggcattgcttgtcgctgttattcaaatgtctggttgctgataaataacaggaaaggaagcttagaactgctgtataaatgaagtcagtgtgtggacatcttcagtgtagaattttaaccagagaatcttataaggcttgttctgaaaaaggtgatggatgctgtcctcgacatgtattagaaccagttgaagaagctgctcttgctccgcttctccccctcgtcgttctcgtcgaactggtcgacgccgaacgacgacacacacggcttgatccctcccgttcccagcgcgatcaggtacagcgccaagaacaccacccccgtctgcgcttggtgcggactgcggagcatctcatagcgcgcggcgaggaggcgctccaatgagccgaagcgctctgtgagtcgctggtacaggtgtgtgcaggtcgcgagcagctgctgctactgctccagctctgcgaaaccttccggcgtgtgcaggtcgcgagctactgctgctgctgctgctccaggccagcgagctcgcaccgactccacccccaccgccgccgcgtcgccaagctaccccgccgcccgtcgccggccgccgtttctgcctcgccctgccagccggcccgcacgaggggggcggggaggccggcgagctcgcgccccccgagcccgcgcgccgccacctgggagtagctaagagcccccgggagccgccgtccccggccgcaccaccctccggccccgcgcgccgccatgggtgctagccctagcatcggcatccccatgccgcccgtgcgagagcagagagcgagacggaggaagaaaggagagaaacagagaaagagaaagagcggaaagaaagcaggcgctgacatggacaccctgacatgtgggacccacgtgggtcccacgctaactcagccgccacgtcggataaagccagagtcaaaaccacttaaggaactcaagtgaacggttttgtaagtttagggatgtcatatacctggttttgcggttaggggatgattttgtaactctatgacaagttgagggaccttaggtgtactttttcctttaaacaaaatgaatagagagtaagcccaacagcaaaaaacatgttagcccaaaaccaacgaactgcatcttaggcccatttaaccagtcgaacatgttatctcaggcccgtttagcccacaaaattgcaatatgaatactagcagtctagcacaactagctttggctgcgttcgtttctccaataacaatagttggatgaaattttggatactgatggtacacttttcaaactactaaacggtgcgttttgtgtgaaaacaattgctctaaaatatcagattaatccattgtcaagtttataataattacacgttattaccacctcgttttacgtgaaacacttaatatttatcctcatcttcattttcaggatatccagagaggaacacacgcttgaaaaatctgtcacgtgctagttaattagcaaaaccgaataaggtacttataaaaactaaagtgtcattccttcttactaacatatatctttagggagagctcccaccttttcgcctcaaaagggaaaataaatatgtgcgcctaagttgatcctgatgcccttaaatccaaagttcaaacatgtggggtggcttcttaagaaagaaaagaaacctaaatacttggatgtaatcataaagattcccaccgaatcttcaccgatcaattgagattaattagaaatgacgatagccgtttaagcggagaaggacggcttacattattgctggttaccattcaaaacagaaagaaaacagtggcaccagattctgcggttttctacagagcttttttcttaaaaaaaactagacacaatatatacacaaactattctaacacacgcacactcacccttataaatgtacacacgcacaccttatccttatcagcatctccagaagattaggctgtcatattttaatattgacgaagccactgcgggcgtctcgttgtcgagggatacgtcttacacatgcacacattattcttatgaacatctctggaagactaggttgtcatatcttgatgtcgatgaagtcactacgggtgcctcgttgttgagggatacgtcgtgtaccattaaaaaaaacaattagccgtaaatatgagcacatgtgtcaagcctagaatttaaacccagatggactggtttcaccataagaaacttaaccaattaagttacgctcacttcacggagccctttgtcactctcctagttgacaaataagttttcaatgactggtccatacaggaatatgttcttccattatttaattttagttgctaaacatgttttcacatactataagttgttcgtccattatccatttttctaataggcaccttgttttgcatctttgaaagcattttgaatggctgataggagataaaaaaatgacccctttttttcttcgattgtgtttttgcccttctttctgtccaagactactataggataccaattcactacgtgcagctgtcatatgtttttgataaatctaggttacctattaatttagagtaatttagaaattatacactaagttttataagtatgtgatatatttttgttggttttttttaattttgggaaggtaatatgctttgataaatatgggtctcctattaatatgagagtaatataaattttcgacatgacctgcaccaaacagtaatgtaattagagattatacatggttcttttgaaagtaagtgacatatgtatatgaatttaatttattatttggtggtggtgatatgacgataaattcttggcacctattaattttgatttaatcttgtagttatggcatatgtttaagttaatcattttgtatgcagcgagaattgcaatggatcgacgataaatgtaccatgcgtcttgttcaggcctcctttgaattggaggaaaaatataggaaaaagaaaggaattgaaatcctacactatttatgcctttgattcataggaatgagaaaaggaaaaacgtaggaaactttcgtattcctacgattctagaggaaaaacatagaaaatttaagacaaaattggttatatagcatcgaaagttcacctttttttagctccaacagataacggttcactttaatagcatctaaagttcacccctttccatttttaacactttcgtcaattctcgatcgttttctatccgccttgatcgttattgactcagccactcacacgatatgacctttttacccctcattgccatgcattatacatgtacttgtgaggggtagaaacgtcatattgcgtgtgtggttatgtcaatagcgatcaaagcggatagaaaacgatcgagaattgacggaagtgttaaaaatgggaacgatgcgaactttgggtgctattatagtgagctggtatctttcggtgttataaaaccaaaaacgtgaacttttgatgctatatatctaattttgtcaaaatttaacatccactctaacctcttggaaaactttccttgagtctatctctttcatctgattcctgcagtccaatcaaacggtcatttctgtgtttacaattctctgttttacacttgcgttgaatacatttttgtttgtcaaagtttcagaaaaacaactgtaccatatattaaaaacagagatatcagaaatttgcacaaacaaatcacacttcaatgttccctattgatttactgattcatcaaaccaaatgccatttgatatcagcattcacctcatgacacgtaaaaaacctgacactgatactccaaattactccctccgtttcaagatgtttgacaccgttgactttttaatacgtgtttggccattcatcttatttaaaaaatttaagtaattatttattcttttcatattatttgattcattgttaaatatactttcatgtacacatataattttacatatttcacaaacttttttaaataagacgaacggtcaaacaagtaagtcaacggtgtcaaatattttgaaacggagggagcaaatgagcagtgagactctgattagtgcctgactcctcctgggcacaaggcgcggacgcagcggcttcgccatggcggtggtgaactcgagcttctcggcgaactccacctcgtcgccggccacctccttccactcgaactccatcaccatggatcccacgaagtactcgaggtgcatcacgccgacgttgagcccggcgcagatcctccgcccggcgccgaacggcatcatccggatctccctgctgcccgtcacgtcgaccccgtcgccgtcgccgccggcgaggaagcgctccgggatgaactccattggcttctcccattctctctcgtctcttccgatctctgccaccatgaagttcaccgtggcgcccttggggatgaggtacccgccgacgtctatgtcctccgccgccttgtgcggcagcagggtgtggctcggtgggtgcttgcgcaggccttccatgaccacggggttgaggtacggcatcttgttgtccttgtccctcacgctccgctccaggagctcgccgtcgtcgccgcaggtggcattgatctcggcgtggagcttctcctgcacggccgggttcttgactagctcggccatgatccattgtagcccggtggaggtggtgtcggtgccggcgttgaggaactcggagcagagcgtgacgatctcgccgtcggtgagcgagcggttgccctcctcggggatcttgacgtcgaggagcgtgtccacgtacgagtgctggaacgtcgtctccctcgccggcgggaggccctggctggcgagcttcttgtactcccggcgagcctcgatcagcggcacgaagagctccttctgccgccgcagaagggcgtgcccggcctcgaggcggccgcggaagaggtgcttggtgatccacgggaggaagaagaagacgctcatcctcctcgagatgtagagcagccacgcgcgctcggcctcctcgatgtcgcgcacggcgtgctcgtggagccgctcgccgaagcacatgagcaggaggaggcagaacacggcgtgctggaacgcctccgttacgttgggcggcgcgtcgccgccgccgccgctgacgccggacgtcgtctcacgcagcttctccatgaggacgcggcgcgcccagacgcgcgccggcgtgaactggtcgacgcgcgactgctgcagcgtctgcgacacgaggttgcggcggagcagccgccacatggcgccgtagttggagcgcgtgatgattctcgctgacgccgaggagcatgctggtggccgtccgcggccggtcggccagcgtggcgccggcgccgacgagcgccgcgtgcgccaggtgccgatccgccacgaagatggagaggcgccacccgatccggagcgtcacgacggggccgtacttgtcgaacagcttcagcagcagaggctccaattcggccgccgagtgccgcagccacagcaggttgccgaacagcggcacggccggcgggccaggcgggaggcggcggcgccgcctcgaggtgacatcgcgcaggaagacgaggagcgggaggagaaggacgccggtgaggatggccaaattatccatcagcgttggcagctgttttcgcttgcgttggttgtcggacgaggctaaactgttgtgtacccatacattttataggtcttcggctcaagtcagtagcagtagactcagtactatgggatgtaatatgttaatcttattcttttaataaaactagctgggtggcccgcgcaattgcgcggctagcatccaaataaaatcatatattttttaatatgattttacttaaaatttattaaatagctatctcattgtcttaagactttgaaagaccaaaccttatcatcctcgtgtttctaattatatagtttttaaaagtcacatcagttgctaccccttatgtcatcttcttctttatttgtttgctcgatctaccactatttctatttattcttcttggaacctttaaaaattgaattttatagtttttagagtttattgtcacattgggtttcgtttttataatttgtagatgtctcgtcaaacgttgtcattatactcctctaccgcccgtccactgtttcttctttttattgtcattgaaattttaaaaatcaaagataattatcatttgggtttatttttactttctagaagtcccgccaaaccgtcagcggctttgccattgtactcctctacagctcacccgcagcctccgttctttattgtcattgagattttaaaatagaacatgattatcattgtttcttttttactttttggaagttccgaaccttaaaaaattagacttgtagttttattatttttataatttttagaagtcccatcaaacgatgccactatgcccctttacagcccgtccgccgcctactctttattgtcgttgtgattctaaaaatcaaacataactatcgttggaattcattttttattttctagaagtcccgtcaatcgtcggcggctcagcaactatactcttatacaccccgcccgctgcttctcctttttattgtcattaacattttaaaaatcgaatatgattatcaatggggtttattttttatactttctagaagtcccggcaaccgccttacttgtttgcttcacggcctgtctgatgtccctccttttaatcgtcattaggattatatttggtgttttattaataatttttatatgtcgtatcaaccgccaccactctactcctttctaggctgttacttaatttatctcgtcatgtgttgtagatggtcttttctttcaatagtctttatttttatcacaaattttagttatttataaattgtatttctaattgaaatcttatttttctttttctaatttcagaatttattttttttaaaaaaaatagttaataccgtattgtgttcctttaatgtttttatttttattttcaatttcagttgtttgaaaattgtattcctacttaaattctcttttaatttttctaattttggatattattttatttttttaattcgaaattttaattattcttgtattgggttcttatatggattcttctttcaatattgcttattttttattccgaattttatctaattttcaattgtattcctactttaactcttcttttattttcttttgctaactttggatttattttattttaattcgaattttaattaatctcatattgggttcttatatggactcttctctttaatattccttatttttaattccgaatttcaggtatttttaaattatattcctacgtggactctcctttccttttctaattttggattttattttatttttattccgaattttaattaatttcgtattgggttcttatatggactcttctctttaatattccttatttttaatttcgaatttcagctatttttaaattgtattcctacttggactctcctttccttttctaattttggattttattttaattgtattcctacttgaactctcttttattttttctaattttggttattattttattttttattctaaattttaattaatctcgtattgggttcttatatggattcttcttttaatattgcttatttttaattcctaattccagctaattttaaattatattcctacttgaactcttcttttattttcttttgctaattttggatttatttttatttttattccgaattttaattaatctcgttctggattattatatggactcttcttttaatattccttatttttaatttcgaatttcagctatttttaaattgtattcctacttggactctcctttccttttctaattttggattttattttatttttatttcgaattttgattaatctcgtattgggttcttatatgaaaatttctttcaatattgcttatttttaatttcgaatttcagcttttttttagattgtattcctacttggactcatctttcctttttctaattttggattttattttatttttatttcgaattttaattaatctcgtgttgggttcttatatagaaacttatttcaatattacttatttttaattccgaatttcagctctttttagattgtattcctacttggactctccttttctttttttttctttttctccgattaatgtgggaatttctagcctccacagcgaacgtggtgtcttcttttcgagctgtcttaataatataatagattttagaacatgttctgtacatacggttttgctaactagcatatgatgcatgttttaagcagccttcctgtttagtttttctttttgactgtcagaacttaggtttacattcgtgctgtggctggaattttatttagaattgatctcaacaccttgggctcgttcttttccacaactaaagactgcaacttagttctttttcattagcatgcttctcgaaccgttaaacgatgtgtattgtaaaaatattaccgtttgaggctaatccatttttctctgtgtcaggttgtgttagctatccaagcgaattggtgtttcaagcgcatagcaatgggagatagaagattgagcttatatggaatagcaattgtgttcgcacatctgaaaaaggggggatgtagcctagtggttgcagtgacctgagtaacaccctaaggttctgagttaaaatcttcatatgagcgaatttcaaattgagttatttgcagtgctaagttctcaatttaaattgttgcatatatccatttggatgtagatgctggataaaaaaaactattctctaacaaaagttgtgttcgccgaatccactttctgctgaacactcatggatgtaaatgtgttatcacacgtgggattaagaccttgtccagcaccacatggcgggcagccctaatgggctatcgatcgcccgccaatgggggt

SEQ ID NO: 59813 - DNA, 5552 bp, Oryza sativa
ttggttggaaaaagtcagcttgcaactcagtaatcaatgttagcattgacacacttcaacatagaattgccacattccccaaatacttcagtcaaggtgatacagtcaatcaaggagtaaaacaacaccaattcttcaaccaaaacataaatcaagctgaaggcaacaagtatattctttcaatcttaaggccatgacagcatcaacatgattataatttatatgtcatagataactgggcatatgtgcacagcagattaatacagcatgaacagattctgcatagtttacatacagaactcatatttttagactacccatgcacctagtagatttaagctaaggtttacttaatgataaccaacaaaataaatgataatgctgcttgtctcaaacaaattaattgcaactcaaatattaagaactcttcgcaatatttattacatgatactcaaatattaagatcttatagctgaccaatagaatagacactgaaaagcatttcaatatgagacatcataaagcatggaaatacgggaacacaatagcaaagttctttatcagaagagtataatgataacagattgcaataccttatcaaaagttaaaagtgagacaaactagggatctgcagcatttggattttcttcctggccaagagccaacacagctttcttcagaagggcctcaattgacagatgtgagttctcaacagcctttgttattgcttgccatctctctccatgctttggttctgctgcaacacatctttgtaggacatccttttgtgtatcagcatttccatgttgcagttcaaatttgtagtacaaggcccaaaaatctccaatgtctggagcaagagtaacagctctattcaaccaacttctagctttatcaaccttcctatcatgccagaaaagtttggccacagctgcaatgacatggggatcatggtcacatcgttttatagcatctgagctctttgctttacgctggggacgtggcaccatctctatagctgcagcccacaaaataccacttgtcgggcattcctgtaatgccttggctagtagagcatcagcttccttcttgttcccatgtctcaattcagccctaactgctgcaagccagagttcaggtgtagctgggttcttctttcttgccatggtgaggacagcacgtgacttgctcaagccatttatcttctcctctagattagctagagagagccaaagagggatgcaactcgggcagtgcttcagtgcattctcgtaaacctcctttgccttggatccatggccaagccggtcttccatttgtccaagcattaaccacagcttgaagaatgaggggaataacttcagaccttcctccaacagcttcctttcttcgtctacattccctaactccctttcaacaatcgcagatttcatccagaccctctcagtgcctcctctttccctggcctttgacaaaagaattcttgctctctctggttcattgttctcaaactcaagcttgaaggcagctagccagatctcctctgaattggggagagaagcataagcttcctgaagaatggctcgggcagccgggacatctccagccagccatttctcctttgcactcataagccataaaacttctgcacgtggattgtaggtaacagcctttctgaggagattataaagagactccttggttccatggctcttctcaagctgagccgctttcagccaaatactcttcttggaaacgaagacactgagtgcatgcgcatagatggcacgggctgtctcaattgaaccacgcttcttgcattcctcagcatcggcaacccatgtgcgttttctgtcttcctcatcaacaccaatgccaatagtgctcttaacaatagcctggcaagtcaatacagatccagcacgctcagcagcttctgcttcctttagccatgcctccctgtcaatatccaatccttctctctgtaaagtttttatacttctctcaatcaccttgattactgactgggtgtttccattagcttcctccagctttgcagctgtaatccagatggcaggttccttaggaagcttttctcttgccttgttaagtaccttctttgcttggtcatatgtctccagccttgctagggcaagccacagttccacatggagtgggcagcactccacagccctgtgaagcaacagtcttgcatcctcctcatttgcaagctctactactgctttccacagtctgactgaatcaggaatgtgttccaacccttttctcaaaaccctgctcttattcaaatcactagtttccaactttgctgcctgcaaccacagcttcacagaattgggaattgccttcacgcccctagcaatcactgcctttgcctcgtctgggctggccagccggcatgcctcgacccaaacatcctcatttgtggggcactcctcacagccacgctggataagctgccgagcaacctgaagcttgccagcaacctcttcaagcctagcagcagcaatccatcctggtggatgcttcgggtttgtctgtgtcactgacttaagcaacaatcgcgcctttttaatgtcagaaatctcagcatcactagtaatcttcatacttttcaggtccgtcaagtaaccctttggatcaacaacagtaagaccagataccgaatccgacaacctgtccagcttcaaggagagcacggtgccacgaccttcgcccacagccgtcagatcggtaaccggagtctgcgcccatggcgtctcggtgccaccagctgcacggctcttgggatccagtgccgtgacatgctcctgctcctgccgagccttctcgagcagggtgtccggcacgggaacgaagctctcaaatcgcttcttcttgttgcgcagcgagtagtccccaatttcaggtatgctttcccactcctgcgccgacaaatcgaccaacttacgcttcaaatcagcgaattgctcggtgatcttagggttggaagcacggtacttctcgatctcctgcttcagccgcgcctcccgccgatccttccggcgagagtccatcctctggtcgatgctctcccagaccgcatccgcctcgcggtcgtcgtcgtcgtagtcggcgttggagaacagcccggcgtcgttgccctcgaactcgtcgaacttctggttctcgtcgtaccccttctcctcgtcgccgccatcgtcgtcgccgtcgtcgtccccgggtggcttcccacggccgcgcccgacggcgggggcggcggcggcggcggcggaccggtcaggcagatcgggcgccgcgcgggccggcccgatatccgaacgggtggtgaacccggtggcgccacgccccagaccggccacgtagttcgggggcggcttggagttgaggaagtcgtagcgcgcggggcgggcgggcggctgcgccgacggcggcggcgggggcgggggtgccgcgggggtcgtcgtcgggccggtcatccctccgagcagggggaggtggagtagcagggaggaggaggccgagacccggagggaggacagcagcggggacggctcggccgggaggaggcggcggtgggcgaggtagagccgcagctgctccggcgggacgccgccgcagacgcgggaggcggaggccgtgaggtcggcgagcgtggcggtggaggggtcgaggtcgacgtggtgggtcctcccgtccggcgcgcggacgaacaccatcgcggcggcggcggcggagtagattggtttgggtttttgaggtcgtgaggaagaatacggaatcgtggaattggtttaactattttgtgacggtttgggacctttgggtgaattgagtcggtggcgaggagaggcggtgggctacgtgggccgttccatggtgggctgatcacctgcatatgggccgtacaagggctcatgggcctgtttggctcgtgtttgggcccatcgcctgaccttcccttcttttgggttgggtttctttggatttatttttaagatgggcttgttgttttatcgacttatttgttgcgaataaaatcttaccgtgccgtatcatcaatttcataggtcatgactctgctgcatctattggaaaaaaaacatatttatattgtataaacaaagaaaacatgcgtagttaggatgggctatcgacgatcacgacaacaatgataataacctaaatagagagctagagattcttataaagattcttataagacgcttgtgattagtcggctgatgataatctgaaagggttaagtttcaagtttctagctccaagttcataatctcaatttttatgtacatatatgtgctagcacactacaatttctatatgtacataaaaatcgagacaatgatgtaatgaaagttgtggcctagagagatatcatttaaagtaaaatgatggaataatacaatttaattaaagattcgatacataaacaattgatgaaatttgtaaccgagggagataaattttaactgaaattgtcaaactataaatctgacgaaagattcattcaaattcccaaaaaggcatacattcactcattttatctgccttggtgccaaatttaacgaaatttatgtacccagtttcaaataaatagacgactatccccattttcttacaagttacaatccaccgcaagaccacaacaccaagattacccgcctccatgccaatttcaatgaaattcgtgtatccaattttaaatagacagacaacactctttatttcgttacaagttagtacatctaggtactatacaagagtaatattggagtgtgtaaaaaactgccgtagattttttaagtgtaaaacttcgagattaaattatattataattgaagtatagttgtactgtaactgtattgtaactacggtataacttatataaaacatgtatttaaccgtggtttggctgactagcaccgagatcttgcacataacatgtatgatatttttgtagcaatgttatctcttgaatgtacaaatctccagtaacccgatgaccataaatctgaaagttttgagagaaaaagggtgtgtttagttcacgctaaaattagaagtttggttgaaattgaaacgatgtgacagaaaagttagaagtttgtatgtgtaggaaagttttgatgcgatggaaagttaaaaatttttttaaaaaagtttggaactaaactccacggaacttgcaaaagttttctagcaatttcgatccaaaattcaacggaattcgtacatacccagagctcaccactcccgaaacgccaccaaaagaccaaacccactcgtttcccctccccccctccctctgactctctccccgtcgtcgtcatcgtcatcgtcgttcgtcgtcgtcgtctcccctttccacggccgcatcccattccccacccaacctgaaagcgacgccgccgcagcgcacacgcaggaggcagcagcaaagcgaggaggggaggaaaccctccccccgcgacagcaacgggcggtcgcttccagtgacctaagcctccccc

SEQ ID NO: 59814 - DNA, 25206 bp, Oryza sativa
  unsure (1)..(25206): unsure at all n locations
aagcagatggtgcagctttgctacttccactagggtactctcttttagagaagtactctacaggatacacggtgtaaggatcatgagcagggccggtcctgagattctgaaggcccagcgtgaaactaaaaacggaggcctttattataaaccttcaaataataattaccatataatataaatatctttaaatagcaatcaatattcgtatttaaaaaatcatacgcattatattaaaattttctttgaagatttgtaggcgcagaattattgatgatgtcctgataatatcagaattattgaagtggctgtattactcttgagcatcctcaacacacctacttgtttttgttatctattgcatactttctcaacagcataatatcaaggaacaggctaatacttaagaaaatattaatactagattcgtaaattacaaggctacagaagtaccaaattagttgaaacaaatctaaccaatgtgaaaccagcaaatcactgaagtttgtacggttataaccttaaattatcaattgataccttgtaattttgttataaacagataattccactatgtaatctcgatctagatctagataggcagtatagcgtacttactgatggcggctagagcccagcaggcagcagtgccgtggttgttcttcacttccgcgacgacaatcgatcgattcagcaccagcacatatatagcagtcagcagttgatgcgacaacagatgtgctcgtccagcatgccgatcaaccaagataaggctgatatgctgcgcttgcgtgtggcatcagcatggcagtcggcagatgagatcgatcggctgatcgttatactcgcgatctcgcagttgcaggccggcgaaatcacggagaaacatcgcctcacgttgcgcgctggaagatcgctactactcgttgcacagataggtgggggccctgggaatcgggggcccggagcgatcgccccattcgacccccctcaggaccgggcctgatcacgaggcccatcattgtccaaccctcaatatgatgtatcattgacaggtcttctatatggtggatcattggcaggtcttccatattgtggatattggtcttccatatggtggatcaatggcaggtcttccatatggtggatcattagcaggccctccatatgggggactattagcagatcgtccatatagcatgaattccttgttaggcaagatatcaacaggaggaccatcaacaggggcaaaaggtgtcggattattggaagaacttccatctctgagtgtcctagttcaaagcctcgaagcaatctctgtcagggctcctctttcaatagctggaagcccagcaacctgaaagcttggaacaaatgtaaaagcacaatgaaatgttaacaagtaaaaactgcagttataaaagtaatatatggatctctggtgtaggtatggccaaataaattacctgcacaagctcctcatcaaaagacaggtacttaggtttatctgcttttgagtagactcggatttcagccccagtccgtcttctcatttcagtaattacctttccaccttccccaagaatacaaccaactttgtttgatggtacaacaagccgtgttgtcaactggtggttctcagcaagtgtacttgctttactatggagcaaaataagcgcctcaattgttggagacactggatcatctggaatctggaaagaatatgtaggaggatataaaattgtaaagactcgtgataaaaatggcaaggcaatgccaattggaataatcatctgcatattacctcctgagatgaaacaacaattaacctttcttcagaagcatttttgccaacttctttaacctgaccgcaagcacctgtctgcacctaaaatattggattggatgcaggttcaaattgaatgaacaggttttataaaatttagaagcgcggaaatgcaccatgccacacactaacaacttttattcaggaaacaggatttagttctgtatttattccagaaaagaatgtcttccatgtaatcagaaaataagctaatggaataaatttagttctttgacaaaatccattcacactggaaggtgggtctccgccatgatcaagtgccacaatatattgaaagaaattaagggaggtagcagcgaagaatcaagagagtgcttaaggtgaaaaaaaaaaggaaaggagaagtgatccgtaccagaaattgatcagttcggagcagttggccttgatgcagcggagtcccctacggacgggaggccttgatcttgccctccactgagtatgccttgtagctcaccacgcgccgtcccctcctctctgggtcactgaagatctgggggatcacatgccaccatcaccgtcaccaaccttggccactactatattctccttcaaagcaacagatcaagtggtcaacaaggtattcactgcagcttcatgaaaattacaagcagagaagcagtagaacctgaattttatctgtggatccttccataccagaacagcaccaaagaagcattctcttcactctcttaaatgctcgcacaacaaaacatggtcaaaggagcttccactagcattcaaacttcatagatacaatcatttaatcagaatatttgcattaacccttctttataagactagcaaaatgcatttgcgttgttacggaattaaaaatcataacagcacaatgcagagaggaaatctattttgaatcctagagcttaattttagaattaatttgagttttttgcttgccaagtttacgctccatttgttattaactcgcaaggatgattatggttgagagctccatggtctgtccgtgatttccactgttctatcatacaattggtttggagaagggattgacagtgattaaanatgtattggaaaaggnattnacantgattnaanangtnannannntnanantnnnnnnnnnnnnnnnnnanattnnnnnntnaccaccaccactactccttttaaagtagtatagatttacagctattatctgtgggtagccaaaagattatagagacaaagaaatcatgctgtcatcctttattccatgtttaagaatgagacagatcatgatactgaatgtcccaggattaagctcaaaacccatcgagcacaggttgtgaaacatctttggaacgcttcttgagcacaacagtattgttctagaataataatgtactccccaaaatataacaacttctctaccaacattctcttcccaaccaatcacaaccctccaccattcacttttcccacctacctccactactcatgcaatcacaaccctccactactcacttctacctactttcttaataatcgtgtccaactctaaaacttcttatattctaggatagagggagtatgtggtgttatccatctcactccttgctgcctcacacaggtaaatagaaacatcattccatcagatatttcatgattagtacatgtgcataataatacgttgagataagataatcagatcggaaaccattctatacaatccaatcttgttccataaaaaatatattgtgatgatcagtactgcatttggtaaagaacaaagcttcagacatatcttttgttcagttaaaaaacaagtcaaactattcaacacctaaacagtacacatagatgaaatttaatgaaaccctataaattgttttggatctaatgtcaaaattactgcctagacacattaagtttgaaactccagtcacaaatccctttatgatccgttagtagagataacgacaaacttttatgttttttctggcatcaacagcataacataattgcttgtttacagtctaggaaccacagtaaaaataattcggagaggtggcatacatacctcgctatttacacatacagagaagatccctcctctaataggactgtaggagaaaagaattccaacacagaatttcaaagctgcaaaatgcttcagcagctcaaagattctataaaggacttgtatttttcagggagaaacctataatattcttgatattttcccccagacaaaagatctataaacaaggaagcagtggatgcttcgagggaaaagtgcttctcatcaatcatggaaaggtaagtgccagccctggttatctcacctctctgcaacagttccctaacaatgaaatttagcatgccagagtcaacagtacagccattgtcctccattgaaagaaagagttgatccaattcttctagcaacccctgtcctataatattttcagccatcaacctgtacgtccaataattcggcactaaaccgttagacgagaaagcaacaaacaaatccttggcttcatcatttctgccaactttaagcaatgcatcaatcataatgttgaaagtcctagcctcaagcttcaaatccatcaaacataggttctgaaacatctgaagtgcatcatcagtgagtttgtttttgcaaagtccatgaaggattatgttgtatgtgctaagttcaatctgcgttccactttcggtaatcctgacatagagttcttttgcagcagcagttcttctggtttgaaataaaccttgcagaattatgttatacgtaataatatcaggactaacaccactgctctccatctccttaaaaagaactaacgcgtcttccatcctactaattttgcagtagccattaatcaaagtgctataagtaacagtattaggtttcaacccaactgagaccatgccagaaagtaacttcattgcttcatccatcttacctgccaagcaatatccatcgatgagtgtactgtatgtaatgatatcaggcttcacaccaatacgtaccatcaggtcaaagagtttttcagattctataaccctcccttctttgcaatgactgtcaattattgaattaaagaaaatagtgtccagacaaatgcctcgatccaacatttcaagaaataactattatatgtcatgcaatcaggcatgacaccattcttaaccatcgtggtaagtacctccatggcttgtccatagcttgacccttgcataacgcagcaataatagagctgtaggtcacaacatcaggtaaaatcccccggtccagcatttcatggtatgtactgtaagctttgtctgaatccccctctttgaagaagccattgatgacagtggtatacgacaccacatcaggtgggctacctcctcctcgatcatcagccatcatgtgcagcaactcgagagcttcttggcttctgttctcatcacacagcccgttgagaagattattgtaggagaagacatttggtatgcaaccgagctcggtcattctgcggagcactatgtccattgcgtcgctcgtcctcttgtcggcacagaggcccttgagcagaggagtgaaggtgatggcttccactctaaatcccttcttaatgacattgcccaaggccgcgaaaccgaggtccaagcggcccgcgcggcagcagcaaccgatgagaatgccgtaggtgcacaagtcgggagttacctcgtcggcgccagctcgggccatgcggttgtagcgggacacggcggccgcggggctgtgacgcgcgacgtcggcgagggcgcggttcaagccgtagatcgaggcgcccctgccacgccggagcaattcgtcgaacacgtggcgtgcgtcctcggcgccactgccccccgcgcggcctcctcgcccttggatcgagccgtccgagcgaagggcgccaacagcgcgggaagcggcgcggcgcgccatgcccgccctagctgacaggtgcagcagcagcgccggcggaaaccaacgccgcaacgcagtttgtcttatacggagaggtgggcggcaccagtggaggatagaggggaggggaaggaggagatggcagggatggtgtaggagatcggcgacgagcagggcgtggagagaatgagagatcggccggcgacgtcggggcagggagatcgcgatcgatctcttctgcgcggcgctcttggggaaaaaaaagacagaaaaaaactaatgctataataatgattatatttattttaaagttccatgggagttataaaagatagttctgaaaataaacaatgtcccttctctcccaccgtaagcgacaacagctgcgcattttcctactgcgcgccgtgaaataatatgatatggttggatttaatttttattaaattaatcatgattaataatgctctttgaatattttttaaaattttcggagcttaatttctaattttgataatataaacaccttttcaacatttatttaaataaaattcccaatttctctatgggccattttcagtccatttactatctcagcccgcaaataaattctactttacctcctccaactcctcctctgactacgtttgttcgaccctccggccttccctcggcccatcaagcatgcgcggcctgaagatggaggcgttctgagccgtctgatctgatggacagcttggatcgcctccgtgtcgctgaagatacgaatggggaaaaacctaaccctccctcacatttccttctctctccatatcctatctcccaagcagcggcggcggcgccctcccataccacgtgcgatagcagcgacatcgttccccgtgagcggcggcggcggcgctcgagcggattcggcggcatcggcagcttcccgcgggattgagataagatttgtgtgctttttattattttttctgttctttttctctattttttggattgtctagttggatttcaatcggatttacggacgaaaatttaatgtgacgaaaggaaaattatgaatattttaattagttaagataagatttaggctatctcttttggtgatgctctaaaataaaagcatagtttaaatttgctatagtctgctacatcctcagtttcatattatatgtcattttgattttttttcgtaatcaaacttctttaaatttggctacatttatagaaaaatatagtagcattttaataaaaaaacaaacatattataaaaatatattccatgctacatttaatgaaactaatgtggtgcttaaatgttgctaattttttttctataaatttagtcaaactcaataaaatttgactaagaaaaaagtcaaaacaacttataatatgaaacagagggagtacgaaataaaaactactccctccatccaaagaggtaataacctattaccgaattagacattacatacgactacaaatctagatagcctaatcaaattcgtgaatccaaataatatctaatctagtactagattcttatattttggaaggaaagaagtacttcatccgtcccgtaatatagcaatatagtatggaacgagattgttatattatggggcggagaagtagtaaaaatgttattgcaagtttgcaactgtgccaaaaccggtgtggtgttgaatgaaacatatgttaacgtgataaaatgacattattaaactgtacaaacagtttaataaccgatgtattgattattgggtagttagtagtagtgcatgctaaataatgaacgtaagggcaagctattgctcgttgtgctctgtgctaaggggctcaaattgtggtgtagatgacggttcaagctaaagtttcagcagaggataatgagaaggatatcatcttaagatcataagatgtaggatcaatatatacctactgcctagataccttaagtttgaaactccagttacaaacccctttatgatccgttagtagagataacgacaaacttttgtgttttttctggcatcaacaccagaagataatagcttgtttacagtccaggaaccacagtcaaaataattcggagaggtgacatacatacctcgctatttacacatacagagaagatccctcctctaatcggactgtaggagaaaagaattccaacacagaatttcaaagctgcaaaatgcttcagcagctcaaagattctataaaggacttgtatttttcagggagaaatatatgatattcttgatattttcccccagacaaaagatctataaacaaggaagcagtggatgcttcgagggaaaagtgcttctcatcaatcatggaaaggtaagtgccagccctggttatctcacctctctgcaacagttccctaacaatgaaatttagcatgccagagtcaacagtacagccattgtcctccattgaaagaaagagttgatccaattcttctagcaacccctgtcctataatattttcagccatcaatctgtacgtccaataattcggcactaaaccgttagacgagaaagcaacaaacaaatccttggcttcatcatttctgccaactttaagcaatgcatcaatcataatgttgaaagtcctagcctcaagcttcaaatccatcaaacataggttctgaaacattcgaagtgcatcatcagtgagtttgtttttgcaaagtccatgaaggattatgttgtatgtgctaagtttgttggaaatttggtcataattcggcatattttaatccaaaataacaagataataaacatgatatttacaataggatttgatccagtgatagtggtgaatgtaatcaacatgagcatgcttaacgttgaataagcatcaacaatcacataatgacacaatgttgacattgcgatgaacattaacagtaaaacttctaattgaaataatgtaataaggttataccccaagaatggtcctccgctggagtttgaggcagtattgcctccgttggtgttgacgggagtctccttctccttgtctccagtgttcgacatgttggtgaagatgaagtagatgttgacgaacagtgagtagtcgcgccttgcgctccccaaaaacctgatcgcccgcccgtctgtgcaaacgtcgcagcaacgcgtggtttcggaggcctactctcccaacgcgtgtgcacacactcgtcgggatgggattaccgtagcagcaacagcttttgaaaatggatgaaagtgtgtcttcttcttctcgcgggagatcaaatccattctcattttataagaggaatggaagatgaagagtaagagtcatggaataggaagaggaatggagcaactaattgtcatcaactagccatgaaccatcctccactacacaaccatcaaccaacaatcaattaagagtaattgatgtaagttaccaatggaataggaagaggaatagagcaactaattgtcatcaactagccatgaaccatcctccactacacaaccatcaaccatccatcaattaggattaattgatataagttaccaattccttaatcaaatggattaattctcaaaactcttcatcccattgatatcccatagaagaatgaattcacatgaattcctagcataatgagccttggaatttatttgatttaattgatttaaatggattaattatccaattaaatctaacaaagttcaatctgcattccactttcggtaatcctgacatagagttcttttgcagcagcagttcttctggtttgaaataaaccttgcagaattatgttatacgtaataatatcaggactaacaccactgctctccatctccttaaaaagaactaacgcgtcttccatcctactaattttgcagtagccattaatcaaagtgctataagtaacagtattaggtttcaacccaactgagaccatgccagaaagtaacttcattgcttcatccatcttacctgccaagggtaatgatatcgggcttcacaccaattcgtaccatcaagtcaaagagttttccagattctataaccctcccttctttgcaatgactgtcaattattgaattaaagaaaatagtgctaagacagatgcctcgatccaacatttcaagaaataactcttcagccttctcccatttgtcaaagatacagagactatgaattagggagttataaacaatgctgtcaggtcttagtccttcatcgatcatctgctcaaaataaagcatagcatcttctactctacctgacttgcaaagtacatctataactgttccataggtcactgcattcggattcaatccttgctgcctcattttgctgaatacaagcattgcctcttctactttctcttgtttagcgtatgcacatactagaatgctgaaaacataatgattagggtggataccgtttcgtaccatcaaatccaagagaccatgcatctcaacaagggctcctttggtagcatacccctgaagcagggtaccataggtagtaatatcaggctttaggcccctcttggtcatagaatcaaaaatctttcttgcttccgtgcatcttccgttcttgcaaagataatccatgagcgagttataagtaacaacatctggttcgacaccatcactgcgcatctttttgagaaatacaatagcctctttcggctgccctgaagagcaaaacccatgcacaatactattatatgtcatgcaatcaggcatgacaccactcttaaccatggtggtaagtacctccatggccttgtccacagtttgagccttgcatagcgcagcaataatagagttgtaggtcacaacatttggcgaaatcctctggtcaagcattttgtccagatccccctccttgaagaagccattgatgacggtgctgtacgacaccacatcaggtgggcagtcacctccatcatcagccattatgtgcagtaactcgagagcttcttggcttctgttctcatcacacagcccgttgagaagaatattgtaggagaagacatctggtatgccacgacggagcaattcgtcgaacacgtggcgtgcgtcctccgcgccaccgccactgccccccgcgcggccccctcgcccttggatcgagccctccgagcgaagggcgccagcagcgcgggaagcggcgcggcgcgccatgcccgccctagctgacaggtgcagcagcagccagtggaggggaaggagatggcagggatggtgtaggagatcggcgacgagcagggtgatcgcgatcgatctcttgcgcagttgtgtgcggcgctcttgggaaaaaaaaccagaaatttccgttcagaatggcccacttttattttttttattgtactgaaaaattacccttgcgttgcaatggaaaaaaaactaatgttatgataatgattatatttattttatagtttcatgggagttataagagatagttataaaaataaacaatgccccttctctcccaccgtaagtgatagcagctgccatttcctcatcacggaccgtgaaataatatgatatggttagatttaatttttaattaaattaaccatgattaataaatctcttttaatttttttttgaaattttgggagctttattgctaattttcataataaaaacatcatttcagcatttatttaaataaaaatctaaataacagttagtgatgctctaaaatgaaagcacagtttaaattctatagtctgctacatccttcgtttcatattatatgtcactagcaaatatgcccgtgagttgcaatgggtgaactaaaaattaaagatttgcactggttttaggagtttgaggggacaaattaagggagctaaagcgaaattattctgtgcggagcgtacacatggcctatggggtggcccaatagtgcggccggcctgggaacaattcagaggcaacttaaaggacctaaagtgaacttatttcacgcggagcgtacatgtggcccaatagtgtgggcaacctaggagtggcacccggcccaacgcgggagaagccgtagttgtccgatctgatggacggtcctgattgatcccgatctatataaaaactcagcagcccaaaccctaactctaaaatcatttttcctcccccctatctctctcaaagccaccactccccttcccttcctcaccggcgtcgccgctcccccccgcgcgcgcgccctcaccggcggcgccgctccatatccccctcttcctcctgtctcgccggcgcggccacggggaggcggcgacggggagggcaccctactggttcccctcgaccactccctccccctttctccaccggcggcgctctccctcccggcgtggaggcggtgatacattctagtataatgaatttggatagatgtgtcacattcacctaaaatctcttatgctatgtaacgaagggagtattgcaactttgcaagtttgtaaatgtgccaaaaccggtgtgttgaatgaaacatatgttaacgtgctaaaatgatgttaacagtttaataatcggtgaattgatttttgcgtagttagtagtagtacatgctaaataatgaacgtaagggcaagctattgctcgtgcacacttgccatgtgcactgatattttgtttttgacattttggtttttagtaataccccttcttttttttaaaaaagtctttgttcctttataaaggaaaggaacatcgtatcaatatcacacgttatactgtcatatccgtatacaatcgcttgtgcgcataccatataagatcgcttgacacgcagtaactgatatgttgagctgaccatggaatctcgtcaaattcatacccagaacgcagaaacaaatgaaaaggtaaatcacatgcacgtaacacaagtgaatccaatacaaaacattattacacttaccgaatggtgtacccggacacaatcttaaagaaactaaaattaacaataaatcccttaccttactcattaatattcatagtcactaggatttgaacctagtagataacgttatgcacccacaactccttcacaataattcctttggtgcttccccaaatttgatatccttaacttaagccaagtaatcgagcgtctaatatcaaatcttaccaataaatttgtggagtatataattaccaagtttccccttttcttctatcttttggttcattttcacttcgattttcaatgaaatataactcatttgtgcacgacaaaattactttgttctactgcttaatcggcgtggcagcaccaagtgcacaaatgaaggcagaagcagtcttaccattcagtgttcgatcctagcctgccctacaccatatcttcaaacaagaacacaggattgcattgacagactcgagcacacatttttacttcacagtttaatttaatgaaacgagcaacttctcctaaattacgataagttcttaggatacgttatatatttgtattgttaaatataaaataggggctaaaataaactacatcagagtctatttttacaaatctgactaacaacggacagtcctgtatttctcctctcttcagtctgcaaaaatggacagcactcagcacctagtctgctaccagccatactagaggctcaggaacatgaagtagataaattgtggactagaagtctagaacatatataaattataaaacatggaaaaaaattcccactcaacgtgggcaagcaaattagcatgatatgcatgaaaataaggtgctaacattcaaagatagaaataaacaaaattcattatgtggtttggccatatgtgtatgcaacaaagttcttcattttaaagaaggtgctataactgtgtgaatagaactatgttcaaggcagccaccaaagagagtttggtgttttccccaaaatcatatatgattcataaaatcttgtttgtttaccaaattctgtaattgcatatatgtctacttaagaaagcagggatgagactacagccataccagctggctcctgctgtccatacgccgcaaaggaattactcctaagagatacattgcccatcaaataattcggaacataaatatacttgtcttgcttataaacttgaaacaccttcctagagttagaagggtatagatatccaaaaaactctgatggttcgcaacatagatagcagggctactattcggtggcaggttctccattccctcgacgtcaagcttgtagaacatggaaattgtcagagttgcccaaatctttgcaatgtagtgctgagctctcgaaaaaaatttgcaaatatacttattttttcaataatttatgtttatatacatgcatggagaggttttataaaaatatacgcatcccgcgaaacggaaacgcgggacagcgacggttccgcagattcaaaatacgggaccgacgatcctgcgcggaaccgtcatggtccggcagctccaaaacgcggaatcgcgacggtcccgcggttccaaaacgcggaaccgcagtggccagcgactccagcactgtgcagcgcagtttatacactgttttaaccctgtgcagcactgttcacacattgttcatggtcggtgccgcgcctccattgtgcggaactgacccgggaactgtgtaaaacagtaccagaaacagtgtcaaacagtattaaacacagtgccatgcagtaaaaaaatgttggcgccgcggttccgcacactggcgctgcgggagcgtaccggttccgcgttaccggcaagcgagactggctcggtcccgcagccccattccgcgcgaacgcctcggccgtccactccgcgccgccacgccatacttttgttgcgctcccgcataaccgatctgcggattagttatattttcgcaaattcttcatactagtgtatataaacgtaaatctttttcaaaaaatgggtattttcaaatttttttcctgaactctcctccggtatcggtcaaataggagcacaagtggatgaaccacaaccatggcgacaaacaaaaagattgctgcaactgcagccaccgcgtagaagcaaacccctctgacccttgaaatcacatcgatgtctggtaaccaaatcaacaacaaaagtaaccacataagaaatgcaattctggaattcggtatgaatcccatgagtttgtccatgtacatgattttatttgcatccgcacattacatgtaaactgtatagacatagttttttgttttgcatcatacatcttagtaagaaatatccattgctgctcaaattccatgaaacacaaatgcacaatagctagtattagctgctacaagttctttagaaagtcttaacaactgcctgttctcctcaatttatactaaacattctattgacaccttcaaggttggtgtggagctaactgttataaccaacaatatatcatggtggttaacaagaatgatgcgctggcaatgattatgtttgatttccacaccttcagttttaaaattagagatggcaattttgtcactgcaggttcaaatgatttttctcccctccacaattccacattttgtcaagcaattgccaacaacgttccaaatgtaaatgttccagcaaactacattaatggctatgaggcctgcccagcgagacgaacatcacaacacattttgcgagaaaaaaaaataaaaaagggaagagagtggaggaggctgcaaacctgagagcgcctgcggcgaatcccccatggtagcgacaccaccagcggcgaaatccgatctcaccacagtctccctccgccgccagctcgccgccaaagcctgcggaccagggcggagcagcgcggccgatacaccctgatgcggatggcactccacgcctcggccacggtcgccccccgccatcaccactgcaaaaacgccaaaatcacaaatcaaccggatgagaagatatcagctagcggcggcctcgagatgcgtgtgattaccgtgcgcggtcgacgacgtggcagcgggggcagcgacgtgggcgattacgtggtggcgacgccgacgcggcggtcaaatgcaaaagggtcatcaccaccaccactgtcggtgattacattttaagatagacggagtctttttgccatttctctggagttcccatcagaactgtgcgctcttattgaaatccatccagttgagcctctaattggatttgcattgccacgatccttttttatattcaacttcaaaccactaccattgctgtgcctctcgcctaatgaaccacttgatgccccattgcttgatataaatggagaacaattgaatgccttctgtgacagaccagcatcactaccagaagatatagtaatatgagaaacttctgattttgaagataagcaacaatgacgtgtctggttcgacaaaagtttttttttttcgagttcttgctctttccatcattaaatgaagttccccccatgacatctgctgcataacaaagcttcaagaatgtcactaattaaacttatacgaggaaccaacaagataatctgggtcaggaaacatgaaatattaaaaatatcaggtagcattttataaatatttggtgtcaggccaagttcaacatctgtagtgagacttgaatggcgaccaaactatattgagacagtgcatagaaaagccaacgagatcaactgatcaaacaaaattggtgtttgttattaccagagtaactctgttgagagactttagacgatttcggatatgtagagctggaaacaacagaagaattctgaagtattgaaagagctgcagcaaaacaaaataggcgtcagactgcaactttaacatactggatgtttaaaacattttattgtgttagcgaacacattgtattattaagaaaaatacctgataataactcaatagtattgataatgacaccaacaaaagaaagcaaggagcgtttcgggttcaattttctactcatattaagcaaatgggtctgcaagaagcaaaatgaatgtaagagttcatattgctttttcaggaagaaaagaaaattgttaagcagacatacaaagtcgcactgtttgcacattttgcacagaacaaatcaggagagaagatagtacagaagaaggaaatgggtactaaactgaaacagaacatataaggagcattaccttgttatcatcgcttagaaatatggcattttccaatattttcaaacatttcaagaggagagcagcactttgcaaagatgttccttcatttcggtccaaagctgaagtggatgtatcctttatgagattctgatacacaaggtttgccaccagaagtatattgttaatttatttattcagtttatcagcgtaatatgattgcattattagttggggaataaaaagtacacagataggaacaccaagcatttaaattaatgcgcaatttactccaaacttgcttacacatgcaagaacagcaagtatagctggaaaagtaacatccaaatgaataatgttcacttggtgtagatatgtcaagtgttattatcgtttcaagtgttattatcgtgggggatataatcatcagaggaactgtaagatactaacaccacatgcagaataaaaaagtattaaaaaactatttttgcaacataaaacaacataatttgtgttgcagccaattttccatgtcctgatgaaaatagttactacctcaagcattttccatgccccaaaatataacaacctttggctatgtatctggacaagcattactttcatgtggcttcaagcacattaaagctaaaatggcgaaaaggaacaagcctgcacaatccattagagttgaacaaaggaaatgtaaaatatgcgatgttagcgagatctcacctccaatgttgaatgaaaatccaccataacgtcaaaaatactatcaagacctcccatctcccttaatgtctctttaaaatttcctccaactctggacactgtgtcagaagtctctgtaacaatcaaatatttgataagggaaaaccttcctagtatgacaatggccataggtgcttctagtgcagtccactactccaattcaattctgcaacacagatggaagtcatcaatcaaaagcaggtgaagaaaagggctaagcaaaccacccatgaatattgcaaataggtgctatgtaacttatgacaagttgacaactgcttatttggctcatataaataaatataatggtcataaagggaaatcatgaccaagaaatttgattaaaacttaccctctactgaaacagcagacaagcatgcattttccattgtcaacaaagcaagccactttggacacagttctggccttgttgttttcttgtcatctttgtcgagcgacttgatcacttgacagcttaagagaatctcttcaacttttgaaaggatttcctctgaaatgcagtcagaatccttatttgatccattaagcatttgaactttactgattccaagaagtttggaacctatcgatggtgctttggaatcaacaagattcactggaggatttaataatttaagaagaaaatggacaccagattctgaatccaacaaatgattttcttgaacctgaacaacaagaagggagatattggagaataagcacaagtgaagttataccattaaagagtacgagctgctagcaataataactgaaatttacaccataaattaaagttcaacttcaaacaaaatgatgaaataaaagcatggattttctcaaataatcttctttgtaatcacatgccaaaatattcatggaaaactggtgaatacttatataactatactgtagaaataaataactttgtcatgatgtgattatctttatggactgttatataaaagaaaacaatcgatatgcgtaaaaaattggaatgaagcatgcacagaagcataaggatgggattgagaggtactcacatcacttcacaaaatgaatagaagagcagctgcaccaatagtgcagggaggatcatcaatgttcaaaaccaaaattgaatcaataatttgttgtaccaatctataggatataagaaaagaggacacttgtgagtaagaaaacaaaaggtaacgtacaataatttcattaacggaacatgtgtttgttgaatggaacgatttcagtatcttttgttcagttaaaaaacaagtcaaactattcaacacctaaacagtacacattaacgaaatttaatgaaaccctatagattgatacacacaaatgaatcctacacaatgttggatctaatgccaaaactactgcctagacaaattaagtttgaaactccagttacaaattcctttatgatccgttagtagagataacgacaaacttttgtgttttttctggcatcaaaggcagaacataattgcttgtttaccgtctaggaaccagagtaaaaataattcggagaggtgacatacatacctcgctatttacacataaagagaagatccctcctctaatacaactgtaggagaaaagaactccaacacagaatttcaaagctgcaaaaggcttcagcagctcaaagattctataaaggacttatatttttcagggagaaacctatgatattcttgatattttcccccagacaaaagatctaaaaacaaggaagcagtggatgcttcgagggagaagtgcttctcatcaatcatgaacaggtaagtgccagccctggttatatcacccctctgtaacagtttcctaacaatggaatttagcatgcgggagttggcagtacagccattctcctccattgaaagaaatagatcatccaattcttctagcaacccctgctctataagattttctgccattaaactgtaggtcctaacatctggcactaaaccgttagccgagagagctgcaaacaaatccttggcttcatcatttctgccaactttaagcaatgcaccaatcataatgttaaaagtcctagtctccagctgtaaatccgtcaaacataggttctgaaacattcgaagtgcctcgtcagtgagattgtttttgcaaagcccatgaaggattatgttgtatgtgctaagttcaagctgcgttccactttcggtaatcccgacatagagttcttttgcagcagcagttcttctggtttgaaataaaccttgcagaattatattatacgtaataatatcaggactaacaccactgctctccatctccctaaaaagaactaacgcatcttccatcctgctaattttacagtagccattaatcaaagtattatatgtaacacaatcaggtttcattccaactgagaccatgctggcaagtaacttcgttgcttcatccatcttacctgccaagcaatatccatcgatgagagtactgtacgtaatgatatcgggcttcacaccaatacgtaccatcaggtcaaagagtttttcagattctataaccctcccttctttgcaatgactgtcaattattgaattaaagaaaatagtgtccagacagatgcctcgatccaacatttcaagaattaactctttagccttgtcccatttgtcaaagatacagagactatgaattagggagttataaacaatgttgccagggcttagtctttcatcgatcatctgctcaaaataacgcatagcatcttctactctgcctgacttgcaaagtatgcctataactgttccataggtcactgtatccggattcaatccttgctgcctcattttgctgaacacaagcattgcctgatctactttcccttgtttagcgtatgcacatattagaatgctgaaaacataatgattagggtggataccgtttcgtaccatcaaatccaagagaccatgcatctcaacaagggctcctttggtagcatacccctgaagcagggtaccataggtagtaatatcaggctttaggcccctcttggtcatagaatcaaaaatctttcttgcttccgtgcatcttccgttcttgcaaagataatccatgagcgagttataagtaacaacatctggttcgacaccatcactgcgcatctttttgagaaatacaatagcctctttcggctgccctgaagagcaaaacccatgcacaatactattatatgtcatgcaatcaggcatgacaccactcttaaccatggtggtaagtacctccatggccttgtccacagtttgagccttgcatagcgcagcaataatagagttgtaggtcacaacatttggtaaaatcccccggtccagcatttcatggtatgtaccgtaagctttgtccagatccccctccttgaagaagccattgatgacagtggtatacgacaccacatcaggtgggcagtcacctccatcatcaggcatcatttggagcagctcgagagcttcttggcttctgttctcatcacacagccccttgagaagaatattgtaggagaagacatttggtatgcagccaagctgggtcattctgcggagcactatgtccattgcgtcgctcgtcctcttgtcagcacagaggcccttgagcagaggagtgaaggcgatggcgtccactctaaatcccttcttaatgacattgcccaaggccgcgaaaccgaggtccaagcggcccgcgcagcagcaggaaccgatgagaatgccgtaggtgcacaagttgggagttacctcgtcggcgccggctcgggccatgcggttgtagcgggacacggcggccgcggggctgtgacgcgcgacgtcggcgagggcgcagttcaagccgtagatcgaggcgcccctgccacgccggagcaattcgtcgaacacgtggcgtgcgtcctcggcgccactgccccccgtgcggccccctcgcccttgggtcgagccctccgagcgaagggcgccaacagcgccggcgcggacgcgggaagcggcgcggcgcgccatgcccgcccgccctagcggactggtgcagcagcagcagcgccggcggaaaccaacgcgacgcagctgatacggagaggtgggcggcagcagtggaggatagaggggaggggaagggggaggtcggcgccgtgctatttggcgctgaagtatacgattttgcgctcaacaaaaagattatttttaaataagttttggtcacggttaatttataaaattaatttttggaaagtgtcaaattgtcaaaaatttgtgtgataaaagggtggccgcagtttgcaagcgcgtctaggtctagacgctgttataaacaacgtccatcctgttttgataaatcctccaaacaaattgctaataatttaattttaaaaatattaattattattaatataaaaattcggcgaaacatgtgtcatgtaaattggatatatagatctttatttgagtcagattttaaatccgtttgcttttggaaatacggaaggagtcgtataaggtatctctttaaaaattttacatgctaacttgatcgagatatctgttctgcgcgcgtggaagagaaaaaaaacataaattttttgcggtagtttaatagagggatccacctttagttttttagttttttattgaatttaggctctctcttagatggaggagtatttccacttcctattttcagtttaggaaaaaaaataaattttagggatagattattgctaacatattagtgatgctctaaaatcaaagcacggtttaaatttgttatagtctactacttcctccatttcatattataagtcgttttgattttttttagtctaacttatttaaatttgactacgtttatagaaaaatatagcagcatttttaacacagaacaaatatattatcaaaatatattccatgctaaatttaatgaaactagtgtggtgcttaaatgttgctaatttttttctataaacttagttaaactcgataaaatttgactaatataaaaatcaaagcgatttataagaaaaaaaaagtcaaaactactccctccatcccgagaggtaataacctattaccgaattatacattacatacaactataaatctagacaacctaatcgaattcgtgaatctagataatatctaatccaatactatattcttatattttggaagaaaagaagtgctccctccatctcataatatagcaacttagtaccagacgagacataccaatttgttatattatgggatggagaagtaggaaagaatttattgcaagtttgcaactgtgccaaaaccggtgtgttgaatgaaacatatattaacgtgataaaatggcgttattaaaccggtgtattgattcttgggtagttagtagtagttcatgctaaataatgaacgtaagggcaagctattgctcgttgtgctctgtgcaaattgggctcaaattgtggtgaagatgacggttcaagctaaagtttcagcagagggtaatgtgaaggagattatcttaagatcataaaatgtagcatcaatatatacctgcgaaagatctgagaaaaaaattagatgtgtaggagtaatggtagttaagaacccttcacttgacatgtgatggaagcaaaaccaggaagaagaaagggaatgaaagagagcttaacacgctggtaggtttcttactttctatggttaaacaaattgagttacataacgtggagaactagaacactggaagaggttggaaagtccccccccccccccccaccgtcgctctcgcacgggcggcttggggggcgaaaaaaccctagctgcccactccccacttcttctcccccacctcgccgccgccggagctcgccggcggcgaagccggcagcgagcaaggaaggcagcggcgaggcccttttttcttggcgtcttcctcctcgacgcgatgaggatggggcaaacgacgaagccctcactgcggtcggaggtggtgacgccgtggcggtgtggggaggcggcggatccggcgcccccaaggccggatccggccatcccgcgcctggatctggcgtggcggcggcacgaggcggctagggacggcggtggcggctcagcaaggtgcgcggtggcggctcggcagcgggcgggcgaggtgcgcggcaatggcatggggctgcctcgggcgcggaggcggagcgtggcggcgtgcggtcgtgtgcgccggtgacgtgcagccggcccgggcggcagcggcggcggctcagtggcatgctcggcccttggagctggcggttgtgctcgctggcgccggcaacagcgcgacggccgtggctcgctggtgccagcgcgagctgtcccatggcgcggccaggcctcggtagccgggcggccgtcgtggtgcccttagcggccagctgggcggcgcgacgcagccaggaggggcgcggagaccaggcaaagggggtgcaggtgggtggcgccggagccggagcgacagcgtatccggcattggcgcaggcccagatggtagtgcaaagggagctggagtcgatgggttgtcttcctcgttgccggtcggcaccctcgcccttcctagagctcatccccttcttttgcggggagtttctaggttggattgagacagcagctcgccagcgggggaagctcaggctgccgaagcaatgtcacccagtcccgggttctcctttggccaaaactggcaaggcggccggcgggtggtggaacggaggggtcctgggccagctctcagggatggtggttcgatggagtcggccgacgaaggggcgtcggtgcggtgcggtggaagctacgtgctaccttttgtctgtgtggtggttctgagtggtggacggtgatctgcgatcaaggctatagggtcctaggcggaagcctagtccggtggttcaccggaccggcagcggctacgccttcgggcgtcgtaacctccttggggcgctgtcaagggttaccctctccccttcttgatgagtttctctgggtgaaaaccacatctttttagatggacgatggcagcatcctacatgtcgtgaccaccttggtggcatcgttttcgaagtctcatctatgtgttgctgccgtaggcctagcggcgtttggtcacacttagtggcggtcgtttggtgctaggcttcaccctcagtggtttgtgcttgggggtagtgtatggtgtgtggtcatgcaccttggtgcattgtggtgttttttcttgtaacttttactccttaatacattcggatggccttgtcgatgacatgggatcaggagtatcatgactagaggtttgaggcagacacaatcgcccacgtggcctggcaccctcgggggacgtcgggcccgagggtgatgtgttcgccctcctcttagtccccccgagggggtcggaccgcacccgcctcggccccgagggccgaggcgccccgacccctcgtgggtttttgctccgcgtgtatgggttagg

SEQ ID NO: 59815 - DNA, 3515 bp, Oryza sativa
catcaccaaagataatcgattcagtcttagatgccttctttagggaggagaaccaatttttatcaccggtcatgtgctgcgaacaaccggaatccacgatccacacgttctccttctttgtcaccaaagcctacacacaagcagaagtcgaagcctcagtacttgggttagatgataataaaaatttaggaatccagtactgagacacacgaccagaagatccaataggcatatatccacgtgcaaaatcaattttagaatttatggaaaaattcctccgaggccggtctgactgagggtgtgcagccggtctatccgggggcaggtatgaccgaggcatcaccgctagtctgactggtggtcggtctgaccgaggctgttcagccggtttgataggtcacgggtccgaccgcgggacccaatttggtctgtccggtttcctcgagggaaaaccagatatttgccactttgattttgtaaaggcaattctctctcctttgtgtggttatgagctaatctgaaacaaaaaccacaatatgtccatctttgccccaaaaaagaacaagtatatttttcacgatgattagacacattggtagcactagtagatttagcaacatgagcaacatcaggagattttgcatgcacaacattggattttgaagaagatgcattcatagtagatatgataccagcagatttaaacacagttttattagtatcaggtttaaccaaaatctcaccacttctagcaccaacacctaacacaacaggtggatgtcaagaattatgagcataaggattaaaacctaaaccacggttatgtgtgctaatctttgattgatccaaaatcatgttgaggttcttcctggcattattcatagctcgagcaattctgttagcaaccaaagccaaatcctcctcctcaatttgttcgagttgatcatcggatgtggcattaaaaatagcaagaaaagaagacttagatgaagaagcatcaacatccaaagaggaaaccaaagcactcgacttagaatcaacttttcgagaaagaacattcatctcatgtgttttcaattttgtataaagtgaatccaaagtcaaagtagacatgttaacagattcctgaatagatgtaacttttatctcccaaatagacatgtcaagaccattcaaaaagtggtgagaaatctcagattgtggataattagcatcataagaagaatcaacagatctaagatcactcaaaattttattaaaccgagaaagatagtcatccaaagcttctctaggtttcatctcaaatttaatatactcctttttgaaaagatcacgacgaagttctttaatattatttgttccttgatgaaaattactcaaagcagtccaaatctcatgagcagtttgaagatgagcaacacgattataatccaaacgagaaataccactcaaaagaatattgcgagctttgcaattttgttcaaaagcagttttttcagcagcagtattaatagtttcaggaatcacataaggatgagaaacttttctccaatatcataatcttcagccataatataagattgcatcctactataccaatgagaaaaatccgttccatcgaaaacatgaggcttagttgaaaacctagcgggagtagccatggcaaaaactctagatcgataaaaatccaaagaagaaaacaaggctctgataccacttgtaggatcgaatcacaagaactaagccaaccagagggggctgaatggttgctatacccaaaaaccgaaaacttttagcggaaataaaagttaccctcaatttcgatgagatcggtctgaccggagtagattagccggtctgactgaagcgtagccgccggtctgaccggtgttgaatctccggtatgaccttcaagatctgctcctgacgcctgtcaccgacgccggtctgaccgccgtgtacccgccgatctaaccaccgcaatgccgtcgatctgacagtcggtgtgtcaccggttagaccggcgaaaccccgggaaacacaaatcgaaaactcttacagtagatgacaactttattgattctctctgtatttacaaaagacaccaacaacactccttacaaaaatttcaactaaaactgaaaccctaactcaaaactcaactcaattgctctcaaaagcgataccgggaagcctcacgctccccctctatttatacatgaggtaggcaggctaaagccacgaaccaaactcatactaagagtcctaaacacattaggaaaccctctagtacaagaaagaaactttacataaccaatcgtaccaaatttggactccttccaaatttgactccgcatcccatatgcacacaataactccatcgtatgccatatggaatctccattaaccacgtgcatcaactctagcctaagtatcccgcatgatctctaaccaccacggacgtcgcctcatccctaagccgactcccgatccatcaccgcaaatactctcccgagacatcgagtcacctacacatggaacaaacaaagaaactatattccgagaccaagctatctccaacttgactcattagtagcaaacaacagtattacatagtatagtatccatctagaagtcataatcatgaaataatcacggatatccaaacaaacaacccgaaccgaaacagacacagtgtcggccggtcataccgcgggctagccggtctgaccgcgcgcataccgccggtccgaccggctaccagagcccggtctgaccggtcacatgaaataatgaatcctgcgatcacctgtgaatctaatcatctccaaaaccacttcgtgaatacattccaaataacaaaaccaataatctccaatgcccaattgttcatcaaagaataataatcaaaaacacctttgattttacaatctcccccttaatgaacacattggcaaacccataaaaaatgttttggtgtttggaaaaataaaaacaaaagtggtaaaaagcacacttcgtacaaatgtacacatcgtgctcaaaaatccaaaagaaaacttctccccctttttaaaaagaaagaaattcccaattgaaccaaaaacatgctcttctcaacaactctccaaaaattcgccttgcttctccaaaaatccaaaaattttcacattacttctccccctttttacaatgatttcatcaagaataggaattatgttcattaatgttcaagagcttagcatacatatagcatatcaagtcatgtgttgcaataaaaagaagataaatccatctataatataacaagcatgcattaaagtataaccatgaaccaaagattttacaattaagcttgaatcaacaatctaaattcatgatttcatacgatttataatgcaacatcttaataagcacataggttgaaaaattaacactaaacatatatacctatggcatttatcactctttctcaaataaccttagcacaaaacaaccaagagaattttttaact

SEQ ID NO: 59816 - DNA, 24487 bp, Oryza sativa
  unsure (1)..(24487): unsure at all n locations
ccccctccccccagcagcggcctccctccccgccccgccgccttgctccccgccatctcctggtccctgacgtgacgcctcgccgcggcggcgccgacgaggtcgagaccggtttgggtttagcgctttctctctctttgtgacctgtggaggatggagtcgtcggagatggggagatgaatgaagggagctggctcgggtcggtgtggtagttgtacggaaaccgctgcgtctctgcgtgacgtgtccgccggggggagatgtgggcccggttttttttttcacatctctaaactttaatttcatttttggttagcacgttttttcgaattgttaaatggtgagtttttatgaaaagtttctatgtaaaagttgtttgcaaaattcaaataaatctattttttaattttataataactaatacttaattaattatgcactaacgaggtttctcgatttacatgcgccgaaattttctagtaaaaaataaatttaagatgtaattacattgaagtataataggagtgtaattacattgtaactatattttaaatgcattgtaattgtaatataactttattgtacctacgatataatttatatgaaacttgtattcaacgatggtttggttagctagcactgagatatcacgcgtgacatgtgtaaaaatttctttctagcaaattttttctttatacataaatctcaaggtgatccgatggtcataaatctgaaagttttggaggcaaaaaagacttgtggaaattttctagcaaattcgttttttgatttttcttttaactttttaccttgggaaatattttttagaaaaaaacaacgctacacattcacctatgcaaatgcacatagacgtatcctatcccaataaactctcgtgagattgggccggcatatgttgggattgtcagaatcattataaatgactcgttgtcaatgagtatgccgaatcaatgattagttatagatgtgagcattgagccaagtctaaaacttgaacggtagcagtaacttttttaatataaatactaatgaaaaggaatcctttattagtttcgttgtgtgatcaacgatggaagtgctgaccttcgaagcaagaaaatgtttagccttctgcttcgtttaattatcatgtacttcctctgtactcctttgtactcgtaaaggagatcgtttaggataatgtttaagtcaaacattgagaatataaatcataaataactcttatgttgttgagtttgaaaatataaaaattatatgaaatatatttgttttgaaaaataattttcataaaagtatacacatatcacttttcaataaatatttttatagaaataagaaatcaaagttgtgttttggaaaccgtgtcactgtccaaaacgacttcctttatacttcctttataagtacggagggagtacattacagtactgaccactgaatgctacagcgtcatatttaaagagaagctaacggagtattatatgaaaaagtcttagtgtacttatatactctctctgtttcacaatataagtcgttctaccatttctcacattcatattaatattaatgaatctagatagatattgtctatattcattaacatcaatatgaatgtgggaaatgctagacgacttacattgtgaaacggagaaagtagtataaattgtcccaaataaaaaccaaagaaggttcatgtgttagctgccaaatcttcagtcacatgcttcaatgccaaattttcgccgtgcaggacaggcctgaccaagcagatatttttttttttttggagaccgacgaccaagcatattgatttttttttcttttcagaaatcattgtttgatctgatacatttggaaggtggtgaggttgctgaatactgagcttcaagctggggcttgcttcgagctgcaactgaccaacaaaaccaacagttaaaggcgaaccataagtccatgacctacattatttttttgcgggtttttcattttgtgtgtatttatttcaagccactgtatgtttttcatcttatgggtattatggatggtagtacattttgtcctctgaaaaactgatccctgaatgcttagagttcagagtagcagcatcagtcccactcccatgaagcttggttcagacttcaaagcaaaaacatttgttcttgcatgaatttgcaaaatcaatttgctaaactgtactttccgctgtactccttcggggtttctttttatgtccttcgctttattcaaaaaaacttcaagcatggaaaaatatgaatcatgttgtttgtttaaaattagagacgaatgtcttcaaaatcaacggcggtaaacattaaaaaaacagagggattagttaggttgtttctctaattttcgagttacatattctgtcggtcttacactgtcgtttcctttttttttttttggcccctgccacgaatctgctatggatttgatatctttgacaccatcgaagttaacataggcagaattttatctacaagcaaaataacagacctctgacaatcttaatactagttggagattcaatttaattatagttacttctaatcttcaataggcaagacaatacactttattcatgaccccataaatatagtaatgcgatacaatcatcttgacgatcgcctctaagccgtaatactaactggatatgcatccggaggcggcatcacacagttatcaccgttgaagtacacacggactgggaaggcccttcccttgttattgttagtagtggaagaagccctgaaatcctttctcacaatcagttctccttgcacatttccaagcggaccagcttgcatgagcaaatcatagtagggctttactccccatagcatcgtagtatcatctaacatacaaggagaaaaaaaaaacttcgtgagcaaaagatagagagatggtatatacaccttctgtccttaaaaaaaataaattttggctacgaatctagacataggtcagaagtatatatacacacacatacacatgcatttttttttatcaaaaaaggatggttccagattgacttacttattttgccgacttggattgacttgtaattgaagccagatatctgggtgatatcgaggatgggatgatactgaacaaccaggttccattcggtgaaattcatgcggtagttcaagttagtgacagtgattttcactctgtagtgttccttgtctttgagcatcaagtgccagttaattttcactgggcacatgtgtgaagtgcactggagaagaggctgccaggtccatctgccagggccgtgaatgatggattgcaaatcaggtgcattcttcctgtcaaatgcaaaggaaattgttacaattttttggtgaaaacaagaagctaggatcccagtggaaattgtagttaagatcagtaacagttatattaactcactttacacattttcctgtagtagatttttcatttcggcagccacaagagcatgttgggcagtcaacagttttgtcattgtcgaacgacgagagagaaacacagcaggatggaaccttttgtgcaagaaattgggagtatgtgcagatcacattccatgtcactgtgaatagagatttcctttttgttaagaagtactactagtagtactgaatataggaattttttctactatagaactcaaaacaaacaacaagtcctatatgtaatcatggggatgtctgtctgaatttgacatgtattagttgctagataacaaaattgattaaaaaaaagatgacaacatttgttaagtaggctcagccttgtaaagcctagcatgctgtaacttgttttcaactaatatcagatcaaccagtcttaggtgaccaactcctgtcccttcctcactaaacctatgcctaatccaacttagcattaagaaatcacaactgagtctatgttcctaatgcatttccacatgacatacaagcaattgggcatcaagcagcaattcagaaaaagaacaacagatggactacttactcagaacttgagtcgccctcctcccatccggacttaaaaacctactaggcttcacaatcatagcacggctacaggtataccccggaccaggcgccataagactgaagttcttcggcaccctaacagtctcattgctgttcccagaatggcctacaatgatctgaaacgacgcggcagaatttgccgggtcctggctgaatgcgctcagtgatccagccttgcagcagttggcgatctgcaggtcgattggggcgcccgggaggaggtcgacgacggtgggatgcttcttgcagctgtgggggacattgctgccctccttggacatggagcagtcgccctgctcgatggcctgcgcgccgtacatggaccagatcacctccttctgctgccatgtccaccccagctgccaccccggtggctggatgtgccggaattgctggtagttggacagtgtgacaacggcctgatgaacaggggacgtttcagaggacagatctttgatacagttacaagagggaaaccggattcgatatagattttgctcgttgttattgttgttgttgtttgcgacatactccctccgtttttcaggttataagattttatagcattgcccaattcatatagatattaataaatctagacgtacatatatgtctagattcattaacatatatatgaatgtggataatgctagaaaatcttataagatgaaacggatgaagtatacatgaagagatgtggctatgctgtttaacttcaagtctataagttcatacttcctccgttcagtaatcattagacgctttgaataagatctagtgtagtcaaacttttgaaaccccagccttcaatataacttataaaatatactacttaatagtatcaaaacataaaaccatgtgtagctttcctaatctctagaacttaatagattttaaaacatcaaatatatttttttattagaggtagtagaacaagatagtgtaaatgtacaggttgagacgaaaataaaggtagagatgttggtgtactgccaccgctacttacagcatagccatcaggagtccattgcatcacatcccattttatcgtgatgttgccgtttggatccagggaatcataagcatctgcaagagcaacaagcaaaagtgatacacataaaaagaaaaatccaaaacaagaaaacaaaatggcttaggcattggttagtgtcacgacagtgtatccatgtgtgagtgatctttttgtcagctgcggctcatttccaaaaaaaaacaaagaaagaaaaaaagaagaagaagaagatgggcgtgcttacatgtggtggccggagaggagaagagcagcgccgccgcgagcagcacggcgcagcagccaccaacaccaatcgccatctataatatatggctatatccttcgccgctacgaactctaactccggcgagcgatgactcggtgtgtggggggtgtgaggcgacgatgtattatatatagccgcggccaccgacggatctcggccggtcgcgtgcgttgacgcacgcacgcgcgcgggtcgtcgtcgccgccgccgtcatgggcgcgccgcttgccagcttgttccttcctgcgcatcttcgcgtcacgcggcgcgcacgcggcgcgcacggcgcttcactggttgtctttgtcaggcaatgcgcgacaagggttcacaatctcgataccggatcaaaaatccactcacgagcgatatcatcggatttcgctgaatccgttgacaaacctaaaaacacagacgaaatctaaatagatttttgtcaaaaaattaaaattcagtttaaaattttctgaacctgacaaaaagccgattggtttgtgtttttaactcaatccaataatgtttggattctattggaattgtgaaccctgccgccgaccactgctagatgaagtagcggaccaccggcccaaccgaaatgggtcgcacgtaagtcgcaatcccgatccggcccatctacaacgggccgaacaatcccgatatagatgggccgtacgcccgttgctacagtttcggcccaagatcaagaatgggccacacagcgtgaggtcgccgccgcatgtcagcacaactaaacagaagccggctgcagccatggtacttaatgctcgacctcatcaagtaaattcgacatacagaacgagcatctacttgtccaagtgcagctgaacacgtcagttatgtacagtacatgatagatctcagcaagaagaaagcaagtcgtagtactagtagtaaatattgataggttccatgttggtgattctagaaaagagacagcggttcgtactggtaatccaagagcctcctaaacaaaaaaaccagaagaatgaaaaaatggaacagacaacgatctgtacaagctgcttgactagcaaacagaatactgaatgggaattacaggtctccgggtatccatcatcagacactgtgctctctccagtctctaccgccatgcagacctacaatacaaaatgcaatgccctccagaaatacccctttttctctgccaaccaccatgttactgcatagagttttgaagccattgttcttgactatgatcaccgtcttcttagggttgaaaccttgctgatggccctgagtcccttctatcgccacttatctcgaattcgcttgagcttgtcttggactcggtatctgcattggcagtgttgcccctccggctcctccggtccttcagtaggattacagcaaaagcttcagatttattgcaatgatataatatgatgaatgttattgcaggaaaggagaaagcgttaccacctcacgggatgggacatcttctgcctcgagcatccgaacaacatgacccatagtaggtcttttctcagagtctgggtcgacgcacctcagtgccactaggagagcacgcttaagagcccgaatggtcggtttgacctccatgtcagggtcaactacctcttcagatcttcttgtgccaaccatcattttgagccactccactagatgcacctgcaaggcatccacgttacaatgttgttatatatgacaaggtatacagctagtcagctcctgaaaaataaaacaatagactgtaaaagtgagacaagggtaactagacagtagacaactgccagacagccatacacctgaagcaaattcgtctctcctagtatagacgttattttgccgtaaaataatttccaatagtacggacttttgtaacatacataatacgcatgagattgtaggatatatgctcacctcattagcaggccggccataatcaactggatctctaccagtcactgcttccagtaatagcacaccaaaactgtagacatcactcttctcgtttaacagacctgtgttggcatactcaggggccacatacctgaaatgaatcaatgatagcaatgagaaagctacctgttataatatacgaaggacaaagttcgcagcatgtaaaattttatattgtatgaataagcgaagtactgcacattccaacagtaaaagctaagcataggaaagattaatactaactccaaaaaaatatcaacatacccaaaagttcccataactcgagttgtgatatggctcttccctgcacccagcatcttagccaagccaaaatcagaaagtttgccattgaattcttcatcgattagtatgttgcttgatttgatatcccggtgtacaacttttggctctattgcttcatgtaaataagcaagcctgtataccaattcagttatggaaaatgggttatgcaactaaacatatacatataaaagagctaaagtgaagaacaattcttttctttttgacggggacgatggtttgtttcttacgctttagcaattccaagaacaactttcattcgggcttcccaggtaagaacaccatgttggcgcatggcaccatgaagccactgttctaagttcccgttattcacatattcgtatacaagcatcctggaatataacaagtcagatgataggatggaagtttaatagactacaaaaacatagtatgatgtacacaaagaaagatttggacaccactaaccactaaaaatattaaacaacagtaatgagtttggatggccaaagcataaggagacaccattaacataaagtacttgtggaaacagaactccttagatacactcaaatcaatggttatgtagtgaaataaaaagcttaaatcaatgaccatgactcgaatacactcaaacctattgtgtgctcagaagtgcaaaatatattgctgtagatatcatttgatggatgttttgttcaattgaaaaccacaaattattacaagatgtagcaacattgttcatttctgtagtcatgatgaaaacaagggagaaacataatcatattttcaacaccctattgcagattattttggctgagtgtggattttgaattacgtgaagcagacaccattatattcataggacctatttgttggtaactagattatccgaaaacacctgacactcaacatcttagtatatttcttaagcaatttctatctcgatggtcacttaagcagcactggccaaaccatataaatatctatattattaacttgtttctagagcagtatccaaaatggcggaaaactggaaaatacataggtgaatggacttctgattttctttggagaatacagtagcttggacatatcatgaatacaaatttagaattgaacatgcatgagaagaaacgtgaagaacaagaacaggcattcacaaagtaatgaactatggaagtacatttcagtaagaccttgttatagccaactaacaaaccaataagcagttgtgcgcttctagtgaatcctagctttcagagctatggccacattttcatggtaaaagaatggtggtccaaagaaggtttctgtggactgagcataatctgtcactgggcatgctgaatcccaccatcagatttggaagggaaaaaatcgatagcataaggagtgcagtcaggaataacctatcccttgagataatctggtgagtaggtggacatagaccaagagcaatcctacatccctatgcaagtaaataatgtgccagtagaaacaaaagctagccatccatcagcaaaggtgatnnnnnnnnnnnnnnnnnnnnngattccctcaacacaatatcctagaaggcggacaagattcttatgcctgacgtggccaatagcctcaacttcaaccctgaactccttttctgcctggcccctgcagcaccatatcaaaagaaaattaatatgatggcatcagaaggagtcacaagttctgtaaaacgcagaatagatttcaggatctcttacatattattaagaagcttctttattgcgacgtcagttccatttatgagtcgaccacggtaaactaccccatatccaccctctccaatgacattctccttggaaaaccgatttgttgcatgctccaaatctctcagagtaaaccaatgaccccagcccagatgagagaattctgggagaccaaccagaggggatgctgagacagttgcatattgagaaaagtgcctcctagcattgcccgagctgccttcatcaccagaatacgagctaccagccctatcacattggtacaccgagctgcattggctcaaattatcggcatcactcgatttactcctaaccaagtgtgccagcattttccctgaatctttctcgtaatgtttctcctgcaccgatatcgcgtggctttcttgcacacggaagttttcgacaacagcatgctcacgaacttcatctactgcaatctccttggaaacatccgggatttgagatactggaatcttatcaaaggacttcttcggcttccttcggtatatggaccagaggcacatgaaacctagtataaagaagatcaccacccaaatactgattccaatcacaatccatagcctcaaaccgaaaggcggcgtcctggatgatagctctgcacgcagggtttcacctgtcgacatcttcacttctcaacaacctatatataagccagcatcagtgatacaatgtcagcttagcattcaatccacgagatgtcatattgctggacctaattagccgaattatttcagctcagcaatttgctgtatatgggtggcataaattcaatgcagcacaaaagatttagcgcagccaccaaacaggaacaagcaagcaaatataccaacaagcgccggtcacttggaagctcggcgacggatggcgagcctaaggctgccagaaccccaaatgcccatatgaggcgatgtttcgcttacccaaattcgatggaaacgggttaacccaacaggcaggagcaagcagcgagtacagggaagccagccagcaagcgggcgcctcacaggcctcgtttcggcgaggggatactaatcaaatggagagagttgcggcgagacgaagcataccggcgtacggatctggacgcgtagcgcctgccagcgaacgagccggtggtggtggcggcgcccgtccctaccccgcgcgccgccgccgccacactccccctcccccgtacgcttccccccgcgcccgcgccaccggcgcacaagcgcgagccgcgccgcgccgcaccccccacctcaccggcagccgcgctccaacacgagcccccacgtcccccggcacacgacctccccgcaatgccagcggaagcagaagcagcagcaggcggaggtggccgcgggaacgagcgcgagcaactccacctcctcacacacacagcaagcaggcccggcgggcgtcgggccgcggctccggcggcggtggcagcgatgggactccggcgagcgggcggcggcggtggatcgggtgggatttgggggaagaatcttgcgggagaagggggagagagagagagagagcgcgcggtggccggtgagagtggaagtggagagagtagggagggtgtcgtgtcctggactggattgtctataatctagtactccagcaaattagcattttattattactgcattttttttctagagttacatagccaacattaccaatatttttcatccttaaaacacatcaatttttttcaactgtacaccctccataaaaaaaacaaatattatattaggatgtgacacgcaccagtacaaggtttactttttttttttttgacgaagggtgtacatagctttagatttactcatacttctttcgtacgaaaaaaaccaacctagatacggaggtgacacttcagtacaacgaacgaatctagatatagtgttatatccgtgtctaggttggttttttttacggagggagtatgcaagttcactgctttcctcttgttagtactattttcttttcgtcgtaattagtctttgtattacgagttgttttcatagtactcttttcgtttaaaagatgaggctctaattatgaacttttatatctatatttataaacaaaagttagatttttatagataggggttttaagtttgtattttggtcagctacggaggcgactgaccccacatagtccatccataaacaaacatgtcattaacaaaatcatatagttatatcaatatttatatcatataagagcaagttgaatagtatagtccactactagctccaatttatctatagccgatctaatagccaattcatacaatagttgcttactatactattaacatatggtctcacctgtcatacacacattgcgtcttggagtccgtgctgcagctggctataaatctgtagcccgctgctcttctctcttatcttttatcccattaaaatatgtttatagctggctaatagtccgctattgtacatgctctaagtatccgaaatgatggagttaacaagttaaacttgtcagccacgtagctcgtgaggttagtcaaacggccgggctaatcacatcatgggcttcatgattataacatgtattatctttgttcgtagatactccctcggtctaaaaaaagataaacattagattttcgtgacaatgtttgactgtccgttttatatgaaatttttttataattagtatttttattgttgttagatgataaaacatgattaatactttatgtgtgacttatttttttaatttttttttataatttttttaaataagacggacggttggagtacaacaaattataaatgagctttggacggagggagtagtacccaaaaatgatttatactaatacgtagtacaacaccgcacagctcacacggtcacctttccaacccaaagccacgaacaaagggcgctcgggcccacatggcatgcacactacgcaatccccccgtgttggggagtagctccggttcacagtcaaacggacacaaggtccaaatctaggctcgctggactcgcggtcgcagtaatttacacctttacccccactgagatgtgggcccggaggaggggcgaaatgatgggaatgctcccctcccctcccccggggacacaacggctagctcccgtccagggctgaggctgacatgcgtcaggccccctgtcactgtcgggctgtgggcccggcccggcccatcactgtacgaccacgcagatcgcttgattcgccgctaattggtttgtctcaaagctactcctctaatgtgattaggcgcttgatttttgctaagagaaaaagtttaatagtatagcccactactaactctaaatcatctatagccaatataatagtcaatttatacaatagttgcttactatactactaatatctggtcccatctgtcatacacacgttgtgtcttggagtccgtgttgtagctggctacagatctgtagcccgctgctcttctctatcaatgtttatctcattataatatgtttataactggctaatatcctactattgtacctgctctatgagcaagtttaatactatagcacactaatagctccaaatcatctatagccaatgtatataatagttacttactatactactctattattatctggtcccacctgttatacacacgttgcgtcttgaagtccatgctacagctggctatagatctgtagcccgttgctcttttctctctttttttatagctggcttatatcctgctgctattgtacctgctctaactgttgtcttattaaaggctaaccaggacgtgattagatgttacttcagtaatcacgcttaattaattaacctgcgcgtagtgtttatgtaggagtggtatcaagagctagtgataaacaggttggctgtgatgttggtagcggtgttcgcttggattgtccgtgatggatggatgcaggtcattttcgtcagctggcgagatgatgatgattatgatggttgatggacgaggttgatgtgcgcatgcatgcattgatgcataaacgcctttcctttccaattcctgtgagggccaagaaacaaaaatggagtaggtagaagcatgatcaagaaaaagggcttgatagatagagcttcaacttatcaatttaacttcaggagttaggtttggagtggagttgtggagctgtctaaatccagctctacaactttttgtgagagagttccacccaactacactcccaattttggtggacctgaaactgttgggctgagctccagctccagaaagagtggagctagaactggagctagagctgtgccaaacaggctccaagaatggcttcgctctactgctgataaaccgtgagaaaatgaacgaaacaacttaaaaaaacaatttttagtgacaaaagaaactaatgctgggaaaatgaagtatggtaaacaagccttaaaaattaactctaaggctaagtttaaaattcgcatttgggttgcggatgataagccgaaaaacaaactctactgttgctattgttattcatttccattttgattttctagctgaggctcagtttgaaacgaattactgcgtgattgtttttacggattgtatatttaattatagagataaattaaatattttgataaataaacttaacagatactcggataggtatataactaaaacgagtggctaatagaggaaagtttttttttctaaaaaagtgtgtttttcgaaacgtcgaataaatagtccgtttcgtcaaatgtggtaaatcatccgacaccgacagaactggttcaagtggattagtagtaatttttattgacttatttctctctctctctctctctaagaaaacgttgttctagaataatgagattagctagaggtcccaggattgctttccaactggtaatctaatgagagagagaataaagttttgcttcacccttttttccatggtacacaaacctgtcatgtttagtggctttaggggagacttgagggccccctaattaattaaccacttgtttgtttacttacgtgttaacgtgtctgctgtcccctgtgcttttcttcgccgtcttgattgacttcgacctcctgctagtaattccaattatttttaaatctagattttgtgtttttcatgtctctttctcatacttgttttaggtagtacttcctccattttaaaatataaataattttagattcaaattttacatcacaaatataaacatttctgcatatgatttctatcacttcgatgattccagagccactcagagcaagtttaatattatagccaactattggctccaaatcatgtataggctgcgttcggatgaggaggttcccaacccctctccctcatattccgcgcgcacgcttttcaaattactaaacggtgagtttttgcaaaaagtttctatacaaaagttgtttaaaaaaatcatattgatttatttttttaaaaaatagctaatacttaattaatcacgccataatggaccgctccgttttccgtgcttgggagatggttcccaacacccacctccgaacacacccatagtcaatttaatagccaattcatacaatagatagatataaacatatactatataattaatgtttggtctcacatgtcatacacatatgtatcttggagctcgcgctgcagctgtctacaaatctatagcccgctactcttatttttcctcttttatctacttaaaatatatttatagctggcttatagtctgctattgtacctgctctcagatgcgtcgaaagagagtttaagcagtttaaaattcgaaaattaacacctaaagtgacttaaaataaatacctaatattattaatttattgaacaatctagaatttttgttttccaaacaacctagaattttagaaaaagaggcaataaaatgttactaccgtactagcacaatctatcatgcatgtgtctgtctgtctgtctctctctctctctctcagagagaggagttgagtggatctccatggatggcttgccgacacatcacagatggatgaacaaaaatcagatcctgtagcttttggaccttttgtcagtgtcatcaccttgtagtggaaggaaagtgaaagacaaaggtgacgccgaatgattttgggtcaacttaattggagaaacaccttggggcatgtttagttaaaaaaagcttttcccaaacatcgcatcgaatctttcgacacatatatgaagcattaaatatagataaaaagaaaaactaattgcatagtttgcatgtaaatcttgagacgaatcttttaagtctaattaggccatgattagccataagtgctataataacccacatatgctaatgacggattaattaggctcaaaacattcgtctcgcggtttccaggcgagttaatccgagatgaaaaaacaggccccaaatggcacaaccgcacaaggaacagggaatagagtaggtataaacagtcttcgcggaaacgtattgtaatcgtatctatgctacgcttttgtgatagtggacttttggatatatgtttttccaatatatgtttaaccatctatcttatttaaaatttcatatagacataagaaaataaaatataaaaaatatccttagagtatttttaattataagccaaagtcataacaaaataaaaattattcatatatttttaaataaataaatagataaatatatgttcaaacgtcaacagcgttatctattcaagactttaccaaacctaatttcctaatttcagatgagaaacatgtaaaaaagaactgaacaaaacccaaaaaagttgaatcgaataaaatccaaatgaactttagtatacctatctcaatattggtatatgcccaaactcaaaaggagagaaccaaaactaaaacttttaatgccgtacgtgagcccaatggaaaaaaaagtgatagtaacagcaaaatctcacttaacaatgtcgttgatcagcactatatatttttaaatattacttaaaaatctttatatttacctattgaaaaaaatgaaaaacagaatatgtttcttttttatttctaatttacagcagctgcattcagtcatgtcctacgctccttgaagagagaaaagtgaatttaacggaaagaagctcgaaaaagaaagaaaacaggggccaccacaccagtaataatccctataatcccgtcttctcccaatagaaagaacctcggaaaaaaaattctcccaccgcaaatttctccgtgcgagaaaccctcagccgcaactaaccaacaaattcgcatcctctccgtgtaaaaaaaataaaaagtaaagtagtgtgtcatctaaatccttaaactctcaaaatacatatccaagtcctagaacttgtcatagtgtgtcatttaggtcccaaatcgccacaaccccttcaggatgctacgtggcgctgatgtggcatgtcacagggatatgatgtggcataattttgactgacaaatgggacccatttaaaaattttcttttttctttttttcttctcttgtattttcctttcttttcctttctttgtgacccgagcagaagatggaaaaaaagaagaatgagaagaaaacggaaaagaaaaagaaaagaagaaaaaaaaaaagacttgtcacgtccatgtgacaagtcacattagcgccatgtaggatccaagagaggatgcgtcggtttgggatctagatgatacactttgacaaattctaggacctggatatgcattttgagagtttgggaacctagatgacagaccgctacaagtttaaggactgcccgtgcattttactcaaaaaaaaatctcgcatcctctccacaagcgcaacagctgagcaagagaaagagccggggtgcgaccgcgcgagtggataaggtcacgcatccttattcactcgtccccctcctctcactcgtccctctctctcccactcggtccctccctctaaccctctcgtcccccgccctcgcccccgcccctctcgtctctcccttgccggtagcagaggaggcggcggcgatggcgtcagtggctcccaccgaccggatccggcggcggtggtggcatcggcggctcccgctaccgaatccggcggaggcggtgacaccggtgtttccggcaggcggatccggcggaggcttttccagcggatggatccggcgattctctaccccctcctcctcaccctccgtgcccaagcttctcccgcgatggcggcggcggcatcggcgctccctcgggcagatccggcggaggtggtggcagcggcatttccggtgggcggatttagcggtcctctccccccctctccctctgtccgaagcttctcccttggatccggtggcggcggcgacgtcagtggcacccgtgggtggatccgaccgagaggatctgcccgctgccacgccgctgtcccctcggctggatccgccggtgttgttgattgtgtatgttgtttgtattgtttttcttatgtgataatgatgtcgttgttgtgattgattttggggtttttatgcgatgatgatgttgctcctgttcacccctccatctcctataatcatctcttgatattttggatgattttgcgatgattctgattggattgagattgagattttgtttttgggtcggattatgatgatgtgggatttggagaggaggtgcgcgtgatgttacagacggacgaaagatcggtgtgacgaaaggaaaaatacgaatcttttaattagttaagatattgcatagtgcccgtgcgttgcaacgggaaaaacttccgtttcatagtgtgacacctcgagaacctcaaatcagtaaaaatcaagtctaatttgatatattaccaaattggtagaaccgagtctaatttgatgaattagcataggatttaggctttagtcttagatttacattgcaatgcggtggtttggcaacaacggtggcacccgatctagctgcatgggaatttttggatatatttgtgtgtatatgcttagttttccctatctttgattctatttgcgtgtatgcttcagttttccctgtctccgattctcaggatggaaagtaacgactgggatttttttttggggaaaagtccattttacgcccttgaactcttatgcttatctaaaatacacccccaaactacaaaaccgggtataatacacccttgaactgtccggtattgatagctcgagggtgtattatacccggttttatagttcgggggtgtattttagacaagcataaaagttcgagggtgtaaaatggattttccctttttttttgagggggaggggggacggacgaaaaattagcgtatggacaaggtgacgatcggaaagatacgaatcttttagttagttattaagattagttaaggttaagactagaaaaaaaaacatgcgttgcaacatgtgaatacaatttaaaagaattggacaaaattgaaggattagcaatgcatatacgtgtatatataggcaatatagctattgcttatcacagtctgctgtaacctggatttttcacattttggttcttttaaaaaacttatttcgcaaatagacccctaaaaaaaattatgctagaaatggtccttttttgtggcgccagagtggctggcgccgccgtccttctgccgacgtggtggggcgatgctgaggtggcaggggaagcgcgccagagtggctaggggtgaaaatagagcggattcggacggatagtggtcataccatatcttaaaccatatttttaagcggattcggagtgggtgcggatagtgtacggatgcagatgtcggaaatggtgcggagtcggtgcggaatcggttcagaaacggattaaatttatcagatgttacgtgtgtatgcaatcaatacaacattgagttagcaatgcaagtaaaaataatacaatgtcaataaacgacccattgtaataattatgtgcttaagtgctaaacaacataaatacatgatgtccattttataaaaatacagctacgcaagtgtgacatgaaatggtgaaaaccacatagtaagaaatctagggtaattgatgaattaggtcattggatggaccaacttgtgttcataatttcggattatccggtaaagggcctatcggacaaaaatgtcggataatccgtcgtatttcggagataccatatcctcatccgcatccatatccgccggatttctaaaaacccataccatatccttatttcggatggattcggagcagattggatcggatattatctgatcgttttcacccctaagagtggctggcgcccccccccgaatttttttatttattattatttttttgatatttttttcacgcttaggaacacacaagaaccaaccatagaaaaaatgaactcaaatggacgaaatatgtgacctgtagaatttttcctctcctctcctctctagtgcagaggagaggatgtgcaacttttttatttttattttatttttttttcacacttgggaactcacatgaacgaaccataaaaataataaactcaaacggacgaaatatgtggcatgtagaatttttcaaggctatcatttcatgtagttatattttgaattagattaagtaatttcacctagtggtagagtgcattatgtttaatatgctgatcaaagggttttactaaagaagttatggtctaattttggtgaaggtgcaaagtaggtaagtggtatgctatattttcagacttctagctatgtgatatattccgttcgagtttaattttttttttgtagttggttgtatcgtgattctaagtgtgaaaaaacatccaaaaaaataaaacaaaaataaaaagtttgcaactctatatagagaaacaagaatagaggcgggggcggcgccagagaggttggcgccgtcccgttggaccacggcgccagccactctgacgccccaaaaaggactatttctgggataagttttttcaggggtctatttgcgaaataaatttttcaaaatgaccaaaatataaaaatccagctgctgtaactaccgatccatcacctaatgaactacggaacatgtgggtatggtcggtgaatattttttttagacaggatgcctagtaaattaacggtcgatgaatataattgtaatgaaaaattaacgtcattctaacatgttagttttgaagttatggtgcatagttttttcgtgcagtagcgtgtgtgtacttgcattgcatggactaatatggatcatgtcgtagaaaatattgttatggcagtctattgatttctaggaggcatgtagcaacttagtcaatagcgaggactcaagagtcaagactatacaaggtaagagctgaaatagacatggtaaattgacaatgtgtggaagggtaacaactgatttattagtgatgtacgagcacaaaaatcaagaaaaaactatttttccaaaattgaaagagaagatgtggagaaaaaaacatttctaacaatcatcaaaggataaattttaactcagctaatgttcatcacatgatttgtgaagagcgtggctggctgcatccactaatgtgggccgtgatcggtcaatgtaacccgctggccctggtggggatggtggaaaaagggcctgccagaccagggagaagcaagactctagcttcatgtattggaacgggagaacacacaacgcgtgcgcggggtgtacaaaaccgatattgtaacggagtagaaccgatattgtaacggagtagagaacgtatggaaatttttgaagaaacatcttcaatttttataatagtagatattaagacaagatatacaatgtactagatttatttcacccaagaacagtgcagatccaccgctcggctatcctgtatggtcactcgggcttgttggcgattacgacgttgtatatctatgttgttgaaggattgaagattaaagttttgcgaacaaatattaccatcatatttaaatatatgacattgttgagtttattcgacattcattgagaaattttggcaactatttttctatattataataataattctaacaaaattataatatttttcttttttacattttataattttttgtgtttttttatttcttctttaactagaaaaaatgcccgtgcattgcaacgggtgaagtctattttaatcttattattgttatatggttcagttaaaataaaattcactgtgggagttcgtttatctctactattataaaaattaatcatctgtgcatgagtcggtttttaagtttattcgtttttggaaatacagatccatgtttgagtcggtttttaagttcgtttgcttttagaaatatagaagaaatcgtataagaaatatctttaaaaaaactcgccctcctgctaacttgagacgattggattcctaattgcagctcatgatttttttaaaaaaaatatatatccaaacaagttcccacaatagatttcttgttaactaaaatatataacaataataagattaagatagcttttaacacacatatattttttctagtatatatatatatatatatatatttagaaaatcatgagctgtagttaggcgtctgatcgtctcaagttactatacgagtgtttttaaacagaattcttatatgattccttctgtattaccaaaagtgaacgatcttataaactgaatcaaatacagatatgtatttccaaaagcaaacgaacttaaaaacggattcatacacggatgacgtaccaaaataccggcaaaaaacatcttcaatttttataatagtagagatttgtaacaacatgtttaattatgaaattaaatagttataattatatttatattgtacaaggtaccacgcttgccgcgaggcaattagcaatccaagagaccatcttttaaacagccccaaattcagctgcacaagcgatgtggtataaatgattcaacgccaaatgttggtaaggttgatattggaaataaagtgaacaaaccccttttattttactactgtcaacgttttgagcttactgttaaacccatgtcttccttttttttttcttttactccagtctgatccagaaatactacaatcacaagtctgaatccatgaacacaaggagagacaacattgggcagtaacacacaataagttatgccactcgctacagttaggtggcaactatgtaccgttctagcaactacggcaaccgatctgcaattttctgcagttgaactgaagaacaaactcagctttgcagtgaccactgacccccctgttgcgaatgtcctccagcttactaaaaataatgggccatgcgagaggactggggcgcctgcctgctgttgctgcttgcgccgatgaagccttgcagaaggctctgtgcggctttcacttgatccggaatgccctggatctccacaatggactcggaagaaccaggatgggcttcgtgcaacttcactctcgcaccagagatctgggatcaaggggagattttcacgaggaaaactattggtggccattggggcatggttatgactggggatagtgcataatgtttctcttacgctataccagacggatctcagctagattgacaccaccaacaccaatgacagactccagttaactatttggaatccacaattcgaagagccacctggatacctgcaaagagatcatcactcaatgattatgaggacaaaattcatgtttgtgtcctgtaaaaattcagtctgcgtaagccatacccagtgagacctgacagtcttcggtaatcctcacgtccatggatctgctcagcagcctgaaaagaatgaaattcaaatctattaagcactgaagagaacaaaaatatacattcagatgcatcagagaggcatcaggtgaaccaggaaacaaggaaataaaaaatgagaaaagatcaacacccaactaagaaaactggtaagcaacagcagcagagaacagctgaataactgaatctagggtttgcaacaacatcgtaacaattgaatagtgttaccaatgatagatattagagtgggcacaagacagaaggatatatttggatcaccatgacatattctagaatatttttgtccttttttcagacgtctgaaccatcatggaagaaaatagacataatgcaacagtcaaatatatggtttcatgtttctaatggaaacatatcaggcgagggccatttgcaaagaagaggcaagctaacgcattggaaatgtacctcagtataatcataagcattggaatttccagctctggtgattcctaattgttgcacattactattcccggctctcgagaggcctaattgtagtgtaaccctattagagtacctatcagtaggtacttggtcaagataagaacggcaggacatataatcggcaccaggactaatagatgagggcagttctccattaggcaagcgagtagttgctgcatatctttcgtatgaagcagatggtgcaactttgctacttccactagggtactctcttttagagaagtactctacaggatacacggtgtaaggatcatgagcagggccggtcctgagattctgaaggcccagcgtgaaactaaaaacggaggcctttattataaaccttcaaataataattaccatataatataaatatctttaaatagcaatcaatattcgtatttaaaaaatcatacgcattatattaaaattttctttgaagatttgtaggcgcagaattattgatgatgtcctgataatatcagaattattgaagtggctgtattactcttgagcatcctcaacacacctacttgtttttgttatctattgcatactttctcaacagcataatatcaaggaacaggctaatacttaagaaaatattaatactagattcgtaaattacaaggctacagaagtaccaaattagttgaaacaaatctaaccaatgtgaaaccagcaaatcactg

SEQ ID NO: 59817 - DNA, 15376 bp, Oryza sativa
  unsure (1)..(15376): unsure at all n locations
acaccaccttagcaacctgcattattgtgaaaatgtcgccgtcgatcgacggccggccggccggcgacaagcagcgccatgtgagatgatggctgatgtaggagaacaccctcgtgacaataaaaccacagaagtctggctccatgcatgttaatttgctactgctgcagtagtggtttcatgaatgcgacttggatggatggatggatagatccataccctgttctgagcagagaccggacgtgccaagtcataacatgtttgaacaacgtatattctttgactccacaggtccactagtacagtgttgtaccgtatcatttcatctgcagggatattgctgtagaaccttttttctttaaccaaaatacaatgttaacatatttaattacatctgcaatcgtacataatttaggccctatttgagattgctttaagtgaagatgaagtgtacgcacgtaaaaaaaactttagcatgttattaattaagttttaattaatttaaacttaaaaatgaatttatatgatattttaaatcaatctatgtatataaatttttcgcatgaaatatagtgtttgacagtttaaaaaacgtgctaacaaagaccgatgtaaaatctgtatcttaattgaaacagtaccttaaacgccaatcaattcgcaaatgcgtcggtgagccaagcttgattcggcagaaccgcaaaaacagatgaaattcgagcaaaagctatactactagtacgaatcttggcaaaaatgcagtatgaatcgtccttctccagttcctccagtccgtgtcatcgtgctcctggagtccttgctagctactgtagtagtatagctgtcatggcaggtggggccctccacccagcacgccgcaaggttggaccgccagcctggcgccccatcccaccatccctccccgatccgatcgccgatctcagccgcccgcaccaaattcaaatcccccgcgccccgccacgtcaccccccccccacacgccacgtcggacagaatccggtacacgcgggcccgtcacgtgactgctcgccgccgccgccgccaacgacgcaagcaacgcgaccggtgggtggcgcgagtcgctggtgataataccacgggatgggggagaacgcgtcgcgagtgtgtacaagaaatcccagcacgaattgtcttttgtacgcatctaacaactaccagtactactactacctgtatgtatatatacacatcaatacgcataatgcacagtgcattagtgcacgatcgatgattgattgcattgtgggggaggtatgaataagtgtaccggtagtaggccgtatagcacgacgcagagcaacatacggcaacaccaggagtacgtacgatgccgtgggttattacgtactcccccgtcccaaaaagaaaacaacctgtgacgaatctagacaactcttatccagattcgttgtattaagaggggataaatttagattggtttttttatggagagagtagaaaacgaaaagaaattagtatcactacagagccaacggcctagatatatgctctctacattccaaattgatctgcatataattttttttatgttattcctaaattatctacatatttgtgttcatttattaagtctattcgttatttgtgcattggagtaaatggacattgatgcatgcatccatgcacacaagtatttataacccacatgcaatatcttgatttgctattggctaagaaatagtagggatggtgtatacattgagtttgttgctagagtaaatatagtatgagagagttactccgtattagtttttcttggtctcgatgtacctataaaatatatagatcaatttgaaatgtagggagtactgtctccgtccattttgggatgggggaagtatctagctcgccgtcgttctttcgttcgttcgtctcgatggccgtcgggccctcccccgcgtgccaatgatgccacgccatgtgatcgttcgccgcgctcgcgcgcacgcctttacacggtttacaccagcaaagccagcagccacgcacgctggcgcgagccgctcgtccacggcgtcgcgcgacgcagaccgggcgcgggctagcgaagacatcagacatggcacatgcatcccgtggatagctagctaagataggggggctgttgctgctggcatggatcgcaaaaggttgggcgcctttgcgagtttgcttcgctttggtctcacctttgatctgcctttggagcagcctactactagtacgctttatacccagttgtagtactcctccgatcgatctgattcgatgctcctgagagtgcttttctttgctggtttatgatgactgatgagaggggaggggttgatgtgtgtcgaggtgccatttcaccagcaggttaatctcggagcaaacgagcccatgagcgatgcaaatccttattaatcctacattacctctatgtactaccagtactcagtactgatgatcacacgctgcactgttttattttactcctgcgcagacgtcggcacatgttttataacagtttttccttaaccaaaaggctcgcaactggcgtagcttttcagaatttttttagaaaaacgatccataccatacgagcactggtacgccagcagctagctactcctagctctgacatgttctgcaggctttctgagccatacgcgagatgacgcaaggcaagggcatgtgtcgtcaggacaaggacgcccccctctccaataatctatcgctgcacccagctgcaatcattggccgcccggcgcagggtatcgatgcagacatgtacagtggagtatcatcatggccctgcacctgcaccactactactcctactgccagtctaccactgaccgactactgtacaactctcctcggaaagacaagcctcacaactcacaagtcacaagcttgtttttttttttgagacaaaggcggcatgccattcattgattaagcaacatcatcacaaagtatgtcccggatataatccggtattacagaacggtacacagtacaggtagacagctcggcattccgagctagagaatgagccgccaaattggacaaccggttaacatgcataaaagagcataaaacaaaggtggacgccaacttcttgatatcttcaatcacgcatcccacccctgagcgatcccttcctgaagtttggatgcgtctgattacagtgagacaatcagatgccatgacaatgtgttccaggccctcttcctttgctagacccagtgcccgcctaattgccagcgcttctgcaagctcaggtagcaccacatcgctgatcatctccgagcaagcaaccaggcatttccctgtattatcacgaatcaaagccccgacccccatggtcctggacgagctgaaaatcgcagcatcagaattgatcatccatacgctggccggcggtggctgccatctaggtatggcttgagtgtttccaccccgctggccatccaccgtcttcgtattgtgctttagaatcatgtcgacataagacaaaattttgatgacaacacgttgggggtgcactgtgccattgttgttctttgtattgttccttgcttcccagatgtgccaaaaggtgacagccaaaagggtgtttgcatggctggatccccgtttcaggaaatcaaagatccattgcctcatggttgagaacccatttcttcctagtttgacagcgcacttacccttgatttcctcccagatttgagcagcaaaggggcagaacaggaagacatgttccactgtgtcatctctgttgcaaaaaacacagccatcagtagaggggatatgccgtcgtcgaagttgaaacccagtcgctaagcattcatgagcagcacgccagagagtaattttcatctttcccggcgcattgattttccacaagcccttccaatccttttggctttcaagcagtctcgacgccattcctcgcccactgttgctctgatcagcaaagaaagcttctgatcgcgccagattgtaagccgaacgcacagagtataaacccagtttgtcatgtggccaagaagcgaagtcagcatcaccatgtctactaataggaatctgtagaatctccttagcaatgtccacagggaagagggatcttatcaaatctccatcccaacatctggcatcctcgttcatcaggcagctaacagtggcatctgttgggaagggagaaagcgttgtcaccaattgaggtcgaaacccaggtatccaattatctgaaaagattttgatggttttcccatcaccgactccccacctcactccttttgccagcagttctctcccaaacagcaagcttcgccaagtgaaagacggcgatttcggttgagcagcctcccagaaggacgagttagggaagtatcttcccttcaaaaccctcgagcacaaggaatcaggatcagtaagcagcctccagcactgtcttcctaacattgcttggttgaaagtagtgaactccctaaagcccattcccccaagaaatttaggagtagaaagccagctccaagatttccagtgcatttttttcttaccatcctcaaagccccaccaatgatcggcaatacaagtcttcatcttttcacagattgagacagggatgcggaaacaactcataacataatttggaattgcttgggccactgctttcagcattgtctccataccggcccttgacagcggccggtcagtccatccattaacccttttccaaattctttctggcagaaacttgaagaaatttgtggtagcaagcccaatttcagtaggcatcccaaggtaagagtcttgcaagacttcattatcgacttgtaagcagcttttcaccgatatcttgaccgcatcaggacatcgtttgccaaaaaagattgaagatttgtgcaggttaattttctgtcccgacgcactgcaatatgatcgcagcgtgtttttgagtgcttggacattcctgctgtcagccttagcaaagaaaatgctatcatccgcaaacaacaagtgggagatagggggtccatgcctgccatttttaattccttgtagctcacccgctacctccttcttgtgtagcaaacatgacagtccttctgtgcacaaaaggaacaggtaggggctgattgggtccccctgtcgaatgccccttgaagggaccaccggcttagtcagctctccattaattttgacggcgtatctcactgaggagacacaacgcatcacagtgttgatccaatcctgggaaaaaccaagtttcgataagcaacccgaaagataagcccactcaactctatcatatgccttcatcatatcaatcttgagtgcaaaaaaaggatttttgttgtgttgtttacggatggtatgcaaacattcatatgccactagggcactgtcagtgatgaggcgacccggcacgaaggcactttggaactcagacacaatatctgggagaaaaggcttcagccggttcgcaagaacttttgaagcaatcttgtacaggacattgcataaactgattgggcgaaattttgagaggtgactcgcattgtttaccttgggaatgaggacaacaaccgagtcacaaagaccttccgggatctcctctcctaacaagaaacctctcaccgcattacagatgtgttcctctaggataccccaatgtgtttggtagaacaaagctgggaatccatccggccccggagcctttgttgatcccatttggaacagtgctgtcttgatctcctcattagtgtactgtttgcccaattccccattgataaagtcgcctactttatttgggatagcatccaagacttcctccattgaatcacagggctccgaggaaaacagattctcatagaaaacttcagccatgcgcttgatcccttcttgggaaatacatctagagccatcatcacgaaccagctccttgattctattagtccgccttctcgccgatgccctggcatggaagaaagcagtgttgcggtccccttcacggagccaatccactcgggacctctgacgcgccataatctcctctttctcgaaaagttcacagagttgttgctcaattaacttctcttcctgaatcaccacgtcattaactggtgactgtcgcagggatttcagcttcctctccatcttgaggattttcctgcgcacagacccaaaggaagccttactccagtccttcaaagacactgcgacttgttgcaagacactccaaactcccctcagccccacgcatccagcagaagagatcctccaagaattttctaccacctccctgtaatcctccgcccgcaaccaagccgcctcaaacctgaatccctgctgaatgggaattctcctttgaccgtggttccttctcgacaagtcaatagagatggcgtagtggtctgaggatgttgttatcacattttccaccaggcagtcctcaaagtatctcgagaactcgccatttgcgacagcacgatcaagccggaccttgctattactgttagcatcctgcttattggaccatgtaaatttgggaccaacaaatcctaggtcaataagaccacaatcatccaagcaacttctgaagtgttgcatatgtggctctgatctctctcgcatccccaagtgctcatcgaggcataaaacctcgttgaagtcgccacaacacagccacggccccctccactgatcatgcaaccggcgaaggaggttccagaaaaaatgtcgaagctcacgtttgggttcaccgtacacaaaggaaattcgccaaggaggcaactcctccgtagagaccagcacatcaatgaaatgggagttgaaccccctaagagaaaccgtgtaggctgtagtccaaaacagggctaagcctccactaaggccctcgcagctcacagcaaaggagccggagaaaccaagtgaccacatcaaatttcttgcctgtttgtccctcatcttcgtttcagacaagaagacaagggagggtctcaaagacttcactaaccagcgaagttcacccactgtcgcagccgaccccaagccacgacagttccgaccccaagtcacaagcttgtttggttccatgggcagggacttatatttttttagagagggtccctctctcccaaacatctctttaggtcttagcaccgtatacaatacgactagggtcttgtttggtttcatgggctaatgtaagaatttaaacatgtgggctaattttgatctaaaatgaattagcccccctcaaaacattagcccctccaagagatgctaatggagctaattttgtgtgaggactataaaaaccagctctctctctccttctctcccctctctttctactctctctctctccaccttttagccttgaattaactcatggatccaaacatgccaccctagactaatatttagcctaccaatttatgactaaacattggctcttaaaattagccctgggctaatctttccaacaggcatagtacaatactcgtacgtatcatatgcactatcgtgcgtacgagtactcttggcgtgtcacggtcaacatagatctcactgttggcgttattgtgacaatgcacaacttttttgacgtaggggcactgtactactagtagaaatactagcgttgcccaagagattgttcacgtgccacacacatgcggcgcacccgtcgatcgaatcgaggggagtgcacggcttttgagttgtgaccacgcgtttggtcgggcctgggctgaaatcgtgaaagtttgtcgggccggatcgcgggatcgaggcggatggaggcgcgcgcggccttcgaaacgggacgaattctcgccgaccgcgtttgggccgcctgcccggatttgcagaccgttttgctcgtctgggctttcactatgttttgggccgcaaatttctggcctaatgttttcctcgtccagactccagcgacgaacgaacagtggagttgcgaacttgcgatcaagctacagcagcagcttgtctgattttattcgataaccaaaacaaaggggtttatgcatgagtagtacatacgaacgtagcggaattcacgatgccagcatcaccatggctaagaagcaaaaaaaaaaaaagtatgagcgcttcgactgttcgacacgattaagatagtgtccagcgacgtacgtgcatgcatccgtacgtaacggcatatacgtagcattattattctaggtcgtcctcctgggcacgaggcgcgcgcggagcggcttggccatgacggtggtgaactcccgcttctcggcgaactccacctcgtcgccggccacctccttccactcgaactccctcaccatgttggccacgaagtactccaggtggtgcatggcgaagctgagccccgcgcagatcctccgcccgacgccgaacggcatcatgcggatccccttgctgcccgtcacgtccaccccctcgccgtcgccgccggggaggaaccgctccgggatgaactccattggcttcgcccactcccgctcgtccctcccgatctcggccaccatgaagttcaccgtcgcgcccttggggatgaggtagccgccgacctccacgtcctccgccgccctgtgcggcagcacgaagtgccccggcgggtgcttccggaggccctccagcaccaccgccctcaggtacggcatgccgtggacgtcctcctcggtgacctccggctggtcgtcgccggtcttggacttgatctcgtcgtggagctttgactggatggatgggttcttgaccagctcggccatgatccactgcagcgcggtggacgtcgtgtccgtgccggcgttgaggaactcggagcagagcttgatgatctcgtcgtcggtgagcgcgcggttgccgtcctcggggagcttgatgtcgagcagcgtgtcgacgtacgagtgctccaacgtggtctctttgttcgtcgtcttcgtcgtctcgccgccgtgtttcttgtactcccggcgcgcgttgatcagtggcatgaagagctccctctgccggcggcggagggcgtagatcttctcgaggcggccgcggaagaggtgcttggtgatcgccgggaagtaggcgaagacggccatctggctcgtgatgtagatgagcaggtcgcgctgggcgtcctcgacggcgcgcaccgtggcctcgtcgaggcgctcgccgaagcacatattcacgaggaggcagaacatggcgtactggagcgtgtccacgacgtcgtggggtgcctggccggacgccgccagcttgtcgacgatgacgcggtgcacccagtagcgcgccggcgcgaacaggcgggcgcgcgacgggtgcagcgtctcggagacgaggttgcggcggaggaggcgccacacgggcccgtacccggcgcgcgtgatgatgttgtcgttctcgccgaggagcctgctcgccggcacgccggggcggtcggccagcgcggcgccgccctcgacgagcgccgcgtgcgcgaggcggcggtcggcgacgaagacggacactcgcgtccccatgcgcagcgacacgatggggccgtaccgagcgatcagcctctggaggagcagctccggctcgacgtcggtcagcgccttggtcagcagcacgacgctgccgagcaacggcaccgccggcgggccgggcgggaggcggcggccgcgcttgccgccattgccgcggaacagaatgaacgggacgacggcggcggcgaggattgcaccgaggatcaagtacaagttgtccatggtgaaccggagcttagctagctagtagctcaccacgtacgaacactacgagctactgagtgtgtgtttgtttgtcatggctagctctcactctcggcgccaatttatagagatctctggccgatcgatcggagacgaagagaacggacggacggttagaaattattttctacacttacctgccatactgctatgtatgacacctactttagacagttatataaaaaaatcataaaatttgataatatagactataataatataagacgctatacaaatatgcaagtctaaattcgatctacacatgaagaaacaataataataaattttatctgcattgtacgggtactatttattatttgatttttataatttttttatattatagataaaagagtaaagtgcattggcggtccttaaacttgtagggttgtgtcgtataggtcactaaactctcaaaatatatatacaggtcccagaacttgtcaaagtgtatcatctaggtcccaaattgacacatcacctctagtatcctacgtggcgatgatgtggcatgccacatggatgtgacgtgccatttttttttcttcttcgttttcttctcattcttcttttttttccctttcttctgctcgggtcacagagaaaggagtagaaagggaaaaaaagataagaaaaaaagaaaaaggaaaaatcttaaacgagacccatttgttagtcaaaatgatgacacgtcatttcgtgtggcatgccacatcaacgtcacgtaggatcctaaaggggttgtgacacactatgacaagttctgagacttggatatgcattttgagagtttatgaatctagatgacacaccactacaaatttaaggaccatccgtacactttactctatataaaatatagtcttgcacgtttgtgtatagacttatatcattataattgatgttactatactttttattttttatataattattgagtcacatggtgctatgctatgacactaggtgtggaaaagtagaaaatccttgtcccggttggttgatcttgcatacgtcggcgtaatgatgtcatgggtttttgaacgatggaacaatggtcaaggccgggaagcttccatctgggaacagtccattttgttctacgggtgcaactgtagtgtgccatcccaaaaaaagaccctaatttccgtgcccaacgtttgaccgtctgtcttatttgaaaaaaatatgaaaaaaattaaaaaagacaagtcacgtataaaatattaatcatgttttatcatctaacaacaatgaaaatacgaattataaaaaaaattcatataagatggacaatcaaaattggacacggaaacatagggtttgcctttttttttggggacggatggagtacaagtactacaacacgtgacatgcatgcgatgcagactcctgaacggtagtacagtccattttgttctacgtacgggagtagtaagtatttcatataaaacattattgcctggccaactgcttggctccacctggaggtgtgtgtcacacccaggtgttgtggtacattgtgattttttttgacgaatcaatcgagattgtcttgggcgcttggctggcttcggcagtatgtcgttgatttgcgttcgtggggttgaccggcgtttggtggggggagacggactgacggaatttagtttacctcggtcgtatcgatgtgtagctgtgctcctggagcctgatggaaatccaaagagatcctttgaagataggaatttcatgttctctccgtctacgaatataaaaatttctaaagtttagcatttctctgcagatataagtatttttaaagcatcgaaacattttaaaaattttgcgaaacacaatgaaaatacacactgaaacatgtcgttatcgcatatgaggcatcaagtgttaacggattgaaacgtatgtttttcatcagaatatagtcatgtaatgtcttgttgtaatatttaattgcaacaaatacaatggtgtgatcggatcgtagatcggataagtagtttagaagaaaaatcattttgaagatagttaaatgcatgcatgaatgaagtggagagagaggagatagagtttatgtgaattttgtgaaacatacagaagacacatcttgaaacatatcgttatcaggtatgagaatataatcacgtgatatcttgctataaagatttaattacaatcaatacaatggtaccgtatcgtagatcggataagtagtttggaaaaaaaatatttaaagttaggagaaataaaagagaaacaaactagcttgatacaatcttgcatgttggggagtgtcaggaagcctgatttttcttctctaaatcgtactgtactaccgaggctaaatattctcctcaaaattcccttgccaaaccaaatgatgcacatatttctacgatgtactctctccatttcaagatagggatacccaggctccgtttagttcttaaaatctttttttcaaatacatcatatcgaatcttttgatacatatatagagtattaaatatagataaaaacaaaaactaattgcacagttagggaggaaatcgtgagacgaatcttttgagcctaattggtccatgattagccataagtgctacagtaacccacatgtgctaatgacggcttaattaggctcaaaagattcgtctcgtggtttccaggcgagttatgaaattatttttttcattagtgtccgaaaacccattccgacatccggtcaaacgtataacgtgacacccaaaaattttctttccacgcactaaacatggcctcatttgggtaggtgaacgaaagaatttttcctagaaaaaactagtactattttcccacattgtagagaggatggacaagacacgtgcactggctgcacaaacgggtagaggtaacaagatatcaaaattttttcacaacactatctagacttcatatatttttaattttggaaaaagtacgaattacctctcgaactattgtggtagtacgatttacccccttaaactacaatactggacatttgacaccccaaacaattaaaactggataaattacccccctaactcgattcgtagtggttttcagtctacatggcacacacatggcgatacagtcagcaaaaatacaaataaaaataggtaggcccacctgtcagcgattttttttctctccttctcccccctctctctctctctctcccccccctctctctctctctcggccaacagaggctgcggctggcgggcggcgggcgggtgaggagccggcgccgacgggaggccaccgccggggatggctgcgggtggcgggcggtcgaggagccaacgccgactggcggtcggcggcggggatggctgtgggcggcgggcgggcgaggagcggagtgtgtgcgcgaacgggcgctgccgcagctcccccgtcggcgactctgtgactgcgaaggcgaacgcgttgctggcaactgcaacggcgaaggcgaaggcggcgacaagatcgaaccgcgagctccggaaggccagcgacggtggcacgagtgcgtgcagggcagcgatttcgcggtggccgaagaagggaggtgcacgagtgctcgtggggaaggcgtgnaggcgctccaggcgaccggcggccagcggcggaggcgcccgggcggctggtgacggaggcgaaggcggacctggcggccggtggcggaggagaaggtggacctggcgggcggcggcggaggcgcccaggcagccggttgcggaggcggagctcgctcgggcggccggttgcggaggcggaggcggagcgtgcgtccgatgacggaagaggagggggagcgagcggccgatgaggcaacgactgagacgttcgcacggctgcctcctcgtccattcttcctcaccgccacgacggctactgctcccagtagcagagagcgctccgcgcgaaggtggtggccctccccgccacggccttccccgcccagaccaccaccgtcactgcattgcaggaaagtagaggggaaagggagaaacggcggtggcggccttccgcgttgccgttcgccggcggaggcgcagctccatctctcccggcaacaccgtcgcagtgccctccggccgccgcccgccctcccagccacgcccgccgcgtctccagtgttagagagagaaaagagagagatgggttgaataggagtactatatgacaagtgggcccatagttttttattactttttttctgattatattgccacgttggcgccacgtgtctgccacataggagcaaaacccctccggattaagtcaaaggggtaatttgtccagtttctatagtttgaggtgacaaatgcacggttttatagttaagggggataattcataccgtcacaattgtttaggggtgtaatttgtattttttcctttattttttggtaacaagatatcaaaatttaacctgctatagattcagcactggaattttctacggtaaaaagttaagcacattatcacccctacgctgctacacacacggtgcaaagtttgcatggctgaatcgtcgttatgggaaaacaattctaaattctcgaggagatgtactatcattatttacatgtcacttaaatagttataaatttttttaaaaaagtttaacaagatagattaatatgggatagatcatctcacaaacatacaatataaaatttaagttctacatgttgtaaaaaaaataaatttgaatgtgaatatacattaagtaatggtagtttaattaatttttttgcaacttgtagaagttaagttttaacttgcatgtttgtagagtgatatatcacatgttagtaatttttattattattttttaattttgttcatgtttgaaacaaacatcaaaccatagccaagacaaatagaaataagtttaaaatccactctctcttgttatggacttgaggattgggctgtttctcacgactctgtagtttgtccaacccaaaccaaagccaagacaaatataaataagttcattttaggtccttcaatttgtcgttgagtctgaaattcatccctgaaccgaaatacatgtatagttcattcctcaacttacagtatcgtgttaatttaactttgatccttcgatagtatagttaccggttttgacttacatggtgagtggaacccacgtgaactctacatgtgagcggttaattcctctccctctccctctccctctcccacacgcgccggaaacggcatgtcaccagcgcccgtcgtgtgcccgtcgtcgggttgcagccgcgcctctaattaaacaaactccatcaacaaagatgcagctatttatatacgtgcacgcttcaaatcaaatggcagctaataactaactgtaatctcaagatggatggtacgtagaggctggtttgatccattatctaaaagaaacgaaaatgctagggacgagataccatcccccaacgggatactccttctccacagatgcgattctcatccatgcgacgcgggtgaaggcatcaacgcgcgcccgt

SEQ ID NO: 59818 - DNA, 9209 bp, Oryza sativa
tccaccgcgtgttccgccaggagctcgacgctctcctccgcgtccgccatcctcacatcgtccgcctcctcgccttctgcgagcagcaaggtgggttgggtgctcccgttctcgcgcgagcctcgccgcgggcgtttgctcgagcaggttgtgtgccaccgcgtcgtgctgaagaattctttggtttttttttgtccttgcagaggaaggcgtgctggtgctggagttcgcggcgaacgggaacctgcacgagcggctgcacggcggcgggaaggccgcggggacgatgccgtgggcgcggcgcgcgtcggtggcgctgcaggtggcgcgggcgctggagtacctgcacgaccggtgcgagcccgcggtggtgcacggcgacgtcaaggcgtcgaacgtgctcctcgacgaggccatgtccgccaagctctgcgacttcgggtcggcgcggatggggttctccgctgccgtccgcccccggtcctccgcgcacaccatgctcggctcgccggggtacgtcgacccgcactacatccgctccggcatggtgaccaagaagagcgacgtgtacagcttcggcgtcctcctcctcgagctcctcaccggcatggaggccttctgcgccgccgagggccgcctcctcaccgccgtcctcgcgccgcgcctcaggcccgcctcctgcgccgcctgcgacgcccgcatgctggtcgacgagaggctgggcagcgcctacgacgccggcgaggcctccgccgtggcgtcgctggcggcgtcgtgcgtcggcgagaacccgagcctccggccatcgatggccgacgtggtgcgcgcgctggagcagggcgcgcacggctccatctcggccgtcgcgaggagatccgacggccacgggaagctgtgattcacacgaggcgtgtcgaatcctaggcgcttagatctggggggcttttggtgagctgtaacttgcgatgacgacgatgacgtcatctggcgtcacctgcacacgtggacccctcctactgggtggagcttagaacaaagcggggtagtgggcgagcacctcaaaaaaaaaagaatcaaaaaaaggagaaaaaaagtagtagtggtatgatttggaaaagatttggagcatcaaaaggtggggtttgtgtgtgctaatggaggaatttcgatcacattgtggtgcaaaaaaaaaatggcagcgatttgggagggtgaggtgattatgaaaatggatcgtccattttacgattccaaagagattttggtttttattctttcgtttgttcgtgtaaagttcaccgagtgcctcctgtttctgttcatattgttgatgattgatttagatttcgaccagagtttgaattccaagagactatgtatatattctatgttcaacttgattctgtactgctactactattgacagcagggttcagtaataagagtttagatgtactaaacaataaatctggtaagtatagtccatgatcaagaataaatacagcattatgaacttaaaacacaactttattccgctgtaccgaagagtgctaataattgattggatcatggcgcccaggatttcaaagagcgtctctgaaagtctgaactgaacgcatatattcgcttcccttttctcactgacaactcagtcttcgctgccctctgaccagctatagtaggagcagtattctactccataatgctgaagtatctccaagtcaaacaaccgtattctacatttgtactcctctagtacgtactggttaccttcgggccaaaatcgaaagaacttgcaaacatttgataatctgctacctactctaatctgattatatttcccctgcattccatcagacttgcccaattcatttgacgatttccatgtattagcaaactaaaaaaatgtgcgactataaaaataaataaataaaatctaaaacgcaattttacagttgaatttggggacttctcattgaaatttatttcccagcagtgacttttaaactgagaacaatataaatatacaatatttacctataaataattttatgctaatttttccgtgtttctaccgcttattggttcaaacagcctgacttcatttcttaactactttaaaagcacagtcgttctactctttccctagaaaaacagctccagaaaagcccgtgaaaaaccagcataaacaaaaccgaatttcatttttatttccaaatccgatataaaagaaactaaattacaagtttttttatctcttgttcccgttgcaacacactggcacatactccctcaatttcataatataagtttttttttcttaggctgtgtttagttcacaccaaaattaaaagtttggttgaaattggaacgatgtgacggaaaagttgaaaatttgtgtgtgtaggaaagttttgatgtgatggaaaagttgaaagtttgaagaattattttggaactaaacacggctttagtcaaagtttttaggtttgatcaaatttataaagaaacacaataacatttccaacacaagacaaatatactatcaatcaaggttatatatagtgaaactaatttggcatcataaatatttctcttttttttctataagtttggttaaatgtaaagaagtttgattagaaagaaaattaaaacaacttatactatggacggagggagtaattagtttgaaataaaaacgagaaccagttacaccacggtgtatagaggtgtttgctgataataattccggtcaaattagcgaaatgattaggggatttgacctgaacccgatgtggacgcgcccgcgctctgccttgcccccaaaccaaccacgcgccgatgcctctgctctcctcacgccgagccgagcaaagcaaaacacacccacgtcgcggacgacgttgacgcgcccgcgcgccgctcccgtgacgccgccgctgccggtgccgcccggaggcggtcacgggggacgcgacgcgacggcgcccgcgcgcgcaccggcaccggtggcgcgtccccgtcggcgacggcacgcccaacaacctccctcggaaaaccggcctcccatctctttcgcccgcgacgcacacgcacccctcccccggttaattccgatttgaatcttacacgtactaattttattgttattattattttagtttttttttttatttacaaacttgttagaaacgccggtgtggtgtcatggtgtgatgaaatctgaattttctcggtgcgtttgcattggctgtacgtttagtttagtactcctatatgcatcctaaattttgatgtgttattggaagtcaactgtgaatgtcactctactaacaatatgttcaatcttcggttactttctatgtttcataattaaatatttttaaattaagaattaatagtaagtactaagtattactaagttacagtacttaaaattaattttttttaagtattttaaaatcaacaagtaccaagttaacttgtcatgcatccttaatttagttttttatttaatatttctaaaactagaaattaacacgtaccgatttgtacatgtcaagaacttgctgtttccttttctaatacatagataagccgttataatttgctcctgagcagatagatggccaatttttttttcattgttttttttttccacagaccactggcttgaagtgactaattaagcatagataaatagatagacccaccagaagttcagagaaccaactgaacacatggcaaagcctgaagattcagttattaatcgtatacggatacagagcagttgttgcaacagggagaaattaggtcggagtgacaaaatgggaagaaaaaaaacagagaggaagagcctagtgagcgtcttcctcctcgcagtgcttggtgtacttggccgggtccagcagggcgtccagctccgacgggctgctcggcttcaccttgatcatccacccgtcctcgtacgggcttgagttaatctgtcaccaccattggcagtagcattagggtttgaaaattgtctcgcaaaaaagaatttgtaattctagtttgtggagagtactaatgaattaaattaacaaagagacattccggttaattaaactaacacctttaaacagggacatgctaccagtcttgaaaaaaaaaagagacacatgtaattttacagcgttattgttaatatgccctatgttaaaaaaagtaacttctgagaatgaatatgcacaaatgtatgtttagatttattttcaaaagttgattttttttaacggaggttatactctctttgagacggtgggagtacataccaggccgggtgtctcagagagcttgtcgttaacctcgacgacctcaccggagatgggggagttgatgtcgctggtggccttcacactctccacgttgccgaatgcacctccctggctcaccttcgcccccgcctccggcagctccacgaacaccacctctcccagatggccctgcgagtatacatacatatctagtcatggctatgtatatccctcatgaatacagagaccggattaataaaaattcattatctaaaaaaatatatatctagtcaggtccaatcaaattattttttaccccccatcttactgttacttttgttttcaaataattgccatcattactgtgtagcactaaaaagtaactggctagcattctgcagtggaagttagttcctttatcttgtttcttattaaagtaacaaaagacatgttctatttagtttgaaaaaaaaagttacagcaaaggtacttcatcatatttcttaaaagtagtaaaggaaaatgttctgtgacatatcaggaaaagggttgttagttgttgcagcagagggcagaatatttgattttgtagcatgccacgtagtttagaatacaacagcaaattgacacttaggccctgtttagaaatgcattaagctttaactaatcttgttgcacatgaaaggcatggaatattttctcctttggttggctcacctgagcatggtctgtaattccaattgtggccacagagccatcattcttgacccactcatgagaggagctgtacttcaacccatcaagaactgcaataccagcatgaaatcatcaccatggcttaaatcaacagggaccatagttacaacaagtatactcaactcttttcaacaactggaatttctaaattttattcccttcccttttcaatcatttagtatgtctccggtgtataactacagcatggaccagtcaatgtaacaatatagaatgtaaaaaagaaagaaaagaaaaaaggaagccacagcaatttataactgggtgcaaggatagcatggcacaatgcaagactgtacaggaaccagaacattgtaacaaccacatgctttgttgcaaaaggcaacagaaaatttatttgatatgaattctactactcaagctagctataccagtggagaagtatctggagattgagtaggcaggtgcagccctggtggctccactgcatgagatcttgagggcattggcagctgagctagcccacagcctcagagccatttctgtgccaatttcttgcttgttaccaaagtatctgtgttcttcttttttccttctcctagttagctggatgagtagtggcagctcagtggtggtggtagtatagtggaaagctgcagtgagatgaggggatagggaattgtttggctcaggaggagagggggaaaatgagagggggttgtgcagggataggatttgtatggttggtgggtgctcatagcctcatcctttgtttagaccattaattcccctctgcttgatccagtgtacatccatgggttaggacagattagttactcagttaattaagtgtgagactggaaaaaaatatctgacggcagttttataagttgagtgattgaactagtgaaagttcagttaactgtcaacggctgtagatttgggatggcagactgttctgagtcaaaatgaagcttttactgtgcgtggttaccaggtgcagtaaaataatttcagatctaatcgcagtaaaaaaaatgtagtactatatgttaagacgagattggtcggtcaaaatctatctggccctttacatctcccaaatgttacctcagttgcaggtggtaaaaaaaaatcactcgtttcacgtgatgtcggcagatcatggaccatgtctcaaatgctgaaactctgaacaatcaacaaaaaaatccaaccagatgagctgtgcaactgataattgatcatcacactatttgcaactcatctttcatgtagatggaacttcaatcccgaagaaataatgacagcaaaatgctgcgatcctgaagaaaggatggcggcaaaatggcagcgataaaaaaaaatggttggttactgaagaattatttgtgcagcagttgagacagtagcaagataagagctagctaagctagctaggtagagttggatggaagagtagtagtatgagatagagcatggagcgcgacaactcaagtggatgctaaagtaaaaggcattctcttctcttgtttggaatcagaaaagaaaagaaaagacttgagctgcttggctggaatgtttggttggatcatgcgcgctctccttagcttagctcgccaagaaatcctctcttcatctctctcaataattcaaagccacgagctctctgctcatatccagtgcgacgattcccgttaatgcaaatgcattatatccagttcgaaatgttacaattcttgcgtttgcagcaagccagcaagtggtgtgaattgtttaatccctcgtgcatttcaacgaaattctctcacaaattcgcattgacttctttcttagcacaattagtaagcagtgacaaataaagaatttttgaacaggatgtctttccaaggaaggtgagattttttatgtggatagcaaggatcgcctttccttagcatgaagagaatgtgatcaactttacaccttgcttacgattatggccttaatttttgataccctaaacaggagcacatcacatgcatgtcgacctgagaccaccaattaactgattaagttggcattgcagatgcatccgtcagttacatgatcaggtgatcgatggatcaactgtaggtttcattgctaatagctgctgctacatctgattattggagccagaaaaagatgcctgtcctttgcaatgtaaagagtgagtgaaaaatctcttcttcatctgctcctgcagcaatgcataccttgagagaatcatatcttgctagcattcgaatgattcatataagtaattgttagtatatattagagatatgtacttgcaagtagcactgaacaataataaactttgcatgctgatatatatcaactgaactaagtacaggttgttcaagaaaaagctgcaagaaccaaacatcaagtagtccagattgtagtagctacttcttcacggggtgcaatgcaatgcaacaatgaatcagaaagtaggataccttttgcatgcacttgaggaggggcatttgttaatccaattattcaactactaactaaaaactatatgtaattatgtcacatccacctactaccagacgtcattcacagacattttttagatggaagcttaactatataagtttgtgtcatccaaagtacacaagcacatgctaaatgttagcatgaggttgacacaatgctaactgccattgcaacaacagagaaaaaacagactagttaacaacagctgctgcatgcatacctagtgaatgattcacattgatcaaccgatgatccatattaggagtatatatatatatatatttatcatcatggaatgaacagttcaggagagaataaagggttcctagctggtgagctaaaagggggaattgcatgaacaacccaactgcattgctgctgtgatcatcaaccaacctataattattcatcctaacatgcagaaacatcaattctgcgttgatccataatggagtttaattagaggaagcatggcacatgccaaacacttgtcattggggcaatgctgtggtcatatccagcagcatgagggacatcctcgacatacttggtcacttccatcgataggtcaacccatcaaacggtactttcaaatatatttatatcaagaatgttattatcagcattgccaattactctagcaatctcccacatgcaaatgcacagtgttactttggaacagtcattctcagagattgcgtatgtggcttggtttaatcatcgttgttaaccggtaatcgagtgatctatcagcaatgcaagcagccaagctggcagtaggtggtagtagtagtagtagatacatgttgattgatcgagaggccaataagaccttgcatttcgcagagcataattggtacctagttgcagggttaacgtgctactgctctgttagttgcaatgcactcaaagcgattaaccattctatatattaattaatttctccaagaacaacaagatcgaagagatagtgccatttgccattggtctaccatggaggaggataagattgtgcattagctcacatgctctggacctcaccttatccatggcgaatccatcattgccgccatgatcgagagagatgagaggccgggagatggtgttgttggacatgtgtgatgtgatgatctctgcacccctgtctgtcctgtcgagtgtcgatcaccactgaaagctggagtaggctgcatgcatggatggatggtccccatttcgttgcaacttttcaagaacattcgacagcaatcactatacttgtactgccagtggtagtacattaaccacgtcgatcgactgctaattaagcattgttcctgcctgccattgtctcgacgactgttcagagccgtcctactctaccagctgtttagctaagctgattgtagtttttggcttcgttcgagtccagcgttcaaaatttcggtcctatcggtccctttatatgatattatattggccgaaatttttattttaaaacgtttcatgaattttaacaatatttattcaaatttgactaaatttttgaaaatattgctatctcgacacccttaatacaaataccgaaaacgaatgattaagccctagtcgagtctgccactcgtcaattagctcgagctcgattgactcgaagctttaggtggtgtttgg

SEQ ID NO: 59819 - DNA, 31368 bp, Oryza sativa
  unsure (1)..(31368): unsure at all n locations
tcagagcaccggtactccttacagacctggttaacggaccaactgggagtcgcctaacaccaggaagcggcggatccccagtccagctgccactctgagtcccgcaaggagtccctcgtactccgccatattgttggtcgcccgaaagtcgaggcggaccaggtatctgaggaagtctccgctcggcgaggtcaacgtgacccccgcaccagcgccctgaagagacagggagccgtcgaactgcatcacccagtaggcggtgtgaggcagctgcgaggggcccgagctggcctcgggggcggagacgggctcgggcgctggggtccactccgccacaaagtcggcgagggcctggctcttgatcgcgtggcgtggttcaaagcgcaaatcgaattcagagagttcgattgcccatctcaccacccgtccagtaccctctcggttatgcaagatttggccgagggggtaagacgtaaccaccgtgacccgatgcgcctggaaataatggcgcaacttcctcgaagccatcagaatagcgtaaagtatcttctgggcctgagggtatcgggtcttggcgtcccggagggcctcgctaacgaagtagacgggccgctgcacctttcggcggggccgatcctcttcgctaggggccgcatctccagggcgctcttcgtccgagaggccacgcggggcgcactcggcttctgtgccgacgacctcggggtcagagggcgacaggcgcggccttcccgcagtggccccggggccatcctgggggtcgggggcgcctggcaccgtcggacaagcaggcggagggccagctccggccgttgggggccttgggccgccgttcggctcgggggcctctcctccctgctctctcccgggtcgagtcgacacagggtggggatgcgcggagtgagggttgtcctcgtcgcgctccacgaccaacgccgtgctgaccacctgcgggggtgccgccaggtagagtagcaaccgctcatctggcttccgggcgaccaagaccgggggagaactgaggtacaccttcaactgagtgaaggcccgctcagcctcctccgtccaggtaaacggcccggagcgtttgaggagcttaaataggggtagtgccttctctcccagcctcgatatgaaccgacttagggcggccatgcagccggtgacgcactgcacatccctaagcttgctgggggggcgcatccgctctatagctcgtatcttctcggggttggcctcgatgcctcgggcagagaccaagaacccgagaagcttgcccgcaggcacgccgaacacgcacttatcggggttcagctttatgcgggcagagcggagactttcgaaagttttcgctagatccgagagtaaggtctcttggttgcgcgtcttcacaaccaagtcatcaacataggcctcaacattgcgtcctatctggctacccaaagaaattcgagtagtacgttgaaaaataggacctgcattctttaacccgaaaggcattgtcgtataacaataagttcctatgggggtaatgaatgcattttttcctcatcctccctagccatgcgaatctgatgataaccagagtatgcatctagaaaacacaaaaggtcgcaccccgcggtggagtcgacaatctgatctatgtgtggcagggggtaagggtccttaggacatgccttgttaaggtcggtgtagtcgatgcacatccgaagcttgccgttcgccttgggaacgacgaccgggttcgccagccactccggatggatgacctcacggatgaatccggcctccagaagtcgcgccacctcctcgcggatgaaggcttgacgttccggggcctgccgccgcactttctgccggaccggccttgcgcccggccgcacggcgagacgatgctcaatcacctccctggggaccccgggcatgtccgccggtctccaggcgaagacgtcggcgtttgcccgcaggaaggagacgagcgcgtcttcctatttgtcgtccagaagaccaccgattcgtgtggtcttggacgggccgtcgcccagggcaaccttcttgaccgggacctcgtcgcacgtgaccatacgctgccttggggcggccgggacggaggtgctgagcctctcgtcgccacccgcgggcttggacgccgcggcgaggtggtccgcgcgctgctccataggtcgccatggacggtgatggggccaccggggcccggcatcttcatctggagataggcgtagtggaccgccgccatgaacttcaccaactgtcgcgaccgagaaaaatacattttcccgaacgctagtgtattaatccccgtcccaggaaaagccggggtacaccacacaaacatggtacaaaaggcacatctttattatatcgataatatttacattattacaaaggcacttaaggcctaacaatcaaaaataaacagcagcggactagcgggcctgcggctccatcttcacaggcgctcaactggggtataagccaggactccacctaagacttcttctccaaagcttctcttactgaaggggggaaaagattgagcaagaatgagtacaaccacagtactcagcaagccacaccggcagatgcatgattaatgcaagggggtacaaggggtaatattataggggttaagttttgcagaaaacagcatttaaaagtcacttagttgcccaaagccattttataaagacgatcctagagttacacagtgttattaatcaaggccgtgaaccctcacgaacctgccttaatccaaggcctacgatgattcagatcgaactggcaacccgaccctgggtctcagctcgtcccaagccaacccaggccaaccatttcacattttagttgttaagcaaattttaagaattaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacagacggaagacgtgacatagttcccaacccatcctagccataaacaagagtaccgacccaaccccacctacggccggaacccccgagacaggtaggcaggactgagcccccagcagcaggacaccggccctgtgccatgacatctcgactaccgggccgtagctcgtgtagccttcatttgtcctagagatgtccatcgacccccgacttcgtccatctccatccgtgtacttttgtttataaccagaccgagccacaaactaagccttacccactagacatgtggaagtacggtagtgctttgcaacagaggcccgagcttaatccttatagtacccgaggtacgactaacaaaacccaaccacgcacctcgagcccagcctaaaaccattttgggggttttgaatagagggggaggtgtgtgtccaattccaacataagccaaccattccatagtgtccaaatgatatgagaattcccaaagtctaaagttataaaaccacataatgttgcctaattaatcagcgaagcatctacctaaattcatactagtggaaccatgaatagagtacccactagttggggttttgtttatcctagggtgaacaaggtaataataacaatagcaataataatgtcttaacaaaggtaaataggcatggctaaataaaacagtgataacgcgggaatttaaataaagcggtaatgcattaatttaaattaaaataattttataaactgggattcaatatgctcaaggatgatgtgaattgccttgctcagagagaacggccttccgacccttcggcgacgaccacgaaccacgcttcgggaacctctggaacgacgaaagctacgcgaagcacacaagcaaagctacaagcctataaagaagcaataacaacacataaaaagaaagcacacagttctttaggttataacaaacattaagagacttgaacgggccgattcgaagctcgtatgaccaagatatgatcatccgaagtttaatgctgttatatggagatttgcggattattataattaagctttgcaattataaaacatgtgtaagcgctagcctggaaaagacaggaaggctgcgccgttgacatgcggaccccacatgtcaacctaaaggaccgcggtagaccgagtacacagagacggtccacgggtcgacgaaagcagatcccgtgtgtcaaccgaggcgagtggccgacaaacggactccactagacaccacacgggctgcacacgtggaaaccacgcggctaccgagcgggcacactaacacagtcaccacacgcataagcgaatgactaccgacaccggtacacgggtaccggggccgacaaccgcacaacgagcacgggcgacaccgaaaggacgaggacggggcagcgagggagagggatccttaccaccacgcgacgaggcgtgggaacgacaacgacgaacgggcgcggcggaggcggccgggaactacggagacgaacggcgaggggacgacttcggcggcgatccttggacgaaggcgagacgcggccggcgcaacgcttggcgacgcggaggcgaggacgaagacgacgacagggctgcagcggcacacttgacggacgcggacgacggacaagaacggcttgacggagggacgaacaccacaacgaccgggaacaacgagaggacgacgacgacgacgaccgggaccggcgaggaggcgacgagggcagccggcagcggctgcacggagacgaggacggcgcggaccacgccgctgcgatgccgacgatggaggcggcgccgcgagacgacgagccggcgagaatgaacggtgaagacgacgacggacaccggcggcattcgggtggaggggaggcgagggcgagggcgagggcgaccttgtcgctgcaatgccgggggtggtggtggtgcagcaagccgacgagccggggaggaggaaggggcggccgaaaggacgccggcgacgaagaggatggagaggccggcgcggcgacggcggtctccggacgaatcagagagcaggccggagtggaggtcgacgcggcaacgacgaaggaggagacggcgcggccagcccgcacctgagcagcgtggcaggggcggctggaggtggtacagtggcggcaacgccactggacgacggcgggaacgcgcctccggcggtcaccgcgcgaaacggagggcaggccggtggagaggaggcggctgcgacgctggaggaggcgacggcacagccggacggcgctcgggcgaggagggagaggcggctggaggccggccggcaccggagagagagaaggagaaggcggggagaggtggtgtggccacgggggagctcgggaaggggctaaaacgagagaacgcaaagagggggttccattttatagcggagggaagcaagccgggcatgggagagggcggaacggcgacgggaaacacggccggcggccatggaaggcggccgggaaagacgcgtccgttcccgacgattgggggcgccattcaagggggaaattggggggaattgaagaggaattaatggggattaaaaccccccacttaattttggaatccccggtttgaatgaggcggatttggaggagggagcgagctagggagacgaccggcgcgtgggccccacgcggtcgggcgcgcggtcagcgcacgcgcggcgcgcgtgtgcacggctggctcggctcggcctggcttgggcgcggcttgggccgggcggccggcccaggaggagaggagggggaggcggcctgggggaaagagggaggaggagggagtgggccgaggggaaggagaggaggcccaagagaaggagggagaggacgagagggagaggaatagagggaggaagagaggacttttgccgcgggctgagagagagagagagggaggttttgggccagacttggcccaaagggaggagggggattatttttagattttctttttattaaactttgataattgtttttgttgcttaataattatttccggtgctctgaaaattcaagtaaaatttgagggctccttttagaccaaggagaatttaacaaaaattctccgggccacattcgaatttttcttgtacgcattttagtgcttgccaatttcttttcgaattttaattaattctattattccttttagggaatgatttttatttcgggatgaatttatcaggacgtgacaccaacgcgggcctccccaggaccgcgttgtagggcagactgaggtccgccacatcgaagtccacccgctccgtgcggaagttggcggaaccaccgaaggtgaccgggaggtcgatatgacctagcggccaggtgtgccccggcgtcacaccgatgatcggctgggacggccggagcaccatccccggggccttgatggcgtcaaaggctgcgggggaaaggatgttgagggctgcacccccgtctatgaggacacgccccaacttcacattgcaaacggtgggggaaaccaccatcgcgatctgtcctccccgggcaacgcacggcgggtggtcggtctggtcgaaggtgagggcaacctccgaccaccgcgcccgccgtgtcgcctcatgggtaggggccgcggccagaagctctcgcttcatggccttgaggctccggcgagaagcgtgagcgcacgctcccccatcgatggtggcgatggtggcctcaggctcctggaaccccaggtcatcgtcgccatcgtcgatgtcctcggcggtggccttctgcttggcctcacctcgtcggttgccggcgggagccgccggggtcttgccctcacggcgctcctgcctcttctcctcctcccacttcctcgtccgctcagccaaacttttgaccgcgcggcagtccgcgaggtcgtggaggaaggtgttgtgcacggtacaccacttgccggtcgggcgctccctgctgggagcgccggcctccttctttttgtcgctcgcaggcctcccctttcggggggcccgcgaagcgccctcgacggcgaggacatgaccctcgtcgtcggaacgggccgaccccttcttcctcctcctgtcccgccgccctgaccgagcggcggacccgggggcggccggagttgccacaccagaaccggaggagttccaggcccaggcctcctccttgcgagccacacggtccgcaagctcaaaaagctgcgcggtggtctggggctccttggaggcgatcttctcgagcatgcggttgtgccgcacgccccccctgaacgcgtagatcaccgcgtgtgcggggatgcacggtatggtgttgcggacttgacagaaccgctgaatgtacgagcgaagagactcatcgtcccttcgctgtaccgcatgcaagtccgcttcttcgcctgggcacggatatatgccctggaagttcgtagtgaactgctggcacaaatcctcccaagagtggaccgacgcgggtggcaagttcattagccaaccccgcgcctgacccttcagggccatggggaagaaattcgccatgaccctgtcgtcacccccggcggcctcgatcccggtcgtgtagatctggagaaactcggtggggttgacgcttccgtcgtatttttcggtgatggtgggccggaaccttgggggccaacggacgttccgaaggctcgccacaaaggctcgacagccggcaccgccaaccggggacacggggggccggcccccgtgcccggaccgaagtggcgctccggacgaggaagtgccctccgttgcgtgggcggcgcgacgagcgtcgcgccggcgctcgatatcgaggcgggcatccggccccccacgcacatcttcttgggtcggaggcgttgacgagggaatggcggacgaacgacgggtaacggccgccgctcgccgcgccctccgcctcgacgacatggagccggcggcggcagcgctagaggcctcgatggcggaggaccgcccgccggcgcctaggcgctgctgcgccgtcatgaccaagtcggccaagtcatccagccaacgtcgggctggagtctctggatcggggacgacgggcgggtgacgcaggagcgcgcctgcagcctggagcgcgccctggggcgtgccgccatcgccgtagacgaggcggcgacgcgccccatctcgccgtcctcccccgtcgcccgcgggcggcgaagtcgcggatcctccgacctccccgagcgcctccccccgcccaagatttcggcgagagggggacggtggggtgcgagcccgacggcgcgggttctgctccccgtcgtcaccgctagcgttcggagagaggctgtgcgccactgcccgttcggccattgggctgagcgggagaagcttggcgcacacgaaagaggacgagggcttagaaagacacgcgcacccctacctggcgcgccagatgacggagcgtggggctcctcaccgggagaccgcgcaggcccccctttgccggttcggccgggggcgctaagtgaggttcctcgccctccatctgaggaacgtcagcgagagaagaagtgcacaagacacgggcgacgtagacaggttcgggccgctgagaagcgtaacaccctactcctgtgttctggtggatctgtgtgtgaaggaataccgagagccggagagcgagagagagttcagactctagaacccccccttcctcccttttttcttttcttccctttttttcccccttttttttcctcctttttttttctctccctcctaggcctgggcctcctttttatctggtcaggggtcaccacaagggcctctagctgcctaagaagggaaacatgctttttacaatgagggctagtctacagccggaagtgacctctgacaagcagagcccacgcctcctgccccgctcgcccgcttttccggtggacgcccatttcaaccttcatttaatggccagcgacttccttgccatacttgcgctgaagcctggaatggatctgaccgggactgacataccaactccaggagttagcacaccggctccggctagggacgagagccaggaagctctcatcattccgacgggacggggcaaggcgtgtgacaggccgcctgttgccacctaacccgcgatctgaccggtctgtgaccggtcacacaccgcgaccggtcacggaccggataagcgcgcgctgcgccgcattaaatacggcgtggcgcgctcgtccaacctgctataaatgcggttaggtgagccccgctgtgctcacctaacccacacacgtggcaccaaaaccacagggggtcggggcgccccagccctcggggccgaaacgggagcggcccgacccctcggggagacagagggaggggtggccacgtcaccctcgggcccgacccccccgagggggtcaggccacgtgggtgaccgcggctacccaagcctctagtcacgatacccccggccccatgtcaccgacaacgtatattcacttatgtttcattttttctttattatgtttttttcagatttacctcaatggctaacccagctatatcattaaaagatatatctgttggacagcaaaactgcaaggtttttggacgtctaataagattatgggatgctataaacatgagatcaaaatctgcagatcccctcatcagcattgacgtcatcctattggatgaacttgtatgtcattctcttatgtgttccaccaaatattaatactagattctacttctttgctatacttaatactagccatatcaattgttgcacaataatttttcagggctcaatagcacagatcactgtgccaaaaaggtttgcaaagcaattccgccccttgctaaataaaggatctgtctacctaattagtaatactgttgccattgatgcaaaaagaaagacctatatctaccagtgccagaactatattctctagtttaaacatgacacaagaattcaacccctggaatctagaggattaaccataccaaagttcctttttgacttctgcccatttgatgaagttctagggaaaagtatcagttccaaacctctcataggtaatgctatctttaattccacattgaatcatacttattacacttcacattcttttggcttattcctctagattttttttgaatgaatattcctccagatttgattggagtaatcagtcatattggtccatatgattttgcgagcccaacatcagacaaaaaactcaggagaattaaaattcaaaacctagagtacgtaccttttccaaacctgatcgttaaaatcaatgctctcattaattacttttgtgtaatctcagcaattgtttatatgcaacattttttgtagggaacagactcaagatgtcctactctggggacaatatggagaatcattcaacgaagatgcaacactccataaatcaaaggatggaattgtagtagccatctttgctggccttactgcaggaaaattttcaggttcattctttgacccaaacaaatgccctcccatacaaagaatgcaaaacatttaaacttcactttcacctgcagctataacaaaagcatcttcaagctctgctactgaaatatatattgacctggacacacctcaagttagagagtttcgcactaggtaattctctttaaccccttcaaaccatttgcacttgaatattcctgttcaatatgtattatatttcacgtcaaaagatgccaacctatctctttgcaatttgaagctacaaatgggaacgtccaactcttgagcaacaactccctaaggttatacgtttaaccccgatccaagcagcaggaaaaatgtacaccttaagtgagatatcagctatgcctatttcagcctttcaggtacaactcaatacaaaagaaaaaaaaactatattgttattaccatgccatggattcctttcgccaagatttaatactttttattacataagggtggagctacatacagtgctactgcgaaaataactgccatactgtcatcaattaaatggtattacataggatgccatcgttgtgataaagggtacatcaacaattctgattcaccaagatgtgcttgcgaagtttcattccgcaaaccaatgtacaatctcctactcttatacattcattcgaagaactaaaatagtttactgtaatgctaaccactctagatgtatctaactaatgtacaatgcttcaggtacaaactccctgtcacgattacagatgaatcagggagtttagatgcagtagcattttcttttgttgctgaagatttggtagagcttgatgcagcccaagcttcccaaaacatgaagatagacccggctgatcatccaacaacactcaataatgccattggtaaaacaaaaatttttgctatagggatgaatactgatacatcttctaagttccctatcagctatgtgcttaagaagagtttcacaattgagcctactatgtcggtccctatgctcacagatggagaggttagtaaatactactgttccatattacttcagatatcctattccatattacttcaaatatttcaaactaattaaattaaaatataaaactaatcaagcctttgaagaacaaagaggtactacagcttccaccacctgcaccacatacagataacccaaggtttgttattctatcaaatgttctattcattacatttgtacaacaccataattttttttagataaaggattttcattaaaacccagcctctacatcacattggatatatagtactaactgctgatgccaaataaatttcagcacaactattcataatacaggagcatcaagcaaaagtacacctcctgaaatatctttggctgataaaactccaactgaaaaaaccaggtaaatatacaaaaaaaattatgcttaataaaatcattcatatgattattatccattactgcagctcaactacaaaaagagccattgatttcactaaagactccattgaggaaaccagaaggtatattttataaccccatttatattgccttttctgattaacaaatatcaactcacaaccaaccttggaacatttttccttttacactaccaaaaaactagatctccctgttctcaaacattacaaagaagggcatgtactactttggaaaatacatagaataacataactcaactataatactgactacaatatttttggaactatttcatgcaacaaaaaactacagcatacagagggaaaggctgattttcctgaagactccattgagggaaccaaagggtatacattattttataacaccacacatttcattatttttatattgatttttgtgatagataaatccactcatgatttgcaatacttttgcctttaacactaactgcaatatcttatgaaccactccaaacaacatagagctacaaactgcattgcataccaatctgcctgaccaatctacataataaaattggtacttattcttcacattcctaacgatttactctattatcttacaagcacatccctgttgtactactaatatattctccaacacaaaatacaggtgaacacatgctgtctgacctacggtgatttcactatgcggaagacttattatattttccttccatatgaagacttcattatgtcatatgcataagacctgctatattttattagggtcccattctgttctccatcttgcagctatagcattatctctactacaattctataatatcagtactcctcgattacaaaaacatataagagatttcccatattttcagaatgtgtttgttcatattatcacccttttcaaaattacatagttcggtattactttttatactcatatccctaatcaacgcgcggggtatcttctagtttatatgtttttcctctccaaatcgaagtgttctcgtagcttaaaaaacacgctaacaaaaaccgtgataaaatctgtataagtcagtcttgtcctgtacagtcaatgtgcgcatcttcccccttttggaatcgcccggtccccatctccacttcgaaccaaacccggaggcgcgccgcgcgcctccccgccgccgccgtcgagcgggaggggatcggagcgcgcggccgccgccgtcgccgagtccgtccgacctccgtcccccgcgccaacgcagcagcagagcagcagtgtgggaaggaagaagggaagccgctgccgcgagcggcgagcgggagtgggggtttctccattgttaccatttcaggccagccgccgtcgacgccgaggcggggtgggccccacctgtcactggccatgttcgcctctatatatatacaccgcgccgccccccttccgccgccaacctgagccgagcggggagacgcgtcttcctcctcctcctcctccattgctgctccccctcccccttcctcctacaggttcgttcgtcttccccctctcctcctcgttgtccagcccgcgatttctctactcggattgctcgatcccctaccgcccatgggttttctcgcgatttttttttttaattttttggggatggaaatggttagctcatgcgaggaacaaccgattagggtttagtttaacgcctcgctatcctctcgaaatgcgaggaacaaccatttcatcttgccctctcttccttgcttgttccgctcgcgatttctctactcggattgctcgatcccctaccgcccatgggttttctcgcgatttttgttttttgttttttttataaattttttgggatggaaatggttagctcatgcgaggaacaaccgattagggtttagtttaacgaatccttatcctctcgaaatcgatttagattattaggattgtggccgttttgtttgcgctcctctccggttgtagtgttgtctccatttctatgggtttagtcgccatgtgagagatgattcaaagtttcaagctatgtggtatgggaatccaaacttctgttgggatcttcttccaaactttgtggtatggcgatttttgctttttttttttgggtgctggaaatggttagctcatgcgaggaacaaccgattagggtttagtttaaggcctcattatcctcttgaaatcgatttagatgattaggattgtagccgttttgtttgcgctcctctccagttgtagtggtgtctccatttctatgggtttagttgccatgtgagatgattcaaagtttcaaactatgtggtatgggaatccaaacttctgttgggatcttcttccaaactatgtggtgtggccatttttgccttttttttttgggtgctggaaatggttagctcatgcgaggaacaaccgattagggtttagtttaacgcctccttatcctctctaaatcgttttggatgattaggattgcgggcgtttagtttgcgccgctctccggttgtattgttgtctccatttctatgggtttagtcgccctgtgagaggtggtggattcagactatgtgtggtatgggaatccaaactttttgttgggatcttcttccattatatgttgagatagataggatttttaccattacgcaatatggggcacccttcttgggttgtgttttttttgtctccatttctatgggtttaatcgcacccttgagttgatccaaacctgtgggggatggaaatccaagtttatgctgctataagatactcatcgcgctatcgtctttgtttcttgcaggggcatgcgattttggaagcggagttgatacttgatcgagatggtaatggagggcatctgtgctccctctattatttagctctctctattattttgtgttttttgattttgttccgtctctcactatatgctggcttttattggtacacaaaggttaaagtagaagatgatgtggagggcagtggcatcaacgcttctgttggtgatctcagggatgctgctgtcaatccacagcctgccctgctgcgtgctactgttaaggaggaggtggtgattttgcttccaaaccttctggtgtattaatctttgcttggagtagtgttttgcatggcatgctaaactatttggatgaatcgattatgtatattacattattaaaacaagggtgaaaaggagtcaccgtattttgctttccatgcctagaagttatcatgttattcacagaaaaaaaaagtatctatgctgttgactgtggtgtggggtccatattattatagttgaggttaaaacaaagtctccatgtcaaatacgattaatgagtaatggcaattacgcgggaaatttgggcagttattattttagggccaggcgggttgagcgcttctcatttaccacttgtagagtgtggttttattatggcggcaatgtgctgtctgttatgtcgtgcttgaagtggaaagcaaagctataattttgtgcacaggcttccagttgctaatcgctatatgcacctgagttgtttgcattgtaccaagaagttatttcttgaaacaacaatagaatcatctgtgtctttgggcactagacccaaattcaatataattctagattgcaccccccctctcccctaccctgtgagctactttctaactgagcctctttttttggtattgtgctttgatttgaggcgaacacatctgccaaacaccaaatcaggatgacttacaaatacaaccaattttaatagacttgacgtttgttttggatgtaatctatattgacagtagtacatctaagatgcagttgattgatggtgttaagtatttgaaagtaactgggtgttgacctaaccataggtatattgctaacaaccagaggtccacaactttaaatagttaatactccttttgacatgttaacttttcctttggttccttttaatattttattttatttatttttgcgggggttccttttaataaagttgtgataccaacaaaatgttcttcacatatattgtaggaaggacagccaagctcttcctccagtcatgtaagatcacaatttattggcatggggttttcaccaatgttggttgacagggtgcttcagaaacacggtaatatcctatgacatgccttttcaaatgcatgtagtgatataaaacttttgcaccagttaaaacacagttaaatccaaacattttatacaccttagagtttacgaactgattacatttatctctctcatgcaggtgacagagattcagatactatactggaggctcttttgtcacagtctgtaagtgattccccagctgcatgtcaacatttgtcccgttaatctcaatattctggttttctttctttaggaaatggtttcctctcctaaccttgatgttacctatttatatttttctgtgttattgttttatgactcgaatagtttaccattaaagctcccattatgatcctccatttactttaatgttgctagtgtaattttatcttaagtacaccttcatgtagttggattgatgtttacttaaatgactgatattcaatttggtatcaggaattttagtttccatctaattttgttggcattgctacagtagtcaataattgtgttgtaatgagttgtggaattcacaatacttgaatttatttttcaattttcatatgttataggctcttcaaaaatctgggtctgaatcaggttcattgggagatctctttgattctgataatgaagaaaatagttctcattttgcgcctaggaaagaagttatccaagacattaaggtgatgttctggttcaaaatgttaatcatggtactattcattttgaactccttagaccaatctgcacaacatttctatttttaggttgaagctgattcatcctcagaaaagagatcatatctactgagtacaatgaacttctcgcagcgagaagttgatttggcactcaaccagctaggtaggtgatgctgcattgacttgtgcaattagcaatttatctttttaattgtctagatcttgtactgttgccttttctttttttttttggtgttgatatcagttcaaccaattgtactacacaatttttaagacactgttgaacaagaatgtgttcaggacacattttagatctgtttgatagtcattctattctttgtcatatccagcatactgtaaacttccagacctgcttggtttcaggtgaggaagcatcattggaacagcttgtagatttcattgttactggtcaagtgtcaggttgctctggaggaaacgaaaatggagatgcttcaaatgaggttttcgccagttcttttgttttctgtttcttacatctgactaacattgtctgagtacatgaagtaaatattgagctcgctgctccaagaatctttactcctttatgaaatgtaaaacacacttttctttttgacattaaatgtaaaacacacttaataacttttaataatatgtagctttgtgaaagactcattattcagtgaactggtgttactgctatgagactagtagaacattgtacattatccaactctggaaaagttgttccagagtctattccgtacttatccaatcacaaaaattggtgctccaaatctctctagtttattatgtgttgcgtccagttacagaatatccttgttcataccagattgtcacttggacattctgcttcatactatcccagctatgaaatcgcagccaaattttctacttatatttcgcatcaacgacaattgagaattctccttttaattctgtgtttttacttggtagtcgataatgtaacaacatgtaaaccacaggatcacattattttgtgcttgttggtactcacattgtcttgtcagccatgctttgtaggtctcctattgtgtaccctagaaacttcttactacagtctgcagtatagatgtttaattccttttgatactacaatgacatgaactatacttagcctggagcatgcatcatgtttttcttcagtcatgcttatagttatatgtgttctttctttgacattctatttttgatagatgggatctgtatcatggttatcaatcatgtttatgatatttttgtgttctttctttaacactaattttgataaatgatatttgtaattggctacaaatgagcaacaacagaactgtatatttaaaatcacatttgtttcaggtaaaggatgaatcactgtttggagtaatggataaaacactacatttactccagatgggttttacggaggaagaagtgtcatctgtcattgacaaagctggtaagtgaaaataaaaatgctttaaaaaattactcagatctgtgagcttcatgaccacagtccacagcatatggtgaagtactctctccggtcaaatttatttgacgctgggtgtactaagtttagtactcccagcatcaaataaatgtgactagagggagtttcacaaagtgaaatccttaaaatctaataccacagcatgcaccagtacattggcacctgatctctgataatactgtacctgtcaacaaacacttgtcattcttgaacctttaccattgcaaagcttttccaagcaatcttttggttttattcaattggactagatcgataaatctttgtcgcatcaaatagatgattggggagcatgcaaaaaggaaattaacaaggaaaaagttatgaaaaatatgctttggaaaagcatgagtaacaaaatatatgaacgattgaaacgatcagttctgacaaatatttgtaacaaagggtgtttttattcatgttaacagtatacttaattttacttattttaccgaatcctaaccttgctcatagattttgtcaaggacgaacctttcagactttctatgtatgattcatgcctgctttgtacataaggtggctccccatggatacatatatgccattttaagctaaaaggactgtaaattcaatctcatgtctcatccagagcatctgattgcacgcacatggcatccgcaggtgcctcactcatgtacatggataaaacgttgcatgcaagtggtaaaagggaattcatatttcacattgtagttatagttttagcccccaaatttttggtattaaaaatttcaatcttccttgtaatacatttgattattttctatatcaatattccattctctcattagttaccagtttctatgttgtatgtactagaatatactgttttaatgagttcctacctctagcaaacttaatgccatatttccttgttcctaccttttcaggtccagaagcaacagttttggagctggctgacaccatttttgcacgtagaattgccagtagcattgagcagaaagaggtaatttcgtcaacattttattcttacagctataagcttgtattgtgaatttacagtcatctgttgcttggtagcattgtccatgacaactgtgcagagcgcacagcagattagtaggaacctttttatataaacaatttgcttgaattacaaaatatccctctaaccaaacacttataccgttctcagcaaaccaatgtttttctttaaatgctgctcatatggctgtacagcatattgttatacacaagtcacaactgttatgatttctaatttgtctgcatttgcattcttgtgcacaggtgaaagttgagcctgactttctagatgagacagaaaccagctattcagcataccatccctcaaattctggtctaaggtactatgatgacgaccatgacaacataaggattaaaagggctaagcatatgtttatagatgacagtgcgggttccagtagtcgtgctggaaatcaacctaacttagatccatggcttaaggatcaccgtgccacaactagtgatgggtctgtcaaggaagaatttgatgcaatgacaccaggcatccgtagaaatgttcgcagtgatgtcgccaatcccccatatttcttatatggaaatgttgtagaaattcccaaagctacatggcgtcagctgtcagagttcttatataatgtggagccagagtttgtaaatagccagtttttctcggctctctcacgaaaggagggttacattcataaccttccaacagagggaaggcgtaacctggttcctaggtcaccaatgactatcgaagaagcattcccattcacaaggcagtgctggccatcgtgggacacaagaaaacaacttaacagtgttgctacagaagttgcaggaatagagcagctgtgtgagagactgggaaagatggtaagagactcaggaggttatctttcacaagaaaagaaaacgcacatcatgcaccagtgcaagctggctaacctcatctgggttggcccagataggttaagtcctttggatccacaacaagtggaacggatacttggctacccacggaaacacacaaacctgtttggcctgaatccacaagatagaatagaagccatgaggtacagtttccagactgacacactcggctatcttttgtcagtcctgaaggacctgtatccagatgggctaagggtgctatcaatctacagtggaattggaggtgcagcaattgccctccatcgcctagggataccactacagtgtgtagtatctgttgaccaatctgatacgaacaggaaaattttgagaaggtggtggagtaatactgaacaaaaggggcaactgaggcagataaataccatttggaagctgaagattaatgtacttgaggacctggtgaaagaatttggtggttttgacataattattggtggaaacttcagttcctgtaaaggtggtacaacagtaaactcatccatgggcatggattccaaccagttttttgagtatgttcgtgttgttcaaagagtgaagcatataatgggtcggctccaggtgagggcgcatgaatctgctcgacatcgacatcgctctccatcaaattgacttgtctggccttgtaggatggtgtagcattagcatagcatcatgtggatctgtaggtgatgtgtcatggagcagttgctctcagacaactttaaatgttatgttgatctccgcagaaacattgcgatggctgttagcattcgttacattgcattaattaccctttcatgttcctggtattcgtagcattatgctccattctttgattataattgctttctatgctgcttctagagttgttttatgtttgcctggttgtaatcgctcagtagattgggactaagcgatcagtttgctgggtaaccttacagcaaaattacattcgtttttcagcttctaaatgctcagttacaattgaaattgcttctccatccttgcacaatatcacagattgatcagtttgcatgctgtacttgtgttgtcctggcaaaagtttgttcatagtagcaaagattcatcatacctttgctgatactggtgcatagacagcaacacatcacctacttgctttctttcacaagcttctcagaagattactgatatgtaagaacatgtagcagcaagtacaattaaatgaatagcctctcgatccatgtccaaatatttggaccgaacgaacattgccatacaaagtgtgcaacatccttccttgcatgttgctacaatcttgacaaaccgatcgaattcagttttcaacctgattttacactcttcttcatcaactttacagaaccgtggatgattttttggttacaccggcagcagcaaagtgggaggggggaaaagaatacgcggcgtcagaatctcggacaaaaaaatgtagttccacttccatatgcaccagctttcccaaatggctgcacacagggttcatctctgctttctaatggaggacggtgaagaaattctgaactagttttcatgctgacctcagaaatcaccatcctacaaacgcgcattgctttcgagcatgttcggggataagcttcaccaggaattccattggcatacccttcagttctgttcaaatcggccagattagtagataattataagttgatcggtggttcagaaattttcgtctacgcatgtcatatgtcagccggtgttgcaagcttaccatggggcttgaagttgaagagaggaggaaggaaacggccgttcggtaagcgggtgtttggatcacggagttcatcgaagaagggatggatcaatgcttccgactgtaatggcaaataaagaaatgcacaatctgtaactactagtacttggcaaggcagtgcatgtttgtatgatgaagtaattagaaaaatgtaacacaatagtgatgccaagaactaaaactttctctaaaaaatggtgttggctcaaatagtgcaacgacaacactcacagcagtggaccggaggtatggtgaatactgcaaaagcctggagacgagatcgactgcttcagcaggcattcttttatggaagatctggtggtaaaaaaaaaggaaagctacattaggtttcaaccctaaaataaaaaataaacagtccaacataagattattttcttctaccttgtgccatgggtgagctttgatttgcggaaatttaaactcggtgtaatttgggttcatgcacttaatctcctctcgtgtaggggtacccagaacctgagagaatagtcagttaagtaggaggtaaacaacaaaaagggagtgatttcgatggaagcaagatataatttaccttgatgatttcaacaagctgatcaacgccactgtcgccagggaatagaggcttttaaaacaaaaaaaggataaagcttaggcagacagttgcaatgagctggatggtccaaaagcctcatgtaaataatgtgatctcttacctgccccaggaggagttcagcaagcacacaaccggcagaccaaacatcaatcgctgttgtgtattcagtagcaccaaatatgagctctggagctctgtagtaccttgaacagatgtaagaaatatttggttctccttttacctataataatagaacaaaagattaggtacaacagacaatggcaatgttcgtgtgagtatctggtaatgagtgatcataccaagactttcgcgctgccgaagtcacataatttcagctgatgagtatgtgggttcacctggaagtaataatcttttagcaaccatctgactaaacaaaacttagtacttgactaactccacaaagcttcaataagtggaaaacagattataactaaatgcaagtatgtaacataccagaagattttgtggcttgatatccctgtgacacacgccaatggtgttgtgaatgtacgccaaagctctgcatatctgtcaattataataggttttccatgttatactcaatgcataattgtgctaggatagattagaagatctaggtgtgtaacgttacctgatacatgtatagttttgcatatatcaatggcatgcgttggttcatcttgttgtaatgtttaattacacggtgagcagtctctggcacatactcaagcaccaaattgaggtaaagctcctccttctcagtctttgagaaaaaacaatgctttagtgacaccacatttgggtggtcaagaactcgcattgtttgcagctcacggttcttatatctcttgtcttgaagaaccttctttatagccacagtctcaccggtttccaggcacttggcctatacaagatcattcaagaaatgaagggttcatcaatcgccaccagaacacacaaattaacacactgaacaagtgcaacataaatcgatctgtctaaagacaaacctggaaaacagttccaaaggatccatgacctacgacacgctcggccatgtagctaatggtctgcaatgtagatagataattcagtgaacaaaaacttattgtgttcccaggcaacactaaatggacacaaaaggatcagcataatatcacttgtgcttgttttgtgaacagtacctgtttagcctgtccatttcttccatcaatgcttgtcacaataacatgaccaggttctgtcccattgccattgacaactatgtcgtcaatgtcctgcgacgtttgtgaatcaaatcagcaactgacaatacagcaaaaggcaactatgatccaccactcttaggcataataccttattatcatcccttatactcatattgctcatctcattcggaagtcggtcggcatcgccacttgtacttgtttcgttctgaaaccccaaggaagaacgcaccacacctaccgaggccatactgttgaaaggcacacaaggctaatgttcaagaggctttcctaaagatgagttgtagttgatccacctgcaaacaacagcataataatggtaagtcaaagtcacaacagtgtttttacttaagaaagatgtgatgagattaggtgccagaagcacattcacagacagtttgtgttggcaattggcaggtaggcttgaaggtacaggaaaagaaaaaaaaagaagaaatgaaactttgggaatccatgatggatgccgagttgttatcaaaactggagtgttacttttctagctcaatcgaaacacagaatctgaagatattagaatgctaatctgtaccaattaccccccgtttatcatgatattttcaaccacgatcattgggagattatcccgaggcggtagctttcaagaatcaaccagttcatccacccatgcttgctatccataacagccaagagaagggaacatttcaccgatccagagaccaccaaattttgcatcaaccaaactaaaccatctttcccccatcaactcatctccctccaatcacacgcatcatccaaatagaagaaagccaccagaatcaccgatcaaaatgcaaaatcagcaggacgaacaagtatccgatccgacctcggaaaccgccaccatcttccccacccccaagaaaatcacaagaacaaacgaacacacacaccaaaaaaaaaaaagaaaaagaaggaaaaaaaaagaaccagctttcccttccaccccttgaaaaagaaaaatccaaccaagccacgatccaagagcaaccacggccgcgtcaaccgtcgaatcgggcaagaacaagcagagagaagaaccacgggatccaagaaacagaggcgagagggatttaccacgggatcaggcggggcggagggtcgccggagagaggacggagcggggctggcggcacgatctggcgctcgctggattgccccacctccctcgctggctcgctgtccctcctcagctccggcgcggaatgcgggggaggattcggagggagagaggaaggaggagcttcgctgccttctataatacacaggaggaagaagagattgcgacacagaaaaaataaaaaaaagggaaatttttatgtttactcttagtattaattaattaattaattaattaattgattattaattgttttaagtaattaacttgtctgtttgaccgttgaaaggttccggtcccgtggcgccaatctcatctcgtgtggggcccatctctctgatttttgttttttttttcatttcatggtcatttttacctttgtactagtagtagtgtattactgaattttgtggtggggaaatttttggtcttgtaaataaatttgctgtggttggctgtaaaatttatttgtgtggtgacagtaagtagaattgtgaaatatgaatataccctggattatgtcatactgtgagttcttgatgttgaaatagtgttattgtatcactgtatgatatatgaaactctgggagcaacttctttttcgtagtttttaacttagcagtttatttcccatgtccttcgacaatggcctttctgaccgttgtgttatataactaaaactttattttctctaatataataacgtgtaattctttcacgtctgtatgatatatgaatatagttgttacatgttgacatagagttcaaccggtatgaaatagaatgtgccctgaatattgcagtgtcattaaaactggttcctaagataggctatcggcgagatgaaacctttgataggagctaaaccttaaaaaagaacttggcagatagttttcaagatatagatatttcattaagtaaataaaagcatatagtcaagacaaatcttccatgttatttttctcttatttaaggatgatctttcatgttggcgtagcagaataatgcagcatgttatcatactaatgtgaaaataggtatggttgttcgtaacgtaatgtccatcatattaaaaattggcaactctctcctttgcactttttcattgctattttatttcccaataaaagccaagtttgttatatcattgtgtgcaataatatgatcatttgtcatatttaagttgcaaatagatatcttaattaaaaaatatgcaaggttaaccacatgtcccaaatccatgaactagtgccaaaccacattgtatttgattggatgcactccaaaagccaaatctacacaaatactccatcacagaatcaaatcatacatatctggtggtttggtaacaaaaattgcgtgtatgcatgatccacaaagttgagcatacaaaaatctctaaaactgttgagaatattgatgaccttgaagaaagcaaaacaaaacaaaatgaaagcaaatgattgggggtctgggacagactgtcatggtcggagcatggaacccactctgcctcactgccagcaggcaacaaaaacaaatacacctcctgcctaattaatatatgataaccatccgcctaattagatcactattggagcttaattagctctaggtggccatctactactgctgctgctacctccatttcttaagtcgaaatttggtcgggatcacagagactatgaaattaaggggatggttcgttgatcaaagaaaacaaccatgatatgtactcccccagttagcatattgactatgattaatctaattttgattgttgcttttaatcagcacaaaagcatgcacctccaaatgtagggtattagtaaagtatttttacttataaatctaccgagcacgtttgtgctacactgttatgttttaaaaaatagtttaatcgaattttaaactgacaagtatcttcgatatacatctttgtgaaacatgagtttatgctcatataaatcaacaagagctgtgattataaatcaggagtaaagagggaaccagtaatcaaatttcacaggcacaatttacattttgaaaaaaaaaaaactgtaaagggagggttcagtgattggtatgcatgctactctagaatccaaggacatcttttgagctagctcatatcattatgagtctccccctttcctgcaattttattatatttgtaaaaatgtattttatgtatctatcttgtaaaggtagccgtcctacctatgatgatgctggccgatcatgactgtctgagaaagaagatgtagcactatagatcactatacacttagcactatagatcactatacactttcatggcatctttacaagaaaaagttgtctaacttgaccctaattttaattcaatttgcaaagatatcaatgaattatatagcattctgtttccagctgcattctcatccaatttacaaatctaccataatacttatgacaaccataatcaagatttgaagttagacatacctccctgttgcagacacattctagtttaagttttaattggtcagttgtcacatctaattttttttctagataagggagatgattacatccccatctttgcatttagaatgcacacaactataaagtttgagttatgacaagaacttcctatgtaacatatagtagtatcatattattttttttaaaaaaaattgccgtaataaacatgtccttaatcataacctatagcaaggagttggaacgcaaggattctattcataattaatgaactttgtataattaagagccttgcgtgccgtgttgtttgtcactcctcacgaatacggagtatatacacattgttttttgtacaacgaataatatacgtcaggccaatacacacatacataatacacctgtatatttgagtaaaccgtacgtcgtcttcgatctgtcagtaattgactaaaatatattgactcttttaatcatctcgataaacccatggaatcctgatatgcctgcagcctaaccaaccaacaattaatcaattaatcaaagtatactaattaacctgacatgatctaactgaagctgggcgtcaggctgcgttcgaatgagaagttgtgtgaactttttaatagcgcgcaaccgagataaacatgattaattaaacattaactattacatgcttgaaaatagatttatttattttttagaaaagttatatataaaaggtttatactccatccattccaaaatataaggcacaaccacccttaatccaaagaccaagaaataattattattatcttgtagtttggatcatcctaataaatactaatgcgtgcatccaataggattagataacatgagggtggaggatttaaaaaaagtaataatttaatagaaaagatgtcatagttaattgcatgcttgtatgtatgctttatattatggaactgtaggatcgaatcgaaagaactaagccaaccagaggggggggtgaatggttgatatacccaaaaaccgaaaacttttagcggaaataaaagttacccttaatttcgatgagatcggtctgaccggagtagattagccggtctgaccggtgttgaatctccggtctgacctccgagatctgctcctgacgcctgtcaccgacaccggtctgaccgtcgtgtaccccgccggtctgaccaccgtgatgccaccggtctgaccgtcggtgtgccaccggttagactgccgaaacccggtgaaacacaaatcgaagaactcttacagtagatgacaactttattgtttctctctgtgtttacaaagtacaccaacagcactccttataaaaatttcgactaaactcgaaaccctaactcaaaactcaactcaattgctctcaaaagcgataccgggaagcctcacgctccccctctatttatacatgaggtaggcagcctaaagccacgaaccaaactcatactaagagtcctaaacacattaggaaaccctctagtacaagaaagaaactttacataaccaatcgtaccaaatttggactccttccaaatttgactccgcatcccatatgcacacaataactccatcatatgccatatggaatctctatcaaccacgtgcatcaactctagcctaagtatcccgcatgatctctgaccaccacggacgtcgccttatccccaagccgactcccgatccatcaccgcaaatactctcccgagacatcgagtcacctacacatggaacaaacaaagaaaccatattccgagaccaagctatctccaacttgactcattagtagcaaacaacagtattacatagtatagtatccatctagaagtcataattatgaaataatcatggatatccaaacaaacaacccgaaaccgaaaccgacacagtgtcggccggtcagaccacctgaccacgcgcataccgccggtccgaccggctaccagagcccggtctgaccggtcacatgaaataatgaatcctgcgatcacctgtgaatccaatcatctccaaaaccactaatctccaatgctcaattgttcatcacagaataataatcaaaaacacatttgattttacaggaacatctaagaaaattggttgtgccttatattttggaatggagggagtataaaatacgtactcgtttatgcatccgtcgaaaatcatgttcactgaaaatgagaagtagctaagcattaagctggtaatgatgtagcctaagacaaattaatcggaagcaatggccgacatgacaggctgttggacggccggcaggacgctacggctcaacaggtccaaccgacccgatcaaaccaaaccatcttaatttaattactcagtctaatccacattttgtgtcattttttatttggtgtagcaccttaaatcggtcaaatttcagaccaaatcatgcagttctaaaaatattgaaggtttggctaaaaatacaaaagctatctttaccatggttgtctctatatgattggccatgtatagtactcacatgttcatgtgagcatacagtcaatattaatttgataaagtctgcatcatgtagtaattaattagcagtagctctagtacttactacggacgaactgatcagttccttggatttgaaattttcaactcgttggtgcaatgctcaatgaatttgtcagctgcgtgcaatcaatgtgtgtggggatgaaatgtatacacggtttgttgtttcaaactttcaaaacctattgaagtatttctgacatttgattggtgagaaatttatgcggtatgcatatatgggccagtgtgagtcggtctgattcaaactccaaaatttgaatggattagttgaatatagcagcttaattggacgactttttattcaagtacactttggtggttagactcttaatatcaaaaatacacgaaacttgacaaaaggaaacacgctcatagactttttgtgtgtttttctcaaagtagtcaattaaatggattaggttgctaaggagttactactagcaagaagctagtatgatgtaaaagtgagattggactttgtttcctcctgtttaatactatgaaatattattatgccattagataataagttgatcaatgttattatcctctaaaaagacaatgatataaaagaaatttgcagattatgcctgagcttatgctattgtactccagtggtgcacaatgtgagatagacttaaatcttgtttagggcaagttatgaatttatttttgggctgggctgtgggctgggcctggcctactgactggtacttatcattcttgatatgttgacatactcatgtgttttgcatagtattcatttattgctaatcccattgcattgcattatctttttcacaatggtagttagattgcgttgtcatatgatgtactcctgtaacgttttcagattttgcacctattgctttcaggtgtggcttgtaggatacaatgaggaatgcatacctacacccaacataaaacattaaaattggaaagaaaccaaaggaagactagaaaaaaaaacttttattagtgaaccaaaaacaataataggtttcnaaatgaataagctggaatccgaagacctcccaaccctttnnntnggggaggagatattcagngtntcagtacagccggg

SEQ ID NO: 59820 - DNA, 74571 bp, Oryza sativa
  unsure (1)..(74571): unsure at all n locations
agagtgagagagagagagaagctagataagagggaggagaaaggctaactgacctgtgggtccgatatttatttttatttttactcactgatatgtaggtcctatttatgtttgtttttattttaatggcacgtaagcactacattgatgtcacatggaatggaatgaagactaagtcaatctgacacgtaagcacacgtacgtaggacaaaaccgcctccaaaaccgtccagggaattgatttgcaacggtgttaggaatcaagggataggttataattatacccggtttagctgttgagggatgcgattcagctagagtcatgagttgagagttgagggaggcaaatagacttattccaaatttggaacacaaaggcagcccgtctatgttcaatttgaggcccagattttgtgctggcatactgaattactgatcagtgtctaggtcacttcagaatttcaatccacgtaagtacgagtactagttaagggtagatgacttatgaaaatcatttcctaagtagtactccgtactgtatagtactgtaccaatcaaagtgtgttatgaatggctgacgaaagtctgatctaaggacgagaatcgtgacgtattccgtattccctccgttttataaaaaaactaggtgattctccacgctttgctgtagaaatttctaagtaacttttaatattttttaataatcaagctaaaagtaaaaattatatccgttattaacaacaaataacattggtttgtccaactatgttcagagagatatttagtagactatatatgagattgtagatgaaatttgatatcatacactttgattatatggatgaatatatgttaaggattataaaacgatagatatatacatgttaaaaatattgtgaaaattaatgtgaaggaagatgattggatgttgatttgtacaattcaatgaattatagatgatgttgcatgcttgcataagttttgcatgtaattattgctagtggatgatgaggtggcatgtttgcatattgagatttatggttagtgggttataactttacagtaagataggatacgactaggtttgttttgtatgagctacatgtatcatatccaatactagatttggtttttgaagataacgggagtaatcccctcgcacataaaatagagcgacttattagcacataactgattgatttatagctaaaaacatgaaaaatggatcaatatgattttcgaaacaactttcttatagacttttgtttaaaaaaatacatggttagcagttcggaaagcatatggcctaggcatagagagagaagagtacatataggtagcataccagataaaaacactacatacatatagctatcatacgcgataaaaacactgcacctagaaataagaatcaacaagaaaaaaactttgtttaaaattagcaaccatcaagtttgtttcttgatacccctctgtaaccatcaaagatcattaaagtggctaatttctctaaatagcaggcactgagaacaaagaaattcctagaactatcgttttcctatagcattaatataatttattagtatgagtacttcattaaaagctcgtttggtatagctcctacttcaacatttttgtctcgtaaagttggagctgtacctaacacttccaagctagtgtgagaatatagagtaaagctaccacacagctcttaaaaaagttgtaccaaactaatgctagttaaaactactgaaagaataattagcaaccatcaagttgtaaatacgagcgccggtactaagtctagtacatgaatccggatggataggttctaccacgtggaatctaaccagttgagctagctatactcactgatgcatagtggtttagtaatttataagcatgtaataattaaacatgaaattaattaagtcatatgtgcatacttgcatatgtgcagcaacgtagttggagagatagtgagatacagaggatatctgcacatgcgacgctatgaaataaacgcaactgcgcaacacaatgcacatgcgacgctacgaaatatataatgacgcgttcaatacatatactcagtacgtgctactcatgcctagcgtcgtattgccatcataggacggaccaggacgacccaatttttcaaatcaaataatttatgggcttaaacaaacaaagtacttctgaaatagggctcaatcggaaaacaaaaatggatcgagttgagtcttcctggtccctatacaaatgtatatgttacacgatgccgtccaactaccaaacatcacaaattcacaaaacattggcatatgcttagtttagcagtgatgacctccaatatcacacttgttttcttgttgatgatgtgcttggcagcggcagtagcagcagcagcaacccctggagtcgccggaggtaatgggctcttgcatacaatcccttccaaaaactctctggctcactgcccttctacctgcggcgacattggcttctcctacccatttgggatcggccatggctgcttccggcaaggtttcgagctcatctgcgacaacaccactcatcctcccacactgctcctggcaaacactacaactaaggtcatcggccaatcaggccggacactagaggtgatagaaatcccagccattgccttcaacatcgcgatgaacaacagcagcatcatcgactacatccgatactgggtttctcctgccaatggtttcaccatcgtgaacgagagcaccctgttcgttatcggatgtgggatcgaggcgtgcctgttcgatcttgacacgaacgagaccatgggttcttgcatcaccatgtgttctgacaatttggggatcatggagatgcacgatggggattgtaccggcatcggttgctgccatatcatcgtgagaagggagctgcgtcggttttggttaaagcttgatcatccggatgatagaacaacaccgcgatcatatcgggtgttgtctcgtgctcaggttttcatcctgccaacaattaacagctatcaattcaatacgaatgatcttgtttcgtccagctggatgaacacgagctccattggtggtactcttctccgtggtgccatcatggaccaggagacttgtccaggtgcatcagcgagcaaagcaacctatgcttgcaccactaacaccaattgcttcaatgctacaaatggaggatattactgttcctgccgcaatgatgtcaccgatggcaatccttacgttaaccttggctgcagtgacgaccctggtacgacttatatatattctttttctatgtatgcatattacccgtgcgctgcaataggattctaattagataaaattatcattgacccgatattaccatattttttcacaaatattatttcttaatttctgtcctttgatcgcacactatcctttttcctttcaaaacgaaaagtacaaagttgcaggtggtggttgacatgtgggccctttgtcctaatagtgtaattttccctttcaaaataaaagtaagttggtgatgggggtggtggtagattcaccactactccattctaaaggtccattttaaaggagtatagatgttcctattttgtattgcctagtgccatgcatgtgcattgtaacaggattggaattatgaggtttagtttttccccttttttggttgatttttcgtgtagaaactggttttaggtgggtggctatttttagtgtgcggatttttaagtggggaactatgatggtggaaaaggaaaaaggacaacttcgttttcaaagtagtaaatttataagaatcaactaagtgagataccctagataacatatatactacatagtaatagaaacagtaaggcacacattggtaatctttctatatactaatttagaaacccatggaggagagagaaaagtaaggccagcaactttattctagatggttcagaaaggctagaagaatctcattattaataagaaatttttataattctcatattgatcaagaaaacctagatacataacacatccaatttgttttactaatgatgaacccatgcatccacatgatgagctactaccattgtagaaaacatttttaagcattagaaataatacatatttgtagttgcaaattcaaagtttacagatattatgcttgcaatatgggggcaagaaattctgaagggagaagtctattttaggatgttggttttccccaagtccagttttcactctatactaacaaatcattcatttttttacacatatatttcaaaatcggaccagatatcaacccaacgtgagctaatctcacaatgctccaaacagtgtcgtgcttatctcctcttggatctggcaagagttcacatgccatctttaaagatagagttttcatatgcacattttttaatgttctagattttcaaatgattaatgtcaattttaacttgtagaacttctagactttcaaattaatgttgaaatctacttttgttacctactggtattaatataggagcatgcaggagaatatagtaaagggtgaagatggattgctttattcatttcaataaccagcatactgcacataattgttactgatgtatggattctccagctccaatgtttgttttttccttccaaaaaagaagggagttggtggtgggggtggttgaacatgtgatcctctggtcctacagtttttttttccttttccacaaaagtagcaagtttgtggtgggggtggtggcaacactactttcttttaaaagaatatagattatacagttctaatattatagacatgccatactgcgtatactcgcacttactaacactggggatacaacatacctatttttatgggtaaaggtattactaagtatggataaatatataatttcatccacttaagaaaggaccatgtagtaattctttatcacgatgttttacctttggctaagttttgtcatatgtacttgaaccccgatatttgtctctaaaattaataggttccactttgtttttttgcttccctactatttacagatattgagtgtttaacaaaaggaaaatgtacggcatcagctaagagacacaatcttattgtaggtaggtcacttcaaacaaaatatattcaagtataattcataaaatgcatgacgtcttcatgaatacaagtgttattggatgaacaggtataacaattggaattgggtgtggccttggctcaatcattcttgcactcggtgcaatagtactaatcaacaagtggaagagaggtgtacaaaagagaattcgaagggcacacttcaagaaaaaccaaggcctactcttggaacaattgatattagatgaaaaagcacaagataaaacaaagatattctccttggaggaactagagaaggcaacgaactactttgatgctactcgtgtacttggctctggagggcatggcacagtttacaaagggattttgtccaatcaatgcatagtagccattaaaatgtccaaaatagcggagcaaacagagatagatcaatttatcaatgaagttgctatattatcgcaaatcattcatcgcaatgtggtaaagctttttgggtgttgtcttgaagcagaggtgcctttattggtgtatgagttcatatccaatgggacactatatgatattcttcacagtgatgtaagtgttaaatgcttgctatcatgggatgaccgtattaggattgcagtagaagccgcaggagctcttgcttacctacactcagctgcagcaattccaatttaccatagagatgtcaaatcttctaatatattgttggacgacaactttactacaaaggtttctgactttggagcttcaagaaccatgtcacttgatcaaactcatgttatgacaaatgtacaaggcacatttggttacttagatccagagtactactacactggccaactaacagcgaagagtgatgtctatagttttggagttatacttgtcgagcttctagtaagaaagaagtcgatttttataaatgaccaaggtacaaaacaaagcttggctcattactttgtggaagggcatcaacaaggagtagtcatggagatcttggattcgcaagttatggaagaggcaaaccgggaagaaattgatgaaattgtctcaattgcagaatcatgcttgaaaacaaaaggagaagagagacctaccatgaaagaagtagaaatgaggttgcagtttgttagaactataagacaaagaaagtgccaacaatttccagtaacagaaggagaaattgagcatttcccattcccaaatactagtaactcttcagatggcaggttcagccattctactggtttaacttgcgactctgtctctggaagttacagcttggagcaacaattttcttcatcaatcaatttgccacgataaccattggtgcaacaatacatttgacttgtaggtgcttgttaagatgaatttgagtcggttgccctatgttttagtttcattaaataatatatttgctctatgcatatgttcttccaacatattttcacgatgtggtttgtgtaccaatctataatcccatacatataatgcataattattaaggtttgatatgctggtgaagaaaaatattttgtagtgttctccatacttcatatccagaggtcagaaactagtctgatctgatctggctgtgttagctgtccctttttttttttttgagaagggtacatactcaggacgcacactcacacacaccacactcacaccacaacacacgcacacacacgcgtgcgcgttcctaacacacggtcacactctaggattgagattgaagacactaggccacagtgtacgggaaacgtgcagtcccactgaacgcgcacaagtgtgtacccttttacctaaccaggaccaaccgaagtgagtcccggggaaagggataaaatcccggtgcgaaaggttcaagcccaataagctcgaggccaatacttttttgggccatgagcccatgaccaacctgtactccgtatttggtttcaggcccgaacgttataaaaccatccagcccacagtatttcgaatttggcccgcatatgaattcatcttaaacatttgggccataatctcttcaaattggcccacaacggctgcctgtttcggtataaattcaggcccatctgaactcgctgaatttgtgcacaaaggaatcatcgaacaaattaaatttacatttttatttgataacagaaatggtcaacatcttcaatctttgttgttcggaacacagccaaaggaattataatttacatgcacaatatggagtgaagcaaactaggaaaatgactgaaactcagttctgcagaaaccagaaagtaaaatgttttgattgaatctgatcactgataaggctggtgaccaacttggtgcaaggcttcaagagttccaagactgttgggcctttcctacaattgggcctttccaggatcaatagaacggcccatcaaagcccaacggactcgagcccaataccttcctggcccagcatatttgatgaaaccatttggccagcaatctttcattctttcaaatctgttccatgatctaaatttttctgaacttttttggcacataatctctcaaatttgaagatattcaactatcttccacttttagatatggtgtttaccaatttgccgcatgaacttacatgtcatagatacaggatttggcccataactgcaacctgcttcagtttaaattcgggcaatagaacgagaaaagtactaaccactgtaactgatcactgaatattcaaagatagtgaattacaattcagttttacaacagcaagaatcgatgcaggtaactacggagtacaaattaagagatcaaaataacaaggaatatatatattatgtggtaatgatccagccgatcgctggagaaagagaacttgtagcttaattatcagctcgccgtgttggtggcgaagcagaccttcctgacctcgccggcgttcccggtgagcacctcgacgccgcccatcttcaccatcgccgccgcgaacctcgccatccacgccaccgggttggcggcgttgtcgtcgaccatcgccttggtgtcgtcgcggctcgtcagcgtctggtccgacgtgaacatcacctccccggcggccacgttcttgaagtactggttgctcagcacgttggggtcggtcacctggttgttgctcaccgccctcccgccgccgccgctcgccggcggcgggcacagcttcttgagcgccgcggcgaacgtggcgttcatggtggggtcgacggtggggtagagcctgccggtgacgaaggcgcagtgggtgaggccgaaggagtgggcgccggagaggatgacgaggtcgtcggcggtgaggcccttggcggcgaagctgtcgacgaggtcctggaggtggaacgccggggacgggatgaaccgggcgacgtcggaggcggaggaggcggtgccgtcgcggcggccggagggcatggcgaaggcgaagttgccgttgacgacggcggagtcgcgcgcggcgaaggcgaggatgtcggcgcaggagaccttgccggggcagacggcctcgacggcggccttgatcttgttcacggcgtcgtagccgcgcagcgggatcgccgtcttctccggctgcgtgtttctgctcgtcgggtccagcaggatggacgcgtcacaaccctattattgcaaatacaatttcattaattacttttttaattagatagttaacctttgtcttcaaacaggtagtttaagtggttttcttgattttaatcgagctatgattttataattcgagtcatttgatttgtaatatatgtgtaataattggatgtactttctttaaaataaagactggaatgaattttattgttaaaacatagttaaagaaatagtgttgggtaaacatgaatgtaaattgttattattaaattgaattaaaccaatccaaatatgacacgttgatgaatttactacgaaacttatatgttttataaatgatagttttgtacgtaccctgacgaagcagtcgtggaagaagaggcggatgaaggcggcgcccatggtggggtcgttgaagatcatcggctcgacgacgttcctcaccgtctcctcggctttcgggcacgacgacgagtagaagtcgtactgcagcgtcgtcgtccccgacgccggcggcacggagctcatcgtcaccgcagccgccatggcgaacgccatgagcatcactgcaggccttctgcatgctgctgtcgccatcgccatgtttcagagactaaactcctcaaattaattaagctatttagttaaccaacaagagagaatgtctgattgcgactgtggtgtgtgtgcatgtcctgctcatctctgcaggtatttatagcatgacatcgactggaatgcagtgttaaccatgcatgggtgatgatggatggatcaatgattaggaggtaattaattaagctagctgcaacaaattattggtatagctgaatgagctaattaattaattaagctagctaggtatatagctgggttgacattgccacacacaagagggtacttgataattatcttgttcctatgggattagacaagagttatctggccggatatatgcaatgttggttagttagcatttgactctatggaggtatgaacactagttacaactgcaacagaaaatgttatcaaatctggctagctttggacaccaatatcctagctaattaagttgatgactttgagaacttttagctagctaccggcagttaagattaacagaatgaatagaacatagtactaattaacccgacccccaattatctaaaaaagcatggttaattttattttgtaggcctggaaatgtccctagctcctcaatttaattttggactcatgatgatcagttcacaagttgaattagtagggaaacgaattgaatcctgtattaaaaaaaacacaagacaatttattttaagagtaaatttaacaaaactacagatactttgatcaaactattacaaaactacagatttaagaatgtatttcacaaaactacagatttagagtcaaatttatcacggaactacagatttaaggtattatatcacaaaactattgatttaacaactattttatcacaaactacatatttaaaaactattttatcacaaaactacagattttataactttaaataaataatagtgctatgatctaaactctaaaatatgtaattctttgataacttcatcactaaatctgtagttttgtgatatggtgcattaaatctgtagttccgtgaaaagtttgacgctaaatctgtagttttgtgatacacattcttaaacctgtagttttatgataatttgatccaaattatctatagttttgtgaaatttactcttattttaatttctatgtcccagcagaacatcaaataaagtcttggatggaaataaaatggatattctagtctatgcaaatgttactacatatatacatgcatgattaaatggacttaatgcaagtctttcattgaaggaaacacggcttgtcgacattctctgcactaattaaggtgtctgtttgtccacaagaatgtcaacttgataggtacttaattactggcagatatactccataccatttttatatgtcttttcggtgtaacagacagtgtatctactatttgctcatactgcacgttgtgctgcatttgtgcatacccaactgaaaaattctcgagttagcgaatattgtgtcgacctaactgataacagacaaattaaattaacaaggatgacatatatatgtccatgcatgaatgaaaaggttgttaattatatggacatatatgcatgcgtgatttatatatgaatgctgctagctgagcttgacgtttattgtccaagcaaaaaacaataattttactacacttgcgagccaaaagatgggtggacatccacccaagtaattagaatccatctccgttacaagcaggaaatacttttaatcaggtggccatccacccatttgttgcatgctcgtgagggtaagtacatttcggtaggtggctacattaagccattcgtctgtgaaaacgaaggcatttttataggctgacgccgagctcgccgtcgtcgtgctcgatgcatggcacgcacgcatcatcgccgggtcaggccactttcaccgcgcaaagacgcgggcggaagaagcgcgggagtatcatgctggccgaggcgttggggttgagctggcacacgcgcgccacaacaaacgccaaaggtgaggagcagcattatccaaaggagtaatatctactatgattgtagggttcggattcgaagccgaatcatgtgtgtcaagtttccaccaaatcgatagttaccttcacttgacggaagatcgggcatcccgttgccatcaccagccgacgccgccgaggaagcccgcgttggagtagacgccccggccgcaccttggcccaaacatcatacatggtggcggaaccgatgctcggggggcgagaaggtggttgacggacaggacgacggttgagcgcgtcgtaggtgcgggaagctgcgcagaacagtgtgaaaccgccgccgtggaagtagatgacgatggggtgcggcgacggcaagcgctccgccacggcgttgaagatggtgatgtccgtggtccgtccagccgacgccggtggtgtccggtcggaaataggccggtgctttccgccatctctatgccgcgtcacgtcgatggcgggcggcgacggcgcggatggtggctagctggtggcaactcgctggcttggaggtgacgaggaaagtagtggaggaaggagaggtggccaatgacatgtggggcctacactattttttttttttctgactaggataccacgtcagctaaaacaaacatacctccaccctactataggacctgatttagactgttttgccgagaagaggggtgaagatttctggtaatcaattaagctaaactcgcgtgaagatgagggatttcagtggacttattcctcatttgggccgtaaccaggcaaaacagctggtggtcggatgtaggccaaaagttacctgcacctaatcaaggcccatatacatattcgtctagacctataagcccatacggggagaggaacgaaattgaactattattcaatttgggcttaaaaagtaggtctaaattggacaattaatttaagcccaactttagagccaattttcatccattacagatttcaaaagctttgattttgtgaattttgccgcttgggcaaatctatgcctagattttcatgcatccgatctaaatctttaaagaactattaatattttaactttttttaatgtttgacttgaaagatgcgtgtctaaactccaaaataatactcactccgtttcatataacaagacgttttgtcttttttttttaaagttaatttttttgttttgactttgaccaagtttaaaaaaaaagcagcaacattttcaatccaaaacatatatagtatcaaaatatattcgacgttagatttaacaaaactaattttgtattgtaaatattgctacgtttttctataaacatagtcaaacttaaaaacgctcaacttagaaaaaaaacaaaagtgtcttataatatgaaactgaaggagtatatttatgtgaccagtggtagtatagcttttggcgagagcgcacccgcgtactagtataaaaagtaataacattataaatttagaatcgaattacttgcatcccaatttttttttgaatgtgtggcagtacaacgaattgaatttaaactacttccttcgttccaaaatgtagctacctagtacaggatgtgacattacctattactaagaatctgaacaggaggctgtccagattcctcctgtccagattcatagcactaagtaatgtcacatcatatactagatagctacattttaggacggaggaagtattagcagtggaaaagaaggacggaggaagtagtagcagtggaaaagaataaagtacaatagagttatagggatcatatcagagtcaaacatttagagagagagagagagctactgcatcgatcatcttatgtcatcgtcgtcaatggtggtagctgttgacggcgttgcacttggtcctgatctcccccttgctctccgccggcatcaccaccagaaactattttaatttttgaacaaaatttgaacaaatatttccaaattcacaaaaaaatgttttctttaaaaaaaattccggccgaaataatatgggcgtgcgtccggaattacgtcctaagcgtagaaagagacagagcgcgtgcttgtataaagagcaatattagaaatttacaattgaactactttgcatcataattattttgaaaagtttgcagtacaacgaattgaatttgaactagtactcacgcgggcgaaggaacaaaaaatacaatagagttacagagatcatatcatagtcaaacattaattcaaagctactgcatcatatatccatgagatcgttcgatcgatcgatcgatggaaggatcgtcgtcgacgtcaatggtggtagccgttgacggcgctgcacttggccctgatctcccccttgctccccgccggcatgggcagcttgctcagcttcaccagcgcgtcgccgaagtccacgttccacagcgtcgcgttcttggcgtactccacgacgtgcccgcgcgcctccttcccggtgagcagcgcccagtccgcgtggaacgtcaccgccatggcgaggttgttgtggtagtagctgttgtccaggtagtccctcgccttcctcaccctcgccgcaaaccccggcatgaccctcgccacggcggcgccgtcctcgtcgcgcacgttgttcaccacgacgtggttgttggccggcgtcggcgacacgccgccgcacttggagacgaggaggctgcggtagcccgggttgatctgggcgtccggggcggtgaggcggccggcgaaggaggtgcagtgggtgacgccgatggagtgcgcgccggagaggatgacgagctcctccacggtgaagttcttgcggcggaagttgcggacgaggtcggtgaggtttgcggcggcgtccgggaggaacgcgtcggcgtcgcggctgcgggagaccacgccgtcgaggcggccggcagggacggggaagtcgacgccgccgtggctgaggtacctggacgcgtcgcgcgccgcgtacgcgatgatgtcggcgcacgacaccgtgttggggcaccgcgcctccagcaccgccttgatcgcgtcgatcacgtccatcccccggatcccgatgttcgccggagattccttctccggctgcctgttcatctcgctcttctccagaagcacggaggcgtcacacccctgcacgcgacgaagcaagcaactccattaatcatcaaacccgccattgctgcctagcgagcgagcgagcgagctctacgtgcattgcattgcatgcacgcatggcgttcggtcaaatgactagttcgatcgatccttaccctgacgaagcagtcgtggaagaggaggcggacgaggccagcgcccttgccgcggttgtccttgatggagttgacgacgatggagttcacgatcttctccacgtccttgcacgtcttctcgtagtacccaaccttcagctcgcgatcggctccggccatcgccgccgccgccgccatgaacaccaccacaacaaagcacacaagcttcaccatctccgatgatgatgatgatgatgatgtgtgcaaccaatcaagaagaagatccgagtgtgagagatcaatcgatggagggatggatgaactccaacgttgatgggtgcatgtatatatactgataatttgggaattttttagcatgtagtggttaattataatttgtgaacaactgatcatgcatgcatatacatgcaatatggtgatcatgcaacatctgattagttgaggagaacatggagatgagcgcagagatgcagtgttctcaactggaatgtcgatggaaaaaataactaaacaaaatagcagcagcaggttgaccttacccagttggagagtttcttatgtctgacagcagcagagagggaatttaattgcattgtctcttcaaaatagcccaaattcattggccatgacagtggaatttgctcaattaattgcagatagaccaagagtttgttactgtcgaaacaagatttcggcaatactaaaaaggggtggctatcaagcttgaaaagtggatgggtttggagacaaacgatttatataggttcaggccttcttattcaagaagtaataccctactcctgtccggggtggaaaccgccgagtgtattattgaatgtatgatctcaaagagaattggtgtcccaggaaggactcggacccctccttatataggggaaggagtccgtattacaaggtataactcatatccttatcagaatacgagaatacaaataaaatacaatcgtaaccgactaaatctcaggatatttccttgacgtacaagttaagaaacaaacccgagatacaaataaagatattctatctatattcggtatcctatattcagtctaaatataaccgccgtgtagatatggggtatccataatctccacagtagcccccgactatatgattagttaacaaactaaacatgtagtcaagaataaaataattgcataatcatgcatcatatgacaaaagcatatgcggcgtccaacaagacattcagccgactgctttccagccatagtaaaaaaatccgagtgaataacactctaaaaggttcacaaatgaacacatttaacaaacatccgagtaaaaaactctaaagataatccatcaaatgttataaaaattatggtaattaataagtctaatagcctaggctatgactctcaccataattaaaataggcatataacacgccaagagaatgaccattgtaaaaacaagtcatcttaaatcaacccagacagcttttgcagcctaaaaaagcttacaaaaatagtataacacttttctgtcgggtacctttcaatttgcattgcaataattccaaagaattatataaccgcattaaaaaggattttatcagcattgggccacaccattgcgagcataaattgccaaagcaaaaatgcctaagtccctaaggagcacaacgggccacgctgttaataatattgggctgaagtactgttcaggcctaggcccattagcacccccgaaacccttaacaaaaaatcccgaagtctaagcggcgcttcgtcttccccgccggaactctcgccatttcccccattccttgctatagtacaaagctgcgccggcgaaactagggttcaccattccgctccaatccacctccaaaagttcaccaaaatcctccacgcaactcattgcttcaattccacatctctccccagccatccctcgaatcaaatcaactcattcggatcaaatcgatggcggaagaaaaagaaagctttgaaagccaatgggcgtcgtccgacgtgacggaggagaacttgaaggagatggtggcgcacggcgttctcccagcaaaggagatcatcggatggtggccagcatttggtgaagctttcccaacccccgatacacatgaggttgtgggtttttctcacttcttctatggcggatttgccctttcaacctcgaagtttttccgtgggatattgaacttctatggtatcaatttacatcatttgaatccaaactccatagtccatattgcaaattccgtccatgtctgtgaagcttttttgggcattaggcctcattttgctctgttccgccgaatattcttcctcaagccccaaccgaacaaaagcaaaccatgcgtagttggaggggctggatttcaactgagagggaccttgagccaaaagtatttttctatgcccttcaagacctcaaacaaaggatggcatgccaactggttttatgtccaaaatcccgagcccgctcttcccgagtactcctgtcttcccctagtataccaagatacttggaactcacttcccatgggagatgaagctgcccaagccttagaactgatggagcgcatgttgaagctcaaggagcaaggcttacagggagagcaaatcactcggcatttcattaagtgccgattagctccaatcaaagaaagatcccgcacagctttcgagtttgatggtaaacatgatccaaaccgtgaagacccagattctctggactttaagatcatgaaggagaggatgtacaagatattctcaaacgccatcgttgtcagttattcgcatctgctgccagtcgtgccatataatgcattcaacccacctccgctggtatgtatcagaactcttcaaaccgtgaccaaaacataattttgtcttcttgttgaattaactgaccatggaggcatttcattcaggaatttgctttgatgaagtctgaccccccgattgctcaacgccgatctcctcgtcatcagaccattcaggggagtggaggaccaaaaatcaggtcagactcccaatccaaaactcccaatccgactgggcaatcagattctcgcaagagaaagcttgtgccgagcgacgacgaaggcgacgacaataataaatttggggataagggatcacccaaaaaattaccaaagcacactgctccgaagaagaaattgtctagccgccccatgccaaagttcagaaaatcctccaggtataaaccattcggtaccatttcacttcgacatgcctctctcatgaagataatattgaaaactggaagaaaacttgcaggaaaccgtctgacatagatccatccgggaaggactctgatccagctaagacagagacaggttcatccaaagaagctgggccgactactgaggaccacccgactggcgctcagacctcaactgataatatcaacccaagcgactagcccccgactggaaaccagtcagcagaagcggaaattgcaacaagccaagagcccccgactggtaatcagtcggaagtatgtccagatcaagaaattcctgaagttgaagttcaggctacgacttcccaaggactggacgctggtaacgacccaacgcctgggtccccagataaagggcaaggatcacctcacgctcaaccggaaactgcttcaggtaacctatcttctcaagtaatgctaatctgaataactccgatttgcttgcctaatgtctggaaatacatcaggaccactggccggtgacagagaagaaatctctcgcataaaggcaactgctgattctcgtccccccatcttaatcaattggtgggacgacaacttgcaacctgcaggcatcgtcataaatcgacagaaagaagacgaagaggtgcgccagctgaagaaagcactcggagaagctacccgcattgtaaatgtaagtcttccaggtggctgcctttggcgaccttgtttccttctcagcaagactaaaccgtgaatcattgcgcagagaatccatctccgtaatgaggccaaaaccacaactttagaaaagctggttcctcatttagggacccttgaagcggttagggatcagctacacgaagccaaagagcttgctaaaaagacagagcatgatctaagggaccgtgacggagctggtggctcctcaccgggagaccgcgcaggcccccctttgccggttcggccgggggcttagggtgagatctcaagctctctctgtgtgtgggaagattgcgtgccaggaagaaacgcgagacacggacgatgtatacaggttcgggccgctgggaagcgtaataccctactcctgtgtttttggtggatctgtgtaagagcaagttacaaaaacatcaactagccctctcctctcccgggaaaatccagcccccgctctttgtgggcatggtcctccttttatatcttaaggggataccacatgtacccttccctttccaaactggacttttcttctctttatggacggagattggtatggttgccgtccgaatgacacttcgatgggacagcccacacctacctccactcccggcggagacaggcgcaacgcgggatcgtggttgtctgatgctgacgcgaccagtgtcagaccggtcacagatcggtcattcttgtcctctatgcgtcagttcagcgatctgcatgatcacccttctttttgtagcatcctgcctgtaatggttgggatgaagcctggtattcatctaaccagggctaacgtgccatctctaagaggtaacacgctagctccggctggagacgtgtgcctagaggctctcgtcttgacgggacggggcgaggcgtgcgtcagaccgccagtcgccacctaaccgttgatctgaccggtctgtgactggtcacagaccggataaaagagcgcgctgcattgcgctgcatgcagcgtgacacgcttgaccagaccgcaataaatgcggttaggtgagccctatcgtgttcacccaacctatgtacatagtgcaaaccccacagggggtcggggcacctcggccctcggggccggggcaggagcaacccgaccccccctcggggaaatcaggaggagggcggacacctcaccctcgggcccgacgtccccgaaggtgccaggccacgtgggcgattccatctgcctcaagcctccgggcgcaatacccccggtcccatatcaccgacagaccggattacccaactccaggattcaaactttgaactgagtggctcatcaaaaggtaacctcaagatctgccccattaatttgtgctgttataattgtaccctcaactatctggaatcaaaacagtacaagctgccaagatagctcaactggagaaacgaatttaggccttagaaagtaacaaggcagaattggctgcacaaagggactcggctttgaaggaggttgaaggtattgtcagccaacaacctgagtttctctctttgatgcagcagatcattgacatgaatttgttattgtagaccgcaagattaagtcccaagcccagttcgacgtcctggttggcaagatcaaaagacttgaaggagccagggatgaggttgccaatgccgctaccccgcttgtccaggcaatgttctataataacaatggtccgagtagattcgatgcttccgaagtgtttgacaagctgagaatcgctccggacacctatttcaagaacattaaagaagccggaagcatgggagtaggtttagcactagcaatgaccaaatccctgtacccgaagatcgatattgatgccgttgatggttttgcggacgggacaagcgaagaggctgcccttgatcttatcaacgacgctcaaaaagcagccgacaagattgcaggtgctgtcgtagatcggtttcaggataccgaccttcggccgactggtaacaataactctgatgatgagaagactgatactgattgaatgtaaatgtattggatgacgaatgatggaggcacaatttgtacaataccggtgtatttatgctgtgcttggtgtttcttgcttagctgttgatttcttaaaaacctttatcaagctttgttgagcctaaaacccgcaaaagctattaaaaacttttagtcctcgtaaactaagtagaaaaatcaaacaaggcaatgatagaccaagtaagcaaattgaattgataaaaaatcacactccattattattatggtagcccccgactgacaacctcaagaagaaggcttgatgttgacagtcaagatagggaaatacatagataaacttaagcgtagaaacgacgaagatgttcgatattccaagaattgtcaacaagtgtaccatcttcgtgcttgagtcggtaggaacctggccgggtgacttcagagattataaatggcccttcccatagaggagataacttgtgccgatctcgtgtagtttgaattttcctcaaaaccaggtcgccgactagaaaagctcgtgatcgaacgttgcgattatgatagcgtcgcaacccttgtaaatatcgggccgactgaattaaagctgcttcacggacttcttccaatcggtgcagatcatccactcggtcctcttcgtagcgttcttcgcgaaaattgtgaaagcgcaaagattcgaatttaacttcactaggcaacattgcttctgccctgtagacaaggaaaaaaggtgactggcctgtggcccgactgggtgtagtacgcaaagaacaaagtactgatggcagctgttccacccattttccagcatagggttttagccggtcaaaaactcatgcttttatcccttgaagtatcatgccgttggctcgttcgacctgtccgttgctcatggggtgcgctactgaggcatagaaaattttaattccgaagtcgtcgcaaaagtccttaaaaactccgctagtgaattgtgtgccattatcggtgataatccgattaggcactccaaacctatgcacaatgttgatgaagaaatctcgagctttatctgctgtgatggtgacaaccggtttagcttcaatccacttggagaatttgtcaatggccacaaagagatgcgtgtaaccgccgactgcctttttgaacgggccaaccatgtcgagcccccaaaccgcaaacggccaagacagtgggattgtttgcaactcttgagctggtagatggatttgtctggtgaaaaattggcaaccttcgcacgtgcgcacaatcttgtcggcgtcggacactgcagtaggccagaaaaaaccctgccggtaagccttgccgacaatggtgcgtgcggcggcatggtttccgcatattccagaatgtatgtctttcaacaattgtctcccttcctctagagatacgcagcgttgcagaattcctgaagggcttttcttgtataactcggcttcatgaataacataaagccggcttcgccttgaaatccgctcggcttcatctttatcttgagggagttcttgagaagttaaaaatcgtatgaggggctctctccagtcggcttcaatcatggctatgtcttgagtgtccgcaacttgaattgtttctttctgaggtacggtcggctcataaaggtgttcgacgaatacatcggagggggccacctcgcgcttggatccaaagttggcaagtctatcggcggcttcgttgttgtgtcggagaacgtgactaagctcgagtccatcgaacttgtcttccaatttgcgtacctcttgtcgatatgccgtcatgttgtcgtcaaggcaggaccactctttcataacttggttaacgactagctgtgaatcccctcgaactattagacgcttgatccctagggaaatcgcgatccgtggtccatggaggagcgcctcatactctgcgacgttgtgggatgcggaaaaatgtatccaaagcacataacttaatctttctccagttggggaaattagaaccactcccgctccagtgcccgaaagcctttttgatccgtcaaaatgcatggtccagtgctccatcttttctcctggaatatcctcttggcactcggtccattcggcgacgaagtctgctaatgcttgggacttgattgaggttcggggcttgaaggatatgtccaaagacattagctccaaagcctatttagcaatccgtccgtttgcttcgcggttgtgcagtatatcaccgagcggaaacgatgtaaccaccgttaccgagtgaccttggaagtagtgggataatttcctagtagtaatcagaatactgtataacagcttctgaacctgaggatatcttgttttggagtcggctaggacctcgctgacaaagtagatcggtcgttggactttctggatgtggccttcttcctcacgctcaacgaccaagactgtgctcacaacctgggaggtggctgatacatatagtagcaacggctcctgcaggtgtggtgaggctaagactggtggctcggtgaggagtttcttgaagtcttcgaaggtcttctgtgcttcgggtccccactggaaattgtctgttttctttaatagcttgaagaagggcatcccccgctcgccaagtcgtgaaacgaatcggctgagcgccgccatgcatccagtcagcttctggacgtctttctgggagcttggcggtttcatgttgaggatagcggtgactttctccgggttggcttgtatgcctctatgagacaccataaaaccaagcagcttccctgacggtactccgaaggtgcacttttcagggtttagtttcatcctgaaagcgcggatgcttgcaaaggtttcttctaggtccgagattaaatcatccttctgcttagtcttgacgactacatcatccacgtaagcttcgacattgcggccaatttgcgtcgagaagcatctctgaatcatgcgttgataagttgctcctgcattttttagtccgaatggcatggtgatgtagcaattggccccaaagggcgtgataaatgaagtcttcaagcagtcggattccttcagtcggatctgatgataccccgagtagcaatccaaaaaactgagtagctcgcagccagcggtcgaatcgactacctggtcaatgcgaggcaacccaaaaggatctttagggcaagacttgttgaggtcggtataatcgacacacatacgccattgcccagttttcttccgaactaggaccgggttagccagccagtcgggatgaaggacttctttaatgaagcctgctgctaacagcttggttaattcctccttgatcgcatacttcctgtcttgtgcgaagcggcggagtcgttgtttaataggtttagcgtcttctttgacgtgcaaggagtgctcaatcacctctctaggaattccaggcatatcagatggtttccacgcaaagatatctttattattttgaagaaaggtgacgagcgcgctttcctatttacaatctaactcggtgcctattacagcagtcttagtgggatcagaaggatctaggggaatctttttagtcttggcttcgctttctccgctcttcgagaccttggtcgcgggcacttctccttcacttgccgtggtcgcagccagtcggatatcttctcgggcagacgccatctcgcgagtttgggccatctcgcaactttccttgtcgcatgtgacggcttgcttgatgtcgctccgtagggataggactcctcggggaccgggcatcttcatcattatgtaagtgtagtgtgggacggccatgaacttggctaacgccgggcgtccgagtatggcgtggtacgctgtctcgaaatcggtgacttcgaagcagatattctctgtgcggaagttttcccgagtgccaaaggtgaccggaagggtgatctggccgagtggagttgcagataaccctgggatggctccgtgaaaaggcgcattgcttggtcttaactcggagcgaggaatctgcatatcatccagggttttggcgaagaggatatttagtgcactgccaccgtcgatgagggttctgcgaagcttgacattacggaccactgggtctagtaccagggggtaccgccccgggtggaccactcggtcgggatgatccgagcggtcaaacttaattgctgtctctgaccatcgaagatattggggtgtgtcgggctgaacagcgttaatctcccgttcagtcaacttttgctttcttttagattcataagccaaggggccgccgaagatgtggttaagctccttgcggtggtcttggaaacctgccggggggtcgccatcgtccttcttcttcgacgtgctttgttcttcgtcggagttcttccgtgtagtcttggtgtattgttccgcgaaatgcttgtagacgaaacaatctttggccgcgtggttggagttagggtgatgcgggcattgggagttcatgatcttgtcgaacgtgttgacgagcgagcgctgtcgagaagagtgagtagtggttgcaacaagttcctcaggcttacgcttgcggtccttatggttgttacttccaccccctcccgtagccggcgtatccttttttggcttccaactggagcccgactgttttgatgcgatgacggcgtcttcagctttggcgtactcgttggctttttcaaacataagtttgactgttttgggaggcttacgcccgaacttgccgaccaattcttcgtggtgaattcctttggtgaatgcggcgatgataacatcgtcagtgatgtcagagatcttgttgcgttgttcagaaaatcgccggatgtaatctcgaagagattctccggacttctgaataacattgtaaagatcgaattgtgtgccggggcgctcgaaagtgccttggaagttggcgatgaagtggtcgcgtaattcggcccaagatccgattgtaccacggggcaatccatggagccaggaccgggcggaatctgctaaagccactgataaatagttcgccatagctttgctatctcctcctgctgcgcggattgcgagaccgtagacggtaagccataattccgggttggtggtaccgtcatacttctctattccagccggcttaaagccggctggccaatccactcgacgcaggtcgttggtgaaagcggcaactacgtctaggtcgtcgtcgtggcgatccggcgaatgatgatggcctcgggctgcccggcgctgtatgatcgtatcgcgaagatcgacggggcgacgacgaggtggcgaacgaggtcgttccactcggcgctccctatgatggtcgggaggcgagtggacagatcgctcgtcgtgacccctgctcctgcgattagatcctgcgccagtgatgctgaggcttggctggtggtagtcgtgagatcgaagatgggggactcggctgccacttggcgtgcggacgcttccggagttaactgggaccgaagacgcaatcatggtcttggtctggttcaagatgttgacgacgtggtcagactgattgagctcgttctccttgaggagggtgtcgaggagggtgatcgcggcaacagcattctgttgtggggtgcggaaaaccggtgtcccctcaacgtcttgttggccgataagatctcgcgctcggcgccctgcttccaaggctcgtagccgccggtcttcagcctcctttgcggcccgctcacgctcctgttgctcacgccgtagccgttcttgttcttgtgcttgacgctcctcctccagtcggcgtcgttcggcctcgcgtcgtgcttcggtttcccgggcttggcgttgctcttccgtctcgttatcggccataaagacgccgaaatagagaggggtgtagttgtcttctaggctttcatcgaagtcgtcgagatccgggtcgttgttgcgaaagccgaactcattgtactccatgatctcggtcggacgcgagtcgatgccgggagagctccagtagccatccagctggtccgtcgaaactgagccgagtggctggaggatgacgccaacttccctggagctaggcgagatcggtgttgaagccgacctccgcctaggcctacgggatggggatgtcgtggtggtgaagacggccgccaaatcgtcggggagcttcattaggatcggtgggtaagccccatcatctcgatctgatgacgttggagaagatgcgatctcgtccgagtggtttgaagccgactcgattgagatggacttgaagtagatttcagccgcgtttggaactccaaacgggaccgagatccggctctctcccgactggtccgattccgagtcgaggagagagatcttgccgaagtcattggtgatgaagtcgaggctgccgaaccgaaacgcctgcccgggtgggaagacgaggtcgtcgatgctggagacggaacccattgcactggtcggcgaaaagcttgacgcaccccctacctggcgcgccaactgtcgaaacaagatttcggcaatactaaaaaggggtggctatcaagcttgaaaagtggatgggtttggagacaaatgatttatacaggttcaggccttcttattcaagaagtaataccctactcctgtccggggtggaaaccgccgagtgtattattgaatgtatgatctcaaagagaattggtgtcccaggaaggactcggacccctccttatataggggaaggagtctgtattacaaggtataactcatatccttatcagaatacgagaatacaaataaaatacaatcgtaaccgactaaatctcaggatatttccttgacgtacaagttaagaaacaaacccgagatacaaataaagatattctatctatattcggtatcctatatccagtctaaatataaccgccgtatagatatggggtatccataatctccacagttactttattaatccaacacacaatcgatggtacattctgctttggatataatactggcctttgaaatgtttttttagtatacatacatgtatctctgtttttttcttggaaaagtctcttctgttcgatcgaacccataagggcatgtgcctttactccccaaatgtcaatcaagtagttaaaaaaaattcaaatataatgtggtaacagcccagtatgataatctctatcactttgaagtctcaaaattcaaaaaattgaagtctcaactggatatatatacacattaaagggaaaaaagaagacattgatgaacaaaaggcttgtatataattattcatggcagaatctgtgttagctaagctcatgtgtttaaatattaaattgtttgcgaagtgagcgtagctcaactggtttgatatcttgtggtggaaccagggttcaagttccagatttgacacgaatattcgcatttacggctaattattctttcagtggtatactacgtacctgtcgacaataaagggcctgtggtgacttcattaatcttaagatatattggccctatcttctggaggtgctcatagaggtagagttgtgcgtgtgtattcataaaggtgatgagcgtgtgtgtatgtttatagagttaagtgtgcacgcattatgaacgaatatgtttgtaccatgtttctaaaaaaaattgtttgcaaacaattgtcagaaatttttacaactaattctatatatagcatttgaggaatcagcacaggttccttaatccaatcttcagtttttttctttctcattaacctaaatgataaaacaaaaagtcatgtttttgacggatgaagatcaacttctggatttgggagtgttgaatccaacttaattaggaacatagttaattaaggcatcttatatattgtagtactatcaataatactaatttagaagagggacagacgtgtggactgctggctagcagtactgtgccttatatttgaagtttgacatgaaataccaaacacgatggaagcacatggcaaatgggacaatcatagtagcttgtatccatgtttcagcggttgggtttgcaattattttgtcccaatattccatgcatatcaaattatcaatgcatgcatgcaacgaccaatgaaggaaatagcagcacttaataataatattaaggatcaatttatacatattattgattcgtagtgaaattattatcaacatgatcatagatataaattcaataattaaacttaacatatagttttaaacaagaaagctaagctaacaattaatacattaaaaatttttagaaaacatatatttaaaaacgtggagcaaataatctgtggtgaagtattacttatttagatacatgagaggtgcggtagtacactcatactaccaaaaagtagtgtcattctccttccatctcctctcaccacgcacgtagcacgtccgtacgttttgtataagtaaccactgatccaatgttttatcctcagttactcttttagtcatccctaattatacggacctaaaataatcaccggatccaatattttatcctcattcaccctcttagtcttctttgattatatgaacctgttacaatattgggtatgtgacatgttactagtataccagaaaatgtgtaaatacaagttaatttaatgggtatatatataagtatccaagaggttaatcctcgattcctccaataatttgtcatagtgtaaataaaggctcacacatgaacaagtgtatgtttgtgtaagtgtagccagggtctggtttagttctcaactttttctttaaactttcaactttttcatcacatcaaaattttcctacacacaaacttctaacttttccatcacatcattctaatttcaattaaactctcaattttggcatgaactaaacacaccccaggttatattttgcgagtgtacgtgccggcctgcaagccattttttggcccaacccgtaggccctctttgtttaggcttataagccaacttataagtcgaaaagtctaagcctaaacaaacaagcagcttttccatttggcttttttgaagccataagccactctaacactattaagccaaaagctaggttggagaagcttttttggtttatgtgaggtagatgtatgactcaactactaaacttaggacattaaatccaccggcttataaatcatataagccaataagctgacttaaaagtctaggccaataagcctaagcctaaacaaagagggccgtaatctggcccacaaaactggcatatatgactgttcgtggcccaagccatttccatccaaccatgtgacgtttataattatagaatgctagaaatgaattgcattataagcccttattatacattagctacaaaattaatcaaagacttaagattaacgatgcagtagtaataattttaaaccaaggtgatattacagtaggtacgtacaagtagtcgtattaatgtacgtacactacgcgtatactagtataataccgtcgtatttttttccgctgactcgatcgttgactagttactactactactagtagtagttctggttggtgcatctgcaagtcttcctgatctcgaagtgggtgccctcggcggggagcttgctgagcttggccatggcggcggcgaagtccacgtcccacttggtggcgttgtccctgtactcggcgaggtcggcggcggcgtcgccgtcggtgcgcagcacccagtccgacttgaacagcacccggttctgcaggttgttgtggtagtagctgttgtccagcgcccccaccgccgccgtgtccacgccggcggcgtcgtacccggcggcgctctggaacgccgcgcccatgtcgcggatgttgttcttctccgccgggttgtccgtgcgctggacacccttctgccgttcgacgtcggcggcgagcgccgacgcgtacgtggcgtctatgggcgtggcggtggcggcggcaaggcggtcgtggaaggaggagaggtgggcgacgccgatggagtgggcgccggagaggatgacgagctccccctgggtgagccccttgctggcgaagttgtccttgagctgggcgaagtcgaaggtggactccgggaggacggcgtcggcggcggcggcggaggagacgacgccgtccttgcggcccgtgccgacgtcgtaggtgatcctgccgccgctgaggatggcggaggcgtcgcggccggcgagcaccacgatgtcggcgcaggagacggcggcgcccagcttggatttgatggcgtcgatgacgtcgaagccgtccaggccgatgttgttcgccgccgccttctccgtgctgctgctgtacggcgtcttgtccaagagcaccgatccatcacaaccctgcatttttcaagaaaaaattctttattagttatgcgctccatcttaacaatttaaaaatgtattcaaatcaaatttatagttaaaaattgttatattttaagatcaagctagctatttgcccaaattaactcagtaagtgaatcacttttgaaacaccatatcaacatcatctcacaatttaaaaaggtatcacagccctgctttttttttgttattatatatccattcatgttatagtattgttcatgcatgtggttatttctccaaactcattacaagtcacttttcaagcaccacatcaacatcatccaacaatttaaaaggtatctaattatcattttcaggtgaaaaaaaaaaagaaaagttattactacttactatcaacttagaccccccccccccaaaaaaaaaaaaaaagctaatgcagacaagcatgacaagttctcttacatgatccccaattcaaaagaaaaaaaagccaaactaaaaatgccataaggcctatctagctccaccgaaatttgcattatattgcaagctaagctgcatacatattggacttcaggtttacttatgcatttagcagatccaaatctttttgagagtgtgttaattaaagacaatatatttaaagcacatatgtacgtgcaaatgtaatatgtgtaacatattacgtgtgggattgagatcctcttcaatcaaaatacacggtatatttgtcactgacatgtgggtccagggatcattggatccacatgccagtgacagagacacgtgacttcgactgcagaggatcctgatctatgtgtatgtgtctgtatgtcattcatgtactcggaaaaaaaaaagtaaatggtggttagtatacttacgttgacccagcagtcatggaacaccaaacggacaagggcggcacccacgccgggattgtgcttgatggccttctccacctccttcctcaccgtctcctcgatgctcttcttgccgtaccaatcgccgccggcgtcggccgccgccggatgcacggcgaccaccaccaacagagacagcacaacggcggcggcggccaccgccgcgttaagcttcaccatcaccatctccgatcctccaaatccttagctgaattagtaagtgtgtgtgtgcttagctagcttactagctactgcttaagtaggatggattgatggattagcagctgtgcatccagggggtatatatactgctgatcacctctcaccatcaccatgagcatcaaataattaattagctactagctgctatagttgaacactatgactatgccattgtatgggttgagttaggctagcttagctagcttgcatgcacacaccggataatatgcgtcactattttatatgagcaatatatatgcatgatgctttgcttgcttaatttgcatgcttgcagttggtagataaacgttgatgccgatcatgtgttgaccaaaaatgaaggaaggtcgacgaacgacaacgtgcatgcatggcaattatatgacgactatgaacgatgatgcgttttagtcttgggcgtctattcaatatttatattattatcttaaaaaaaatccaatctttgtattgtcagtttggcgccgctgtcgcctgataagcctagtttaattagttgcgctagtcaaatggaacgtttatatatataaatattacaagttgggacgaagttcaattcgttgccaacttccttctcttccaatccatttcgttaattcggatgatatatacgatgatcgattatcatcatctcttgctggtcagcttgacaactgtacgcgtttgtttgtcactgattaattaaatttgtagttttaattagagcaaaaattaaaggacccaacacgtttacttttgtggtttaaaattaagttaccatgcttattcggagaaaaagaaaaatatatacacaccctttgattatgatgatggatccaaaactctatatgaccgtgtaaatagaccaattaatatctacactattctaaaagaagagcaatgaatttttgccaaaaaaaatgtttatatttttactaactactctttcatatgattttaatattacaaaatagagcacataattttaatcttagagtaaatttcacaaaactacaggtactttgcacaatctatcacaaaactacagatttaagaaattgtctcataaaactatagatttagggaccccgttatcacaaaactacaggttttagctctccccgttaaatctaccgtgacctgacaggggtggcccacttgcagtctcaggaaccttcaagatggttgccacatcagaaatcccatgtcaaatgcgtgcgtggtggaacggttgtacgaagaagttgcaggatgtgtttctatccctctcgtggacccagaggtggccaaacgggcggcacggcccggcccggcacgggcacggttccggcacggcccgtttcggcacggcccgttaggcacggctgatgaaacgggccgtgccgtgccggcccacgtgccgagccgccggcccaagcacggcccgtggatggccgggccgtgcccgtgccggcacggcacgcccgcggcccacgggccgttcggggcacggcggcccgtgtgcacagttttttttttaaaaaaaaaaaagcaaaggaaatgtataaggaaaaaaaaattaaaaatggaaataaaatgtttaaaaaaaagtaatgatttactaatgttaaaaaatgaaaaaatggtatttaaaaaatggaaataaaagttttttaaaaaagtaatgatttgctaatgttaaaaaaaaagaaaaaatggtatttttttgttgtgttgaaaaatttaaaaatatagattgtgattcattattatgaaataatttaaaggtaaatccacacttgcgaaaatattgcaaaagaatttgttaaaaatagtaatgacctttattgatgtttatatcattacaggatacaatgatacatgctgcctcgttaaaaactttgtcatgtaaaaactcataggggaaaatgagaaaaccatgacaaagaaaagagtacagctcaaaggtcagaactacttctaacaaaattctactggggttggtctggatccaggtagagttgctcgaagtgggcggccaattcttggttgtccgcagtgtattgggcatgttgtcgagcaagctcccagtctttaacgcttagtagcatttcgacgtggtcgctgcgcagagtcgtcctccggtcttcgatgattcggccgcatagactgaaggccgattcggaggacaccgtcgacacgggcaccgtcaacacatcccgtgctagttttgaaagcacaggatatgttatcttgtggtcattccaccacccgaggacgttgaaatcttgtgcttcgtggtggatggcgtcgctgtccaaataaccggacaactcttcggccacaacatgcgaagaggcgtctccacttgtagccgacgaactgccaccaccttggattgaacttgaagacgatccaccccaaatcctaccccactgtatcttcttcttacctgtagtggggataggagggggtctccgctggcgaacttcctgaaactttacttcatatcttccaaaaacctcatataatttacgtctaacctcagtataaaaagaactataatctacacctatagtatctccaacaagtgataaaatagcagacaatccccttaatttacacctaggatctaaaacaaaagcaagagcatacaacataggtatatttttccaatatttcaaatatttttgtttcatgtgaaagacaggttcagttagaacgtcatcattttcgtattctttaaataaagtaacaatttcaagaaggttgtgcaaaattatattagcagttggataataaacatgtgacaaagttagagtacaatcataaaaagtttctagaaattggtaaaatttttggacaattgcccaaacatgctcgttcagtactgaagacccgtcactgtttcttgggccaccacgtgactgaacaaaatcagaaagtaaactactataaggtaaaacaacttttaacattaaatacgttgcattccaccgatgctctgcatcggtggcaaacttacgagcttccacaccggccgcattgcaaaacctcttccatgcagcaatccgcgggttagaagcagttaaccacgcgattgcttgacgaacagcatcgatgtggtcacctaccctcttcatgccagtcttaacaatcaaattaattatatgacatgcacaacgctgatggagtagaaaagattgagcatacacacaaaataaaggttgcaatatttcaatagctctagaattagcagatgcattatctagggtgacagcaaatattttatcagcaagattaaattcattaattacttccctaattctttcagctatgttttctcctgtatgtgagacatctattaacctaagccctaaaactctcttttgtaattgccaatcatcatcaacaaaatgaacaactacgctaagataatcctctctagctctactactccatatatctgaagtaacacaaacagagaaagtacatgtactaaacagttccttaagtgcagttgcttccttgtgataaacattctctaaatctctagttgatgtttgcctactcacagctttaaacctagggttatgagattgctgaatgtaatgttcaaaagcaggggactccccaaagttcaagggtaaatcttgcctggcgattaaccggacaagagattcccgagcaaccatgggatcgtactcccaactgcgtaccgtaccgtctgggtttagcataagttgctgctgccggagttgtattccttgcttcttggcacacgactctgcatggcgcttgaggtgacctgtaccaccagaagaacgagcagataaaatttgcctacatattctacaacgggctttcgatacctcccttccgtcggggcatgtttcctttatctcgtcgaagctttgccacacaccggaggttctcgatctcttcgagccggtgtgtgtcgaaacacttccgctcgcggttccggaaaatccttccgaagctgtcgcctcctgaaccggtacctcctcaacgacagccgtatgaaccggtacctcctccacagatggtggagttggagccgatccggaggtaccgtcaaaccccgacatgtagttggggtcgaaatcacccaaggtgaacgacggtgactggtatggaaagttcggatccattctgaaaatttaaaccgacataaacaaattttcgaatatttattgaattcacaaacacaatacaaataatacacaaatttgaatattacttacatctttccaaccgcgagctcttcaaacctctgcgatcaaactgttgaactacgaaactaattttgatttttgacaaaatttgagcaaattttgtcaaaatcaaaaaaaaaaatgcacacttgagaacaaagagagcacttaaaacacttgagagcacaagatgaggagtgtgggatgaggagaaatggctggggttcatgccctatttatagggcgaaatttgagattttttggaattttttcggaatttttatgaattttttagcctcccaacggttattttcaaatttcaacggtcaaatagccgttagtgccacgtgtcgccgtcccattggaccgccgcccgcctgccgcgcctgacgggccgccgccgtgccgtgccgggccgtgccgcgggccgtgccgtgccggcccgctacagtagccgggccgtgccgtgccggcccgcgtgctcggccagcggcccaagcacggcacggctaaacgggccgtgccggcacggcccgttactgtagcaggccgtgccgggccgtgcctgctacaggtccggccgtgccgcgcgcggcccgtttggcccggcccatttggccacctctacgtggacccattcggtggccaattcctcactttccacgcgtgcatcgtcgtctcgcgtcttcgcctggtcaccgcatcgttcctctttggcctgaagaaaccctagccatagagatggcatcggcgaatagcgcgagcaagaagcgaagcataggtgcaccatcccagcaacagggtagcgtgagctgtgcattgggcaaggtatgcaatgtatatactagtggatttgagtgtgcgattggttttgattttgatttttcgaaattgggtttgatttggtgagttgggatcgaatgaaatctttggggtcgtaggaggtaagtctggatgcagtgcccttatatttggaagaaacagaatggcatggtgaggagaaaggaactcgattgcgctgcaagcatggattgtgtctagcacggagggtggcttgggaaggagaagacacaggcaggaggttcttgggctgtccattagaggtttgtttttttgttttctttgattttgttttttttttaattttcccccacaattttgacctgattttgttgggcttattcaggaagacgaggaccaatgcaagttcgttcaatgggtggatcctgaatgggactcgagggtgaagaagacactagctggcatgtgggatatggtggaccgtggagtgaaacgtgaagcaattattcaagctgacatgtttaaggcttttgccctgaaagaccgtttggagaaagagaagaatgatgagttagcccacaagaatgctctgcttgacatgagggaagcacaattgaaagaactgctctacaaatctgcctccgaagcaaacgagctatgttctccctcctcctaggttccccccttcatccccattattttgctcgttcccgcgtttcctctcttttgccgcccagggcgcaggaggactggcgtggttccttccaggagaaggaaaagtgcgtgcgtggactgacgattcaaccggaggaggagtgacatgggatttctgatgtggcaaccatcttgaaggttcctgagactgcaagtgggccacccctgtcaggtcacggtagatttaactgggagagctaagacctgtagttttgtgataacgaggtccctaaatctgtagttttatgagacaattttttaaatatgtagttttgtgatagattgtgcaaagtacctgtagttttgtgaaatttactcttaatcttattacatctctcaactacaaatttatcctgaaaagacgtctacacgtacacagatgaattgtactctatctataaaaaaaacatcacaatcgattctttccaaacatgcataattcatatttatttgtagcaaaacataggtattttgtttagtagctatattcaaataaaaacacatttatagaaataggagaaataattatatattgactctaattctgctttctaaatctaggtccgtggaattgtagaaaaattctatagttttttaggctttcccttgaaatggaggattttcaaaaggaatttcaccgaaactaaactaacttatgtaaaattcctgtaattttttctcacatagatcgtccttaaagtgagctgagcttacaacaataatatatgaattacaactttttccacatttgataacatacgactgattgtcaaaatattttcgctaggtaatggactaatagtggatatcgacgcagcaccctattgctacccgcgctaactaaattatactattaattaattagttcagtcattccatctttcacggagaaaaacctgctcttgatcgacaagaagtcatctcagaagtcagagttaatctgccagtctccaacttcttctgttcatcaggccaactgcaactaattgggtaggagtagcaaatatatgttaattaatttggataaaaaaaattggttggtagttccataggcactatagctgaattagcgccttaactcttcctcaacctgatagtaggaaaaaaagtccgagcatatatagatataaattcgaaagtggattccatgtagatagcatatccaatcaaagtggtagaatgatcggctggaatgctggatgcatgtgcaagggttagttgcaactagctgatgaactaatctgtactagattaaattcatcaacttgtctattgtgttcttaattatgtatcttggagttgttttattagaatctgcatatagttgtctgattgtctccaaaatgacatgctcaattaattactccctccgtattttaatttatgacgccgttgactttttaaccaacgtttgaccactcgtcttattcaaaatttttatacaaatataaaaatacttatgtcatgcttaaagaacatttgatgataaatcaagtcacaataaaataaattataattacataaattttttgaataagacgaaaggtcaaacgcttgtcaaaaagtcaacggcgtcatgcattaaaatatggagggagtatatattaacatatgatttaagtattccattagatcgagcacatgtacaataaccggctattagccttccacatcagctgttgcagtaagctagaggagagagttgagacgcgagagtgcaaagccgcaggcgactaaatagtctcaagaattaactccaactaagaaagagtgaaaattaagcaaaattttagaataagcagctgactgattattaggcttgctcagtaatatcagttaacctaatgtacattgaaccggaaattaatcacctagaaaacaagagaccgatggagggctcccggagaagaagaatggtttttacaattcaaataattaatgcatgtgcaacaatattctaaggcattaatcgatgttttattgagaatggtatatttgtactgataagaggatataatatatattagtattatgcttttcttgaagtatgtatatgatgatagtggatgtaggtaaacatgcacttgggttgtactaatgaaattgactaatttctcctctcatttttgataatattttatagttagtacctttcgttccatttcatcctccctgtaatatattcaagaaccggatctttcggcacgttctctcaacaatacagaaggaatcgttctattccatctttgtcttgccttcgtcgttatccccaatatgtcctaaccatagttaatactcctaccatttgttttcaaagttgctgttaagtggcctacgtgcaaattaaaatggacaagacaagtcatttcaattcgttggtacttgagcaatatactccctacgtttcaaaatatttgacaccgttaacttttcagtatgtgtttgacaatttgtcttattcaaaaaaatttaagtaattatttattctttttatatcatttgattcgttgttaaatatacttttatgtacacatatagttttatatatttcacaattttttttaataagacgaacagtctaacatgtactaaaaagtcaacggtgtcaagtattttaaaacggagggagtactatatagttagagccctggagctgaaatgtgctagctccataatatctatctcgatcgatcgtctgatcagttgtcgaacggaaaaggatcgatgggcgttcctgtagtgtcggcaaggtagatgcattattgaatcttagggccgttttaaattgaagctgaaatgtttttaccgatagtttcaatactagatagggtgattttagtccgaagccaaatcattggcattgccgatatccaatttgacactttctaaattcttatcaaaattttactagcttctaattatatgttggcctgctcagatttttaaggtgctcgtaggggtatggtgtgtgcgtgtgtttacaaggggtgagtgtacgtgcgttataagcatttaagtttgtaccgtgtttctaaaaaaatatattagcatcaaaccaaatacaactttacactactgtatctatatttcctaaacagttcaactgttgttggttgctctattaaaccacaataaaaattgaagtccacggtgagtagctgatagacaacgaaaaaactcaactaagcaacgaattgaaggttaaacttttatattcgtgttttaacgatttaaaaaccaatgcttaaaagataaattataatgagaaaaaacacaaaatcaactgtaaaatcaaataataaatttaaattttagttgtgaccgattagataataaccaggcaatgagagagaaaatatagccacgatggatttgttttaacagagaaaaaaaaagcttgtgtacatgtgcaatatatagtcgaaattgtgaataagttgagagaaaactaatgcgagatggattgtgcgtggatggggagattaattgctcgatcggtcgcgagccatctagtagttagatcgggaggcaagtcgcattgcaagtaagcgaagtctgaactctgaatttaacatggaaaattcttcagacatgctcatcagatttcgcggcaagcaagcaaagctatgtaggctatggcgacgagttggatggtggtcagatcatcaccaattcccatcttctctgaaactggagctggtccacttgccgggaagcacgcacataccccacgtgctgaaactaatcgggatatagtggtggtgttcctcctcttccaacccttcttctacttgccggcgctccttgttctgatatacttcctccgtttcataatataagtctttctagtattgcccacatttatagagatgttaatgaatctagacatatatgtgtatctatattcattaacatctatatgaatatgagcaatactagaaagtcttacattatgaaacggagggagtagcaccactgcaattcttctttccagcgattggtcactgcatctccggatttctactcctagccgccggcagggatacctccggatatgggaaagaaaaaggttgcgtctctccggatttctactcctatagtcgccggctgggatacctccggatatgggaaaggaaaggttgtgccagcctagtaaaaaaaccggaccggcccagcggttgaatcgtaaaaccagaaccatgcctctcaccggttcggtttagtagaacggacggctcatgcatttgacccggtaagaaccgagtgaaccggatggtttttagtgaaaaccggcgaaccgggctaataagaaccggcggttcattgtaagttgggctaacgcttgggctagccttgtaaggcccatcatcctacaccacggcccatttatattttatgcaaaatataagagaaagcatgtgtgggaagtgatttgaacccgtgacttgcggattgagacattgggcctgttcactttgatgccattttcaaccttaccaaattttggtaaagttgcaaaaaaagtggctacgggcctgttcactttgatgccatttttaaccttaccaaatttttggtaaagttatcaaaaaagtggctacatttagtttgctgccaaattttggtaactatataagaaatcctgccaaaattttggcaagttgtcaaaattttggtaactatgctaaaatttggtaaggtttttttttggcatcaaagtaaacaggccctacatttagtttgctattaaattttgataactatataagaaatcctgtcaaaattttgacaagtttaccaaaattttggcaactataccaaaatgctaaaatttggtaaggttttttttttttttcatcaaagtgaacagacccattatcaagtttaccatattgctagcaaactcattttttttaatagaaaatatatagtagccatatacctccgttcagcattgaaccggctgactcgacggtccgatcggtgaacagtaaaccaacgagatcactaggtcgatcaccgtggtcttcttcgatttctccggcgagttctgacttctatccagtggcggaccaggtcctgggccacttaaggctatggcctgagacctgggtacgagagcccacattttcaccattctcttggaccgaataggtagtgggctggtcaggggctggcccaaacctgggtccgctggttcgctggcctcgggaataagatcactttgactccctcaactgaccacctaatctaaatcgtatccctcaaccgcaataacagaaatctcgaccccccaaacttgcaaaaccggtgcaatttgactccctcggtggtttgggggggtggtttcgctgacgtggcgcctatgtggtgatattgaccgagtctacggtccacgtggcgttaacgtggcacttacgtggcagtagaattaaaaaatatttgtgggacccattagtcattaaaaaaaaagtgggcccactaacatgtggggcccacatgtcagtcctttcttcttcctcctccctctctcccttctctctcaatctctccccttcttcccatttggccggcggtcgagagggcagcaagagcgggggccggcccggctcggcctcggtggggaggcggtggcgcaccgccggggtctaccgacaatggaaacggcgcacgaacgaggggagcggcggcggccatcggagcttcttgggcctcgcctcggagtccccgtcgcatctcgccattcgcagctaccagctgctccctccctgtccccgccgcccgtgagatcccgccatggaggtgagcgccgcctctcgtcccctttttttccttttcttttgtttctttgttttgtttgtctctttcgatttgatggttctcggcggaggaggtggcgttgtagtgtttgccacccctggccttctccagccccgtcaccccgaccttctccaacggcctccacatgaccccccgcgccagtcgcttcgtcaccgacgacgacctcacgagccgtcggagaccacgccggtaaccgcgaggatgaggatgacgagcggcagcgcgggccgccaccgccgttccactcgtcctcccattgccgcgagtcgccgctgccgttcccctcgtcctcccactgccgccagtcgccgccgtcgttcccctcgtcctcccactatcgcgagccgtcgcggcggagccaccgccgccctagccgccgaccgccgcccctggtccggttctgatgtgccccgatgccgccagccgccctcctgcccgtcggccgaatgggaagaaggggatagaaagagagagaaggaagagagggaggaggaagaagaaagggctgacatgtgggccccacatgtcagtgggcccacagtttttttgtgtgaatgactaatgggtcccacgtatattttttaattctactgccacgtaagtgccacgtcaacgccacgtggaccgaagactaggtcaatatctacatgtaggcgccacatggtgccatgtcagcgaaaccgcccccaaaaccgccgagggagtcaaattgcaccggtttcgcaagttcggggggtcgagatttctggtattacggttgagggatacgatttagattcggtggtcagttgagggagtcaaagtgatcttattccctggcctcgtcgatgtgtgttggagtccagcttgattagcgaaatgggctgtgatcccgctggactgcacatatgggccatgtgtctcaagcatggcaatttgggcccacaattgggtctagatgattaatgggccggtctaaatttcatgaatggaagtcacatttgagcccaacacgtttctcatggtccaaatggccctaggcttgcactctagatgacagcaattatatttgggcccatcgaatcttcctgtggatgggcccaaatataattgctgccatctagagttactgtgataataattcaagaattaacattgtgccattgaaatcactagtatgtttaacatgaaggagtagcataattttgtgcttcttttcttttcatttcatgtttcctttttgctagaagcaaattgacatccattaaaaacagaggatctggactagcaatgacagtagggcttgctcatcacagttaaaactggaaatggaacataattgaagtggccagtgccatatatcgatctttctgtaatccctccttattacatgaaaatggagaaagttttggatggatgaatacaaatccaatccaaaccataccaaaaaaaaaaacaacaactaattaactttctttctttttgacaccaatagacagagaatgcaacaacacaaaagctactatacaccatgaattctcgctgtactggtgttctcacatacacatgcgcgtagaattcaacacaaaattaaaccaattcaacacgagatcgacgagcaccaacaaatcaaaaaaaagaacaagatacacaaaattaaacgacgatgatgaaccaaccatgcgaataatgaaacaaagaattattgaaaatgaggatgcagatgagagctcaagatggaaggcttgatgttgggatgatgaggatgaagaatcagtagtggtgggtgttgacgcggcggcaatggcggcggatctcgcccttggccttgggcggcaatggcagcttgctgagcttgacgagcgcgtcggagaaatcctcgtcccagagcgtgccattgtcggcgtactcgtggacatggccgcgcgccttcttctccgtgagcagctgccaatcggagttgaaggtgacgatcctcgcgaggttgttgtggtagtagctgttgtccaagaactcgaacttcctcagcttcgggaggaaggacgggatggtggcggcgacggcggcggggtcctcgtcgcggacgttgttgggcacgatcgggtcctcgccggcggcgcacttgccggcgaggaggctgcggtatcccgggaggatctgctcgggtggcgcggtgaggcgggcgcggagggaggagcagtggccgacgccgacggcgtgggcgccggagaggatgacgagctcctcgatggtgaagttcttgcggcggaagttgcggatgagctcggagatggtgaaggtggagtccgggaggtcgcgctgggcgtcggcggcgcgggagacgcggccgtcgaggcggccggcgaggacgtcgaagtggacgtggccgttgctgaggaggatggaggcgtcgcgggcggcgtagatgacgatgtcggcgcaggagaccacgcccgggcaccgctcctccaccgccgccttgatctcgtcgatgagctcgaacgcggcgaggccgatgttgatcggcgccgtcttctccgtgtgcgggttctccgccgtcgggtccagcagcaccgacgcgtcgcacccctgcaccacccattccaattcaaatcgatcattaacattcgcgcgtttttttaaaaaaaaaattactataatcagcaaccaattgagaattcaaatttgtcgtgcattttttacattgtaattaatcaatggcgccaaacaattcaaatacaaaaagttttcataaacttgaccaaacttaaaattgtttgcgtggtaaaaaaaggtcaaatcgttatactaaaatttgttcgaattttgaatttttttaggcagaaatatttcagaatttctgcattgtacaagtagaaccatagtaggataagcaggaatgatccataaatttgactggtaacaattagatgttttgggattagtgaatatcggggtaagatttaaatgtatgtcataattatgttagctaacggtaattatcacatgattagacaatacaattgataaaaaattaagcacgcgcaatgtagtcaactaataatgccttaaacactctgcatatgttgaagttctctatataccccaatttaggtagttagtcaattaacaatcttccacaccatattataagacgttttttttgacctatgtcaaactatatcaagtttgaccaagcttgttaaaaacttagcaacatataaaacaccgaattagttttattaaatccataattaaaaatatcattatattaaatttgttttgtattaaaatgctacttattctatagttgtttcatccttctttattctctcaaccaatgagcctaacactactaggccgaatcataccgtcctttggaccaaacatctccacggaatcgttcaattaattccacacatcatcgatctcatacctcctactcttgttccaccgtccaaaacactagtagttaatactaatactgttaactatatgtgtgcttggcaagtcatcctatctgtacttaagcacagttaggatctgtttgatagagctccaactcttaaatttagttttaagagttggatttggagtggagttgtggaacagtctaaatctagctccacctctctaatttattttgtgagaatgcttcaaccagatctactcttattttagatggagctgaaactgtttcgttgagctccaacttttaaaagatggagctgaagctatggcaaataaacctttaattatattagagccccttgagaaaaatgtgtgatagatcgatcgattgatcatcgtcagctgagttgttggaaaacgatatgcacatataattgcatatgtagtgtcggtgagagggcaaatgcattattggttcttaattacttgaacagttctattgctgctgatgcttaaaccacacaacgaaaagtccatgcatgctgcaacttgtatatatgtacatcatcttcttttattattttcttaaaaagaggagaacaaaaagaaagactaccgatgctaccgaccatttcgtctataatgtgctcattcaattccgtagccactaatgacctatgttgtattcttgcatgtctaaataaaatagtttcactctatatttttagtctaataacatgaacacaaattggctcgcacaaaccaatcaaaatatgtaatttaatcagaacaaatgcaactccaagaacttttagagccaagtaagctaggatgcttgcttggatgagagtgctgaaactctgtcagaacatgcactaattacttgttaatcaaaagggtaagtaaaaaaaagttcaattaattacttttactctcttttctattcatgactgaggagctagtggtaccaattattggtcatgactctggagagatataggtatgctttctctttctcaacacagtgtccccttttctctcccatatgtgtccttttcctctctctctctctctctctctctctctctcctagacaatcagcacaagaaaacaatttgccccataggaagcaaagaagctctggccccaagcacaatccaaacataatcatatcccactaattgagcttacctagaaatcgaacaccaataaaatcatgtttaactactactactactaatatgatatacatgagagtctaattaattaattatttgtgtgtatgcaaaacgtactgatgatgcatgaaccaattgaataggtagttacatgttgcttgccaatcacagcaacatcagcagcagctgcatctggctggcacccatgcagagaaaagaaaggagagggaataaactgacgacaagggcatagtgtttctgggaccctagagctaattaagctaagctaatgcagcttaattatgtgtttagctaagcagccagaagggaaaaaaaaaggtgtagcatgcattgacagtccaaatgatggacacaaggaaagtatcacattcgattccagcatgcatgttgcagatgctgaattgctggctaccaatctctctctctctctctatctatctatctttctctctctaatctacctttagtttctctctcttgccatgttggattagtagtgaactagtagaagtcaagtagctcacgaaactagcttagcttagcttagctaggtctccattgaacttttcttttcttttgtgcatggaaagaaaggaagagaaagaagaagaaactgtctctggatggagtgatgacagtgtgtcaaatgcagtggcgtgtggctgctaacttgctgataactatctgtgttgatcttgacaacaaccaaccaagtggggttcagagacttaactaagaagctgtgttatgtatattagcttaagatttgatcatttctcatacacgcttatgcggcgacgacgacgttggtgtaagataagatgctgattgagtagttgcttagttagtttgtgtaaatgttgctgttatttccatcaagagtaaagttgttttccttattaattaatcaactaacctagctagaatgtgataagtttcctcgatggatcgatcacctgatgagtgattctgaagaatgaaaccaactgtaacacaactaaactctgcaaagccaagttgtactatgtacacacacaactaactaacagttaagctagctagtaaaccttagctagtacgtactgcaaatgtagattgatatatatggatggatcaatcatgagccgctacaataattgatatgcaagaaagttaattatctgattgagataattaccctgacgaagcagtcgtggaagatgaggcggacgagggcggcgccttccttgcgattcgccttgagcgccttggcgacatggtacctcaccacgttctccactccgggacaactcttcttgtagtaatccacgctcagctccgcctccaccgacatcgccgccgccgccaccaccaccatcaccaccaccgccgccgccaacctcatcgtcatcctcctcctctccggcaacttaatttctcgctatcgatgggtacgtcgccttttctcgctctccggccacgcgccgcctcgtgtgtagcggtggttggttggcgaggcagtgtggagggaagcagagaggggggtggagaggagaagaaggggtggcaggtggtatatatatcgttgcacgatcgatgggaaattgcgttttaacggtcagctttgctaagtgatgatgtgagcggggtcatcatgtgtgacagtgaagtgccaccgcgcaaaaacgcttgtaatttaactttaattcgcagatcagtttagtttacagagttttcagagagaaagggagagagtgatgggctctgatgcttcagtaagacagtaatcactgtactgcttcttcttcttcttctagtaggagtatatcttaagaattaagaagaatgaggagattagaagaaaaaggagagaaataaaagtaactaaaagggttcgatttatgcttgttactatcgcgccacctaactgcagttggggcgttgacggatcgatccgtgcgtgccatactgccatggcgtgtcactgatctctgatgtaattcatgatcgatatcaaatatggaggtagtacgtacgtcttgccgcttcgagaaatgcgcgcagcccacgccacagtcgccggccggaaccccttgccgtcgttacgccggcgtgtcgagggggccagcatatgtcgagattacgaagttacacacaacgcaatcgcccagaccgacttatgttaggagaagggagaaaaagcaaaagaaacttagagaaactacggcggctaaaaacagactccaagcggcggaaggcaccgagccatgctacactcccaacaaatccccagaaacagcgacgccagctaaatgccacatatggctctatgaatggatggactccagaaccactgagactaaagagagagtggatcaaggaagcacccgtgtcaaatatattgacgtgcaatccttttgcgcattcgtgaaaaaaatattatgaagttatcaaggaagcacccgtgttaaatttataatttaaatccaagtagattgattccaccacaaggaatctaaccagttgagatacgctcacttcattaaaaaaaaactgtacaatttacaagacaagtgtaaatattaagaacaaagggagtatgatttatttatgtacaacaataattatcgaattacttgtatacatgtgcgccgactggtttcgatataatcctaccatctccaacataaatatttaatgtttatgataatgtttggtcaagcttttaatattttgatcattaaaaattttatgttggaataagtttgtaaaacacattaagtttatgatatcttgcttcctaattaagtcaaatatagacatataattacttttgtatttttttaataaactaatcaatttgagaaatcgtcgatggtttgagttttaaaaatcaaatattgtactaaacatcaaatatttttatgagtatgaaacatgttatgttcatacaaaagtacaagtgaatttaccaatcgtcgccactcatgaatagcttgatatttgctcattagcctctccttctccttgaactccggtcggttgttggcgaggcgctgtcggtggcacaagaaaaccgtgcacacatcacgcattgatcgatacatctatcggcatttctaactggagctagcataaggttaaatttcgatccaacctcaattacgaattcagatggatggatggatgcaatcgtgttgagcatatttcgaatcatatcctggtggttgcagagttccattccatcccatcgtttttcctttttgttgagatcattaaacaacttaatttctcgtttctttgacacgcacacatagattaatgctctatgtatatgtacgaacagtagtgactccatgatccgtccatgccaacgtccctccctgctggccctttgccttctcaatttttagtcgctttcgtgcaacctccttgtactgccatactacatatgcattctctttgtctcggtcgtctctctgattaactagacgacacctcgcacgttacacgggaaattatatgaaacaaatatcaattttaactaaatacctataatatgtatgatatataaaagtgatatttttttttaggaaggggcaggtgctctgccaatttcattatagaaggagagaaaaagcgaaggttcaccgacaaatggtgtcacatagtaggaacatgagggggtacaagaattttgaaaaaaatacaaagcaactttctactggtctattggtttagcttctggcttctcgatgtgtggcctcacgtacgcataggcttctttacaagagtaaatgatgttagtgggttgtaactatataatacaggattttcaaaagtattccgtgtttatgtatactccctccttcatgttacgaataagttatgtattttgtaaaatgcacaattaatgtgtctgtaaattcttatcatcaatatctttgcaatacttcgattcaattttgaaaacggtatggctagatctgttttggggtacattttaaaatatattttgcattttgtactagcaattaaaaataaactagtgcataggtgatcattcatatcactgtagtacaaactaaacgccactatttataactgaatttagtagtaccatatacacactcttccaatcaatctactcctacccatccattttttcttgtctgtatacatatcctgtcatgcatggcagattgattgcacagaaagtaagcaacagcagctgaattaaggccatccagaatgatgaacagtattatacaatgtggtaattagcctttatttggaggccagtacacaaacacaataatattcaggctcatcaatgaccagcaagtgtctgcaaatggttaggcacattacatttggccgtgtcttcttgctgtatgcataaactagtttagatctactaatatatactgttcatgatgccatgcacttgcaggtagtagctgcaggtgacatgtcaatctcatacaagtaggaatatatagcatcatggaaatattaaaaacttaacgatttctctcaagtcaatattataaatatagatggaactgatctgtcatctctcttcctcctccatctttaatcaatttctcccgttttcttagaccgaccttttgattaatcttttcttgagttctgcaatgccgatgcagacacgcaacttgtttaattcgtgcctgaattgaagcctagtggctagcaggcagctgcaagcaagcttccaattcagcacaagtcttcaattcagaacaagtcttcagaacttaacaaccatccttggcaagctagcaagctagtagatgcatataaccttaattggccatgaaaaaagtctaatcaaaggtggtccatgaataataattccaaagtttatcaagcacgcaggctgctctccatgctagctcggattattccaactttgccttgatattgaatagactgtgcacttgcttttgctttctttgcaatttgccatactgctagctccagctatatttgctcatttttaattgaagcctttgatacatgctggagtattaatgaattaaactagctagcattggggggctacaacttagttaattagtagttacatgtgatccctactttatatgtagatacttagatgatcagtgttagatactaatattactcatgctgtgtacttgagtaccactttgtttgattagtgttggagtacagacagaatattcatcatggaaagtaggtaggaggagtacatgggagaaaataaattcaagggttgtcaggcccaacagagattgcatatttagtagaggacttaattagttttttttaagtaagagcacttaactatagataatttgaccatgccaaaaaagcttgcactaataattaatgtacttccctaaaaaagtttgccccagtaatattagtagtagtattagtatttgatagagatgctccaactatgtagcagatcaaaatagcagttttaatttatagatcatgtgcatcaattcatatagccatcattctttatgggtattatactccaacttgtaagtgtgatacttaccttaatctgcagtaatgatggtgccgtgtgtatatacacatctcctcctatattagtcaaagatttgtgtctatgcaatgtatttgtacatctctggaatggttggggcaggatcatcttgacactgatcaatgtccccttgttcgtttgtttatttggatgcaatgtttctttctttccaactcttttgtgcgtgtttggacatgatttagtaaaagctgatgatgcaatatggaccattcaaatcaatcaaggaatttggattatgagagagatgatcatagaagccggggttggtccattcctctagctttcgccatttttccttttcgtaagctagaacatcactgttaggaccatcttgggttactatgataatgtaagagcaaatagtagctaccagactaagatccaatttttcaattaattattaattaattaaccaaaatattaatggggatagacctagtgtaatgacaaaattaattgtactggtgaatgaggagatgacaagctatataggtagatagagaggttgttgacagcagtaggaagtactgaagtggcagcttgttagaaagaaaccgatgatttaattttgtaattagggcttcggccgacacacggcgctcaggtaattggatgaattaattagttttaatttatacccatccatctatataagtttgtattctgtttcgacccgtgtatatgtgctggtttcgatttaggcacattaattaaactcaagtgctcgtttggtgaccttatatatgaaaagactatacaggtttacaccagcttatttcagccattgcacatttcagattaacccttttatataaaacaagaaataacttgtaattaaggtcagtgattacaatttcggttcgaaatctcggttatctcagccaaattttttggtttttctcaaaaaaaatttacaaatttgatcaaaatatagtcaaattatcaattaaattatgttaaaatttttaaaaaaattcggtccaataagtgccgaaaatacaccctccaggttgataatacttatcattttgaacaagagcacagtctccaaaaattaaccattatttttcattataatatgtataaaagtgttaacaaatatatgattttattaaagtactttttagagaaaattccctacatacccctgaaaagtttcgcgatctcttctatacccctgagttttgcctcatcccctacatgcccttgagttttcattttgatctcctctatccctattccgttagttgaccgtgagttgactgttaaatttttctaaaatgaccatatcgcccatttcccattcttacagtacatgttatatactctacttcataattcacaatgtgaaaaattgtaactcatgataaaatcaaataggacataattatttattgaaaagaaaatttaaactattgaacaaatttattttttttgacaaaatccatataagagctttagctagaaattgtgaaccaaaattatttatttgttgggttcaaattttgatgaaaacaatgtacggatatcataaaagttaatttaaaatttatttttttttaaaaaatgttgtcaaataattatattccctttgtttatttacaaacagatcttttttcatataataattgtgtttttgtcattaaactagcacataagtataagagaggggtaatatagtcaattttaataacatttaacggtcaactcacggtcaactaacggaattaatgggcatagaggagatcaaaataaaaactcagaggtatataagggatgaggcaaaatttaggagtacataagggagtggatgaattctcaaggatatacagggggttttctctactttttaagactaatctatacatatagtcaccattagtcactatatgtgaaagataaatattttaaaaatgattcataatcaaagattataaagtttgacctcacccttatttaaaacgataagtattattagcccggagaaagtactgaaatttcggccaaaatcgaaattgaaaaccctgaatcagatattatgtgtagtgagcccactcctacagaagagcagagagctaggttttgtggatttggaggctaattgtcttacacgtatgctagcttaattaactggtgatatgaaatgtattgtcggtcacagtgttgatacctagttttggtggtgattaaatgatgaacatgtgtacctgagatgagcttaactgtttttgggtaagtacaaatagagacaaaatgtgcgtgagacacgcgtgtcatatatatctacaatgtaacaaggtgaggtgttgctggctagtgtggtagcagcatgtggttgtacatctccatttcttgattggcctggcccacccaccattggttgctctcatcggcaaaacactattttgcactttcctgtgataagaggggatccatcagttggttagatcagcatatgcgaaatgctctcgacttccaaatatagggagggttcagcaagccggctgcaacggctaaggctacggctgcacacggtgagtgtgacactgttcataccggttacggtgcaaccatgaaagtagcagccaaatagaccataatgtaatgacttctaaatgtatcaacatttaacactctgagtgtataactgtaatgacttttaaacattacatttgatcatctgtcttataaaaaaactatataaatatattatttattttgttatgagatttatcgttaaatggactttatttctttttttttgcatattttaatattttaaataagacatattatcaaatattatgtttaaaagccaactattacagattcaaaaagaaaatgatatattaaagtacaagtgaattatccctctccattcattaacagatgcaatctgatatgatattaacgtcgtatcaggttgcacggaatatagtcatattttctttttctgaatactgacacatcagtggaaccagccatcataataccattgaatctaatttaacccgattttatgtatccggtatcgcgtttagggatacgatttaaactcgacggaaatacaacgaatgtaaagtggacttatcctgcccgaatttacaaggcccaagcccaaaaggcccatccaactcacatcgggctacgtgggccgcccggcccacacacaacccagaaaaccgccttactaccgacaatgttagctccctctctcttcctcttcgtctcgactctgaactaaaaactcaactcctcccaaaatccctcgccgccgccgccgccgccgccgacgacgacgacatgggccccaccacggccaccgacaccggcgcgaggatgaagcccacgaccgtcgcgtcggcggtgcaccgcgtccagatggcgctctacgacggcgccgcggcgtcgagggagccgctgctccgcgcggcggcctcgctgctctcggggccggactacgccgacgtcgtcacggagcgctccatcgccgacgcctgcgggtacccggcgtgccccaacccgctcccctcggaggacgcccgcggcaaggcggcgccgcggttccgcatctcgctccgggagcaccgcgtgtacgacctcgaggaggcccgcaagttctgctccgagcgctgcctcgtcgcctccgccgccttcggggcgtcgctcccgcccgaccgccccttcggcgtctcgcccgaccggctcgacgccctcgtcgcgctcttcgagggcggtggtggtggtggtgatgacggtgggttggcgctagggtttggggcgagcggcgatgggaaggaggtggaagaggggaggaaggtggagatcatggagaaggaggcggctgggacgggggaggtgacgctgcaggagtggattgggccgtcggacgccatcgagggctatgtgcctcgccgtgatcgcgtcgttggaggtgaatcgccttttgctgacctcttctatttctatttgcattgagcattgattggtttttctgttcaaattatttactcgtttggtttgattgtgctgccataggttagtagtacgatgagtgaggtttatggcggtggcattctctgttatcctttgtgctcaaattaggtagagaaaaaactttggaagatagaaaatggaggaatttgtagtgttcgtagtaaattactttgagtatcaacaattgttgttgctagtagcagttaggaaaattctctgtaacatgtacaactacaacattttggtgaactagttataaactccttgtgtaaaatctccctacctgattagcaaattagtagcatttgtgtatgactagaaacaatcaactaggtaataattgagagctatcaaatatggtaagggacagctgaagaatagacataaccgtggtgccatattttttggttgcagtcattcaaattacaagaggacaactaggcaattcactcattttgtttagacctacatattgttgttgataagggacgctagaacgaagataggagattgagagagtaattaatttttggaagtacgttacagattttaatgggaggtagtgacttcttttttgagagattagaggggtgagagatgagctgcttactttgtcaatgaaaagcgctcaggttttgttcaatatttccccgaagaaatacaaaaatcatgtctttgtaagcatcatgtgttgttcctcttttctcactgctcacggaggtgcctaaactgcctaacaaggtggcaaactggtccctagtgcctaaacaccaagccaccaaggcagtggtggtttggtgggagtgtggtggtacttagctcctacctcctaggcactgtttgtttttcttatattcaaataatgttctagaactagatgtgacaatgttacaagagtaacaatagttttacttgcaggcacatttatatatatgaaaaggatatgctcattcttgctctttgttcgacctgtcttagtttcgaacaattgaagaaacaatgagcttgtgttctgtatttcagggccaaaaaaagaggctaaacagaacgatgcttgtagtgctgagcagtccagtaatattaatgtggattctaggaatgcttcttctggtgaatccggcatggttcttactgagaatacaaaagcaaagaaaaaggaagcaaccaaaaccccattgaagatgttcaagcaggatgaagataatgatatgttgtcgtcttgcatatcggattccattgtgaagcagctggaggatgtagttctcgaagagaaaaaggataagaagaaaaataaagcagctaaaggaacatcgagggtaggtaagagtaagcctgcaaaaagaccagttgggcgtgatggacatgaagtggactttacaagtacaattattatgggtgatcgtggttcagaaatgatggatcatggtgctctgggtcaatataatttctcaagttctatattagcaaatgagcagccttcatcatctcaatatgcagcgatagattcagtgcaagcttacactgaagaactagatgaattatttagtaatgcagttaacattgcaaaagacgagacaagtgatgatagtggtagatgtacactaagatcttcattgaaggctgttggatccaagaatgcagggcattctgtgaaatgggcagacgagaatggaagtgtgttagagacaagcagagcatttgtaagtcactccagtaaatctcaagaaagcatggacagttcagtaaggcgtgaatctgcagaagcttgtgcagctgcgcttattgaagcagcagaagctatttcatctggcacatcggaagtagaagatgcaggtgaacacttattccttaaccctgtggtgctttgacatgcagcttttgtttttgatatgtattaacctgtgccttttggtaacagtttcaaaggcaggaatcatcatactgccggacatggttaaccagcaacagtacaataatgattatgacaatgacaaagatgcaggggaaaatgaaatatttgaaattgataggggtgttgtgaagtggccgaagaagactgtgcttctagacacagatatgtttgatgtcgatgattcttggcatgatacaccaccagaaggctttagtctaactgtaagaattcttgagaaaaaataaagtagcacttcttcttttttttccttctggttgaatttggcatgtcatgccttttttccttttcagctgtcctccttcgcaacgatgtgggctgcattatttggatgggtatcccggtcctcattggcctatgtgtatgggcttgatgaaagttctatggaagatttgttgattgcaggtggaagagaatgtcctcagaagagagttttaaatgatggccactcatctgaaattagaagagctttggatacttgtgtgtgtaatgccctgccagttcttgtatcaaacttgaggatgcaaattccagtctcaaagttggagattactctggtatggataaagctagttgaacaaactaattaaaaagttaaaacattttttaaaagaaaagaataaggactccgcaattggttagtgacctagttgaacctggatatgtatttactggctagtacatatagtttttcagcagcggctgtgaagaggcttttcgttgcattttgttctggtatctagacacctttgactgagatcaatcaagctactaatatcttggtcagtttaacaataatttcttagtcatttggggttctctctcattcataagtgtgggtgatgagctgcgcatatctggaaatagataagacgaagtggaggctgtacgttacagttattctgaattagggccagtctcttttttgttgattctattgaagacagcttaactgctagatgttgccaccaagaattttatttgttagtttgattacagtttcagtaattaacatttagagctataattagtgtgcatctaatgtgtttttcccctccccactagggatacttgttggacacgatgtcatttgttgatgcactgccttctctgagatcaaggcagtggcaattgatggttctcgtgctgcttgatgcgctctcactccatcggcttcctgctcttgctccaataatgtcagattcgaagcttttgcagaaggtgatgatgcctttccctgcctttctgctatgcaagtagacggatgcacatattctttttaagaaatctgatctttcttcccttttgtgtgctgcagcttttgaactcggctcaggttagccgagaggagtatgactccatgattgatctcctcctcccttttggaagatccacgcagagccaggcatccctgccaagttaaacctcaagcaacacaagtatctaaatacatgtttacacagcggagtaaatagagagaggttctacatatcagcgtcagcttggcagtctattcggatatactatcataatggtgcctcttgcgtctggttgtttaggtttcggaacacgtcttgcaaaatatcggttgctcccagttgcttcaactatcccctttgcattggcgtcagacgtacaagcggagcgggcactgattcctgtcattctcaggaattgttagctttagtgaggagagcaaaagataactgcctccagaacaatttggtccactatggacttttatctctcattgctagcgcagttcagaattgtagtgcatctttgggttttttttttacctcttttaccggtgtgcagtttgtcaggttagtacagccgaatttgaccagctaacaacccactcgtgagtcctaataggtgagtgctagatatcaagtggtatagtaaacccagtgttagcatctataaaattctgaattttatgcctgtcaatctcgcattcatggtcaatcggagacttgcagtggctgtaactttctacaagttggcatctcattgcagagagagaagaacaagagcaaaaaggttggcggctgatggctgaagtgcgaatacattgaaaacccaggtgctgccttatcgcaagagacttaaaagggaggagcccaaaaggagaggttagaccattattagcttggtgtgaagtgtgaacagagctgcctgagcttgaggattagcagcaaacttagtagcgtgtgtgcctcttttttccatgtgaaatcgtcgctaatttggattcatgtcctgattggctccttgtctcgataggaatttgacaatcctttaggtatttcgtctgaccggttgcctagattatccactctataaatgatagcagtatcagccccaacgcccaacaactagcctaaacgctttaacactacctaggtttttgttttggtgagctggagatatgtgtatgcatctaacactgatattccatctattccaaaataaatataactacgcctagtacttaaaaaatatatttattaaaatataagcggttctagcactatttaatgcaagttacctttcatctaaacttctcatcttacccaaagactcccatcctcagaaatatccatattttgaaagtaaaaattcaacggaacgtattttctgcttagctcatttcattgattcttctacaattagcaaggaaatagtattttcctgcttagctaatttcattgattcttgaactgcttggttcacaaaccaggaagagcctgttttgctctccatagtcttacgtggtgtttggattagtccatgtatttagaaactaatttaatttaaagtactaaatatagactacttacaaaactaattatataaatgaaagctaattcgcgaaataaattttttaaagcttaattaatccataattagtaaacattatataaatgaaagctaattcgcgaaataaattttttaaagcttaattaatccataattagataatgtttactgcagcatcacatagactaattatgggttaattaggcttaatagattcatcttgcgaattagtccaagattatagataggttttattaatagtctatgtttaatatttataattaatgtcaaatattcgatgtgataaggacttaaaagttttagtcccatctaaaaaaggtctaaatctatctcaacgaattggtctttcaagaatgggacaatcaagaatctcacagcaacttggtaaaagagcatttcacagagagagagagagagagagagagagagagagtattgctcaagggaagctagtccatccatacatgaactcaacagagatatgtacaacagcaatggtgtgaacaatagcagtaacatgtcaacaaaacgcagaaaaataataacgaggaaaaaaaatggcctacaaaactgccggctgctcaccctccctgctccacctcagcagcctctcaacaaatcagaagaacaaaaaacaactaatgtcagcatatgtacacaagtgtgaagtggccacaaccaaacaccggcgcctcgccctagcgatcagtctccagccagctcctcaggttgcacagggcctccgcagagaggctcttgcaactcctcggcctcgccacccccgcctgcccccccacctgctcctgccgcggcgacccaagctccgagacgaagcagacgacgatcaccgtcaggttgtcggcggtctcgagcctcttggcctccatgacaagctccctcgcgcacctctcggggtcgtcgtgctgccggagcccccgtcggacgatgctcaccgcgtgctggctggtcatcacgtcccagatcccgtcgcaccccatgatgaggaactcgtcgtcctccgtgagcatggtctgtcggaactctggctcggcgatgagaggggatatcgagccgtcgggcattttcatgtcccagtcccctagggcccgtgtcacggataggactccgttgaggtagccatcctcgatgtatcctccggatgcagcaacccgttcacactcctcggcatagtttgctctgtgatctcgagacatctccatcgctacgcctctccggcaaaggaccgcacggcaatcccccgcatttgcaaccagcaattgcctgcaagacagttcagcagaacctcgagtgagcatccacactgaagcatgagatgtgcaactatagatactggatatgtttttttttaccttccgaagactaatgcggtgagtgctgtagttccggaagagcggctgatatctaaatcatcagctaaggcaagatctgcttgcaagaacgctctgcgcacagagttctcaactgactgaacatatgtttcatctacttgcgatgcttgtgggaactcactgtcctcaaacaggaacctcattgcatgccttttcatgtaggctgcagcatccaggcctccatggccatcgaagacctaaaattgcaaagggaagaagcacgggcaataagttcaaccattgttgctgaggaagtagcattcacaaatcacaaatcagggtaggcattcacatagaagattacacttaccccatagaaggcactaggcaacggacacaccaagagcgatccaagatgggcagagagatcatctatccggatgtgctcatcttccatgtacctcctaggtccaatatcagcaaagctaccagatcgaatactgggaacaaactgtagtgcatcaactgatatgctcggtgcaccagcagcactctccaacccctattaataatgaacagaaacacaaaaattactaatcttatttctcagacacaaaacaaacataaacaaccaattcttccttaatctgctaaattatatacccagcactgccactgacctacttgcgtagttatgtttcaaacataatcctatcctgccgctcacgcagcactatgatttaccccactaccccactctacactgaaataagatactgaacaagagctgaaaagtttcagctacagctatagaaacaggacaacacttttaggctagataaacaatcatctgcgcaaattcgtatgataagttgaacttgcgcgaaagcgcataaatacatactacaactcaactaccactagcactatctacacaatggatccaataatatcagcacccaccttctcaaccttctggcctacaaccaccaccctataccccctaaaaagggactacttttttttttcttacaaactgtgtcagtcttttgcatccacgaacagaaaacaatctcgtgtaataaacagaaaggcagtaaactccataataaacctaaaatccaataacaagatgacagcaataatttacatagagatatctaaaaatcagagctgattacaacaactgaaagcacctttttcacatgagtagtattaacaaacaatcctaaaattactgaaaaacagctgctaaactgctagtaatccttgctagattccatgttatttcccacgaaattcttcgatctcccaactgaaatactactgaaaacgtagaactacagaacacaaagttgagcaactcaccatgtgaggcacctggacggcaacctcgacctcgaccaccggcggcggcgcgaccgccgccgcggcggccacctcctcgacacccttggcgacgcaccggtggtacggcacctccaacaccggcacgggctgatgcatcacctccgcctccgccaccatctctcccctcccgatccaaacaccaccgcctctccggtcaccggagaaaaaaaaataaaaaaaaaatcaagaaaccgagcagcgatcgatccgcgcgagaggccgcgatccgaggggggagagggcgatctcgatggtttctaggacacggtttcttgatctgaggaggaggaaggagaagaggaagggggaagaaatgggggaagaggaggaggggtggttggtatttatccggtggcggtgaccggcggcgaccggcgacgatgcggacgggtgaccgggtggtgccggtggcctcaccggacacgtggcggtctcacgcccgtgtgattgcgctgccgacctcgcctccctctttcttctagattggatggaggccaagggagagtgataaaagatgtgttttttttactaatctagagttctaatcaaatgatttactacttacagtgttaattactggattagttagaggcttgggagtgatgaagaatgtgtcttttttttttgagtggtaatcaaatgatttattgaaatgtttgtgttagaaggaagaacaagctaaaaaaggatgtaatttttttgcaagaatgatttggattggaggtggtgagatgcactttggtttgaaaaagaatgtgtctatttggagtgctaatcaaatgaaatggtctatggaaatgtttgtgacacaaggaagaacaagctaaaaaaatgtaattttgcaagaaatatttggattagagggagtggttcttttgcatatgggtgatggtggtggtgtttatatatgcacttgtttggtttgatcagctttgattttcgggaggtgtggtcaatttgagtgttttttgtgctggtttacagtttttgttgcatacgttgtttttgggtggttaatttgaggttaggggtgttacaaacttacagtacattgattaattagctggtgttttaaagtgtttaattactaactcgtggtaaatgcatagcaggtttgctcttttcctgtttttaaccaggcagttttggttgggaacaaaaggcaggttattcttacttttttgaagggaatataatgagaatcacacatgctaacggtacaaagattactactttttttaaggggaaaaaatggcaatcacttgcaggtgggagtgactgtttcttgcacgtcatcaactgaatctctgtccacgtgttcgaacttgctgttaatcactgaacagcagagcagcttaagtagcaagaaggaatctttgtaaccctttgtcatcttatctcttgggcaagaataagatggcaaattagattgttgtctactgcctgtcagtggaatcacaatggaagatatcaagataagtacatgattaagaacaattagagatttagaggatctgagaggcatcaatcaaatcttattatgaaaatttagccactattatcttcctgaatatgacatgacaaagagagacggtggatcaaatcaaaacggatataagaaaatcgagtttttttagtagggtatgttttatccggcctctacatgcaaccagatatatatagcctttttaaattagaaacttagcttctcaaataacacaatctgaaatcgagttaggaagttgatgctttatgggcatgattagttactagtttattttatactacagttcctgcaacagggtgcgatcatttaaaaaagaaggtggccaatccaataaatagattgtactagaaatattagtgaataaattacatttcaatgtagttagaggcctagaggacgatcatgtctgcaaaatttaagtaaacatattccaacagaaattttgcaagaaaagtatttttcataacactataatgttatgaaacatacttttcaagacaattcttctcatatggttttcacacgttaaatctgaatatttaaactaaattggcgaagagaagttgttcttccttcatacacccaattaagttataagattgactgtgatagtgtgatatctatccccattggtgtctacagtacatatagcttatgattatttttttagaaaaaaaggagtgaagtaaatgaaaaaattgctttccaaataacagacacaaacggtgcaagatttatatataatgttgacaaagcagtggcacaccggacagcctgacgtaattgtgatccaaatcactgttctaacacaggatgagctaatccgatccacttcaagttcataaatgacacaagattgcttcatttggggataaactaaataatccaaatatataatttataattgcaatgctattgcttgcagttccctttccttttcgtatcactttcttcctacaagaagcgaactcttgtggcttcatttgttcctgacgcatcttcactttgtacaagttgaccaaaagaaatagacaacataagaagatcttttacaattgaatggtggataatttaaggaattgtgaagtaatatttttttagtcagagattgtgctccatttcttttgacaaatttaattgggaatttgggattgctctttattttttatcgaaaatattacttgtttcttcagtcacaagataaacaaaaacttatgacaaatgatttggaatagtaaaaaaacccaaatatcagacaacttcactaacaccacatatatagtactgaaagaaaatgttggaatctcacgcaggcctcaattgaaacaactttatattttttgtcgaaactattacttgtttcttccaatcacaagatagtaaaaaaaaaaactagtgagaaatgatttggaatagtaaaaaaccacatacacaaagtatcaaacaatttcattaacagcatttatagtactgaaacaaaaatgttggaatctaaagtgaaactctaccagctctcaggtttaagttagttaattcatttttcttgaagtttcttgtgctggagccaatgggagggcaacaggtcatctcctaagaatagtggtgacaaagaaagttggcccctttcttccactcctgtcctctggagctccctttcttgtctgtagttggttgagaaaattggcaagcaagactgtcttcttgttttttggggcctcatcatcaccatcactaccattcattttaaggtcacctttgcaagaactgaaaaaaaaagccaggtggcagtggcactaatcacactccagctagtttgtggattgtaagaaaaagagggagagaaatgcagcatatatgtattctggatttttttgggggcccctttcttcttgttgttcagccacaaattcaggaagcttctagatgtttggtctgatggaagacaaccaaaatggcctgatgagtttctggtcaggaaatcaaatcaattttgttattttccagtgcatgcatgattgagtagttggttagggatgagcaagcttatgaaatatgtggttgttttatcttgttcagcattatactaattgtgtatatatatgtaattaacttattgtcatatgcacaagaatacgtaacagttagacaggataagatttcttcttcccactgccttaatattattgtttttggttcactaataaaagtttttttttctagtcttcctttggtttctttccaattttaatgttttatgttgggtgtaggtatgcattcctcattgtatcctacaagccacacctgaaagcaataggtgcaaaatctgaaaacgttacaggagtacatcatatgacaacgcaatctaactaccattgtgaaaaagataatgcaatgcaatgggattagcaataaatgaatactatgcaaaacacatgagtatgtcaacatatcaagaatgataagtaccagtcagtaggccaggcccagcccacagcccagcccaaaaataaattcataacttgccctaaacaagatttaagtctatctcacattgtgcaccactggagtacaatagcataagctcaggcataatctgcaaatttcttttatatcattgtctttttagaggataataacattgatcaacttattatctaatggcataataatatttcatagtattaaacaggaggaaacaaagtccaatctcacttttacatcatactagcttcttgctagtagtaactccttagcaacctaatccatttaattgactactttgagaaaaacacacaaaaagtctatgagcgtgtttccttttgtcaagtttcgtgtatttttgatattaagagtctaaccaccaaagtgtacttgaataaaaagtcgtccaattaagctgctatattcaactaatccattcaaattttggagtttgaatcagaccgactcacactggcccatatatgcataccgcataaatttctcaccaatcaaatgtcagaaatacttcaataggttttgaaagtttgaaacaacaaaccgtgtatacatttcatccccacacacattgattgcacgcagctgacaaattcattgagcattgcaccaacgagttgaaaatttcaaatccaaggaactgatcagttcgtccgtagtaagtactagagctactgctaattaattactacatgatgcagactttatcaaattaatattgactgtatgctcacatgaacatgtgagtactatacatggccaatcatatagagacaaccatggtaaagatagcttttgtatttttagccaaaccttcaatatttttagaactgcatgatttggtctgaaatttgaccgatttaaggtgctacaccaaataaaaaatgacacaaaatgtggattagactgagtaattaaattaagatggtttggtttgatcgggtcggttggacctgttgagccgtagcgtcctgccggccgtccaacagcctgtcatgtcggccattgcttccgattaatttgtcttaggctacatcattaccagcttaatgcttagctacttctcattttcagtgaacatgattttcgacggatgcataaacgagtacgtattttatactccctccattccaaaatataaggcacaaccaattttcttagatgttcctgtaaaatcaaatgtgtttttgattattattctgtgatgaacaattgagcattggagattagtggttttggagatgattggattcacaggtgatcgcaggattcattatttcatgtgaccggtcagaccgggctctggtagccggtcggaccggcggtatgcgcgtggtcaggtggtctgaccggccgacactgtgtcggtttcggtttcgggttgtttgtttggatatccatgattatttcataattatgacttctagatggatactatactatgtaatactgttgtttgctactaatgagtcaagttggagatagcttggtctcggaatatggtttctttgtttgttccatgtgtaggtgactcgatgtctcgggagagtatttgcggtgatggaccaggagtcggcttggggataaggcgacgtccgtggtggtcagagatcatgcgggatacttaggctagagttgatgcacgtggttgatagagattccatatggcatatgatggagttattgtgtgcgtatgggatgcggagtcaaatttggaaggagtccaaatttggtacgattggttatgtaaagtttctttcttgtactagagggtttcctaatgtgtttaggactcttagtatgagtttggttcgtggctttagcctgcctacctcatgtataaatagagggggagcgtgaggcttcccggtatcgcttttgagagcaattgagttgagttttgagttagggtttcgagtttagtcgaaatttttgtaaggagtgctgttggtgcactttgtaaacacagagagaatcaataaagttgtcatctactgtaagagttcttcgatttgtgtttcaccgggtttcggcggtctaaccggcgacacaccgactgtcagaccgacggcatcgcggtggttagatcggcgggtacacggcggtcagaccggcgtcggtgacaggcgtcaggagcagatcttggaggtcataccggagattcaacaccggtcagaccggcggctacgcttcagtcagaccggctaatctactccggtcagaccgatctcatcgaaattgagggtaacttttatttccgctaaaagttttcggtttttgggtatagcaaccattcagccccctctggttggcttagttcttgtgattcgatcctacaagtggtatcagagccttgttttcttctttggatttttatcgatctagagtttttgccatggctactcccgctaggttttcaactaagcctcatgttttcgatggaacggatttttctcattggtatagtaggatgcaatcttatattatggctgaagattatgatatttggagaaaagtttctcatccttatgtgattcctgaaactattaatactgctgctgaaaaaactgcttttgaacaaaattgcaaagctcgcaatattcttttgagtggtatttctcgtttggattataatcgtgttgctcatcttcaaactgctcatgagatttggactgctttgagtaattttcatcaaggaacaaataatattaaagaacttcgtcgtgatcttttcaaaaaggagtatattaaatttgagatgaaacctagagaagctttggatgactatctttctcggtttaataaaattttgagtgatcttagatctgttgattcttcttatgatgctaattatccacaatctgagatttctcaccactttttgaatggtcttgacatgtctatttgggagataaaagttacatctattcaggaatctgttaacatgtctactttgactttggattcactttatacaaaattgaaaacacatgagatgaatgttctttctcgaaaagttgattctaagtcgagtgctttggtttcctctttggatgttgatgcttcttcatctaagtcttcttttcttgctatttttaatgccacatccgatgatcaactcgaacaaattgaggaggaggatttggctttggttgctaacagaattgctcgagctatgaataatgccaggaagaacctcaacatgattttggatcaatcaaagattagcacacataaccgtggtttaggttttaatccttatgctcataattcttgacatccacctgttgtgttaggtgttggtgctagaagtggtgagattttggttaaacctgatactaataaaactgtgtttaaatctgctggtatcatatctactatgaatgcatcttcttcaaaatccaatgttgtgcatgcaaaatctcctgttgttgctcatgttgctaaatctactagtgctaccaatgtgtctaatcatcgtgaaaaatatacttgttcttttttggggcaaagatggacatattgttggtttttgtttcagattagctcataaacagaaaaaggagagagagattgcctttacaaaatcaaagtggcaaaaatctggttttccctcgaggaaaccggtcagaccgcagtgggtcccgcggtcggaccggcgacctatcagaccggctgaacagcctcggtcagaccgaccaccagtcagactagcggtgatgcctcggtcataccggcccccggttagaccggctgcacaccctcggtcagaccggcctcggaggaatttttccataaattctaaaattgattttgcacgtggatatatgcctattggatcttctggtcgtgtgtctcagtactggattcctaaatttttattatcatctaacccaagtactgaggcttcgacttctgcttgtgtgtaggctttggtgacaaagaaggagaacgtgtggatcgtggattccggttgttcgcagcacatgaccggtgataaaaattggttctcctccctaaagaaggcatctaagactgaatcgattatctttggtgatgctgctacaagtgtcgttctcgctacaggtttggttaaggtaaatgaaaaatttgaattgaagaatgtagcttttgttgaggacttaaagtacaatttgctttcagtttcacaaattgttgatgaaaattttgaggttcactttaagaaaactgaaagtaaagtttttgattcttgtggtgattctttgttgaatatttctcgctatggaagagtgtttaaacctgattttgaaaatcctgtttcacctgtgataacatgtttggttgctaagtttgataaagatgtgatgttttgtcatcgtagacttggacatgttggttttgatcatctcactaggttaagtggtttggatcttgttcgtggtttgcctaaacttaagaaagatcttgatttggtttgtaccccgtgtcgtcatgctaagatggtttctacttcacatgctcctattgtttctgtgatgacgcatgcaccgggacagctattacatatggacactgttggtccagctagagtgcaatctgttgcaggaaagtggtatgtgttggttattgttgacgatttttctcgatattcttgggttttctttatggcaactaaggacgaagcttttcaacactttcatggtttgtttcttcgattggagcttgaatttcctggttctttgaaaagaattcgaagtgataatggtggtgagtttaaaaatgcttcttttgaacaattttgcaatgaaagaggtcttgaacatgaattttcttctcctcgtgtttctcaacaaaatggtgttgttgaaaggaaaaaccgtgttttggttgagatggctagaacgatgttggatgaatataaaactcatagaaaattttgggctgaggtgattaacactgcttgttatatttcaaatcgggttttcttgagatcaaaacttggaaaaacttcttatgaacttcgatttggacatcaacccaaagtttcacatttgcgtgtttttggttgcaagtgctttgtcttgaaatctggaaattttgataagtttgaggcacgttctaccgatggattgtttcttgnnnnnnnnnnnnnnnnnnnnnnnnnnnnnnnnnnnnnnnnnnnnngagatggaaccaaaagattacatgcgcg

SEQ ID NO: 59821 - DNA, 14473 bp, Oryza sativa
ttggatccttatccattcactgaagggtaaaacagtaaataaatatttcataaaaagaaatttctatttctctttgtatatttttaacccaaaaccgtgggacccatctaacggggttaaaagtgagggcaaacggtgggttcgtgttcaaaaagatagggcaaaaatgcaaactttaaaaagtaggggtaaaacagcagttgaggttcaaagtgagggtatagatgcaattatcccaaagaggatccatgccaccgagaagaaggatccctgagtttccagcaatctagcatacactaagattttccactccacgcactgtgaacatgatcatcaccatcatctaccaaagaacacaagagtaaagtattacgcttccgagcggcccaaaccggtctaaaaatgcttgcctctcccacttttatccttcgagcgtcgcctcatttttgcgcaccgctccctggccgaatcttcaaagggggagtacacgcttacccgctagaggagttccacgctccgacaaccacattaccatcgatccctaaaaaagagcacaaatcaaccactctgagatagatagaaggtgcatgagcgatgttctggtactctctactggtagtattattctaccagtattattaggggtaaattaataatttaataataccctaattagttatgttttcttttctaactaaatatatctatgattatctattacgatgacattactcatattgcatagaaaaaaatgtttagtcgctgataaatgatgattatacccctccgcacctttttttttataataatgcccctccgcgttttttactaccactagttactattgtagtataaatagatttgaacccttcgatcaaatgaaatcaatagttcatattgttttctacttagtagtagagaacatcgtaatggagctcaaggtgcgtagggtacctcatgtccataacaccaacaaataaaaatggtgcaaataccattgagtatttgagtatatttcttcgatgctttctggtacttatatggattgtgttagattacatgtttgttcagcttcaaataccactataaatctataatcactgttgtcgaacttttatacttttttataatgtaaagtatgatgggccattggagcgaggggtacacttccttaataattaagatgttaaactccagctccaaatagtagggaaacatcactgaatctgccttcaagtctattatactccatttatcatcaaaagatccatatcatatccttgtatttcttaatgaaaggagaactaattaggtcgcatgcgccagccattcacacaagagcttaacgaaaagaaaaaaaaggtggagaacaactcacagaatcctcttattctatttatgtttgtgctgtaatctccgctctttgctcgctgacttgcattatcttgcaaaaagcaactctagatatgcgcgtccaaatcaacaactatacaatcagtggctagctagctgctagctagctagtgatcgatgcaagttgatactaggattaagtatactattacccggtttgatcgatcaatcagctcatgatcaacactaaaccgtatcgatcggcgtcacatctcacatgtacttccccagttgccggttgccccctgcatcgatcctctttcgtgttgcctgccgcctgccgcctgccgctttcagctctgtgatgttggaaaactattctaaactctcaaagatgacatcctctcgttatttatatatcatctaaatagttataaaaaatattaaaaaaataataagatagattaatatatgataaattactccacaaatatgcaagataaaatttaacttgtacaggttgcaatgaaaaaaaataaatttaactaaatatatgttaactaaccatagtttaatttatgtattttctataatttatagattttaacttgtatgtttatggagttatatatcacatattaatctatttatttaattttttataactatttaaattacatgtaaataataatgtaaataataaggggaagttggctcgaaagttttagagtccactctcgtgatgttgccactcgtacgtgagctagcttagctatatattgcgcacatgtgcagcaaccaaacctagctgctacgagcaaggcaaagcagagccgtcagttgcggtcagtttccctgtcacctccaggcgtccaggaacatacacacacatcaaggtagtggtggccatggccgcgtgcaggtgcagcagccgcctctccctgcagctgcctcctccgtgcttgctcatcgtcctcgtcgccggtaagtgtatcgtatcttgcatgcatgcgtacgtgtgtgtgatgtgtgtcactgtggctgacacggcggctgggatgtgttgttgttgttggttttggtgcagcggcggcgatggtggcggcggcggcgacaggggcgagggcggcgtgggtggactacccgtcgggggtgccgtgcggggagacgatcccggtggagcagtgcgacccgggcgacgcggcggcgaacagcgcgtgcatggacgtgtgccactacggcggatgccggcgcggcggcgagtgcgtctccctcggcttcggccgcggccggggatgccactgcaagtgctagcagctgaactgagctgagctgatctctgatctgaactgaactgatatgctaatcaggttgagcaaagtagtagaagcagtaattaggagagaataaattaatgagcgctaagctgctgtttgtagatgctcgcttagctactgtcccgttgctggctgccttgctagttttcccgcccttttttgttcctctgttttttcctgatcttcgtgttttgcatgagttggtagcacattaggtttgcttttgtccgcgctgcctctctgtacaaaagcctaaggcgtgagctttgaaaaatgaaatcgccaggtgccttttgttttcttgcacctgtcttttgcctcctttttacaacaagctcgtgctaccaagtaccagttggatctaaacaaacaggagaaaataatcactggattgtacttgcggatccggagtgttcttttggttgccagaagcatgtgtacttccgttacaatgtttgtggtcaagagtttcataatccatgttctagagacaggaattctctaggacgcatcaactattcgaaggtgtgtatgattctccaggacgaaataaagtaagcaccattctgttcttcgggaccaacattgtcacacaccatccactctctgagactcggtatcaaatattcgcttgctaaagcaagatacttcctccgtttcagtaatatgaatagatttattaacattaatatgaatattgaaaatattagaataacttatattgtgaaacggagagtagtactactacaagatgtgcgcattcctgtgagaatataacaggcaagtaaagaaagcccacccaaccaccaaattgcttatcctccaaacgacaacaatacacatcagtaactctatcttcacaagatgatcatcatcatctagctcatgtggcagacaacacgtacaaatacaactcatacatcaccacaattcacgaagaacaagttacaagggaggggatagaaaggtacatgagcagttctgcactacagattgtccatcttttttttcctgttgaaaaatcctatactgtactgagaacacaaacaccgcaggacacaagtcttattcacactttgtaaacactacaaggctcaagctgatcaaggacatcacattcggggtgctgtccctttaatgggggcgatgaacatcaagtggccggcatcagggacctcaaaacaaccacacaaacagggacctccaaacaaccgcgcacactgggggtggcagccactgtgttgtttcgaatgcaagtacaccgattcgagattactctatagtagttgtattagatatcagcaaggtaaaaaggagaaaccacgagatgtactacacaacaagctgcagtccagactccggataggcttttacatttggatagacatcacctcaccaggcacttttgctcgtcaagcacacgatgcacacctctgaagttgggtgtcagcaaggctgttctgacttctgactttagctatgatcaagcacacgatgtacacctctgaagcaaggtgccagcaaagctgttctgacctcttgactgtagctatgaatctgtgggcgtggacaaaaataatccacacctttgccgattgtacatgaacaggatatcgggcaaacttgagaactgtgcagactttggagtcatgtatttacagctactgtacaggatttttggctggcctgccgattaatcgacattgctgaggcagcaaactgcatcgaacttgccccttgacatgcaatagttcaccatcaataccacatccatcatgtgtgttgggcccagccttgagcctcacagacttaacctggaaaagttaatatgtccgtgaactaagtaaattaaagaaaagagttttaacatgaaaacttctggataacaataaaaatatcatgacaggttcaataaaaaccagaaaattctaacgtaatatatgccaatcccgactttataggtttacccttttttttctctcatctatgattccaatttccagaacagattgtgaatggcatgtgaaaggtaaattttttcattacacacctacaattgaaccaagttgtgcagtgaatccaggagatttgcaataaaaaagaaaataaaaaatacaataatcacatgacatgcacaaaaagattttaaaacaacagtttctaagaatgaacgaaaaccttaatatttgaccaagagaaccaatcgtattaccttcagatattccacattgggaagagaaatatgctttccaaactgcaaaagcaccaaaaatttcagtaacctcagcctcccacttccaccaaccaacagtaggtccaggcaattgtcatcgtattcagccttaggagcaataacctgagagcttaaactctgcacagtcttgcatgaatggttgcataccagtacaccaagataccgccccttcctaactgtccatctttcatctaagcttgggactagttccttagtcagaccaagttcaatatcatccaatggaccaggtaagtcaatgggagtctctggttcccagttaggttgattatcccatttaggctcatcatcccacttgggtcctgaatcccacacaggcccaggatctgaaattgtggaggaggcgtcttctttgtcatgtgttgtggtaccacgagaggaatttgcatcatttgtagcacccgagcctggccatgccttttctgtccttgatttcgatttggatctacgccagttgggagtcgatgaaacatgagcctgaggatggatcacttcttctggttctttgaaagtacttgttctccctaatgataggcgctttgattttgggtcaagtgcacgaacaagttcagagggttcattattagcatgtggactcgaaacctctagatctccacctgacattattcctgtagacatgattgaatcaatgctagataaacttgaggcacgaggtagacattctactcgcgacctccgaactacatcatcatagaggtctgatgcatcaactttatcttgcccttccacaattttatgctcaccaccaccaccatctgatattggaagatactccaattcaaagttatactttggcaagcacaagaatttcagaaaaccggctacaaagtaacggagaggaccaaaacgcttctggtatctctctgagagttcaagaactgcaatagaaacaaatagtcagattttctgcttccatttcaaaaaagaattaatattgatccaacaggaaaagaaaatggtctgaaatgtcaattatgtggttaccatcactaacaaaaccaaaatatgagactgttgtgccaaaatggatagtcccactttgaatccattcaacggcaaaaacatcaatgggtgtaaaacctccctgcaagcaatgaacagtttaacaaacattgatgtgaaacaaaaaagaaaaaaatgctgacacaaaattgtgagggcaataattaactcggtctacgttagacagctaaactagtacacagcagaactcttgactaatttgtatgcttcacagactttcagtgccctgctacattttcttgaaaagcagcatgtaaactttcatacacgattctaccttcagtgttcaaactaattcttgccagaacaatggtttcaaatgatggattctctaagaaaaaaaaatcagcatgacttctgtgtactttcagaactgctcgactgcacctggtgacagaagccccctttgacataagttgagctagcttactactgtggcatactaggatggctagttaatggagtacaataagcagatctagaaatgtcagtacaggcctggccaacaattccacatccccagggtccaactagagcaaagcagtgtgaacacatggttggcaacaaagagtaaagagtcatgatagctagtaactcaagagctggtatcatatccagcatcatcaataacatttaatttctttgatgcctagtactgaatcaataaatcatgtgacacgtatatagaaaaccataaatactgaaacaatataatgatgtttaccctgacaattgacattgctgcagaaatcggatctttaacacccaatactgtccaaacaagtgagttatcggaccctgctggtattataccaattggaacagatacagccacattttgatcatctctacaaaggagaccattgagaacctacaaaatgaatttattaatgcatcagaacctgtagttgacaaatgagcattttatagtgacatgcaaggagaggatggcttcagaaagtggaagacaaacatggtctagtgttcatagaagtacataggttttgagaagtaagcattaacagccctcatgtgataaccattctaggttagcagcgtcactgaaaatgatttgaaggttttgtgggttcgacaaccagttgtttaatgaactccaaaattgtgaataacaaagtaaaatattacaatatacaaatctgctgatccctgggagaagcttcttgaacttagtagtttccccctgaaacagttcaggctgaggaagtagaaggttggtttcagaacaaagttgcgaaacttcaagcaattttcagcagtttatataggtatatcctatttgttcttgatataacagatcaaaacttcagaaaagctaaggcaatttaagaaactgtaattggtaatgttgtcataaaagattaccttctctagttggtataccaaacacattaaaaataagatgaggaaacataaaaaaatcatgcatgaaattaacatagactaacctcattaacaatcccatcgccacccacacatacaattcctagaagacaggcacaaacatgaatcagatgatcaaaatagttatgtagaacacttcaggtaagatgtaaagatatatataccatctggacaggtactgaaatctattgttgatacaagagattttgcatgaccagcatgtgtagttttgaccacttccatcttgaaacctgcaagctgtcaccggcacttattattgttataaaaacaagcacaaccacatgatacactgaaaacaagttgttttgctctggaatgataagatgagtatttccatacaattgaatgctcacttatgtcaaagactatagtgatgccgaattttcatccctaataaattcagcattacagagatgataggacatggcagaaataatcttcaaggcatggcactagaagcagcaagattgatatgtaacgcagtagagacaacagtgtatcaagatattactccatcacacgtgtctatgtaataccaatatcttgattcaaatagactggatgaaaggatacaacagctacagacacacacagcgagagagagagagagagagagagagagagagagagatttaaaatcccttaaagttcaggaacatttcaaacatatgaatcataccaaccagcggaccttgacagataatgtgaactactagagccagagaaccttcaaaatggctcctggcaacaaatggatagcaaagcatgctccagttcaacaggagagatgattcttagggcacaatatgaactcaaacatgaatttatacatagagaagctcatcttggtaagatactgacaacatgaatattgatatggtcctctactacaaacgaattcatttttatggagatggatcaaggaacataataaagaaacagttcgtgccttttcatctacctatgcaaagttagcatcttacttgattactacaaataaaaaggtcaacacgattaggtatatgacttgcatttttatcggtaaccaatgtcaatggtaaataaggaaacatgaaagacactcattgcaacattttttttaaagttatgtaatgactatatgaccatagctaatgctgcaaacatgcttaagagttgatgaggcagacatcacagctctgattataaaataatgcacatgattctattcatctagacataccttgaatataggttccacttttccgtggaaaactttgctagatctaccatgtccagatcgaggattcaagatgacaagtatctttgggggagaccggcatttaacacatggatcaaacatattatcaaatggaatgagttcagatgaatgcttcttgctagatgccatggggtgaggtaatagatttacatagcattgttgatctgcaaaaccattaacccaccgaaaagcctcgtgtggagaagtggataggaaacgtaagtccttttgaatttttctaggcttcataaagcaggaaagtccactggatcttttttcaagagggcatgcatgcacagtgaagtgacggagcccggaatgatatgatacctgcaatgttaaagttgaaaagatcttagaattgctctcacatgatgtggacttgcagtgaaactcagaaacataccaacgcaatttacagaataaagtcaatgagctaaaaactcacagatacaatgtcctcgagcttaaggatattagaaccccataccaaggcttcagtagtgagtctagcatcaaagcaattgctactggaccctgatccagactgttcacctgatgcacttttggctttgttatccaatgtaagcttcccagaacaaatttcataccctaacaaatcagacttctcatcttcaattctgttgtcgtgtgtgcctgccttctctggatccttgatggcatcatcaatatccttttgctttaagaattttgaattgcttgtctccaggaatacaggagaagggttatggtctgctgcagttggagaacgcctgctacttgtgcgacgcagcactttatggattagccctcttggtgaagtaagattctgctcatgatgatcagacttctgaatttccatcttttaagggagcccagtacatgcataacattgggagatgctagatgctatagaaacatgccaataatggcatcactcttataagctcatggaacaccaacttatggctgtgtgcctgcaaaacatatgtaacagaacatcaagcaggtaataatggaacagatctgcgcctaattgattgctgtggcaacatcagtaaccaatgaaagccgcaatggatgagtagcagctactgagtgttcagttaaatcatcctatacatttataagaaattgcctacctaatatgatagtttagctagggatgcaagtggaccagatcaggctgacccattgaccccttctagttcatttgagtgcaaataatactaaatggaccaccaataggtgggagtgatccctagaccattaccatagtacttgaggaataaattataacagatcctacaggtgaatttttctaggtccaccatagccaggagctaccctgcatcaataattcatctctatttgaactatgccagacatacaaatatcgatgtatgaagctgaaacactcaacaccaaccttttaatcaaggacagagatcaagccaagtcaaaccacacagaccaaaagggaaaaaagtatttagaaagctacatagaacaattaatttatagtgccactttgtaaccaacaaaaactattttaaaatgaaaggttccgttgttggcctgtcaaaggtgatgacagaaacttaatgcatatacatatgcatgccattaggtgataataacatgagtaaaacgcatggtcattcaacatgtttaggtgtgtcatataggtcactacttccaaaatgcacatttaggtcactaatgtgagttaaatgagtcatgttctcatctaactatccatgtaagcataccttacacatgacatgccacctaagactgaaaaaattacttctgaaaatgtgcagacctagcaatgtaattgagtggaacaaaaacatagtgaaaataaaagctgctagggtttgatggcaactgagaacttgaactcgtcaaaataggcacatgaaataatttagtttcactaattccgtgtattgccaattagtagtgctctgacaaaggaaaaaatacacaaagagttttctacacatttctagatgcaattttttaatcctatgtggcatgccatgtgtacaaggtatgctcatgtggatagttagatgggtaaatgactcacttaactcacattagtgacttaaatgtgcattttctaagtagagtaaccaatatgacacctaaacaagttgggtgaccctccatgcattttactcattaaacatttttttgacaacctttatagaatttatttataaatatacgcatcataggtccatacaaataaagagtagtaggcattacttatcattttaagagatcccacagtgaacaatagaatttacgatttcatgaagtgggcattcatagcaaactcaactatatgttttatactcaatgaacaaaggaatcaaagggacatctcatgttgttacttttcatacagcatatgaatctgtcttatagtaaacttactcaatggtgcaaaccttactcttatagagttacagtaagatgtctgaaggtgaactacagatgtcggtgtaacttccatcaatcattagggaaattaacttccattctatacaaaattgtacagatatacatgagttattccgattatgaaacaactacacctatagcatctacatgatccttggtttgtgaaaaaacacaagtgatggacactaaatgttcctaaatcttgtgggttaggaacaaatattgctcaaggaaagctatctgctgcattgcccaatgaaaaaacaacaataaaaactatagtacatgaagcacatgaggcgtatcaactggattcatcacccgtccaggacgggaatgaagaaaccagttcagaaatgactcttaaggatctgcaaccaatggatagtggccaaggaaaagactaataagcaaccgaagagaacatcatgttaggtacaaccttggcacagaaaaactgcgtctacctaaccacagaaatcagaaggcaaaagcatcccacagccacagcccacaggactcgcaccacagccctgggcgaaacgccgccgcccaaaccgaattcgcgcgccttccagagcaggcacgccgaggaggaggaggagggcactcaccgatcggatcgagccggacggaggccgaggccacccgaagcctccccaccgccgcgggcgctccgccccaccgcaaaatccccgcgccaccgagctcgattcggcggcgaaaccctagcttggtcgaagcaaacggagagagagagagagagacggagcgcgtagccggtggaggaaggaaggaagaggaggggggaaatttattaattaacggagagagacagcaaggcaacgacgacgaggaggacgaaggtatagtggggggagctgctttggtttgcttttaatccccgattagactgtggggattagctgctaatcgtgccatttcctgcgtgctaattatggcacgtagcgtgtcttccacgaagagacgcaggaaaggaaaagggggcggacgcctgctttctctttggattttatcggcacgacccccgcggccgcacgatgggaatttccgacagcttttttatttgggtagattcgtgttattataatttttgtggttttgttattataatttttgtggtttggggaaaaaaaacattcttactgtttagtactctgtactgtttttgagtggttatttcgattcatgtcattataatttcacctttattaaaaatacgctaatttttagatcatattaccctcatattcttccttcatcctctactctctttcatattcatcttctccaccgctagatctgacggagctgatgtcgttgaatggtagctctaagcagtatgtggtgggaatagggcagcgttgttttccctcgttggttgaccctgctcattgacctatttgcatgttcacacctcgaagcccacaaccctcacctgcacgaggagcttcccaactcacagtcccaaaccccaagaaggcactcacctttgagctctcccgcgatatgggttaggatgtgctcttgccgctacctaggaaggaggaaggtgaagtgggataggtgtcagagctcgcggttggacgcgacaaatgggaggatgggagaatggtgtggccagtgagggaggggatgggaagagaagagggccctcccatcgtggagcttgtcgcactactctgcaccgttttcactacatggaactcgtcggtccgagtccctgatctaccacttgttggcaccgggagaagcaagggcaatggtatgagcttgtcggcttgcgccttcatgatccactccgccatacgccatagtgcgccgaggagcttgcgggagaagggagaggtacggtagcagcagaaaggggatcgaggggagaccggccctcggtccgtgagatgatggggactcgtcatccgtgccatcgccaaggctcgcttcgttaatttcatcaggttggccgcctcaatcttgagaaatgaactagagatgaaaagtggatgaggagaatgaaaagggtaatatggtccaaaaattttagagaaatatagtaaaagggtaaagagtggcatattttgaataacaacttcaaaactgtaaaataataacatggatccaattaacccggtatggccgcggtacactagcgtgtacggtgaccccacctgtcggcctccatcgctgacgcgagttcatcgacctgggtgtgttctgcatctgcacatccacagctcggccaatctttggaaaatcataatttagggaatttgggcttttatgatgtgcaacataagtgagcccatcttattcttcagacttactgttgggccactcatcttaccttcacgtcccatactgccatctaactaaaggaataagttcacttgaagtcccttaatttgtcgccgagtcttaaatttgtccctgcaccacaatattagatagaagcatctttcaactaaaaaactactgacttcgatagttgatggatgcaacatatctgatattgcggtttatggatgaattttagacttgacgatgacttagaaacctaaagtgaacttattcctaaactaaatgggcttgctttgtaagttttactgagatctgggtgttgggcttcgtaaatggccaaataggcctcggtgttggcatggtttacaaagggtctgtctggcacagctccaactctagctccacccctcctggagttggagctcagccaaacagtttcagctccatcaaaactgggagtggagttgggtggagctctctcacaaaatgaactagagttgtggagctgggtttaggcagctccacaactccactccagacccaactcctgaagctaaatttatgagttggagctgtatcaaacagacccaaagtattgacaatctggctaagcgcctatcaacgaaaagaaacacagatgctttgaaaggttttttttttaaaaaaaaaagttttcaggggtcaatcccaagtgtcctaatattgctacagattgatagagctaaccacaaggtctaatggaaactttgcttccgaatcagaataggacatatacactttccgatgtactataaacttactacaaaagaaaaaaagcggtgaaaaaaaaaggtactacctccgtttcatattataagactttctaacattgtacatatttatatatgtgttacacacacacacacacacacacacacacacacacatatatatatatatatatatatatatatatatatatatata

SEQ ID NO: 59822 - DNA, 14169 bp, Oryza sativa
tcaaagtcctgtcccattgattttaaatggtacaaaattacttccttttgtgactagagggagtagtagtacaactcaatacaacaatctgatcaacaatggcgcattatcgatccgcggagtaagtacaacttaaaaaaagaacttcttttaaaaccaagttatcaactttctaatatttaattaatttacttatatttactctcgaataatggttaatcacaaaaactcattttcattcatcatccataactctgttgagaatgcatataggtgtgccatcctacaagcgcttcaaaagcaatattatttgcccagagctcagtgggtctatatcaatgcctgaactacctttcagaatcacggggggtaattaattaaaccagtacactataaaagatcaagaaattatatatggatcaatccaggcaataccatttaatctgggggtgtttcaaccatgcatgtgctggctagtatttcaacctgaacccaacatcacatgaccactgtagaaattatcccagacaaaggtagctggatatatcaagaacaaattaatgcagatctgaataaatggatcacatgcatacatattccaccattaaattgcgaggttcttaagtatgaattctttggttctatatgatcaaagtgtcatttggaagatcgatatacatatcaagtgcaacgttacatgaagaaatagggtctctatattttcaatatactgaatagtataactgaagaggaagaaagaatcaaagcacgtatatagatgcattattcttactgatcgatcaccacacattgaaattcaagtagaaaaggtttatcagagttcgatctgttggatcatggtattctaaaaccctacctttagaagggagcctgcttttcatcagagaccatggaagttggaacgaaataagtacattcatgcataaaagaagaaagacagactgcgcaggaataataatctcgtagagtagaacataaacacagttaaatattgcctttgctcatcccaaagtatcatgcatgcatgtgtgtatgttctgtgttcagccaacaattaatcttgctagatacaaaatatacagtaaaacaaaacatgcataaccgcatccaggttacttcttatccccacttcatctcttatacatacattcttgaaagcgtatgcagaaggttaaaccaagctactcgatcagatctgagttattgtacgtaatctagcatcagttcgtcctagagcttcttcggactttataccaagacaaatcatgattgaacctgcggataagggcaaattaaaaaaaccatactggagatggaagttagttaaaaaaaaaatacagaaagttttcactgaaaacattcatatatatatacacctctattccaaacatcactactgcataattatgagcacactacatgttcaaccttgaatcacataagagcatgcaggctgcacagcatcaccgagaagacaaccctagctggctagctatagctcttatgcatgtcgttgctagctagctagagctttttctcttttggtaatataaccagatccagatatacatcaaattttatgctaacttgttgaagtaacataagtatatctttcattgaagagaaaaggaagcagggaaaagaacacctgtgaaaatgaagaaactaaacagaatggaagaaataaagagagaagataatgaaatagaagagggggagagagaatgtcaaggaagattcccccaatcaaaaggtaatgatgaaactttccagcgcctgccagagagacagagaaaagaggagtcaaagcaagccatcattacaccaatcttctatctctcctcggttctaagcaaacacaaacaaacaaacaaaaaagcagtgaaatcatgaaacagcatcctcggttctcaacaaaccaacaaaaataaaccgaaacaaacatcacatgaaaaatgaaatcctcaataatagagggaagaaagtgaagaaataatagcgagaactatagatctaatgttttgaagctatctctgaggggaatgaagcctggtccgagatcccacggatgagaggaatgaaaaaccttgcacaaatcatcctcaaaaccgcaaggtgcatgagaccttgaaccagacaacattccactcagaagcaaatagcttcatactatctattttcctttcccctcctctctctctctatctatctagttctcatcctctgatattcttcccttgcaagaagctatgggcaaagagcacgggtatgtatagacacaaggagcaagggccagtgacatggtccatggagtggtcatgatatgtgaaatgattacagctgcacacatcaccataaataatttttttttgaagtcacccaaattattcaaaagaaaatactctgacgaccatgcatccccagtgcatctattgaaacgagccatgcacctgcatagtcactgacaagtggaccatgatgcagctgtagcacccgtggagcccacctgtcagtggctggggcatggacagctatacatttacatggggggtgtttagattaggggtgtaaaattttgacgtgtcatattgggtattatatggggtgttgcatggggtacttgggcactaacaaaaaaaaactaattacaaaatctgttagtaaaccgcgagacgaatttattaagcctaattaatccgttattagtaaatgtttattgtagcaccatattgtcaaatcatggaacaattaggcttaaaagattcgtctcacaaattaatcgcagtctgtgcaattagttattttttagcctacattaaatactttatgcggattttaaacatttgaaatgacatggtgtaaaatttttgtgtgggaaatatacagggccatcgcaacaggcaagaccacatggaaaaaagagacggcattaaaaaaccataaagagcggaatgaatggtgacaaagaacacggcggcagaggggttggacctacagctgtggtcgccgccgtggagagacccgggatgcaatcctagccgtccatcgcggcctcgatcgacggatgagagagcacgagacgccatgaaaccctagaaatgacgagagggtcggggggcagtcactgggggagtggttgagttaaatgcgcggcccaagatttggaatttggtgtgcctgctctcgtgtgttgtgtgttgccttgcttgccctagggccatgaattattcatttttttcatgtattttgcttggagtacacagctagctagcaacgagcatatgaagatctctcactgacaaggctccatctctctgcattatgtgtacgtgtacgtgttttatcactgagtcactgacaggagacatgcagatgtaatgatgcaaatatataatacatgtagaatctgactgcattgtacatatatacacataatacatagcggcatgcactacaggtaggagttaaggtcttcatttcttcaaggagtttgtaaactctgaacagtgtggaaaaacgggagagaaagagagcctagatcagacatacacaaatttctcagtaccatggcgtacgtggcactttagcttagctgctgacaaagcccctgcactagctaggttgcatgtttcagtcatcagcaatagaaaacacgattcaaccgttgtttatgtttctcagatatgttaaactaatggccatatgtcttgtgacataatgacatcttctatcagcaattgtcttattcaatgcatagagccatagtccatagctagatgtctcttgatcaagcatatggccggcattaattacaaaatatggagtagtagtactgcttactgctgatataatgtcgtacgtgatggaaaatatatgcattgatttgaattattgcttgaacagggcctccttgtttcatatgcatagcctgccacaaaacacgtactcatgtgataaggcagacgtacactgttggtttttgttaatatatctagagaaatccatgtattgggtttgttgttttgttagtatattgtgaagtactccctccgtcccaaaataagtgcagttttacactattcatgtttaacgtttgaccgttcgtcttatttgaaaatattttatgattagtatttttattactattagatgataaaacatgaatagtattttatgtatgactaaatatttttaaatttttcaaataagacggacggtcaaacgttgaacacggatatctatgactgcacttattttaggacggaggtagtagatgtgacaggcactgacactacaactcaactttacatatagaaaactatacatagtgtagtatgtccaactactattcagagaccttgcccatgcacgatatgggcacggggtctgcgagctagggctcatctggggtcaagcgaatcaacacggtcggcctttgtatggcccctaattcaaaagggttaggccggccattttgtcatctcatcgtgtacacaagtataagatagtacgtactactgtttaacaaaataattaccgtacatacaaaattttgaattagcactcataagtttagcatttaatttgtaaggagtaccacacattattcggataagtttgatataatgtgcaatgagatgatcgattgtgatgcatgacttcgttaagcgtaagttataccgacttagtattttggaagctctcatatgggttgaaacgtgaatattggggtgagtgcgcttgcgtgtatgagcataatggtttaattatatcgcgttttgcaaaaaaaaaaaaatgaaaatcctaaatgtagcaaatgttgactgtgtatcgacaataacccattccctctggcctggtgtggccttcgtctgaaccaggcgacgacgacatgatcgatcagccagccaaaaagcccaaaacccttgccattttcaagcttctcccatctccactacgtgtaaacgccgcatacgcacacagaccagaagctaccgccgagcgccgatcgcgcaggcatgcatgagctatttcccgagaaagccaaagctgtgagcgcccgtagctccagggcttctgcagcagcaagtagcttgtgactaggtttcagccacttgtagcgaaggattagaccacacatgacatgcatgagaatgcagagagctaggcgcaccgcactggagcgccgatttgatcgattcgtctctctgctccttaatttgcgtgtgttttggtccgttgctccggcgtcgtcttcgccttcgcctgcatgcgtggcagcatggctgcatgggtaagtgcatgcacgcagagagctagcggccggcactacagtaacgcgtgggtagccatggcgtgtaacgttttctcatgcgttagattattcgtatagttagtttagtcgtactagccgtagtagtagtagtagatgtgccgtgcgtgaagcggtcaagtgatcggccagagacgtgacatctcgtcgcactctcgatcacctgcatgcgcgcgcgcgcgcccgtgaggcgccgaaccgcgcaaacgcacgcgctgcctctcgcggtgagatttgccgatcgcggtgagccgcgcccgagctcccccccgccccgcgcgcgtaacgctcggctcggctattgtctgcgcggctgtgcgaacgtgacgatgtcgtgggcggaacacgcgctgcctctcgccgtgagattttgccggttaatttttctgcgagatttgccgatttggagcccccgccgcgtgcgtgcgtgcggctatatcctcttgggcctccttcccgtgcgtacgacgcgtgggttgggtcggggaaactggccggcggggcctgcgcgaggggaagctttgcgttttttttttccggtgttgggcttggtaggccaggagcggtggtccgcggcgtagctaggacgcagagcctgtttctgtcgtgggctgcagtggttttactccttggaaggagttgtgagctctgggctgcggcaagtgatggaagatggaagaaatttgatgtgctttccttggttttcttcaactccctccgtcctaaaatgtcctttttctctcaatgaattccctttcgacgggaataaggccttctttcttcttgacacaacttcggatccaagaattttttagaactaagtatccctaacttcacaaatccatcaatttagatctgtgaccacatttataaaatttggataaattatttcgttctagatgaaatttatgattttaaactatatataaactataaatctatcgtgaacggtggattgagatctgaaactgtattgaacagagtccaagagtgtaggtagtgggaaatgggtagaaatggattccatgctttttcgtgtctcagttttatatggtgtgtttttttataaacaaaagtaataaagcatgcatcagatgccaaggtttttgataagggagaaaagatggagtgctatttgcgaacatggttatatttttattgaagtttcttcaagctgattttactcgttttgcaacacacatcatcttgtgagggagtgatgtataaagtatgtaatttgtaaacgagtgaggaagtgacaaaaaagttgcacgtattttgtatacataggctgtgtttggatgcctcctttcccaaccactctccctcgttttctgcgcgcacgtttttcaaactgctaaacggtgtgttttttgcgaaaagtttctatacgaaagttgcttaaaaaaatcaaattaattctttttttaaaaaagatagcaaatacttaattaatcacgtgctaatggaccgctccgttttccgtgaccacagggctgtccctaggggcgtgcagcctgcgcgcccgcacagggcccccaattttcaagggccccttaggcccaaaacttcaacactagatatacaacttaataagtaaattggtagcctaactagtcccgaaaatctgttatttttcttgtcgtttcggcttcgataaagcctttgccggttcgcatagttgcgccagttcgcaattttgaatcgcctcccactatggaccttatcaatcaccaaccgcaacgaacgagaggagtaaacgacgcctcacctctctcttgtgcggtcgtgccgcctaatgctgtttgccacgcccctaacctaattatttctgataatttctaatccggtaatacctaattttggattatcattttaggccattctaattttttatgaaatatattacggagtataaattattttcatattatatcatcaattaagtttttatccttcaactttgcacaggcccctgaatttaacgggacggccctgcgtgatcactgttacggatgggaacttgttctaacggacacagccatataatacatggcttaaaaaaaaaagcttcacctcaaacggaagatctctacaaataagtgtacaaattctaacctaccttaccagtactctctctgccttcaagtatttgtcaagatagtggatagtattcctcaaatttcgaccactcgtcttcctttaaaaaaataaataaatactaaaacttaatgttccgtaataacataacaaagtatatagcactctaaatatatgcattcatgaaacttttgtcagtggcaaaaccacgggagtgccagagtgggcctgtcactcctcattcgacctggaaaccctggtgcatagtcaatcgatcatttgtgtaggcattcaccaaactctgtatgtacctacttatctacagtcttgagtaaataactagctacaataatacatttgtgatattgaagctagactgatttctattatcaaaagaaaatctgaacaagctttaaggcaaggttaatggcacgataaacttttctctttctctctcgaccatgacatcgtcttatcaatgggtccaatgatcgatgatatatttctctaactacggtatgcatgattgtgctctcagtggacaacctaggaattttttaaacctaaacgaaacatgaaaagcatgcgagaaagcatgggctccatgcatctctgagacgccgacctcacagtggtgagatcttataattaatggcgactagccacagtccattttccccgccatggtgaccggtgtccatcgtgacgttcgtcctcgttctctaacatgtggtcctattaattatgttcttccactcctaggtgttagtttcaatgttagaggattatagagtccaagcactcctcatgacttctagacaattacagcttctgagaatctgtaccaaaagctgagctgtttgaggaagtttttgattctgagagaagctgcagcagctagaaactccctaatcagagcctcaatatgctgtgctattttttattacatatagtccaatttcgaatctttggtctcgctaaaatactataaaatcctattaaaagtacacacgcgctcatgtgtaatagcgggctcaggatttgaaccctaataaacaaaatcatgcatgtactatttcacatgtatacttttggtgctgatcatatagcatgtgacttcgcttgagtatataatttttgacatttagttatgtgaccccttaatttttttgctcaaagtacgccactgcatgggttcaaacttgtgtgtgtcttgtgatcaaactaatacttgtttggtcctattatcaacctatatatcgttgccttcaaattgtggagaattgaagaatagattaaccgatcgatcgatcgatcgaacactgcaaattgcgagcagcatgttgctttctgaccccagcaacgaaagacaccattcggcttagccctctagcctctgtatacctgattacctgtacgccactacgcactacagtaatcctactctacaggtgtcatcgtttggcttatttttgataagtcaaatagcatatttataacgaaaaataatttgtgaataaaatttttatatacgtgttcttaacgatcgaaaataaaaaaacaatctaaaaacaaaaaggggaaaataaactatgataaaacccttaaaatcaactcccaatttaatattgaaaatttaaattttagtttataagcataagccaaaagatgaggttgcacacccgttaactccacctaggaagacgcgcacgcctatcgatctgtcatgttcaacacatacatgatttccacttttgttccaaccaggggcggattcagcatggggatggtggggtctcgagccaccactactaacgtgaagactatgagagccccacgaagaccccactaaaatttttttaccatacatagatgggagggggactgtaactccatctagtttgcttagaccccactgatatttctttctggatccgccactggttccaaccgcaattatacatcatgcgtgcatctttcagtttcaggctttcagggatcagaacactagctagtagctaacaatgtttaaatttcctttttgctgatcggttaatttggtgcggctattctacacgcaaagtctcagtaaggttgcctttacggttagtgggtagtgcaagttgccataggcttcaatatacaattgcaataatgtatcaactatcaaccgaatatatgatcgtcctgactgatgatcacttaacagtctgtcattgcaacgacacctttttggaacacagagtgttcgacgatccccacagatattgaccagtccagctagctaagctagaagccgatcggatggcggcctttaatttggtcagtatcttgtgccgattcgatcaatcttcagagaaagattatacagtttcagcggtagcaacagcggtacaatattatagagagagagagagagaggaaccaaggggcaaatttttttgcttaaacatcattcatttcaatagttatgtaaaaatcccaaataaaagttacaatactcatataacaacatgtattaccagagtaccagtctaccacatcacaagatgtaaagtcgaaacaaaatttacacatcgagaaaaaaataattaaagacaaatccagcgtatgaacggtacagagcatttggctttgcgaaaagtcgagaaccatcgggtcaaaatatggaacctagctagctatatataagcatatttttctaattgcaagtgcgacgttatcacacttgcaaggaaaaggcggttaattccgatctatcgatgcatgtcgatcgaggtagttagtggccatcgttttcgtcaatttcgtgctgttgtttcttttgaaggataaggcagggtggtggatgcatgatcagatcagttttcggttcagttaaaagcggcgacatgaggtgaaaggtcgctgcacggcttgccgctatctctcgctgtctgtgtctccccctcgctcgcgatcggcgccgcgcgcgcgctagcgagctagctagctgcgtcgtctgtgcgccacgacctgatcagcacgagcacgaaccgtgcggctcattggccacacggagcagctagctaagggaacatatatgtcacactgctcgccatggacgccgcccgcgaaatgaggtgtggagagggtggttaggctagctaggccgtatctctatctcgccgcatcattattttggattcggcgaccaggagcagcaccagcggcatactccgtccgtcccaaaaaaaaaaaaagacaaaccctgatttctgtgtccaatgtttaaccatccgtcttatttaaaaaaatatgaaaaaaattaaaaagataagtcacacataaagtattaatcatgttttatcatctaacaacaacaaaaaatactaattataaaaaaatttcatataagacggacagttaaacattggcacgaaaacccggggtttgactttttttttgggacggagggagtacttacttcgtaccatgaaaaaccaatctaatatctgatatgatatatcatagtactatatttagattcgtagtactaaaatactccctccattttaaattaatctacatatagttttttttaggttattccgaaatgatctatatatttgtgtttattcattaggtctattcgttatttgtgcattggagtaaatggacattgatgcatgcatccatgcacacaaatatttataactcacatgcaatatcttgatttgctattggctaggagatagtggggatggtgcatatatctagtttgttgctagagaaaatatagtatgagagagttattagcttttcttggtcttggtgtacctatgaaatatgtagatcaatttggaatggagtgagtatgtcacatctaacgtcagattgtttttatggaatagagggattactagctacacatgctctgaatcagtcagcggaaagagtataaaaaacaaacctaatatcgaatattgtaatactacaaatccagatatacatttatatccagatatacatttattgaaatttatagtagtagaatgtgtaataggaagtatttgatatcaggtttttttttacagagtgaatactagctacacatgctctgaatcagtcagcgggaagagcatgcaggagcagtgtgcgcacaactgtgcagcggcacgatgatggccaaggagaaagtggagcttaacgttgttggttccaattaattactaattcctctctggtttaatttgaaaagagcagggagccaattgattttgcgctagctgagtccgtctgcatgtgtaactgtgtactccctccgtccaaaaaaaaaaaggcaaaccctaaattttcataccaatgtttaactgttcgtcttatatgaattttttttataattagtatttcattacgcgtgacttatctttttaattttttttcatatttttttaaataagacggatgatcaaatgttggacacggaaaccagagtttgtcttctttttttagacggaaggagtatggttgtagctagcttttactgcggtggtcgtagagagggtttgatttccaaaaggtgttcacgaggtcgggtttccggccgatcgatcgacagcaaaactagctagggttgcccggtatgtacattgatgtgatacggccgtgtaggtcactatagtgacctaaccatacatgtccatatcacaggctagatctgatctctcatgctttgcttacgattaaggaatatatttcagtacttccttcgtttttaaatatacgatatattaacttttagatagacgatgtttgaccatttaccttattcaacaatttagtaatataaaaaaatataaacaatgcttaaaatatatgcaatgataatataagtacaacaagataataatacttgcataagttttttaaaataaaatgaattgttgcatgttcaaaagtcaatagcatcatatatttaaaaaggaagataataactcatttctactaggacgttgtgtggtaagtagaatatcccgtgatgacctaggggttcactaaggagttgaagagttatgatcactttagtctcatatattgatgactacacactttttttttgggggagggggggggggggctgctctcggggcgcatccaccacctttccctcgggcgccctcctcctcggcctggttgtgcttggggtctgatcgagacctacaatatcttcaaggtgttgaagttgcagctcacgaccttcggcatctccttctagctatatccatcgtgaactcctgcgccatcaacatctttgagaaggtcgtccaaactaacaagaaaacctacattcagccatagttattaggaccggattggcggtccgaccgaaaaaaatgggaaccaggggctcagccgatccgatccagtttaaaaattggagtgcaatcaacccggaaaaaatcggttgaatcgccggtttttggaaagaaccagtgaaaaatcaggcaaatagaccgctaaagaaccgagcgctcgtgggaacatgtgtgaaaaggccgaacactggctgaaacgtggggatagagaagaaaataggcggcttgagggatttgaactctcaacctcccctttagactcaatcatccccaccactgagctatgcatgcttatcaattgatttgaaccgtgttggaccggtggttcaaccgatcagaccaatcaaaccgtgtctggtccgatcctaataactatgcattcagcaatggtaacgatcacggctgccctggacgtgcggttaaaaaaacactgagcacagtgaccgcctatgaataaggctcaaacgtcttgggggggcgggctcaggcccgagcatgccctctgccccgagctctcctcagaaggctctgtcctatttatgggtattggtgggcctatagggctaacattaaccgacacaccgcttaaaccgcagggtagagcaactcggtgtacagctcgtccgcatgctgagaaacatgatgcttcatgaagccccttacatggccacatcaaccaaagaaatagaggggaggtaacatggcatgccctcatcatccgtagtttaggtccacctcggtactttagaaaggctgacatgtggccctgtgacagttgggaaaacactttcttacctcctgctccactagttagccgacagctgagacagtcacgtccggctagcttgtttgtagggacatcgacaacactaagcatacctaattcaatagagtgggtctcactcctgcatacatgcattggcattgtggactccccttcatgtataaaaagaggatggggcaattgcatcggtgcccccactttcaaacccatttgctgttttatcatcactttttagggtttacagttttaccctcactctttgaatctgaaccagccagttacccccacttctaatagaaggtgtcacggtgttagttgtacaacaaaaggacatgtataccctctgcatccaacaacatcgtgcaggggaggacctggagcaagggacggggaggagggcggcgtctgcgccgacgtcgacgtccagcaggatggggtcgtcgccggccacgggagcagcagcagcagcgatggtgggggcaggtggaggcggacgctgacgacgatgcctcagcgtggaagccagcggccacgggagcagcagcagcagccgccgccgtcgcccgcacgccgtt

SEQ ID NO: 59823 - DNA, 1722 bp, Oryza sativa
atcaactatcaaatttgaaatccgccccgaaaaaaaattgtctgattcaacctaaaaaaaagagtgtgtaagagattcatattgctttttgctttttcctcatcgtctcgtccgcgatttcgccggagttttcgccggcgctttgggaagccgccacggggttatatttacaaccgtattaccgcctttgaagtgagatgttgcctgctcgccggggccccgaaaacaggtcacgtcgccgtcacgccgaaaattcacctagtaatttccgaacttatttgtgcataaaatcctcgtccaggaatcagccgaggtacacaaactgacaatttaatatacagattcatcaaattaactaaaccgataaatacttacttaagaggcacttagtcctcaccatgaagaaaactgcagcggaaaataaaatctagcgaagctccagctccactcccacaggcagctcagctggggtataagccaaacgtcttctcctcctagatcctttttcttcaactgaggttgattgattattgcaagaatgagcatatgacatactcaacaagccacacagcaaatatgcaagtgcacaaggataccaaaggatggcataatataggctcatttgcaaaagcagcatttagcaaaacatttaagagaaataaaacagtggagtaattaatcagaaattttaatcaacactgaacaacacacccatgctgcacaggcccaaccatcctgaacaaccatacccggctgtacagatctaactccaaaccaggagctaagcaaattattaccaggtataacatccataattattgtgagaggtgtgagactaatcacgaaaaacattgctcaacccgcccataaccgcgggcacggctattcgaatagttttactctggccagaggtgtaccactgtacccacaagacacagccccacaacatgtcaccatgtgcctcaataccaccacggtacctcggaaaggagttgtgacaataccccttgcacaacacaatccaccacagcgcacctttcctggatcataatcacccccttataaacaaggcatggactccccagcgacccccgtgggcttatctccgccacttctcagtctggtgctccgcaatgaatcatgctatacaaaaggtaaagccgttgcccacgctggcttgtggttggcacggttaatgtttcacaacagtagctcgcgaaccggtccttaattgtcatgagcacgactctcaaaaccatgtgctcacaacccaccattatcaagttttagttggcaagtaattaattaaccaatcacgattgaccatcgtgaactatcattaagccatcattaaataataatgagtcataagtaatcccaatagtgtgctaatgtttctaagcatggctaagcaatcatatctaatatctagctgaaccaatatatatagctcaactagtcaagttataataacccaaggtatcaaggaataaagtaatcaatgcaaacaggccataacaaaggaatagattcacaccacccagtgacattcgaaaataaatgcacagttgaaataaatagagaatttaaatataggatcaacatgctcaaaggattgtgtttaggatctgtgtgacttgccttgcaataatcggtcttcaattaatcttcttgaatactttccgcgcacttacgaacctttgcaacgacggaaacgacaac

SEQ ID NO: 59824 - DNA, 19543 bp, Oryza sativa
acaactccactccagacccaactcctgaagctaaatttatgagttggagctgtatcaaacagacccaaagtattgacaatctggctaagcgcctatcaacgaaaagaaacacagatgctttgaaaggttttttttttaaaaaaaaaagttttcaggggtcaatcccaagtgtcctaatattgctacagattgatagagctaaccacaaggtctaatggaaactttgcttccgaatcagaataggacatatacactttccgatgtactataaacttactacaaaagaaaaaaagcggtgaaaaaaaaaggtactaccctccgtttcatattataagactttctaacattgtacatatttatatatgtgtgacacacacacacacacacacacacacacacacacatatatatatatatatatatatatatatatatatatatatatatatatatatatatatatatatatatatatataaaagtatgtatgtatgtatgtatatatgtatagattcattaatatccatatgaatgtgggtaatgctagaaagtcttataatatgaaacggagggagtatgtggtgagcgcgtttgcccatcagacttttcattataaattgtgtgtccattccacaccgcttcagatagattttggagggattcggttcaggtgcagtagctagtgtgatattgtgactgcaagttacacagtcacaccagcaccactagatttgaaacatatggcccagatgcattagaatactgtagcaaagtactgtagcgttgctgcaagaactagtgctgattcactgtagcaaacgatttggatcattggatcaagaaatagagggatcagattatgcgcagtagcaataacaactgcactggatctcaatccatttttgagatatctaggagttttgtgcattttcattgttgatcaaaatccaaagtcttttattctactaccctcgagaaggaggagatgtaaattagatctattggatcaatagacccgatgaactccgagaaaatccattgttaaatggcctataaaacgaaaatatgacatcgtgtaccgagggatattaagtttagagtaacaccaataaactatttttttctcgatccgcaactaatgttgatggtattgttgtaattccatctatgccttcccagactacattagaaaatactcgttttagaccttctcagaagaatctttttacctgtgacccttaaatggcgtattaactttttattagtttggtgttaaagcctcttttaaatggtgcatatgagccttaggatacatatccaaacattttaggtacatgcaaaaaagtagttaggtgttgtatgctttagagcaagtctaatagtatagctcactactagctccaaatcatgtacagccaatatagtagccaattcatataatagttgcttactatatactattaatgcatagtctcacctgtaatatatacgttatgtttttgagtccatgctgtagctagctacagatctgtagcccgctactcttctctctcttctttatctctttaaaatatatttatagctagtttatagcttgctattgtacctgctcttacatgagttttggcatctatcctatgtgaatggctagaattacagcctacagcccccaatgctccaagaatttgagtcacaattattttcccttttctcctctccatgtggtttgtgcaaaggcaactattttgtccttcttgtggtgatgtttggacacgtggcatacttgaatagaggaataaagtttatcaagatatggatgctatggtcctcaaataaaagataggaattcctcacaaaaaacaggagaacaaaaatagacatggttggctgacattaaacctccaaattgaaaaataccgccaaaaaagaagccatggatgaagcagattatactatcaaactgctcatacgccttttgcacatttgtttcagatgacacttgtatcaccattaaagcagtattgaccaaacaaaaacaggccttatttagattcaatttttttttccaaaaatgtcacatcgaatgtttgaacacatgcacagagcattaaatgtggacgaaaaaaaaccaattgcacagtttgcatgtaaattacgagacaaatcttttgagcctaattacgtcattatttgacaatgtaatgctacagtaaatatttactaatgacggattaattagacttaataaattcgtcttgtagtttacaggcggaatctataatttattttattattagattatatttaatactttaaatataaatatgtatccgaatatacttaaaaaaattagccaagaaactaaacatggccacagttaagcagagtataggagtacagttaagcagagtataggagtaatcacaacataggaacaatgattgatgggatggatcacagaatatgttctacaaggtcccaaaagaatgaaaatgaaattcctttgatcacaagttctaaacacatggcaggacattagtaagcatcctaatagcttaatgtatagatcgccacacaaagatattcttttttaaaaaagcatatgatgcacatacactacaagtcaaaactatttcgtagaacagtggtctaccactaaacactcaaagcccaccatcctcctccacgtgcaggtttcaaaccgctaacatgggtgagtgaatctgtattcaaattcaaataaatatatttaaaataccccacaccgaacgaagatttactcccatttacacctaattaggtggtggttggatccaggaacttaactttagtctctatagttagacactaatttagagtattaaatataggctacttacaaaactaattacataaatgaaagctaatttacgagacaatttttttaagcctaattaatccataattagggaatatttactgtagcatcacataggctaatcatagattaattaggcttaaatgattcgtctcgcgaattagtccaagattatggatgggttttattaatagtctacgtttaatatttataattagtgtccaaacattcgatgtgatagggacttaaaagttttagtcccatctaaacagggtcttattcttttaacggtagacgacacatccatcatcagcgaaacacccatgataactccgtcaatcataatatatgctggatcagtttttcataagtattcataggtgtagagtgtgcgtgtgtatgtttacatgggtaagtgtgcgtgtgttgtgaacctctgtttataccgtgtttttttttaaaaaaaatgaaaattcgaatgtggcttgttggtattacaaccgcaggtgagtgagaccacccaccggttcgtgtctccgcaccgcccatccctaaaacatcgccacgtccccgccaccccccttcaatgtccgtcgccaccggcggcggcgtcgtcctctcgcgtgcccaatgcgcaagccccaccacgccgcgcagcctccgccgccgccgccgctcccgctcccgctcccgctcccgccgcggaactgcccgctcgcgaccgcggtcctggcgctcctctccgtgctcctcgccacggcgctgtgggtcctcctcgtgctgtccccggcgtcccacgcgaggggcccagccgcggggctgtcggatgcggcggacgcggaggcgtttgcggtggcgggcggaggaggcggaggcggcggggagggcgcggaggccccgctgtcgctcggccacatcgtgttcgggatcgcgggctccgcgcacctctggccgcgccgccgggagtacgtccggatgtggtgggacccggccgccatgcgcgggcacgggtggctcgacgccggggcgcccgcggcgccggggccgagcgcgtccggggaggggtccctcctcccgccgatccgggtgtcggaggacacgtcgcggttccggtacacgaaccccacgggccacccctcgggcctccggatcgcgcgcatcgccgccgaggccgtgcggctcgtgggcggcggcggcgggggcgcgcggtgggtggtgctcgtggacgacgacaccgtggtgtccgcggacaacctggtggccgtgctcgggaagtacgactggagggagatggtgtacgtcggcgcgccgtcggagagccactcggcgaacacctacttcagccacagtatggcgttcgggggcggcggcgtcgcgctcagcctccccctcgccacggcgctcgcgcggacgctcgacgtctgcatcgagaggtaccccaagctgtacggaagtgacgatcgcctccatgcttgcatcaccgagctcggagtgcccctctcccgcgagtacggattccatcaggtatgagcttatttttcaacattttgtggccattcaacagaaatgtgggttgggtattaacagcgcttagattattgagtggtcttatgaaatgttattcgcctcagcaattggagcacttattctgttctgctttgtacgatctgctgatagactagttaccagtgacacagtgacttgaattcagggactatccactctctcctgatcccatgcatgaatttagtgcgaaatagcatgctgtctatgctcacggaaattcgggggattgctaatgaactagcccaatttagaatttgcgttagatcttgggaggcatgcatattgatccactctttggaaccttaccatttctgtgatgcttgattcattatggcagaaaggaagtgtagcctgtctgctgttgtgccaacctagctggctgttatatgttcaatcagaatacatgaacaatagtagtagggtcttgccagagtggttatgttagattgatagtgaaaggaagtttggtagtacttgaatgttacctttctttgggctcttttatggccagcagaagtttttgcaagaacttgcctgcttgctttatagtactattgtaatttctgtcaaataggtaccagcatgctgcatgtgtttgaaaatatgataataagtgattagcaagttcttttttctgtttgcacattaacaagtcatatttacttttttttattaatcgtgtgtatggagaactaaactctactctcttaatcttacttttgtccctttgcattgtaatcagtgggatatcagaggcaatgcccatggtatattggctgctcatccaattgctcctttcatcagtatccaccatctggagcttgtcgatcctatataccctggtttgaactctcttgagagtttggagctctttacaaaggctatgaaaacagaacccatgagcttcttgcagcgctcgatttgttatgataaaaggcagaagtatacatttgcagtctctttgggttatgttgttcaagtgtacccctatgttcttcttcctcgtgaattggagcgatccgagcggacttacattgcatataataggatgagtcagcgaactgaatttgattttgacactaaggatattcagaaatcattgtgcaagaaacctatattatttttcttgaaggatgtttggaaggatggaaacataactaggggttcttatatacgtgcaagtgttcgggatgacctaaaaaacaaagtgttttgcttcaggtcaccccctttacctgacatagacgagattcaagtttctgcatccccattaagcaaaagatggcatctggtttgttctaatattcctaacaatatatcatatcttgtttctacatttacattggctaattgtcgtaccactgatataggcaccaagaaggttatgcagtgcgcttaaaggatctattaatggcactttgtttatgtttgttcggcaatgtggacgggggacatttggctcagcttctgattctctataattgatggaaagcagaggtgtatattttctgttcagatgatacctggaagatgtagttaccatcctacattctttgaatcgagtgttgtgggggctctttttctgcctcgagcacttggcagttaccaactgcttgttatacttggtagttgttgaaggtagtttctgtatcttctgaatagtgacattagaaaatagttttaatcgttgaccgtaacaattgggattcatttttgatgatttttaaggtgcttctaaaattatgatggtttctcaggctagtaccattccctatttgacgattgatgacctgtaatatatctaatgtaggccttttcaggttttcattcactttgtactatatttcatcaattggaaaaaaacccaatcatgcatgggctatactaagtttaaacataggtctcagacataaatatggaccttacttattacataaaaaatggcatcatgcttgtccatacctactttgagttgcaaattaattccatgtgctatgtatgcttatcatggtgttgtcttttgatatggatgcaagaggacccttctaggagatcataaccccccctcccccccccctattttcattagtagaaatgagcattacaaagtttctgaccgtcagtattatgattaattgatcaaaatttgatactttcttcttgtcatgtaccattttgttattaaaggatatagtttctaactttgtttaggcatcagagcaatcaaatcattgctaatatacaaaaaggaattcagaaggatatgcagatatacaaacagttgaaaaatgacagggaaaaaaatatgcctgctgattggagagagattttttttgttgttaaaaataagttagcacacaggcgtacgattcaaaattaattgtggtctaatggctgagtcgatgagcgaaaatacctagttgcttcgcacgatgaatccagttttctacgtcttgcatacatcttatgagaaaataatcattgactgacatggttgtcaactattatgttccagttacgaggatctttttgcagaaagctctgaaaatttaagttgcatttgccattttagttatttgaaggaaaaaaaactgttgtgtctagtcataaactgccttgagcttcatttttcctaatttttataaagaatgttggagtgggatgcttagcttccgacaatcttttacagtgtcagtgtgctgtgtgcggtactctgtttcgacaaccttaatgcttatttaagagtaactggcttactggcatatgcagattgatatttttcatttcccttgcattttgttttcagtatccggtgctttatctgtagccttttttcaacactctgttctctacttttatgtcgccacatgatgtgctttaatcaatgctttatgctgtggtcacaaatgttctaacttttgagcaaagtttcagtgctgtattcattcacttcaatagcaagattaatctatcatggtacattgcaaaagttgccagattgacttggtgttctgaaattcttttgtagcagtttgttaatagaagaatctgctgaggaacaaagctgaaaaagaaatactggtggctttttttgtggaatcttcaagctactcgtggatgtacgatacttgtggacggagactgggtgaacggagtgtcaccctttgattagctgcattagtctgactgaaacaactttccggcttcattctttgagacccgtgtactaaccttgatggattctcagtcgaaatgtgaaatcactaaatcaggtaagaacagcactccattagcattgtattggagggctgtaaacctttcccgataccttgtttagaactgtaaatcagtgtgaactgtgaagcgccataaccatgaaagagattccattcaatctttattcctttccagttcattctgaaagccgttatctgctatgacgcctaaatttacttttgtgtccattttagtcctactccttttgatatctgctttatactatcaaagtcttaccacagctaaacatgttacctttattggggcatgtctaaagttgaggatttaaatggggcaaatccgcaaatgcacatgtaccttttccagatcaattaccttaagctatatgccatatcctttctgtagtatatccttgctgttctcgtgtaagtcgaatttctaacgtgtttttccttttcaattgacttccctgatttagtcacggttcaatccagtcttgctgctcattattctacgaatctcccgtatgtacttatggtacactgtttgctgctaaattaacatatgaactgctatgctgtatctgtttgctgctaaaataacatctggacttatatgctgtgtggaagtgattcatcttccttatcaaaaaggaaaataaaatgtgtatgtctgtgatgtgctctccacggtcggcaagcagatatttaacctcctagttctgttcgttgttattttcagtacatgatgtttcctgagtatcaacaatatttttcctcttattttttcccctgaggtgggactatcaaccatattttacccgttgctaatggctcaagtggttggtggttacttgtcaagggcacaaaacatggtacttgactactcctaattctcaagtaacaggtttgttcagatactgcatcgctgcttttctgtttactctgcaaattgcgatcctcttattacaacttgtgtagcaactcttgtgctgtgcaaaggcaacactacgtactgcgctagtacatggtccaatcagggcccaagcccttgaggcccatcttagcccatgtggtttgagctttgccatgtgctccctgagacagtaattagagttaagttagcaccctagtgggcctttttcttaattgtccatgagctttggcatccattatcgaaatgatatgaacataagaggatttgaataggtgggaaggaggttaaacatcttcccactacttgatcattggccctattctttccttggtgcatttgtaaagtccaaatataaattttgatgtactaacaactatgctttccaactgtcaactgttaggcgctgactttttgtagtttaagactggagatcagattcggcgtatggtcgcatggtctcgtgggacatttcatatcctcgcaaagctagcttaaatgttccatcatggggtcatctgtcaacgcattttgcatgttgattttgatatttcatatcttcgcaaagcttatcggacgtagctaaaatttaaattttaaaacttaaatttaaaattgattttgatgctttttatcgtagtttattttcaacattagcttttaagtcgctaaaatatatatatgtagaagttatatataaaattagtttatatttgctaatcagcgttacgccttataataagtggtatgtgaaaggcaaaactatcacactgggactgaggtgctctcctctaatatcaactctgttaagtttcgaattccgtgaaccaaaattcttttgtcagcttccaccaaaaaatgtcctcttatttcttctcttgaatataagagcctggtctctataggtgaagtacagcagttttaccaactactatagtctggttgacacagtatttttttttcctgatcatgcatttacgtgatataggcccatattaactgttactcattactgttgcgagcaaaacctaatttcagatcaaggaccacacgagtgtctctgactttcagattcagtgtgaaaaattccttgtatttattccgtggacttgcaggctgttactttgtcttttggtgttcatccagcccatgttttgtcaactctctacctaacttgcttcctcaatcttttcctaccctctttctactgtgttttgccccagtaggtaaccaattccaatgtaaaaaagagaaaaggagaaatgtcttcagtggcgtgcagccagggtagtatagttgtgtggttaaaatttggtttgacatctctggctctgaccagcaacagcatcatctttgctcctaatgaattctaatgaaattgctcaattattaccaggatttaagaaaaacctacctgcatgcatgatctaacctctagaaaggagtccttttgccttctactaatccatttctaatttttctttctgcgaaatgcgatccatcattccatctcatcgatcccaacattttgcaaccgatatacaaaacagtacagtgggaattgtgggaaaggtgagaccaactgtgcagtaaggcgagcagttcggttgcacgctatctgaaacatgttttgtgtgaaggctaggcggttggaactaacatcatatcgctggcaggcagcgtgcgtgcgtgtgtgtgaggatgaacaaagagacgatgcgtgccgcaaaggaaaagcgcatgcaaattgccttcgttttcgcgtcatcccgcccggtgcatggctggcacgcgccgccgtaagcaaagctacgccgagcatgggagtcgccgagctgcggtggcacgtacgtggacctattccaaacaacttcaccgttttgctcttcagcttatcagccgtaattaaaatttaaaattatcagacttaatttaagggttgattttcaatttttttcgtcgttgtttatttttagtttagagcttttaaatcactaaaaacatatataaaacgctttacttatactatatataataaaccttacggtttaaaatctgctgtaggcgaaactatgggaatgaaaaatgtttctcaataactaaaccagccacttgtcactttgatcattcgttcacagatcacaggataagttgactaagttcagaaaaccgactgcaaaatttctcccatggcacgagctctctatctctctgcccccaatttggcgtagaaaagaggtcaaaattacgtagaaagctctttctctgtttctcataagtgagctttgagcttaacgtcgaaacgtccaagtgttcaactctccaagacctcgatgatgctctctgttaagaggccaaaattacacgtcagatgagctgcctagtgtggccgtgtccgtctgcaactctgtttgcttctcccattgggtaaaaacccaattattgatcttgtgtgctcaactgctcatcagaaggtggcatctgactatttgtaccttctgcaaattcatccacttctgctgcccttttcacatctcctaactaattgccgtgtacttacacgctgatgccatttatttcctcagcttcatccacctctcactgacccattacgtacatcaatcatcagatcacacagagatactcctatactcctccagaatgtcagtgtgctacagtacgtgtaatttcagaaacacggattcagcagagtggtttagccaataattgtgcagagtttgcttgcgtgtaatacaaaccaatccaaaatgtgcatcaaaagcttggagttaaaactacctacccatcttcacctaatccccatccttattttacgagtccttctgtactactaccacttaattaccacgagtcattttattcgttatcagtagcaatcaccaacatctcatccgctgttcatctttgactcctgaaagctgaaaaaacatactccgtacagtactctactagttttttctaaaaaaaaaaaaccatatactcgcactggaagcagtaaattgactggaattcctcactccagattacgtgaagaaccgagatatttcacgcagtggatttctcccggtactgatcctatctctgaaccgtactactgcaaagcctgcagagccgtgtctgaattctgacactgacgaggttgcagatatctgaattttttttttgggtgctgaaagctgcggccactacggacactgatggttacgtgaggccgccggcgccgaagctgaatatatgcagatgtggccgtgcccttactaatggcactttaataaccagccgcactgttagaaagaagcaagcaggacagtgctggctctaactcttaactaactgaattaacttcacatgtgactttgcactaccgtatcttatcttccatgaaagtttttgcaagtgtagtttccagtgctggacgatttaagcctttcagaagatcagatgctgcatgtcaaatatggtaacatggtgtccatctccgtacatttttctcatgcagaaaaaaagaatgaaaagaagaatgaaagaaaggaacattgcgtgcatagggatcaaacattgctgcatgctgagatgagatggatcctgtagatgtagctagcaatggacaggtaaaatttggccatcacagtgtttgatgcttgatctgatctgatctgatccgatctgcttctccagaatgcaccagccgtttgcatggacgcgtctctgtaaccaggtgccagccaagtcactactgtcaagagtcagcatctgtaattctcctcttctctgatctgtccctccctgtggcctgcgtgcgtctctccatccccttcatcacctctctgtctcgcctccacgaccccgttcttttcggctacttcacagttattgttacgggttactcatttcacgtctctaaaaactcatcttctaaaaaaatagagaacatttttaattgtttatatcatatcgcttgttataagttatccgcttactatatttaatttatatttataattgtatagttaatctgctataataatttggtcaataatctgttgtagttttggtcgtgaaaacgggagaaatcgcaacttataattgtatatagataattcactattgggacgcaggctattcatctaatttctctaaaaattcctttttttctaaaagaaaagaataatccttttactgcacaacatcacttatcctaagttatcagttattaaaatatttaattatttactatcataattcagtggataatctgtttcaagcaggtcgtgacaacgagagaaagcaaacagccaatagctcggccgcgggcgtccctttctcgtgcatggctgcaacctgacggggaacggaaacgccgagcacttccgcgcgcggcgtggaaggaagccgcgcgcgcgcgcgtgcgacttggcgaggggagagccacatgtgtgcgtgaggagacagttaggcaaagctgggcacttaacagtgctgacactgccgtgtgctttgacactttgacagtgaaatccccttgagtttagttcttttgctcgtctcccggtggcatcattgctgtgctgggggctcaaaaaggagagagagatggagagggtgactgtgactctaggttacaccttcaccttggttaaccttgtaaacttgttttgtttagatttaaccatggttgcaaaaaataggggtatttgcttttccacttgcaagcttgcgtgaggaatccttttatttaggtttaaccatggttgcggaaattgggtgtgttccttttccaccggcaagtcgtgtatgcgtgcagaatcttttgtatttaggtttaactattgttgcggaaattggaggtgtttcctttcacactggcagacgtgcatgcgagatcttatgaccgtgataatttgataccataacgtttaatttgggcggaggtgcttcttgtgcttcttacttaattacgagctcattttcggattcgtcctcgatttatcaagaagggtcaattaaaacatgcactaatgtttaataagatttaaccacggttttttaaattggaagttttagggttggtttggtttgtggtcaaatagacattaccaaattttgtcagtgcaaattttagtaagttttggcatgactaattttattaaggcaaagttgtgtttggattgaagctaaaatagcctaagttcattattgaaatgacatattttcttaggcatgtcaaaatttagcttcaaaccaaatagacactaaacactattgaaattatcaaatattggtaagcctaatttaggtctcaaaccaaaccagcccttacttttcggctagtagacatacgagtgatatatctcttaactatgatatataccacactacgagtatttagggggtggtacagaaaatcaacaactcagttcgccatcaattgtagagaatcagaagctgagccaaatgtcccccgtccacattgccgaacaaacataaacaaagtgccattaatagatcctttaagcgcactgcataaccttcttggtgcctatatcaggggtacgacaattagccaatgtaaatgtagaaacaagatatgatatattgttaggaatattagaacaaaccagatgccatcttttgcttaatggggatgcagaaacttgaatctcgtctatgtcaggtaaagggggtgacctgaagcaaaacactttgttttttaggtcatcccgaacacttgcacgtatataagaacccctagttatgtttccatccttccaaacatccttcaagaaaaataatataggtttcttgcacaatgatttctgaatatccttagtgtcaaaatcaaattcagttcgctgactcatcctattatatgcaatgtaagtccgctcggatcgctccaattcacgaggaagaagaacataggggtacacttgaacaacataacccaaagagactgcaaatgtatacttctgccttttatcataacaaatcgagcgctgcaagaagctcatgggttctgttttcatagcctttgtaaagagctccaaactctcaagagagttcaaaccagggtatataggatcgacaagctccagatggtggatactgatgaaaggagcaattggatgagcagccaatataccatgggcattgcctctgatatcccactgattacaatgcaaagggacaaaagtaagattaagagagtagagtttagttctccatacacacgattaataaaaaaaagtaaatatgacttgttaatgtgcaaacagaaaaaagaacttgctaatcacttattatcatattttcaaacacatgcagcatgctggtacctatttgacagaaattacaatagtactataaagcaagcaggcaagttcttgcaaaaacttctgctggccataaaagagcccaaagaaaggtaacattcaagtactaccaaacttcctttcactatcaatctaacataaccactctggcaagaccctactactattgttcatgtattctgattgaacatataacagccagctaggttggcacaacagcagacaggctacacttcctttctgccataatgaatcaagcatcacagaaatggtaaggttccaaagagtggatcaatatgcatgcctcccaagatctaacgcaaattctaaattgggctagttcattagcaatcccccgaatttccgtgagcatagacagcatgctatttcgcactaaattcatgcatgggatcaggagagagtggatagtccctgaattcaagtcactgtgtcactggtaactagtctatcagcagatcgtacaaagcagaacagaataagtgctccaattgctgaggcgaataacatttcataagaccactcaataatctaagcgctgttaatacccaacccacatttctgttgaatggccacaaaatgttgaaaaataagctcatacctgatggaatccgtactcgcgggagaggggcactccgagctcggtgatgcaagcatggaggcgatcgtcacttccgtacagcttggggtacctctcgatgcagacgtcgagcgtccgcgcgagcgccgtggcgagggggaggctgagcgcgacgccgccgcccccgaacgccatactgtggctgaagtaggtgttcgccgagtggctctccgacggcgcgccgacgtacaccatctccctccagtcgtacttcccgagcacggccaccaggttgtccgcggacaccacggtgtcgtcgtccacgagcaccacccaccgcgcgcccccgccgccgccgcccacgagccgcacggcctcggcggcgatgcgcgcgatccggaggcccgaggggtggcccgtggggttcgtgtaccggaaccgcgacgtgtcctccgacacccggatcggcgggaggagggacccctccccggacgcgctcggccccggcgccgtgggcgccccggcgtcgagccacacgtgcccgcgcatggcggccgggtcccaccacatccggacgtactcccggcggcgcggccagaggtgcgcggagcccgcgatcccgaacacgatgtggccgagcgacagcggggcctccgcgccctccccgccgcctccgcctcctccgcccgccaccgcaaacgcctccgcgtccgccgcatccgacagccccgcggctgggcccctcgcgtgggacgccggggacagcacgaggaggacccacagcgccgtggcgaggagcacggagaggagcgccaggaccgcggtcgcgagcgggcagttccgcggcgggagcgggagcgggagcgggagcggcggcggcggcggaggctgcgcggcgtggtggggcttgcgcattgggcacgcgagaggacgacgccgccgccggtggcgacggacattgaaggggggtggcggggacgtggcgatgttttagggatgggcggtgcggagacacgaaccggtgggtggtctcactcacctgcggttgtaataccaacaagccacattcgaattttcattttttttaaaaaaaaacacggtataaacagaggttcacaacacacgcacacttacccatgtaaacatacacacgcacactctacacctatgaatacttatgaaaaactgatccagcatatattatgattgacggagttatcatgggtgtttcgctgatgatggatgtgtcgtctaccgttaaaagaataagaccctgtttagatgggactaaaacttttaagtccctatcacatcgaatgtttggacactaattataaatattaaacgtagactattaataaaacccatccataatcttggactaattcgcgagacgaatcatttaagcctaattaatctatgattagcctatgtgatgctacagtaaatattccctaattatggattaattaggcttaaaaaaattgtctcgtaaattagctttcatttatgtaattagttttgtaagtagcctatatttaatactctaaattagtgtctaactatagagactaaagttaagttcctggatccaaccaccacctaattaggtgtaaatgggagtaaatcttcgttcggtgtggggtattttaaatatatttatttgaatttgaatacagattcactcacccatgttagcggtttgaaacctgcacgtggaggaggatggtgggctttgagtgtttagtggtagaccactgttctacgaaatagttttgacttgtagtgtatgtgcatcatatgcttttttaaaaaagaatatctttgtgtggcgatctatacattaagctattaggatgcttactaatgtcctgccatgtgtttagaacttgtgatcaaaggaatttcattttcattcttttgggaccttgtagaacatattctgtgatccatcccatcaatcattgttcctatgttgtgattactcctatactctgcttaactgtactcctatactctgcttaactgtggccatgtttagtttcttggctaatttttttaagtatattcggatacatatttatatttaaagtattaaatataatctaataataaaataaattatagattccgcctgtaaactacaagacgaatttattaagtctaattaatccgtcattagtaaatatttactgtagcattacattgtcaaataatgacgtaattaggctcaaaagatttgtctcgtaatttacatgcaaactgtgcaattggttttttttcgtccacatttaatgctctgtgcatgtgttcaaacattcgatgtgacatttttggaaaaaaaaattgaatctaaataaggcctgtttttgtttggtcaatactgctttaatggtgatacaagtgtcatctgaaacaaatgtgcaaaaggcgtatgagcagtttgatagtataatctgcttcatccatggcttcttttttggcggtatttttcaatttggaggtttaatgtcagccaaccatgtctatttttgttctcctgttttttgtgaggaattcctatcttttatttgaggaccatagcatccatatcttgataaactttattcctctattcaagtatgccacgtgtccaaacatcaccacaagaaggacaaaatagttgcctttgcacaaaccacatggagaggagaaaagggaaaataattgtgactcaaattcttggagcattgggggctgtaggctgtaattctagccattcacataggatagatgccaaaactcatgtaagagcaggtacaatagcaagctataaactagctataaatatattttaaagagataaagaagagagagaagagtagcgggctacagatctgtagctagctacagcatggactcaaaaacataacgtatatattacaggtgagactatgcattaatagtatatagtaagcaactattatatgaattggctactatattggctgtacatgatttggagctagtagtgagctatactattagacttgctctaaagcatacaacacctaactacttttttgcatgtacctaaaatgtttggatatgtatcctaaggctcatatgcaccatttaaaagaggctttaacaccaaactaataaaaagttaatacgccatttaagggtcacaggtaaaaagattcttctgagaaggtctaaaacgagtattttctaatgtagtctgggaaggcatagatggaattacaacaataccatcaacattagttgcggatcgagaaaaaaatagtttattggtgttactctaaacttaatatccctcggtacacgatgtcatattttcgttttataggccatttaacaatggattttctcggagttcatcgggtctattgatccaatagatctaatttacatctcctccttctcgagggtagtagaataaaagactttggattttgatcaacaatgaaaatgcacaaaactcctagatatctcaaaaatggattgagatccagtgcagttgttattgctactgcgcataatctgatccctctatttcttgatccaatgatccaaatcgtttgctacagtgaatcagcactagttcttgcagcaacgctacagtactttgctacagtattctaatgcatctgggccatatgtttcaaatctagtggtgctggtgtgactgtgtaacttgcagtcacaatatcacactagctactgcacctgaaccgaatccctccaaaatctatctgaagcggtgtggaatggacacacaatttataatgaaaagtctgatgggcaaacgcgctcaccacatactccctccgtttcatattataagactttctagcattacccacattcatatggatattaatgaatctatacatatatacatacatacatacatacttttatatatatatatatatatatatatatatatatatatatatatatatatatatatatatatatatatatatatat

SEQ ID NO: 59825 - DNA, 25747 bp, Oryza sativa
ctcctcaaggatcgtaaaattgctcatattagattgtgcaaaaaaatagttgatcaattaatctctaaagcatcatcctttcacttatgcttatataagccaaactttaaaatttaaaacttagttttaaagttgattttgttggtttttcatcatagtttattttacagcacatgcttttaaatctctaaggacagtatgtataaaaattttatccacattatttttcaatggctgataagcaatacggataaacacgaagtataagcgaaacaatggggccgctagtctctaatgaatatgatgataactgtacacttgtaaattttacaaaaattctttcaacacagttcacctgaagactatatttatattgaaaattttcaagcgtctatgtatcattttgtcaacaatatttggtgactaattatcatcactatgatagaaaaagaatatatccaaaatatactgcaaacaaagtcaaccacataggagaaaaaaaagagaacaataatgttgcatttttgtagaatatcttattagatgacacaaactcatgatctccaggacaatgaaatggcatgcatatgccttgatcaggctgctagcttgtctggatcacagtattaaacagataactaaatgaacatgatgaatcatcaaacaaatgcatagtctttttcaatatttattatcttactcctatatacatagaacatgcaccacattttatatagtagtacatggaacactctatcttcagtgctatatgtcgggtttgctatcctggtttgtttttgactttacatagtagcttttatcggtgtgctggttaggtacatgtgtgaagagggacatcaggaagcaaaagagaagagaaaattgaaaatgcttccaattttgtggcaggtagtacaaatgttttatcaagaaaatataccgcctgcaaaaaaaaaaaatcttcggaaggaacccaaagtgaatgatttgagatcacgcaatactcatttcattctgttggttggctaattagttatagatgctttgtgccttcgttgacacactcatatgccaatcaagcaaataaacaagtttatttccaagtccaaataggaatgcacacatataggaaatttagcattcggccggtggtcttcacgttagatgatgccattcaattaaccagggacgacctttcaaatagagtcatcgcctcattggtgtagttacgtaccctttgcatgtttctagttacacactcagtaatccgtttttaacgaaaaggccggatttcacacccaatcgattgaactatttttattaatgccacacaatgtctgaaaatgacacccattgattgtgttgttagtagcactgtggactaaaataagatataaacagtcatgtcccgtgagtacgtaccatccgcttaattgccgtgaatagtggttaaatgtatacaaaactctatcatgtttgcacaggatatgattaatcaaccaaccacattttcttgttaggttatataggggcatgtcattgactaattaagatgtgttaaagtaatcaccaaaacagcatttgatatagtaggtgtggcggtatattaatcctttttgtcttcattaaaatttgatggattttatacaaaaccaaatttgacaactagataggtagaacatacatgtacatgcttgcatgtcggtgcaaacaaaaaaaaacaaacaaacaaaggcgtgcagatgaggaggtatcatccatcctagggtgacaaaccggtaaagagaaaaagggcatccttcctagtgcaagaaaaggtgatgttaaaatgattgggtcgcagctcaaatgataagaacaaagagaagcgtttggaagcggcacaagtatgcaaaactaaattattaatagcttaatatgccgcctgatagcgacatcatgatgtgctagtttcttttgatctgttgcgtatattattgtttttttatctctctatctcttttcattttattatattagtgtaaccgcacagaagagaggaaaaaaaaaacctgtaaagttgcggcgattccagggaccttttccagtgcagcacggctgaaacaaataaaaagataggaaaataattaaaaaaaagggttccctccaacgtcgggatgagctctgtgtgtcgtgttctgtggtgtcagtgtcgcacaaagctgcaatgctaacttagttatatatgcatgcatggctgctgtgtgcaccaagaatttaccaaaagaagcctcaccaacgtgtatttcaaattaccctttaaaggccctgccgcagggatacctgggactttttaatatcccaaatgtttaaaaaaaactctaattaactactttattatgtaaaaaaaatatcaaagttaaagctgattgcaatagttcaactggaacatatacctagctattgtgataaaaaaattctagagtagattatattacaacatgttgtatataaatttgcgaattaattaggaaaacaaagcacctgatggattacctgaacaattctttttagccaggggtgtgaccatttctttaagaaaattaaataatgtgagctctgtcaaccaatgaaagggtttaataaggcaaaccttgtctggcatgactaatcaaaccagttaaacagggagatgcgtccaaatggccccttgctatatatgtgaaccatggtccagccggcggctcccactgtgcacgccggtgagccgcggcgatcgatgatggtccaaacggaaacccatacattatcatggtcccgtacgtgttgctggagagacgatctgaaattagacatctttttcccttgtcctcttcaagcttggatgcataggagagataactaattaagcagatccatcgatccttgagagataaaccacatgtatatctagttagcttgtgttgtccatctggaccaccaagtcatcaggtttggttagccacaaaaccttgcgtaaatccatccgatcgggtcacatgccgaggcgtgagcctgaagctcgttgaatcattagtacttgcccctgaagaaacagcttcgatctaatcggcagatcagaggctggatgcatgcttggattccttccctgtcttttaacaaagacgaattaaaacccagtatgttaacagactccgtgagagttaatgacagattagcactgaccttattcgatgaaaaggaaccttctttcttcagagaaaagcttgaactggctttagcctgtgcaaggggtaggaccatttctgttacagcaacaatccaagattgttgtgtccaggatggagctgtcaatggctcgagatgttaatcctgccaactgttttcccctttccataatcccttgtgtggtgtgcatctgtacaaagctagctaaatggtgcacttccattaaccttttagcagcacctacccaacaagtgaagctaggaccaactgttgacaacaatacttcaacgaccacaatgaaagatagccggccaatttggttgtccctgtgagcacttgtacgccataatacaggttccttgatgccgtcagattatagatgcatgtactcaaatacgcatcatctgtaaacaggaaaagaccgtgagtgtaactgaagatagcaatcttgtaaaaaaaaaagtgtaataatacgtcagagatttcaaatactgatatcagattgataccacttgattggcgaggaaaatgaagtgctggaatctgggccaggatttaagtaaaagcagataaaagtcacaagcatatctgggcaggactaaaatcatatattccaacttgcatatcggcttccagtgtcccaaggtatttttatcttgggcatctcatccatactcaaataagagcctgacccatgtgataatcagaactactagtttccttctcattaggttaaagtgccaacatttcgcttgtacatcatggttccagcaaagattccctacagtttcacaaaaggtaccatcacctaaagcacacacttgagtgttactgtcattacagggcagtacaaagtgaccaaaccacaaaagaatttatcagtcagaagtccatttcaccttaatgtgctcaattacatgtagaattgccaccgttgctctggttgtcttgtctcatgattaggcgagcgcaccgatgctgtagtgcactaggaaactctttctgatatccgttagtgttaggtggtgaaaaaactttatttacagcgtgcaaaatccttcttccatgaccatagcacacatggcaccccagcaatccatctggttccagtaagaaataacagaatggtacaatgggaaaaatacttaaactttaaagctgattacttggtagaaatcaaggaatcagattttattcactttgtcaaaataccagctaaaaaatatcacatatgagggaatgaattctcttccatgtcccctacagggatgaccgccaattgaaatcggatctataaaagtaaaacggaaaaggaaaaaatagtaaagcttccatttcttttggtttctaatattggtaggaaaagggtaagtaatgtaaagtagaagtgggggaattgtgagttgttgatagttattcccatgccagaggagtccagccaagaacgaaagctatacacaaatactcactaggcaacatggagagacatggctcccatgttatcccgtgcaacccctgttccccacttgtgccctcccgttgcacatggcctcataaccaacccttcctcccctcctctcctatagttaacattgccatgggaccccattcctatacagaacaattatcaccaccttccttttcccaactcctctgtaccctagacttctgcattggaacagtgctctgttctaagcattgtatagcaatatctctaccactataaaatcaattcatgaggtgaatctgattgcaaacttttatgaattattgcatggactaaatagtcttgttataaacaggaaccaagctaaggataaagaaattcatgcaatttaatatacagatgctaaaaatgcctaacgcttaattgtgagattaaggggatctttataatgagcatctgtaccatatacagtacttcagctcagttagtcacagctactgtagaagataaatattcgaaattggtggagtcccagttctttcgaaaaggacatgttttatcattttactttcatgtccatctacactatctttcgttgtcagcccaatcttggaggtgtgtcataatatcatctactaagatatgacaaaagtattcgggctagcgggccaggtggttaattagataatcacaggggaggctttagagcccataaggaattgcacgctacagtaggaactgcaataaagaatcccaatatattgaaacgttactgttgactgataggaacatatgagcataaaaattcctgtaactttccagccatacaagtgggttggcctttgaggggtcattttcacagaccatacttacaattgccacaactttgatagagatattgtaaactagaagttagataaggagtctgccgcttacatattaaccattaaaggaaatctttagattatcaccgcatagcccaaaataggaagattctcaccaagttgggcctcatcaattgatatgccggagttctgataagagtcacgcagctactcgaacagcaaatgccagtgtaagattcttcacctgaaataaacatttggacagaaactgatgtagtatagatatcaatagaacagatgaaactcaaaggattattccaaataagtcatcgaatcacatatcatcaattcttatatatataattacccacagggggtaaagaaaaaaaggaaaaagaacagaatcagaggaatcagtgatcaaaatagctccacatatttccttgtttcttttaggactaactggcttacaaatgaataataaatatatggaagtcattgttgtatagagttgttatgtattgaagcatgtagaaataagttcaatattactagtttgggtcccacatataaagtataaaacaaactgaaaaaactatgttagcttgagtttcacacggtaatcctccttatcatattttacacacgtcacatcaaataaattattattgcttcaccagacataacttgcagtatatgctaaagcctactttaaacaataatgaaacaaacttacatgcccttaacaacttgactactgacctaaataacgtttacatgatgacagtgcaagctggatgtgatgcatgaaagattgttcaaaaacaaaataatcattcacttacatcgatgctgtcaatcactatcctagtcaaacttaacattttgaagggtttattcagaggctatcattattataaagcctaagagtatatgaaaatcagggaagattcatctccccattcagcccttcagggaatatgacttctgtcatgcaaccctgacaggttattgttactgcaaaaagtactgaactccaatatcttttatttcccttgaaattatttgacccctgtatttcactttctatttgatggaaactatttcgttgagttcacaatagtaggagccaaaacaaaaatctattgcacagcagctgtaagtgtaaagcatagcactactagatctgtgaagtcaactgccgggaaccatagagaactcaaaatcaagtgattgtgtattggagaggtagacagtggaatacttacagaatgtctgaaacgacaatgctgggacatcacttatctaataaatgaacaaaagatagctatgaccaagtgaggcactgcaataagggggtaataatcgataaaaactttgaagagagagccgattgtaccaatcaaagtacgatgcaaacataactattcctttcactcgatttcgcagaatccctctataaaattcccttgccaactccaagcactacttgtgcagttctgcccatgcccagccatcaactaggatcgtgttagggttaatcactacatgaagtgaataaaaaaaatatcaactgaccttattgggtaaaattttacaggcctagcgccctacctctcaaattaacatctagtgaaactgaataatagataaacagaggcacaaagtgagtactggttactggtaagggaaggggcgtcacatcgccactacagtgctcgcggctggtctcctccccctccgaatcgaaccgagcagcgccggcgaggaggagccgccttcccccaacccggcaaccccccgaacccaacggtgcagaaggggtcggcggccggagcggagccgacgcggcggttgaagggagtagccgagttaggaggaggagctcaccgccgtgccgagagtgggtgcacgcacgccgcgccccgccggccggcttgttcggccggccgccgctccgcgcgacgcggcacggcgaaggcgctcgcctcgctccgtccgtccccacgagcagaggcttcagcgggccgtgtgcttcgtcacgggcccaacagcaagaagctcagctggagaagcagcccgtgtagatgggcccgtccggttaccgttgattggcctcagtggtgaaggagcccgtgtagatggatcttcggcgtgggggaaaaaggccgaaatgtcacgggaaccaactacgggaggccgtgggccgcatccattaggataagcgggctagatctatccatgcgactagcgggcatcaattcgctgcggaaaatgtctaatttttcttaggttggatctaattcgtcttttaaccataaaatcagatataataacccctctaactattaagagagttgaaaaagatttctaagatagtattgcgggaagaggagagagatatggggaggagggaggaaggagaaaggaaggagggtaagcgagaatgacatgtgagttccacttgatatcctaacatccttgttggcttggtgtttttgaccgtggttaatttgccacgttagctaatgccattctaaatactccctccgtatctaaatataagagattttagtcggatataatatatcctggtataatgattcgttatattaggatgtgttattttcaaccaatatcccttatatttatagagacagatggagtagtgtcttataagtttttttttccggttttaacggttagtagagttgttgtatccagcagctttacgatcgagaaatacggcctatatttaagggagttacaatagacattttccattcggcaagtcagaggttgacacgacgacgacgcgagtcacacgacgcgacagccttcaccgacgcacatggccgtccagctcgggcgcatcacggggcacgccgcacgcggcccactccgtaccggccgcgccatggattccacgcggtggccgcactccgtcccgtgcgggcgtgcggcccatgctgccatggcatccaatccgatgcaatccaaccgacatctccgcggccgcatcgcccgctcccgtcaccgacgcaacccacggtccaaagtccacagacttcaccgccgctgttaccgcgatcccgggctcctccccacagctgtcgtcgcgtcaacccattatccttcaccgccacactcgctgacaggtgggtccacgtcgccgacccgcaccacatggcccacgaggcagtcaccctacgatgtgtggcagtgaccctatgcaggcggtgccttatatttagcgcacaggaaacccatgagaaatccaaggtcatcaccaccttcttcctcctcttcatttgccatctttagtaccacctcgccttcccaatccaatctcgccgcccattaaggcccgagagcccccattccgccagatccatgacggtctcgtcgccgtcggcggaggagccgttccgggtgttcgtcggctacgacccgcgggaggacgaggcgtacgaggtgtgccgccgcagcctgctccgccacgcctccatccccgtcgacgtccgccccatccggcagccggatctccgcgcggcggggctctactggcgggagcgggggcccaccgagagcaccgagttctccttcacccgcttcctcacaccctacctcgccggctaccgcgggtgggcgctcttcgtcgactgcgacttcctctacctcgccgacatcgccggcctcctcgcctgcctcccctcctccgaccccgaccaccgcctcgccgtcgcttgcgtcaagcacgagtacgcccccgccgaggcgaccaagatggacggcgccatccagaccgtgtacccgcgcaagaactggtcgtccatggtgctctacaactgcggccaccccaagaacgtcgccgcgctcaccccggacgccgtcagcacccagaccggcgccttcctccaccgattcgcctggctcgatgacgacgagatcggcgagatccccttcgcctggaacttcctcgtcggccacaacaaggtcgaccccgccgacccgtccacgcagcccaaggccatccactacacctccggcgggccgtggttcgagaggtacaggaactgcgacttcgccgagctctggatcaaggaggccgacgagctcaaggccgacaaggagaagcagaagcagcagcagatcgtcatggccaacggcgagaaggagaaagacgaggaggggaattgaatcgaatccaattgaattcattgtgccgcattgcgttgcaattttgcatcgaattggttcaaatctgttgtttattgggttggggttgggtggtaggctatgagtggatagctctagtattggtagtagtacgcttttgtgtagcggcaaatcaatctatctatgagtcctcaatgttcaggaattttaattcttttggcctttgatcaattgaccatgtacctgtttttgctgtttctgaatactgatcatactggctagccttctctaatgctggaattgagaaatcaggttgggtctcgagtgtcccgtgagggaatgaaatgtgatcattttccttttgcagtgaagattttgtgcccatttcatcagtttgcaggtagcattatgttcatatgttgatgtctgcattcaaccgattcaggagattggattttcatttggtgatctgaacctcagaatgttccgtacagccgatacagataatctgaagagataccttcgttttatatatctgttactactaattaaattaaagctcagtgacagatcacagatgcatgttctttggagattggacaagaccagcttaaaatgtgtcctgtcatccgtacattgtactcctaatcacgtgtagtgtacacaatacagtactactattagatctcagtgatcactgcagtgttctggtgatcactgtattctggtcgcctgaattttctctcttgataagagaatccaaagctgactgaggtggtgtttgggtgggagggactaaataagtcattatcacatcggatgtttggacactaattataaatattaaacgtagactattaataaaatccatccataatcttgaactaattcacgagacgaatctattgagcctaattaatccgtgattagcctatgtgatgctacagtaaatattatctaattatggattaattaggcttaaaaaatttatctcgcaaattagcttttatttatgtaattagttttgtaagtagtctatatttaatactctaaattagtgtctaaatatagagaataaagttaagtccctggatccaaacatcacctaaactttagtccttcacaaaaaacataagggggtgtttgggagagaggggctaaactttagctatctcttaagtattcagtccaaggatgcaagcaaagcatcatgctggatggattgctgaacaatttatcccattgatcaatgcctttctcaacatgttgtgaacttgtgatctgaaagcaaagtatctggtctctctgaactctgaagcttggaaccagcagcaattggtgtcagtagtcagcaactgtgtactgaaacgttgggtttgctgttttgagcccactgtaatgcatgtgcacatgtcttggctgtaagctgaatactgaattcgttgcaaaatgccgtatggatcacagaaagcacagccagaatggatcagtacattggttcctgcctgagaatggttggaatctgatgagttgcttgaattcctgaaatgtggttccaaacaacgtgtgtaaatttccattcagaaataccacatgtaaacttcaatagaggaattgatcattgtgagctggttgcatctttgaggctaaaacacattatgttcatcgataaagtacctcaaaccttgaaaccttgaagagtggagttgaggcatccggacagcagaggaagagcgtgttgcagctgaagactgaggagcaaatgaaagatagcggcggcggaggccaatcgtcttctccgcggccggtggatgtcgccgccgcccaccggcttccaatcgagtcgccgcgctgatcgatggagcaaaaactctcaattccatttccggagtaacaagtacgggccgcacgtagcccgcactcccttttcggcccaattactatataggccgcacgtgttgcatcccaacaaatgggccaaaagtaattcgcaatccagtccggaccgacagagttggacgtggccagcgaagtgggccttgtgggccatcgcatcgcaccactgcattttatggtttgtaacaggaaaatatgttgcaactttgacggcatttaaatttcttcaaaacaagaatattttgaaactacactgaacaaaagtcactgtgaaattatctagtcctgatgtagtctgtctgtgattttgtcatgtatttccttttttcctttggtatactttggaacgaccaattgacaagtataggttgaattcacattgaccagaagaaatataccatacattatttcatgatgtcctctatacatgatgataatttattgcctttcggttaatgttttcatggtatcaggcagtattttgctatcgtctacattactgtgtaccctggaccgcctccaccttctggaacggtccattcgatgttttgctttggatctttgatgtcacaagcctgcagataccgtcaacatttcattcagttacaggaaacaaaagatgcaaatgtccatggacaactgaatcaacatggaggcaaataccttgcaatgaagacaattttgagcatttatgtgaagcttctggtcacctttctcgtcggtgacatacctgcatgagaacatgtatggcagaagtgattagcaatccttgtttgggcattcagtacttaattgtaggttatctttcattcaagtaagaaaggccaatttccttactcgtaaactcgagctggacaataatgtgactctggtccagcatacagaggaagatttactctctccggtactgtaggatccctcaaacggagatgaggaggttgatcatgctcatggtttgtgctgctcctgtataaatgagatcatacatgatcagtgtacagaatatgcatgtaaatcactccacattacatttcagttcatgaaaaaaaaatggagaacgatagccattcacccactaaatttgatgaatctgccgccactatactacatgtgactattaagaaaaagctctaaaccaattcacaggaaagcactattgcttctaaaaattgtgaacataacttgaaactttgaaagaaagaattctaaagagtgatgtctaaagagtgatggacgtcatcattcttgctgcatatcttacctgtataaagaagttggtacgtcaaaggatatttgaccatctggtttcggatattgaataggcgagtgcaaactggccatctgttcacaagaatgtgtttggttaatgtcagtagtgaaaaaatgaaacaatgtgcttttcatttatgctaacaaagaatgtctatattagatgagcaccagcagtacttgaaactcacatctgttgcttcatggtcaggtatcccgtgctttaaggtaaagggggactttcctttgaatacgtatctaaaaattgaacaataacaacaaacgtcagcgaaccaagtagagtattgacttcatcccaaaagaagtatagaatattaagtaatattaacaaattagttgggcctcaccgttccagtgcagacaaggcaatgcctggaataaatccatattcaaatgcctgtaacagaatataaataaatctgtctgctcaatagcttcagaaaggaaaaaacagaaactgcatatcctcacttcaaaagcttgtatgacggaatacttaattagacaaaataaatgttcaggaagtctgtaacaaacataatcacatactggtctgtaattccgagctctataaagctcttcccatatccatgacttcttgagattctcccaatagagttccatcgaagatccttcaacaagagttttgaaagttgcttctgcagccagcatacctgttgtacacatccaaccctttagtacatggcttctcagcatactctacagttagcacacatgatctaccatttttggttgagaataatgtgccactttaaggagatcaaaatgtgtactctgaaagaaatgtaaagtaattgacataaaagtgaacaggcagcactacaacataaagctcaaagcatcacgtaaagagatacctgacttcatggctgtatgagttccttttattttgggaacattaaggaaccctgcagagcatccaataattgcacctccagggaaaactggatttggtattgactgaaattttacatgaacattatcagcaccctatcagtaactattgctaacaactaaagaaaacaaaatacaggagacctgactgaatgacggaggtaaaagctacagtgtcgaaacatatagcataacaagaacactataacaatgctgtgtctcaaagttcatgtaccagttaaccggaaacaccaggtgaattgattttgatgtaaaatgcttgtaatgtcataaaccggcagatgcccaatatagttatgcgcagagtttacatatcatatgaatctatttacaacaaaattttcatttctttgacatgccacttacttgaaaaccaccttcattcaacgtacgagcaccatactgaagaactgttccaccatccaaaattgtcctgacagcagggtgttgcttgaatttctgaaatataaaatatgattgcataatgcttagaagaaaaaaaatcgaccatcaggagttcaggactatactagtacactaccatcataaaagaacatacccatagaaatttgactaacctggaattcatcgtatgggctcatgaaaggattttgatagttcaaggcaacaaccagacctatcgctaactgaaatatcagagcagagataaagtaaacaccactaagcgataaagtaatcaaaatttccggggaaaaaactgagcaagttatacatttatccactctgcaaacaaaaggccttatgataagggatgaattaatggttcctcctttaaacccaaattataatctgtaagctgtgaacttaggttgtggagaaggatgcatctatcatgtaagataaatacatttttacatctttacacagatgacagacttcactgaacatatatttgcaaaagaaaagagaactcataaagggatattgtagcaaataacagaagaactacctgtctatcatcaaggtgatacataaatgatcctccatatgttttcgagtccaaaggccaccctacagtatgaatcacagaacctggcttgtgctttccttcctcgatctcccaaacctaagaaagcttccaattagtttcaagtggcactgctaactcgtctgtaagtcattttaaggaaaagaatggagatgttttgaagataaagctagtaaatcatagttctataaggaacaaacgaaagcatctaatggaattcctcaaaaataaccataagttctttattagaaaatatttttgaagtgtttgtgcatgggtgattttgaaaatgttaacataaaagagtgttacctatagtttgcatatattgcatgtataatgtggtatgggactgatttaagtcagacgattttcacacatacacacacacacacacacacaaaggatcttgttttcctcacgagatatatgagttggtttgataagatttgagaacaaggcatttggaaactgaaagtggtattactgaatatcaaggtacctccttaattccaagagcatatgtctgatgctggccttgcccactctctctgagcttgtggttccttattattttctggaaagagaaagagggaagaataacatgataagtgttagcaccaaatgaaatatatatataaaaaagaacatatgaatttcataaaactagatttatgctgacctctgataatgaacctcggcaaccctcggccaacagtgtcattcgccctgcattttctaagtagctgaccatgagaatagacacgtgagtggaaccaccagcttggaacaaatgggtaccaattttacagaaagaacaacgtcaacagactgaaaaggttttaaagacaaacaatagggaaaacaaaatcactattatctgcctatacaaacaacggaaaaaaaaggagcaattgattatctcaacattatgcactcaataaggatggttactcgcctcttagttcaacaccaggttgaaaagtttcccttttggaaccatctttagcaataccaacatcattggttgcaacgcctgtaactatttgattttcatcataaaggatctgttagagaagaattcagacagattaatattagccctttgacagaagagttccacaactgaaaaatggtggtacctcactcgcagcaaaacctggatatacttcaacacccaattcttcagctttggaggccatccatcgcaccatttggctcaagctggacaatattaagcattgtttctaaaatcagatactgtcgaataagtgaaatatactagaactttgcatagatgaagctaataattagaagaaaatctcagcaccttatcacatagtttcccttgttatcgaaaggagatggaagtgtccatgccttattctttgtcaacagccagaacttgtcagatgagacggggactcttattggggtctatcaaacacacagtaggcacataaatatcaatgccttatgtacttagaactaaatttactttgttactgaagtgtattttgctatcattattcaaggaactgccatatcaaaaggaccaggtcttattcattgggaatttgggacatctcatgatgcaattgttagtttgaaactgttactgagcatcaactaattaaatttcgcccccccccccccccaaaaaaaaaataaataaataattattattattatatatcgtttatttctgtgcatttgccctacgcaaagcaaaattagggagctgaaacatcctcatacaccaaaatatccatgatttcccatgatcaaatgaacctcaggcttctgatgaagggatcaaccatagttaatttgcacttggtctagagtctagacagcagaatggccaactaaaacatacttatatagcatatccagtttagagcagagaagggcatacatcctcttgcctccacttcgggatgagttcatccaacgctcgtggctcgaacacgttccccgacaatacatgcgcacctgcagcgagagcaagcaaaatcaaacaaacgccaaattacacgagcaggagtagagtaacgccatcgcgcactggcgtgctaagacgcaagcaaccggaccgaagggggaaccgattccggaggaagacacgcaccgacttcggagcccttctcgaggacgcagacggagaggtcggtgtcggcgtcgcggcagagctgcttcagccggatggccgcggcgagccccgcgggcccagcccccacgaccaccacgtcgtagctcatcgcctccctgcccccgctcagccacctcgccgccgccgccgccgcgccccacctcggcgcgcggtggcccgacgcgtggccaatccccgccgccgccgcgcggagcactcgttgcattgccgcgggaagcttcccgatcccgagccgaaagggaggaaggagaaggccgggaaggtacggaactgtggaggaatgggagtggcagttgagctccgcgacgggacggcgatgggattaggtcgctgaggtggaagaagacgaggacgaacagtattcctttttttttaattgaaaactaatactccctccgtcacaatataagggattttgagtttttgattgcaacgtttaaccacttgtcttattcaattttttttacaaatataaaaaatgaaaagttgtgcttaaattactgtagataataaagtaagtcacaaataaaataaataataattttaaatttttttaaataagacgagtggtcaaacgttgcaagtaaaaatctaaaatcccttatattacgggacagagagagtaataataattcgctctgttcatgggctgtttccgggctagctttatgggcctttgaacacttctactagtttttgggccttacataaatgggccgttacatggtgatgcaggctggagtttgggcccatcgaacaaggagcatggtattgctgggcttctttcggcctgccccgctgttcaaggatttaacctcgattttgctattacatccatcatcgaacaaaaaacttgtcaagaataaatatagtataattatattgtaacttacgtttaactaaagtataacttgtattatattatagttgcatgtaaactacagtgtaattatgctacaattatactatatttagattttacaaagttgtcaacaaatgttagaatataacatagtcattacacaagtacgtggttgtctcgaagaaaaagggagttacaatgttgccatcactggccatagatgatgtatacgtatacacgtcctgtacttgtctctgaacacaagctacgatacccagctagttccagaaaagaaaagcagagaagaacatctgaagcaatgccagaggaagtgccacagcttcaagtcaagctatcctgcttttgcacgagcgtgtagtgttgtgcatagacgacggaaggggataaacgcctgtgatttagccgacaaatcccatttaggacagatgaccaaagctaaactatgctggttgctgccttacaaggaacatccctcctgcctcctgattcctgcacacactgcccggcatctctctctgtctgggtcaacgtacaaatcgttctagttttctactactatatattgtatactactagtatatttgatcaggtaagtgctagagaactgtgtatagctagcacaaaaatgtattataattaggattggtttaatctgtaaatgtgttgcactccaaccaagcacaagtccccatcagaagtttcagagccattagacaaagggttgcaccacactctgagctgcctgcacgtagcttcgtttctgtacttctctatttggatgccaaaccaagacgcttgtcccagttagtaggttcaagcaacaagaacagaaaatagtacatctcttctacgattaatattattcagagtttcggacacataaactggagctaatcagctaatcgcagcagcgtgcaaataatagagagaatctcttatatgccactagaatttaaccagttcccttatatgccatttaaaattggcttctctcttatatgccactagttcaagtttttccacccttttatgccactcccaccactatagtgttagttgactgttagtcaaaggttagttttttcataaatgaccaatatgccctctcaactaaaaaatgtgtaaacttcaaaaaaatcataactaatttattttaaatcctttttggatgaacaaaattttatcagaaccagtgaaaaatgctctttatattaaaaatattgttggaaaactgcatgtttcatgcttacattgaaaatttatttgtgatggtaatggctaaaattgcatgtgatgcataaaaaatcaattttcatatgttgtatccagtatagctatattagtactaaaatacctattattaagggcaaatgagtctttttacaataaagttaacggtcaactgacggtggactgacggtaatggcataaaagggaggagaaacttgaaccggtggcataaaagggagaagccaatttaaagtggcatataaaggagccggttaatttagagtggcatataagggattctctccaaataataatatttggagaacaaggacacgttttcagtaccggtgcgataaacaaattcaagtacaggatcgtagaagatatagcttatggattgcagcgtccgacgacgattcagccgacaaatttgctcgcgccggcgacgctgtccggtggttcgacgaacaggatttctatcgctgaatcctccacacgaacgatctgtaattcgtgcgcccatgcaactccaggggagttgcaaaaattgcaatctcttccagtcaatgacgcaaccagatgcaaaattgtgatcctactaaaacctttttttaaagactatttcaactgatgaaaagtttagaatcacgcatagtttcaaagctgctgttccaatcagtgcatttgaataggagtataggaccccatgggtagtactattttatggctcgttgcgaagctgttgagcttggaagttagatgaacacagtcttgtcagttctgatgtccattttgctcattcgctcctcgcacgtagcttccaagcacactgcaaaactcccccaaaattattatttttcccctctgaatatccatatatccattgcaccaaacgattgaattggtggtacggcaagcaaaagacatggcatatttattgtctctaaattatatatttagtagccgcacgcacggtttaggaagattgttcttgtctgattgattctctagtactcctctagctagtagctcctgttgcacacatctttttctgccttaaaaagttcgatttttttcttcttctgaatgactcgtgaagcttcttgcttgcttcacgctctcgtcttgagcaaataaatttgagtcacatcacatcgctcaaagatgcctatagttttaagtatttaaactctaattaatctgtcgtgttcatgattgattggtggtggcggtgcgattttgggaatgtgatggaatttggaagccatcagagttcagccacgcatggcccagcaggagactgcactgttggtgttaattgtgtgttcttcgtgtcaattggactgaaactaagtgcacactatgttaggacgtcgtcttctacattggaccccaggatgtgtatccctgtgctgctctctccatggacggactccaaatcttcaatccaatatatcgtgatgtgatcgccgcgacgatacgattttatagtgtactacacaagtacacatccgaaaggcgctgcgatgtatgatcagacgatgaaacagcatcaagatcaagccttttttcataaacaaacagctgtcctattcctagatagctatgattaattcccaagaactgcaagatcctgaaggcaccaattaattaatattcagatgataaataaagatggtacaaaactgagaggtgaggggttaagttcttggtgtcagtgagatgtgaatcacaagagagaaaaattgtgacctaaatgaacacattacacatggaatgaaaggctctttgttttgtttctcttacaagttttattaaaaaaaactgttgcctagttgtggaagcaagaactcgagcgctttacggtacattgtcaataattatctagcagctttcacgcattcaggttgttgacatactctctccatcactcatatcagaatctctacattagtatattgtttatctacaagccacaaaatcaaaggcaaacgaactgacgcgtgagtctgaactctaatacgattcagggactagcagtagagcacaagacagtttagtttagcacatgtgatccacacggtgcaattcgccgtggaaagtcaccaaaatgtgacatgtaaactcgcttctgccgttgctttcggagctagtttctttcgtcaccttgcagatcactgttgcaggacagcaatcagtgaccaaatcaggtagccgtgaaaaatgacagtaacctgctgaagaaagctctgaatttcttgtccgggacgctgggtgtaactgcttaaattaatacttggacctaatctcggatgcaaattcttttgtttgcatctttctcacgagagttgaacatagtgatgactaaatctctgaaaaggattcacagacaatctgggaatcaaagaaagccatattttcagtgattcaggacactgactgaaactattttctttgtaggcatgcaattctgtcatcatccatcaccaggaacactgttctgtgttctacacttctactggtagcacttgcaattatatatctcagctagtagctgtttcagagtgaaaaagtctatggcgtcccaaaattcactcatcaagatgcttcactgtgaccatcactttgtccttaaagagcatttggacgtactccattttgcaacacagtgcagattagtgctttgttttgtggtcagtgagccatccgaatcagcaccaaatgattgctcattggcctactcaattagtagtaaggcccaagctgctgctgatgctgctactgttcctgatgacttagcctcagcgactttttgttcccagtacaggtttcttttcttgctgcagcatccgtagcatagcagcaccctcccaagaaccaaacgctgctgattgctgcgtgccaccggatgtttttttctctctaatgctgacaagccaatgcactgttgaaccttgatggtttcgtgatatcggcgcaaggtggacggtccagatcatgcaacgagccatcatccgacggtcccaaaccgagtcaaatgatcaccagtcctctcctcccactgtttttattcacatatatgttttctgaacttttctctgaattgagcttcagtaaaccagaagtgttcattacgagagatcaattgctcactttttcaggtgcagctgtacgtagaagcacacttactcctgcttgaccccagtgactcctacacttgtcacattttcagtgtcttgtcttgttggatcatccaaacggcgagatgcccttgcattgcaaaagaggggaagatcagaagaagaagaagaattaagacggttcgatccataaagattaaagagagggcagcaagaacaggatggctagctgctcgtagcaagaacagtagcttggaagcaataaatttcaccttttaaaaccgctccccgtacgcagcccatgcagatgtgttgagttcagtgaacgcgatcgatcgtgaagagagatactagctctctttcctgtgagcttcaggaatccgatgtgtgcaatgcatgcccctctctctccttttgaaaagctgttcatctatgctcagctttattaactcgcaaatctgaaacaccgaaaggttagacgggtagtagtaactgtagtagtaacagcagaaggcaagtaagtactgatgcataactatatactgacattttagtcagggtttacaagcaaaatgttgcttttgctgatgtaaccttgtgacttcagagaacagagatatttcttttaccaccaaggactgcattttcgtctgcatcagcaggagtcctagatactactacaaggggaacatggtggcggaaattcctgatcgaccgagtatcacaatttttgtaaaagtagtaccatttccaattgtttttattctatccctatatatatagaactttgatttttatgatttctggaatcaacattgtactgatatcgccatcaaattgagtatatgaaattctcgaccaaccgagaaccattttccatagacatgatatcgttttcgacagttttcattccagcatctagcacactcgtatgcgagcttaattcgagcctgccagcttcacttcgccaacaacactcgagcattgcaatctgcaagcttccagcagcaagcagcctaattagcatcacagactcatctcagtatcacaccccatgatttcttagatgcatatgcatgcattcaaggacaaatcaaagcattctgctaataagctcgctaacgcggccacaaaatccgtcgctgacagatcatcagaagcaaccaaaaacccacattaatcgcggcgactccgctcagatcgatcgatcgatcgctgcgcccaccgtgatggccaccacaccagccgtcgtcgtctcctagctccacacctcccccttgaccaccgccaccgccaccggccggccgggccatgcacggcgaccggccggatcgaccaagccgacgccaccaaccaaatccatcccggtcatatctctgtcgcctcctcggacccccaagctccatcacatggtggttgtcattactgtcactcgatgaaaccccatccattgctgcggacacttatataagaataaaaaaaattttggatgcacttaatagtttagtgagaagggacgtgtggtttcaacccagaggtccctattcaatccccaacacgcttacatatttttctttaaaaaaaaatggagaggcgtctctaccctccatatctccattttttaaggaggatggaaattttattaaataaataagcaagaacaattagcaataaagtaggtactaaataagttgagtaattaatagggaatataattgcatagaacatgaacggttgagattaagcatgagagagatcgaatggctcatcttagcttcacgcatgttgagcttgtggctgtaactttatagaaagagaggatttgtgtcgtcagtgtaagtgtactgctggtaattgcacagtttaattaccagctaatgcatggctgggtggttaatcagctagatctctctggttttgagctagctgatcagtgatcagtgtagcagcggcaaattaataaatgggatgaaaaagcttttgcattgcatgcatcatttcgtacctcacctagacgatcaatggtggttgtgagacatcctggatcttgaaggaaatataactgtcctgtgtcacatataatggcgtttcagctgtaatctaatccaatggagctacctaagctaccacgtatacatgtacctatagctcacattatgagtgatcgatttatctaaaatccaataattagcccatccaaaaagggccataattgtttcaatttcagtgtaatctattggattccagggatgttggaataatggaataagaaggtgagctcaaaacggatttcctgtacatgtttaacaagtgtatttgttgtaacctaacactggcgagtgagtgaatgagtgagtgagtaaggtgggccccacatgccagtcactcacccccaggctctgctttctgctcctgcataataatcaattttttaatcagtcaccagttcatctcaacatctcatcctaatttgtctttgcatttttttttgcagtttacacccccaccaaatctgaaatccccacacgcagcaatatataaggctacaatacagagccccaaacgccacacaaagtctcctcctttcttcttcttcttcctcctctcgcctttcctctcctcctcctcttcttcttcttcttcttctcgtgggtgcaagaagcagagaaggagcaacgcgagctgagatcgagcgcgaggatgtggcagagatacaggttcttgtgctgcggctgcggcgggaacatggcggcctcggccgccggtgacagggggtgcgacgatgacgcggactgcggcggcggcagcggcggcgggggatttggggaggaggaggaggggggaaaggatcaattccacatccccagggtccaactagagcaaagcagtgtgaacacatggttggcaacaaagagtaaagagtcatgatagctagtaactcaagagctggtatcatatccagcatcatcaataacatttaatttctttgatgcctagtactgaatcaataaatcatgtgacacgtatatagaaaaccataaatcctgaaacaatataatgatgtttaccctgacaattgacattgctgcagaaatcggatctttaacacccaatacttttcaaaaaagtgagttatgggacccttgttgtattattccaattggaacagatacagccacattttgatcatctctacaaaggagaccattgagaacctacaaaatgaatttattaatgcatcagaacctgtagttgacaaatgagcattttatagtgacatgcaaggagaggatggcttcagaaagtggaagacaaacatggtctagtgttcatagaagtacataggttttgagaagtaagcattaacagccctcatgtgataaccattctaggttagcagcgtcactgaaaatgatttgaaggttttgtgggttcgacacccagttgtttaatgaactccaaaattgtgaataacaaagtaaaatattccaatatacaaatgtgctgatccc

SEQ ID NO: 59826 - DNA, 1457 bp, Oryza sativa
atgcggccggtgtgaaagctcgtaagtttgccaccgatgcagagcactgagagatcccctcataatttccccaaagcgtaaccatgtgtgaataaattttgagctagtagggttgcagccacgagtaagtcttcccttgttattgtgtagccagaatgccgcaaaacttccatgcctaagcgaactgttgagagtacgtttcgatttctgactgtgttagcctggaagtgcttgtcccaaccttgtttctgagcatgaacgcccgcaagccaacatgttagttgaagcatcagggcgattagcagcatgatatcaaaacgctctgagctgctcgttcggctatggcgtaggcctagtccgtaggcaggacttttcaagtctcggaaggtttcttcaatctgcattcgcttcgaatagatattaacaagttgtttgggtgttcgaatttcaacaggtaagttagttgctagaacccatggctcctttgccgacgctgagtagattttaggtgacgggtggtgacaatgagtccgtgtcgagcgctgattttttcggcctttagagcgagatttatacaatagaatttggcatgagattggattgcttttagtcagcctcttatagcctaaagtctttgagtgactagatgacatatcatgtaagttgctgataggtttccagttttccgctcctaggtctgcatattgtacttttcctcttactcgacttaaccagtaccaacccagcttctcaacggatttataccatggcactttaaagccagcatcactgacaatgagcggtgtggtgttactcggtagaatgctcgcaaggtcggctagaaattggtcatgagctttctttgaacattgctctgaaagcgggaacgctttctcataaagagtaacagaacgaccgtgtagtgcgactgaagctcgcaataccataagtcgtttttgctcacgaatatcagaccagtcaacaagtacaatgggcatcgtattgcccgaacagataaagctagcatgccaacggtatacagcgagtcgctctttgtggaggtgacgattacctaacaatcggtcgattcgtttgatgttatgttttgttctcgctttggttggcaggttacggccaagttcggtaagagtgagagttttacagtcaagtaatgcgtggcaagccaacgttaagctgttgagtcgttttaagtgtaattcggggcagaattggtaaagagagtcgtgtaaaatatcgagttcgcacatcttgttgtctgattattgatttttcgcgaaaccatttgatcatatgacaagatgtgtatccaccttaacttaatgatttttaccaaaatcattaggggattcatcagtgcataacccccaataaattcccgactgactgtcgaataaactccaactaaaatttttctaaagccctaggctgagctcatt

SEQ ID NO: 59827 - DNA, 7928 bp, Oryza sativa
cgggtgggccccacctgtgggcgatccccgagaaagaaggcggccgcggtctacaagactgggcctcggcctggggccggcccacaaagaagaatggtaagaaagaaggggaatggaccggcggcccatccaaaaataaaaaaggaggaaaaaagggagggaaaagaaaaagaaaaaaggaataggattttccctggaattaaaaattgcactttggtgatttttaattggttaaaattatttccaaggctttgaaaattccactaaaaatcctgttaatatattgtgacatgtagaatccaagaaaaattccacatgccgattccgattattatttgcatttattaattagggaattagctctaggttaattaagataatttcttcggacgatttatttagccaaatttttaaagcaagcaaaaaggggaaaacttcagggcgtgacaaacctaccccccttaaacggaatctcgaccccgagattcggaagagctggcgaagaggtgcgggtgggtggccttcaactcatcttctctttcccaagtggcctcttcctctgagtggtggctccactgaaccttgcagaatcttattactttgtttctggtctttctctcgctggtttcgaggatacgagttggcttctccacatacgtcaagtcttcctggatttcgatttgatccggacttgcctgttcctcaggaactctcaaacatttcttcaactgggagacgtggaacacattatggatgccaagcatgttggagggaagctcgagctggtaagcaacttcacctctacgttccaaaacccgatatggtcccacaaagcgtggtgccaactttcctttggtttggaagcgatgtactcccctgagcggagtgacacggagatacacataatcccctgtttcgaaagcgagctcccttcggcggttgtctgcatagcttttctgccgagactgcgcgattctcaatctttccctaacagctctgactttctcttctgcctcatttaaaacttctgtaccaaacaactggcgttcccctgtctgataccagaagagcggagtacgacacctccgtccatacagtgcttcaaatggtgccatctgcagactagcttggtaactgttgttgtacgagaactcagcatacggcaagcttttgtcccatgccccaccaaaatcaagcgcacaggctctcaacatatcctctagtatttgattgactcgctcggtctggccatctgtttgtggatggtaagcggtgctgaaattcaaccgggttcccaattcttcttgtaatttctgccagaactttgaagtgaattggcttcctcgatcagacacgatcttcttaggtacaccatgtaaacacataattcttgccagatagagttctgctaatttcttccctgagtaggtagtgtgcaccggaatgaagtgggccactttggtgagtcggtcaatgactacccaaatagaatcatgccccgatgacgtcctgggcaaaccggtgatgaaatccattccgatttcttcccacttccattctggaatctgaagtggctgtagcaaacctgctggcctttggtgttctgcctttactcgttgacagacgtcacagagtgctacgaattcagctatttcccttctcatgctgacccaccaaaacttctctttgaggtcttggtacatcttagtactaccgggatgaatggaatattgagtttgatgagcctcggttagtatcaggtcttttaattccttgttttcgggtacacacaatctttctcccatccagattgttccttgttcatcctcaacaaaacctcgggcttttccgaccctcatgttctttttgagctctgctatttcaggatcacttgcttgagctatgcgaacctgctccaccagtgtgggctgtgcctctagggcagccacgaatccgtgctcaactataccaaggttcaaatgttccaaatcatgttgaacctcacagcatagttcctctacccatgcgacgttgcagtaactcttcctgctcaaggcatctgctaccacattggccttgccgggatgatagtgtattcccatatcataatctttgattagctccaaccatcttcgttgtcggagattcagatcaggttgggtgaagatgtactttagacttttgtgatctgtatatacctcacaacggttaccgatgagatagtgccgccaaatctttaaagcatgaacaactgcggctaattccagatcatgcgtcgggtagttgccttcatgaggacgcaactgccgtgaagcataagaaaccactttgccatcctgcatcaacacacatcctagcccctggcgagatgcatcacaatagacctggaaatctttcgtctgatcaggcaggattaagactggtgcagacaccaaccgtcgtttgagttcttcaaaactcctattgcattcagcagaccagataaacttttcttccttcttcaatagctgtgtcattggcttagcaattttagagaagttctcaatgaaccggcggtaataacccgcaagtcctaagaaactccgaacctgagtgactgtccttggtggggtccatttggtaactgactccacatttgctggatccacagctactccttgagcattcacgatgtgaccgagaaactgaacttccttaagccagaagtcgcacttgctgaacttggcatatagctggtgctcttttaacttttcaagtaccagccgaagatgctgctcatgttcttcctcggacttggagtagataagtatgtcatcgatgaaaaccacgacaaacttgtctagaaattccataaacaccttgttcatcaaattcatgaagaaggcaggtgcgttagtgagtccgaaagacataactgtgcattcgaacaacccgtaccgagtgatgaatgctgtctttggaatatcctcttcgcggatcctcaactggtgatagcctgatcgcaggtctatcttagagaacacagtagctcctttcaactgatcaaacaggtcatcaatccttggcaaaggatacttgttcttgatggtgacctcattgagtgcgcggtagtcaacgcacatcctcttggttttgtctttcttctccacaaagataaccggagcaccccaaggcgacgtgctcgggcggatgtatcccttctgtaactgttcatcaacttgcttcttgacttccgccaactcgttggctcccattctgtaaggcctcttgtggatcggtgcagttccaggtaccaagtcaatccggaactcgatatccctttttggtggcattgttgtcagatcatccggaaaaacctctggatactctctgactatgggaatatcctccagcttcttagtggttttctccactgctacctcttgttcttcaccagcagcctggtttaaactaatccctggcttctgcggcactggagactggaagattaccacctctccttttgcattggtcaacttgatggtgcggctggcgcaatcaatcactcctctgtgccttgccaaccaatccattccaagtatgacatctaggtccttggattcgagaagaatgaggttggctggaaaaatcaacccttgaatttcaactgtcacagatgggcagtagtgagttgtggtcatgccacctccaggagtatgaactcgcattggtatcttaagcttcactaaagataacccatgtgcaccagcaaaacgcttggaaataaaggaatgggttgcaccagaatcaaacaatattactgccggtgtcgagttgacggggaatgtgcccaatataacctctggtgctgactgcgcctcctctgcagatgcatgattaacacgggcctgaacgaacttgggtccggcacgtcttggcttcgggcactttccaaccgtgtgtccgggtttgttacaattgaagcagagttcgggtttttctcccaacctcttgggctgttctgtcagagctggctgaactgattgagctggaatctttagtgaactcggagtagggttgaggctgtgctgctcactattgttgtgactgtcactatggtggttcttgttgaagttacccgggtggtagggacggtgctgccggataatcatggtggaaggtccaccgtgatgtcccatcgtgaaacgaggcttctgactcttcccctggggagtcctgaactgagctgccttcctcttacggtttattttgttacagtgctcctcctgacggatagccttatccaccagcttctcaaagtcctcataatctctagagatcaactggttagtcaattcatcatcaagaccagacaaaaacttctcctgcctctcggcatcggtacgcacgtcctcaggggcatagcgcgcgaggcggttgaactcatgcaaatactctataactgttctggttccttgttgcagggaacggaactctctcttcttttgtgccacgattccctcgggaacctgggctttattgaaactatgacaaaactctgtccaagtaacctctgccccagctggacgggtcaccatgtagttgtcccaccaaatagaagcgggaccttgtagctggtgtgtagcaaaagcaaccttctcctgctcgttgcattgcaaaagattcagcttcttctcaacggcatgaagccagtcgtgggcctcgattgggttggtggtgcttgagaaagtgggcggcttgacacgaagaaattctaacaatttggactgaggaggtggaggaccaaactgcaggttctgctgctgcagctgtgcttgctgctgcacctgctgcaacacctgatggtactgttgctgcatctgttgcatcatcattgtcatcatctgagtctgattgtccaacacctgagcgatcgttgggttctcgggcggtggggacggactgttgtcagatgcaccgttggcacgtgctccattgatcggctcttcgctgccactggcgttgttggagtcgcgtgaaccattccttgtctccatctgaggggataggtagaaatatgagaaaaggaagaaaacaggggctcagaaactaatcttgcttatgaatttaagtgcaattatcttaatcttgattaaaacactgaaaaagaggcacgaaactcctaattgaggcagtcataccactgacacatgatatcgaccgccgactaacccacaagcaacaaacctaaacacgaaaactagcaagcaaacagactaagaaggcgataaagctaagggcggcgactctgaagctcgaggcggcgcttgcaaacgagggataggactgacatctaaagtagacaagggataggaaccaactcatgctcaaatccaaattaaacaaagcaaaagaagactcaaataaataaccgagcatgatgatttttatgcatagaatatttttcatgaactcaaataaagacactaatgcaactaaacaataaattaatgcatagactagttgcatggaaaatgatgcgcataacattgcccccaccgaatatagacacgacctaatgcataacccccaataaattcccgactgactgtcgaataaactccaactaaaatttttctaaagccctaggctgagctcattttttttttaaaaaaaaatccgatccgaatgaacgaccaagatttttcccgcaaaccaaagaggcaaaactccaaattttcccaaaacaaattccaagtgcaaaagggcatatgcatatgaaaaggggttcagagggctcttagggtttccagttggcttgtcctacggtcaaggtcggctctgataccaacttgtcacgcccagaaattctcgaaccagaatttctaagctgaatgtgcattgaatccctgtccaggaccagccagggtacacaaacgacaattgttgacatacagatccacgtcttacaaaaatagaaaagattacaaatgcagcggaaaagataaaagcgagctaaaccgggaagcttgacttcagcagcgggcgactccactccacagacaatccttgacggcagcgacgaaaccaaatttgacaaaacagctccaactaggaaaatcttcagctctggtgtgggggaaaagagagcaagactgagtactacccactgtactcagcaagtcataccggtagaggaggtatgatgcaggatataaccaaaggaggctagaggttcttttgcataaagctagcatttaaaagcagtagttgaaagcagtaaaacagttgtagtaattaatcaatattaaccaaacactgtccaacgctacaccacgttgcaacaggcccaaccaaccacctgaactacaccagttcattaagctaaactaggggtgagactaatcacggtgaatctggttgatcgcccataaccgcgggcacggctattcgaatagttttactctggccagaggtgtacaactgtacccacaagacacgattccacacatgtcgccatgccccgaagtatcaccatgatactgcaaagggggaaatcgtgacaagaccctccacataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccactcccgcttgtggtaagcacggtaagtctcccagggtttcccgtgaaccggtccttaactgccatgggtgcgaccagcaaaaccatgcacccacaacccaccattcaatgtattttaattaactaataccattgcggtggcaccaatccaaagctatgctcatagtcaaagtctatgtaataaggtgatccccatttgtgtgctagttgaactaagcatggctaagcatttcctaaaccaacatctagtcattttgatacccaggttatcaatggcatatggtaaacaataaatggctgagtaataggacccattccacatgatattgtaaacgaatgcaacatttaatagaaatgcgggatatttgtaaattgggtacaatatgatcaaacgtattgcatgacttgccttgctctcgcactgacgagacctcagcaacgtcttcgagaaaccgtggatcgacgaaacggccgaaacctacgcgacaaacaaagcacacaagcaaaacaggctataagactactgaaacagagaacaaaaccatttttaatggattctacacatttttcttgatttactgagacttgaatgggattaaacggagctcggatgaattagatatgaattttagaagattcactgtgtttattactataaaagaaatccttaaataatttattgcgcaatattaaccagggctgacgtcagcacggaggggtgcggcgccgacaggcggggcccaccggtcagcgaccgggagagagagaaagggggtggcggcgcgcgggcccactggtcagcggcacgggggaaaggaggggcggcggcgccacgtggcggccgaaccgacggacccgatctacccaagggtagatcgacccgatctacccaagggtagatcggacggcggcgggaccttagggccggggcgcgcgggcgcagcgcgagacggcagcaaccatggcgccggcggggcggagcccacacgggggcggcgcgcatgcagcagcggcgcaaggcggttaccgaaggcgaccgaccggcggcggagagcggcggctagaggaggagcggacgatacgccggtaatctgtgcgcacgcggatacacggtacggtgaaaaggagaatggggagggggaaacccaaacttcatcgggagactacggctgt

SEQ ID NO: 59828 - DNA, 1487 bp, Oryza sativa
  unsure (1)..(1487): unsure at all n locations
aatccttaacttataaattgttgtttaaaaggaataattagaaatgattttaaaagcctaaaagagaagatctaattttaatttgctaaatctcaatataaaaaggggccagataaaatttcattaaatactttgcttaattctataattcctagatttttctgggatttatttgagctaaggaagtatttttaataaatggaattgcatttaagaaataatttaattgaaaaaggttttaaaaagtcttcttttggctttgggccgaaagccggcccaaaacccttctctctctttccctcggcccagccggcccagtccgccgagccgccgctctcctctctctcagccgctgacaggtgggccccacctgtcaggttcgtcttcctcgagccgccgctgccgcccgaaaccctagcgcgccgccgtcgccgtttccttccaaatccggccgctcctttccttctccggccgaattgattgaggggaaacaatctccgggatctcctctaccttttctcctttggaaacatcggctaaatcgttttggaagttcgtggaatagagttcgattcggatcggcctctttccttcaagccgcgagctttccttctcgtcgccggccgccgtgggcctttgccgccgcctccttgcacctatataaggacccccgagctcccctctacccgtcgcctcctttgccttagcctgccgtcgcgtctagcgccgcctccgcgtagccctagtcgccgccgtcgttgccgtcggttcagccgcgccgcgccgccgttgcagtcgccgtcgtcggtcgccgtcgccaccatcgggttcgccaagtcatcgccgtccccgtccaccgcttcgccgccgccgaagaccgtcggagcgccgtcgccgtcgtcgacccgaagagcttcgccgcttcctcctcgtcgccgccgccgtccgttggtcttccgccgccgttttggtcaccggtgagttcgccgcgtcgtcctctacgtgctggtgccctccgtttgtgccgaagtgccgccgttcgccggcgagcgtgcgccgcccgagctgtccgctccgccgagccgccgccgctgtcggtgacgtcatcgctggcgtcatcgtcccttttcccgtgagccggtcgtggaccgatcgatctcagccgtccgttttggatagggttgatctcggccgtccgttcccgtgaaccgtcgcccgtgcgcccggtccaccgaaaccctagccgctgacgcaataatccttcttttccttttcaaaaataattcattattgcgtcataattcaattaaaatccatataaaggttttaatccgatttaatctttaaaaattcataactaattcatcttaactcagtttaatgtggttcaagttgcaaaagttgtttaaaatnnnnnnnnnnnnnnnnnnnnnnnnnnnnnnnnnnnnnnnnnnnnnnnnnnnnnagcgagaggataatcaatcaat

SEQ ID NO: 59829 - DNA, 2521 bp, Oryza sativa
  unsure (1)..(2521): unsure at all n locations
gaggttctggaaaagggtgtaaagcgccacctaataaggggggcccgcatttttagaggtgcaaggggaaatacccggtggaacggttgaaaaaggaaattgtaaaaaatattaaagaggggggtaacaaggtttttggaaaattataacggaaacttgtaggcgataaccaaccaaaaggggggtgtaaaatggcacgtttaagagggtgggtccattagccaatttagttttgcgcaattttttgaaaaggaagatgggtggggaactttttataattatctccgcgtgcaaaaaaacgcgatgcaagccaaaagggtataggtggggccctaaaagggtttttgccagtccaaccgctgtaagtaggggacatttacttgtaagtcgacccactatagggagatttgggccaggagatgaggactcctatatcccggatgactttgggacccatcaacaattgttgagcagtgttgtcgggttagacgttacaagcaaaaactgaaaatcccttatattgtgggacggagggagtattttcaaaaagaagaatctactaaaatcccgtgaacctatccttgcattgattgctaactgaatcgtggaaaaccaaataaaatgtcatttacgaatactaggctaatgttcaaagttcaaacacatgcagcagctgcagaacaaaactcaacattttcaggggaaaaacaagacaccaaaacagtacttgggagacgtaccaggtatcctctgaaggccttctggatcatgacggccgcctccacctcccgttgctggccgcagctgcatggccggacctgcgagagctcgccggcgacgacggcggtgaccgagggcctgcggctgccgtcagcgaaactgctcctcggcttagcgaagctccacctcctcctctccatcggcggcggcgcgacgccaccattggcgcctccggcggcgctgtgctccttccgatccctgtctcctccttccttcttgccggtgagaaccttcttgaaccacctcatcgcgcggcccatggtgaatcaacctatctgcagcacgacgaatgccacgaacagaggcgtcaaaaaaaatgtgtagagagcgtggataaaaggattcaagaacagcagctagaactattactccagtgctgaaacaatggaactaataggagacgcaaagatcaactcgggagttgttgaaagttgaaaaactgtaggcgaacaggggaaagaaggctatagtataccgctatagctcaataaaacagagacgccacgatttgaaatgagatactccagagtccagatagcagagtggacaagaaaaaagcatggaagcaagaaagcttgggtgaaaaaagggtcttttttcgatggtgaagcagggaagaaacctttttacagagaggggctgctgccgagaaacatgggaccgaacagagatggaaaccgaactgaaaaggcctcaagaagcttagctgaaaaaggagaaggcaaagacgtgtaatgtagcgccaaaaacagccgagttggtgggggagatcacagtgctcccctccagctcacgaaacgtgactccctgatgcggaaaaggaccttttcatcagtgaaacccagtacccaccagcccagccagcccagccggttgaactctcccaggcgaagcagcgagccagccggcgattcagagcggaagcagccggcgacgaagtgtgagatagcgagctatcgagccagcccagccaccgcaaccgcagcgacgctcgcaggggaaaagaaaagattccccctgcttgccccctctcgcctaagagtccgagcacaaggcaacaaaaaggctaagcgagaggcaagaccaaccgaagcaaaaaaagacccaaaccccggagggttcaccaccacgcaccgcacgagacagcaaaagaaaaaaagaaaaaccgagatggcaacaagatccaaacggcgtcgctcgcgcagatgcaatcattcgcacggacgcacctcgcctccgcgccgcgcgcgcgcgggggccgagagcccgagatagccgcgcaacaacaagtcacaagttggggggggggggggggggggnttttacngtcctctttntttaatttttaataaaaatatgccttatttctatttttttatcccctcccttctcattaccccatccctaactttaataaaaaaattttattccccccttaaaaattttttttcacaccaaatttccccaatttacacttttactcaccaattatttaaccccccccacaaattncaaatcctcatccaaaaaaattcctttaatttttttcccttaaaaaaaattttttattaacacaaactttacccctacaaaaaaaccatttataaatcttttttaaacaaatttttttacaatttccccccctttttttttacctttattcctcttttataaatcaaatatttctccctaacaaaaattttcctaaaacacatttttcttttttctctttcacaaaaac

SEQ ID NO: 59830 - DNA, 2995 bp, Oryza sativa
gggggggggggggctcgcgtctctcgcctcccactccgcggcacggcttttggagcccgagtctggccgagaactcacgccaagatccgatccggcaaccggctaaaaacaaacgtagtacgagcagtgacgcacgcccaccccacccgcgatggtagcagctcggctaaccccttccacactccacaccagcgcaacgacggaagtgtgtgacgcggatggatgtggtagtacgctgtagcatgtactccctccctccgttcttaaaaaaaagacaaaccatgttttcgtgtccaacgtaaattaaaaagacaagtcacgtataaaatattaatcatattttatcatctaacaacaataaaaatataaattataaaaaaatttcatataagagagacagttaaaattggcaaaaaaaacccagagtttgtctcttttttttttatggagggagcacgagcgctcactgatccggtcaaataaatgtttgtgcctttgtttatcgccttgtgtagggatacggattctaggcctctggaccacagtgggaacgtccgaacgtgaattggttaaggctgtgtttagttcacgctaaaattgaaagtttagtcgaaattgtaacgatgtaataaaaaatttaaaaatttatgtgtgcaggaaagttttgatgtgataaaaaagttaaaagttcaaagaaaaattttagatctaaacacggcctaaccatcgttggcatggaagttgaaccgctcgtatactgtatacttcgactctgtaatgtgtatagtgttataactcacggcaacaagcttgagaaaatggaacaccaaatgtaaagatggcagaaaatggaacaccaaatgtaaagatggcttaattaacgggttgtgcatctgtaactccagaggtgctaagcgttaattatcaaccatgacgggaatgcacatgccttgccttgcgttgtggtccatattcccccggttcagtagtagaagatcacaaatttatttactgttcaaaatacacagccgatggcccccgctggagacgcacgcgtgacgcaagcggcgtgcacgcaagaaattttatgggaggagagtggtacggatgctgaagggaaaaatttctcatacgaattggcacgcttctcgaggctgccgctctgcgtgacgccatcctcccgtcgtggaacacggtttcgacagggcatggccgtcctttcgacagtgcagagcatgtactcctccgtagtagcagatccgtcgaaaacgaaaacggaaaaaaaaaaagaatgagtatctgttgcactgacccgtgggtcccactccatcgtatatgcttctaatcggcgtagctacagaggtggcaaaggagtagtagggtaccaagatactggtatactatggctgtgttgagatccaaagtttggatccaaagtttggatccaaacttcagtcctttttcatcacatcaacctgtcatacacacataacttttcagtcacatcatcttcaatttcaaccaaaatccaaactttgcgtgaactaaacacagcctactagtatcccaaatgggtttatatcatgtactataatgacactgttattatagacaccaacatgtgaggcaataggagagtagaagtgtgggacccacacacctacgctagtgacattatggtagaggatactcatataccccaaacactaccaagacaccaacacgaagagagtacgaacgctagtagggcgttcccagcgcgccttcatggtgttcgaactgaataatcaacaccatgttctccacacaggaaaacccgtgaagatcgatcgtgtagtcaaaactgatcgcccgttctttagcttgaaaaacctgtaaaaagcacatgcacaaatgactgggaagaggagagagagagagatagagtgtgtgtgtgtgtatgaaagctgtggaaggaatcgacagcggttgaagccaccttgacgagtgaagtcaacggggaaatggaggggctcgccggcccgatatgctgcgccgctggacatgatgactcaaagagcagccatatccacttgtccaccggaccacgctacaccgacctcattgcagagatggcatggaagtgtggaagggaggaagatgaggacggatccgtcatcgaccgcttcaatctaccacagagatgttgagcgtcgcggcgaacagcgaaggagaagagaagggtatgatgatggctgttgcaagctcaattatttgtcactcagtcaatccacaacctgctctcggttcatcgctattgggggagtgccggggggctgcctcctccgccaccagggatcgtgcctatcgcggccacccgctcgtcaccacctcagggagcttgtcgcccgtatggatcgaggcatcgctgggagagggtagaggttgtggcgcctgggagatagaggggagaggcagcaccgccaaggagcacatcgctggtgatgggttgatggaaggtgtagggatgccgacgaagtgatgaggagaggcgtagggaaagggagaggtggaaaattttatatttgtttttgaattttaggctgttgagtgtaaaaattggaccacttcataatttgaaaacatgtgatgactgagccacttgcactataagacaaatagatttaggtttaattggatccatgccatataaatatgctgatttagataaataccactataattcgtctattatatttataaccgtgatattaaaatgttacaaaatttgggccatgcactactgtcatgttttccatccatctcagtcttcatcctcatatacacataggacccatctgtcaaattcatcaacttcatttttcctcttatcttcttcttttttttcctctcagctcctcatcgtcgtctgagagaaagtacgagaagtttccgctggcgctcatctgctcctcggataccccatacgcgtgccacatgctggtccgttcgccac

SEQ ID NO: 59831 - DNA, 15016 bp, Oryza sativa
ctttcggcccaaagccaaaagaagactttttaaaacctttttcaattaaattatttcttaaatgcaattccatttattaaaaatacttccttagctcaaataaatcccagaaaaatctaggaattatagaattaagcaaagtatttaatgaaattttatctggcccctttttatattgagatttagcaaattaaaattagatcttctcttttaggcttttaaaatcatttctaattattccttttaaacaacaatttataagttaaggatttttaaacaagaaaagctcttaacaattatacttagatcattaatgatcaaataattactgaactgttctttgtattatttaagaattgagctctgaaaaaaaaccgagaaaatttcagagagttgacttaaccatggagaatttaacaaaaattaaatccatccatgctttagatttaagaaatttttatttcccacattttacttcacttgaaaattaaagatcatttaatataaattctattaataatttattaaataatttataaatcctgaaacgaaaatcaggatgtgacaaactaccccccttacaaagaatctcgtcccgagattcggaacggctagaaagaaaagggcataggtaaactgcagtctatcttattccataactccgataattattctaaggctttaaagaaaactactgctgctttgaaactggtggctgagctgcaacacttgaagacacaactcttgaagacgcaactggcactgcattggctcctgtgacgacaatgttgttgacctgaccttgcggctgctgatgcttcggcttcggacactctcttgcaaagtggcctggcttgtaacagttgaaacatacctgctgcttccttccactactgttattctcctgagactgatcctgctgaactggcaccggctgattagcttgcttgatgttaacttcattgctttcattagtctctgatttgatctcaccaccgatattcaactgttgcgattgtccttggccagcggaaaaaggttcaccaatttggagtggcttgatacgctgcctctggctactaccttgtgcctcctggaaaacagtcattttccttttacggttatccatcctgttcttcttgtcttcaagtcgaattgctttgtcaaccaactcctgaaaatcctcatagtcatgagagatcaacataactgatagctcatcctttaagccttccaaaaacttctcctgcctttcctcgtcagtacgcacatcttctggagcatagcgagctagacgattgaactcatgaagatattccgtcacggtacgatccttttgcttaagtgcccggaactcacgcttcttcaaagcaacaacacctgcaggtatgtgtgtcttcttgaatgcttccgtgaactccgcccaagtgattggttgtccttctgctctgttcatccggaaatgatcccaccattctgatgcaggtccttgcaactgatgtgaagcgaaaacaactttctcctgatccgtacactggagcaattccaacttcttctcaatagcgtgtagccaatcacctgcttccactgggttggtagtgctagaaaaggtaggtggcctcacacgaagaaaatcagctagcttgttctgcggcggtggagcattgttgttcccttggttgagctggttctgcatctgctgtatcatcatgttcattaactgagtctgttgagccagaacttgagcaagagttgggttcccttcattgttattgtttccacttcgactggcgcgagtgttcaccatctattgcagattagagaagataggaggagaggggttacactaaagacaagaccttaaccatgttaccactgatctggtgtgtgtagaccattatattgttcaagttgattaagcaagcaacctagtatagttacacactcatcaatgaactactccaatgatggaaatgcaaccatacctacacacaagcaaacaacaaacgttctaccctactaactattcttcaaagacactttggcggcataggttctaaggtaggatccaaacttcattccatcttgaccacttggcacttcagatcgaccatcaccttcttattcatcgatccacttgactgacctccataagtagacctcactggcgtcttcaagtttcaacaactagtttcagaaccacttaagttgaaagcaggaggggagaggatgataaaatgatttatacagaattctagagaaggaagaaaggaaaattttcacaaatcatgttttcagaaaatttgtccttaaggtttgaccatttggcttatcctacagtcgagatggctctgataccaacttgtcacgcccgaaaattcacaagtaatttccgaacttatttgtgcataaaatcctcgtccaggaatcagccgaggtacacaaactgacaatttaatatacagattcatcaaattaactaaaacgataaatacttacttaagaggcacttagtcctcaccaagaagaaaattgcagcggaaaataaaatctagcgaagctccggctccactcccacaggcagctcaactggggtataagccaaacgtcttctccttcgcaacttgtcttcaactgaggttgattgattattgcaaggtgagcatatgacatactcagcaagccacacagcaaatatgcaagtgcacaaggataccaaaggaatggcataatattggctcatttgcaaaagcagcatttagcaaaatatttaagagaagtaaaacagtggagtaattaatcagaaattttaatcaacactgaacagcacacccatgctgcacaggcccaaccatcctgaacaaccatacccggctgaacagatctaactccaaaccaggagctaagcaaattattatcaggtataacatccataattattgtgagaggtgtgagactaatcacgaaaaacattgctcaactcgcccataaccgcgggcacggctattcgaatagttttactctggccagaggtgtaccactgtacccacaagacacagcctcaacatcatgtctaccatgcgtcgcgatactggaaagtacccgaatagaggctgtgacaataccctctgcataacacaactcaccacagtgcaccattcctggatcataatcacccccttataaaacaaggcatggactccccagcgacccccgtgggcttatttccgccacttctcagtctggtgctccgcaatgaaccatgctatacaaaaggtaaagccgttgcccacgctggcttgtggttggcacggttaatgtttcacaacagtagctcgcgaaccggtccttaattgccatgagcacgactctcaaaaccatgtgctcacaacccaccattatcaagttttagttggcaagtaattaattaaccaatcacgattgaccatcgtgagctaccattaaaccatcattaaataataatgaatcataagttatcccaatagtgtgctaatgtttctaagcatggctaagcaatcatatctaatatctagttgaaccaatatatataaagctcaactagtccaattataatcacccaaggtatcaaggaataaagtaatcgagaacaaaagggccataacaaagaataggttaattccacccaatgacattcgaaaataaatgcacagttgaaataaatagagaatttaaatataggatcaacatgctcaaaggattgtgtttaggatctgtgtgacttgccttgcaataatcggtcttcaattaatcttcttgaacactcccgacgcactcgcgaaccttcgcaacgacggaaacgacaagctatcacgcaaaacgaggaaaaagactaataaaaaccaaataaacaatacataaaaagtaaacaaacatgtagatcatatttttagatgaattatgagacttgaacggcctcattctgacttcaaatgaatttattaagaattttacaagattaaatctaattaaagcccatttaaaaagaattaaataaatttaattcaatttatggacaattttaatatgtagatctttattttaaacaacttttgcaacttgaaccacattaaactgagttaagatgaattagttatgaatttttaaagattaaatcggattaaaacctttatatggattttaattgaattatgacgcaataatgaattatttttgaaaaggaaaagaaggattattgcgtcagcggctagggtttcggtggaccgggcgcacgggcgacggttcacgggaacggacggccgagatcaaccctatccaaaacggacggctgagatcgatcggtccacgaccggctcacgggaaaagggacgatgacgccagcgatgacgtcaccgacagcggcggcggctcggcggagcggacagctcgggcggcgcacgctcgccggcgaacggcggcacttcggcacaaacggagggcaccagcacgtagaggacgacgcggcgaactcaccggtgaccaaaacggcggcggaagaccaacggacggcggcggcgacgaggaggaagcggcgaagctcttcgggtcgacgacggcgacggcgctccgacggtcttcggcggcggcgaagcggtggacggggacagcgatgacttggcgaacccgatggtggcgacgtgtcacgcccagaaattctcgaaccagaatttctaagctgaatgtgcattgaatccctgtccaggaccagccagggtacacaaacgacaattgttgacatacagatccacgtcttacaaaaatagaaaagattacaaatgcagcggaaaagataaaagcgagctaaaccgggaagcttgacttcagcagcgggcgactccactccacagacaatccttgacggcagcgacgaaaccaaatttgacaaaacagctccaactaggaaaatcttcagctctggtgtgggggaaaagagagcaagactgagtactacccactgtactcagcaagtcataccggtagaggaggtatgatgcaggatataaccaaaggaggctagaggttcttttgcataaagctagcatttaaaagcagtagttgaaagcagtaaaacagttgtagtaattaatcaatattaaccaaacactgtccaacgctacaccacgttgcaacaggcccaaccaaccacctgaactacaccagttcattaagctaaactaggggtgagactaatcacggtgaatctggttgatcgcccataaccgcgggcacggctattcgaatagttttactctggccagaggtgtacaactgtacccacaagacacgattccacacatgtcgccatgccccgaagtatcaccatgatactgcaaagggggaaatcgtgacaagaccctccacataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccactcccgcttgtggtaagcacggtaagtctcccagggtttcccgtgaaccggtccttaactgccatgggtgcgaccagcaaaaccatgcacccacaacccaccattcaatgtattttaattaactaataccattgcggtggcaccaatccaaagctatgctcatagtcaaagtctatgtaataaggtgatccccatttgtgtgctagttgaactaagcatggctaagcatttcctaaaccaacatctagtcattttgatacccaggttatcaatggcatatggtaaacaataaatggctgagtaataggacccattccacatgatattgtaaacgaatgcaacatttaatagaaatgcgggatatttgtaaattgggtacaatatgatcaaacgtattgcatgacttgccttgctctcgcactgacgagacctcagcaacgtcttcgagaaaccgtggatcgacgaaacggccgaaacctacgcgacaaacaaagcacacaagcaaaacaggctataagactactgaaacagagaacaaaaccatttttaatggattctacacatttttcttgatttactgagacttgaatgggattaaacggagctcggatgaattagatatgaattttagaagattcactgtgtttattactataaaagaaatccttaaataatttattgcgcaatattaaccagggctgacgtcagcacggaggggtgcggcgccgacaggcggggcccaccggtcagcgaccgggagagagagaaagggggtggcggcgcgcgggcccactggtcagcggcacgggggaaaggaggggcggcggcgccacgtggcggccgaaccgacggccccgatctacccaagggtagatcgccccgatctacccaagggtagatcggacggcggcgggacctctcggccggggcgcgcgggcgcggcgcgagacggcggcgaccatggcgccggcggcgcggcgcccacacggcggcggcgcgcatgcggcagcggcgcaaggcggcgaccgaatgcgaccgaccggctgtggggagcggcggctaaaggaggagcggcggctacgcggctaagcggcgcgcacgcggctacacggtacggggaaaaggagaaaggggagggggaagcctcaccgacaacggtcgacgacggcggccgacggaggacgacgacgacggcgggacgagctccggaacctcctaacgaacaaaaggagagggattagagagagaggaaagagcgtgggagggcgagagcgccggccgaaggcggcggccatggcgccgcttgccggcacacgacggggatgggtctccggcggcgaacctcgacggggaaggggcggccaaggtagatctcgaccccgcgaagctaacggcggcgacggcgcgagacggcgacgagcctagcggcggctagcggcggtcggagtagcaaaagcggcggcggcgggtggttgcacggcgcggaggcgatggggagctcgggagagatcggcgaaatggggaaaaagcgagagaggaggacggcgatgcttaaaaagggggagagggagccggacgtggccgggagcggcgggattcgacggccgacgtgggggagtggggaggagagagaggcgggattcggttttcgaatcccggccatctcgggcgcgggcgcgaacgggagggagaggggaaagggcgcgggagacgcggcgcacgcgcgggcgtggccgacgtggcccgggaaaaacggaggcgtgggcgcggcggcggtttcggctcggcggcgcgccgggatcggcgggaggtgggggaaggacccgacaggtgggccccacctgtcggcgaccccgagaaaggaggcgggcggcggctgccaggctgggccctcggcctgcggccggcccagcaaggaggagggggaggaaggaggggaatgggccggcggcccatccgaaaagaaaaaaggagggaaaaagggagggaaaagaaaaagaaaaaggaaaaggattttccctggaattaaaaattgcactttggtgatttttaattggttaaaattatttccaaggctctgaaaaatccactaaaaatcctgttaatatattgtgacatgtagaatccaagaaaaattccacatgccgattccgattattatttgcatttattaattagggaattagctctaggttaattaagataatttcttcggacgatttatttagccaaatttttaaagcaagcaaaaaggggaaaacttcagggcgtgacacgacggcgaccgacgacggcgactgcaacggcggcgcggcgcggctgaaccgacggcaacgacggcggcgactagggctacgcggaggcggcgctagacgcgacggcaggctaaggcaaaggaggcgacgggtagaggggagctcgggggtccttatataggtgcaaggaggcggcggcaaaggcccacggcggccggcgacgagaaggaaagctcgcggcttgaaggaaagaggccgatccgaatcgaactctattccacgaacttccaaaacgatttagccgatgtttccaaaggagaaaaggtagaggagatcccggagattgtttcccctcaatcaattcggccggagaaggaaaggagcggccggatttggaaggaaacggcgacggcggcgcgctagggtttcgggcggcagcggcggctcgaggaagacgaacctgacaggtggggcccacctgtcagcggctgagagagaggagagcggcggctcggcggactgggccggctgggccgagggaaagagagagaagggttttgggccggctttcggcccaaagccaaaagaagactttttaaaacctttttcaattaaattatttcttaaatgcaattccatttattaaaaatacttccttagctcaaataaatcccagaaaaatctaggaattatagaattaagcaaagtatttaatgaaattttatctggcccctttttatattgagatttagcaaattaaaattagatcttctcttttaggcttttaaaatcatttctaattattccttttaaacaacaatttataagttaaggatttttaaacaagaaaagctcttaacaattatacttagatcattaatgatcaaataattactgaactgttctttgtattatttaagaattgagctctgaaaaaaaaccgagaaaatttcagagagttgacttaaccatggagaatttaacaaaaattaaatccatccatgctttagatttaagaaatttttatttcccacattttacttcacttgaaaattaaagatcatttaatataaattctattaataatttattaaataatttataaatcctgaaacgaaaatcaggatgtgacaagacatgaccactctttcatgacttgattgacaaccatctgagagtctccacagacgattagtcggcgaatacctagagatattgcaatcctttgtccatgaagtagcgccttgtattccgccacgttatgggacgcagaaaaatgtatccacaatacgtagctcaatctttctccagtcggggagattaaaacaaccccagctccagtgcctgtaagcctcttcgacccatcaaaatacatagtccaatattccatcttttcctctggcatgtcttcttggcactcggtccactcggcaaggaaatcagctaaagcttgtgacttgatcgaagttcgtggcttgaacgatatgtccaaagacatcaattctaaggcccatttcgcgatccgtccgtttgcttcgcggttatgaagtatatccccgagtggaaacgatgtgactaccgtgactgggtgactttgaaagtagtgagataatttcctaacggtaattaagacaccatatagtaacttttgaacctgaggatatcttgtcttggagtcggctaaaacctcgctaacgaaataaattggacgttagactttttgaacatggccttcctcttcacgctcgacaaccaggaccgcactcacaacctgggaggtcgccaacacatataacagtagcggctcttgcggatgtggcgaggccaaaactggtggagtggtgagaagtttcttgaagtcttcaaaggctttctgtgcttcgggtccccactggaaattgtcagtcttctttagcagcttaaagaaaggcatcccccgcttgccgagtcgtgagacgaaccggctgagcgccgccatgcaaccagtcaacttttggacgtctttttgggagcttggcggtttcatgttgagaatggcgttgattttctccgggttggcctgtatgcctctttgagataccataaatccgagcaatttccctgacggtactccgaagatgcacttttccgggtttagtttcatcttgaaagcacgaatgcttgtaaaagtttcttctaaatccacaatcaggtcatccttctgcttggtcttgacgactacatcatcaacataagcttcaacattgcgaccgatctgagttgaaaaacatctttgaatcatgcgttgataggtcgctcctgcattcttcaatccaaagggcatggtgatgtagcagtaggccccaaagggcgtaataaacgaggtcttcaagcagtcggattcttttagtcggatctgatgatatcccgagtaacagtccaagaaactgagtaacttgtagccagccgttgagtcaaccacctggtcaatgtgaggtaacccaaaagggtctttgggacaagatttgttgaggtcggtataatcgacacacatgcgccattaccccgtctttttccgaaccaggactgggttagccagccagtcgagatgaaggacttccttaatgaagcctgctactaacagcttggttaattcctccttgatcgcatccttcctgtcctgtgcaaaacggcggagtcattgcttgatgggtttggcgtcttcgttaacaagtaaagagtgctcaatcacctctctggggataccaggcatatcggatggtttccacgcaaaaatatctttattattctgaagaaaggtgatgagcacgctttcctatttacaatctaactcagcacctattacaacagtcttatcaagatcggagggatctaagggaatcttttttgtcttggcatcactttcttcggtcttcgtcagcttggttgaaggcacttctccctcgcttgccgtggtcgcagccagtcggatctcttcgcgggcgagagtagtctcgtgagtttgggccatctcgcaactttctttgtcacatgtgacggcttgcttgatgtcgctccgttgtgatatgacccctcgaggaccaggcatcttcatcattatgtaggtgtagtatgggacggccatgaatttggctagagccggtcgtccaagtatagcatgatatgctgtctcgaaatcagcaacttcgaaacaaacattttctgtgcgaaaattctcccgagtgccgaaggtaactggaagagtgatctggcgagtggtatagctgacaatcctgggataacaccgtggaagggtgcattactcggctttaattccgtgcgaggaatctgcatatcgtccagggtcttagcgaaaaggatgttgagtgcgctgccaccgtcgatgagagtccgtcggagcttgacattgcgaaccactgggtctagtaccagggggtaccgccccgggtggaccactcggtcgggatgatccgagcggttgaacttaattgttatctctgaccaccgaagatattggggcgtgctaggctgaaccgcattgatctcccgctctgttagcttttgttttctcttagattcataagccaggggtccgccgaagatgtgattaagttctttgcgatgatcttgaaaaccggtcggggcatcgtcttcatcatctttcttctttgatgtgccttgatctccgtctgagggtttacgtgcgttcttaacgtattgctccgcgaactgtttgtagacgaagcaatctttggccacgtggttggagttgggatgatgcgggcattgggagttcattatcttgtcgaaggtgttgacacgagaacgttgtcgggaagatggagaggtggtcgccacaagttcttcgagcttacgcttgcgatccttgtggtttttacttccactccctcctgcggtcggcgtatccttctttggcttccaagtggtgcccgactgcttggatgtcgtgatagcatcttcggctttggcatactcattggctttttcaaacatctgtttgaccgtcttgggaggtttgcgtccgaacttgtcgactaggtcctcgtggcgaatgcctttagtaaaggcggcaatgatgacgtcgtcggtgatgtcggagatcttgttgcgttgctcagagaagcgtcgaatgtaatctcgaagagattctccagacttctgaacgatgttgtagagatcgaagtgtgtgccgggccgttcaaaagtaccttggaagttggcgatgaagtggtcgcgtagctctgcccatgatccgatcgtgtcgcggggtagcccgtgaagccatgaccaggcagaatccgctagggccacaggtagatagttcgtcatggctttgctgtcccctcctgctgcgcggattgcgagaccatagacggtgagccaagactcagggttagtggtgccgtcatattttttgattccagtcggcttaaagccggctggccaatccactcgacgtagatcgcttgtgaaggcagcaactccgtccacgttgtcgtcgtagcgatccggtgaatgatggcctcttgctgtgcggcgctggttgatggtgtcgcgaagatcgatgggacgtcttcgatgtggggagtgtggtcgttcaattcggcgctccctatatcgctcgggaggcgagcgaacggaccgttcatcatgtcccctgctcctgcgactagattcggcgccggcaatgctgaggcttggctggtgatagtcttgagatcgaagatgagggactcggctaccagtcggggtgcgggtgcttgcagagttggctgggaccgaggcagcgatcatggtcttcgtctggttcaagatgttgactacatgatcagcttggttgagtgcgtcttccttgaggagggtgtcgaggagagtgattgctgcaaccgcgttctgttggggggtgcgaaagaccgctatcccatcgacgtcttgttgcccaatgagctctctcgcttgccacccagattccaaggcgcgttgtcgtcgatcttcagcctcctttgcaatccgttcgcgatcttgttgctcacgctgtagtcgttctcgctcttgtcgctgtcgctcttcctccaatcggcgacgttcagcttcttgccgtgcgcgatcttggtccgcttctcgggcttggcgctgttcctccgtttcgttgtcagccatgaatacgccgaagaagaggggcgtgtagttatccttatagctgtcgtcgaagttgtcgaggtcgccgtggtcgtagtggtagccgaaatcgtcgtagtcgaggatctcggttggtcgagaactgacgccgggggagctgaggtagccatccaactcttccgtcgagactgtcccgagaggttggagtataacgccaacctccctggatctagatcggatcggggccgaagccggagctcgcctagatcttcgagtgggagatgtcttgactgtgaagacagcggccaaatcatcaggaagtttcatcaggattgagggataggacccgtcgtcttgatctggtcgcggaagagtagattggatctcatccgagtggtttgaagccgactcgggagagatgatcttggagtaggcctcggccgagttcggaataccgaacggcacagggacctggtctctccccgactggtttgaatccgagtcaaggagagagatcttgccgaagtcgttggtgatgaagttgaggctgccgaaccggaacgcctgcccgggaggaaaggcgaagtcgtcgatgccagaaacgaaacccatcgcacttagtcggcgagaacttgacgctacccctacctggcgcgccaactgtcgaagcaagatttcggcaataataaaagggggtggctgtcaagctaggaaaatggatgggtttggagacaagaaattttatacaggttcaggccttcttattaaagaagtaataccctactcctgtccggggatgattccgccgagtgtgttattaattgtatagactgggaaaaagaatcacctcccaagaggcacgcggaccctccttatataggggaaggagtccgctttacaaaatacagtccatatcctaacggaatatgggattatagataaaatacaatcgtaaccgactaagatcccgggtatttccttgacatacaagtttagaacctaacccgagtcttcatagagatattccatctatatttgataccgtatatccgactaaattacaaccgtcatgtagatatggggtatccataatctccacaagctggcttgtctcgagctatcttattgggtcacatgacggtgttaaattttgaaatagatctaaggaaatcatgcataagagaaaatagccaaaagaaaataaaagacacaaatccaatttttaaagacttctcaattatctatctcttaaagataaatatagagaatatccataataaaaggaatgccgagaagcaaatagaaggcataacatccagattgtaaaggcttcccaaaatatctttcccctttgcaatctatcaatcccatgctggttggttttatgccagctgattgttgccctcaacattctttagttgagcgacacgtgacgacatacaagcgtcgaaaagagagccggttaataaaccctccctataaaactggcaagcgttcagttacaacggtgaatagaaaaacaagagaagagttgttccacgtgtcgtgaccacatatcctatatttggagaaactaaaagcaataaatagaaaaactaaatgacataaacaataaactctataatcctgataaccaatttctaaatatatgtattttctgcttatactataaataaataatatgtagatctttacgctacaattataataaaacaaatattaattctggtgttggatttatacctagagttttatgtcaaatctaaacaccataatgctcaaaatcataaaagaaaaattgaaatattagtatattaactatatggtttttaaaagccatacacccaagctaattagtggacgcgccaaacggcgtcttgattttctaatctacattattggtgattagtgaacctgaactaaaatttcatgaagtgcctttttttcaagttcacttagaaacttgtgtaaatattgatcacctaaaatttcatatataa

SEQ ID NO: 59832 - DNA, 20915 bp, Oryza sativa
aacacccccttagtctaggatacttcttgtaaacgatggaattacttcctagtagtatttgcgatctcaattttggccttttgtcctcgattcatccagaaggatcaactggaccacacgcttagttttcaaatagtggagtacaatttgcatgtacagagattcaaaacaagaaaaggggagcatgtacaggaagtgcgagtctaaaaaatgtactgaattcgaacaggacagagtgacaaggagagggaatggcttgaaatggcaatgaaaaggccaggtcaaattggcaatcacaccggccagaaaacctagtcaaaacgtcattgaaaaagagaaaaaaaactgaggcgttcaacctgttcatgcacgagccgttcgttcggttcattcaccttttcacagcggtcgctagctgacggcatgtcggctcgcttgtgttactactacttgattaattgacagctgcatgccataaaacccaattacaattagcagtggtatattttttttcagataaggacaattagaagtagtagtaaaagaccaattctttctttgttaattacgcgtatcaatggatggccttttccatgtgcagcagctgcagtggtatgatcactgtcaatttatgggccggggttgagcagtatatttgacttcaaaagatgggaggccattttaatcaatcacctgttctaacaacctttaactagacgtgtttggtttaatttcaccgttatttctagaatgaggtttgtgtccggttgttgatacggcgcacgagtttgaacagtgacatgagagttgaagtactgctggtggtaaatgctaccaaaattagtccgacgtgaccaattcaattattacttctctagtttctacacttttgtgccattggtcaaagaagtaatactcgtggatgcacacactataaagatatatatcattctcaatgttccggtatattctttagatagcacttttaagaaaaaaaactttttaatcacaaataaaaatatctataaatttcaagcattaatttaatgagaatgatactggtacattctgtagttttatgatactctactttaaatctgtaattttgtaatatattttgtgttaaacctatagttttctgatatatcatctttaatctataattttgtgctaatttggtcaatatatctataactttgtgaaattacttttttatataagaaaatggtgaaaagtggcacattatggggttgggttttaatatgcatgtgatgtgaatggttcgacttctctggtttggttgaacttttgggtgagtttcatttttttttgtgagaaaagctttggatgaacttattgttgcatacaacttaattagtaaataatatcagtaaacatttcactagtcaaatttatgatatatcggactacaaaatgcagaacaaaacatcaactttgttttttagcatgggtgcgacggatgaaagtgaaacaacgttagaaaactgggagtataactgttgctaacaagtggacagcgtacggacgaaagggtcagcagtggtcaaattaaccgattactgtagctagccgtcaaaccaccccaaatttgaccgccgaaaaatctaaccattccctctgaccaccatgcatgtacgtaaatacgtgcacacaccatccccgaaacacatccaaaagccgaccttttcatcgaaatgaatagcgatcggtcgagtgagacgcgcgcgctacagtgcaagtacttcgtagcttttttcttaccgtcggttactgtggtatacgtataccgggcacatactggtactactgagttggagtataattttacatattgttttcatactatattcactgttaccgtgcttatcttaatttggctagggtaaggatttgcattcttgatgaaaaccgatctggatttcacataatccagacttctctaacgaggtaaaaaaacaaaaatcgctttttcatgttaaattcaaaaaattcaagctggactataaattttcgacaaaaaattatcgatttcatctctttttcatttttatcaatgtctttggtgaattccaaagatacacctcgtgagcggtttttatccagtatcaggatcgtgaaccctattccctctcccccgattgtccccggtaataaggcaaactaagagcaggtacaatagcaggctataagctagctataaacatatttaaaggagataaaagagtagagagaagagcagtgggctatagatttgtagccagctgtagcacggactcctagacacaatgtgtatatgacaggtggaaccaggtattaatagtatagtatgtaactattgtatgaattggctactaaattgactatagataatttataatccctccgtttcataatgtaaatcattctagcattttctatattcatattgatgttaaatgaatctagacatatatatctatttatattcattaacattaatatgaatgtagaaaatgctaaaatgatttacattgtaaaacggaggaagtagccggtagttggctacactattaaacttgctctaaccgagcgcaaagcctggaagaaaaaaaaaacaccgagccatcgctcggtccgcatccgcgcgcaagtgtgggagcagccgcggccgcccgcccgcccgcccgcgcgcgcgcgtgtgccgcatgggcaaattttccctctcacccgcacgtatgcacgcatgcgcgcggcgtttgcgtgtggttgcgtcgcgggagacggcgccccgcgcccgatcgatcgatcgaacgagcccacgcgccgcgtgcgcgtgagccctcgcacgcaacacatgaagctagtcgatcgatcgagccgccgtttcgttagccgacacgcttcgctcgatcggcagctggcggctcgcggaaaaggcgagacgaaatcacgctgcaacttgccgccggatatgcacgcattgcatgcgtatccggtcaaaactcaacggggatccacagctagtttatttcaagtctggactacttggttcatcacatcgaccaatctcggtcagcctcacagttgatttatcgctggtcgtatactctgctctctttttttttcaaccctaaaatgcacgcactcgtgtgaaatgaaatgaaatgatacacgagatcgatgtatcgatcggtatcttgttgccagaagctaacgagatgatatgtacgccagcagggtttacattaccatcggtaaccgcgcggttatcggtcttaacgtgggggtacggtaataaaaaaactgcgataacctccttaaattcaaataaaattttaaaataatttaaatttttaataaattttacatggtttcgtacggtttgtcacggttatcggggtaactgtgcttaccgccagggcgcggtaaccctgacccccggtgttttgggaaaccctgctagaaacaggttgggaatctcaacatccgataaacgagatcgatatatcggtcggtatcatccggtgctgcacgttgcaaactcaaactacgggagtcaaaaagtttcgttgcgaaagtgagcagatgcagcaccacatctgtgtatactccagttgcttcctcagcataaacatctctcattctttgacgggaaagcaactagttagcaagcatacatataaacatctctcactctcacgggcattgggatgcacacgcagtagaccaagcagcgacccgactctgatttttgtactagtagcgcctgtagacagcaacgtataatagtacgacgtatgttgccatttgtaatacactaagctgcagcccaccgcgcatattattcccccggacaagttgctacttaacaaaatgacagggaaggaataacatactttgcatatgtacacaaaagggtgttcctgttcatggaacaagagctcgtactgccgctgcagcggcaacccctgtcgtgtggtggcgctcggctaataaaccaatccccaatcccccgagcgaatagaatttgtgattaattcttcggtgtccctctctcctctggtttgatgtgaaatcctctgtcacgttgccaattggaaagaggtagctgtacgtagccgaagtccccgaggcggtttggtggtggtgtggtgtggttggtcgatgcgcgcggccgcgttcgagtgcgtgcaccgtgcgccgccgcggggtgggtgattgggtggctatggttactcagtgttcagttccattcaaactcccaaaaatttcatcacatcaaatatttaaatatatacatagagtattaaatatggatagaaaaaaaaaccaattagaaagtttgcatgtaaattacgagacgaatcttttgagcctaattgcaacatgatttgataatgtgatgctacagtaaatatttactaatgacgaattaattaaacttaataaattcgtctcgcagtttacaggtgaaatttataatttgttttattattagtctatgtttaatactttaaacgtgtgtatgtatatttaaaaagttttaggacacgaactaatcactgccggcttttgcaggcgcgagatgcgcgcgccgccggatgaaaggtgtggtgtgggtgtgtgggtggtcggagggaaagctgcaaaagccggcaggagcactgcggtgcgggcggagatggacgtggtacgtcatgctgctggccacagtggtgcatgcctagacctgcggcttcctgggccactcgtactagctcctggggagagtagcttaagccagatagtgggtaatcagtggaagtgctagaccttggccattccaaataaggagattcggttaactaagtgctttttactctagtattataaaaactaaatatattgttaccggtattttgttacctcatccgtatttgagttcgttttaaagttcgttcgcttttaaaaatacagatccgtatttaagtcggattttaaattcatttgtttttagaaataaaaaagaatcatataagaaatctctttaaaatactccctccatccacaaaagttagaaatatttcacatttgagtttttccaaataagttattcctatttgtagtctttatgcattcaagacttaaataaagagataaattaaatgtttgattagaacccaaggagtcatataaatactcattggttgcatgctttcattcactcgttgaatttgtaacatccaagatgatttaatttctccttggtcttgatgacaaaagtaataggtataacttttgtggatggagggagtaactcgcaagctaacttgagatgaaagtcggattcctaattgcagctcatgattttctaaaaaaaaatatctaagcgaattcttacagtgaatttcatcatagctaaaccgtataataataataagattaaaatagcattcacctgttgcaacacacggatattttttttatctttttaaaaatataaaatatttgtatttgatcggttcttaaatttgaagcagagtatcacgtcgatttggatagcttcacatagaattttcagctcctcaaacagttcatattgttacctaggttctgacaatctatagttgtagtcagaagctgaaaaacaaaattctccgtattctcgaagttggctaccaaccagcagattattagaatcttaaggtccccaaacagaaccgatcatctagattcatgcacttataaaatataaggactaaaatcttggtttaatgtatcacgagatgtataaagtacaaacaatgtagctcgggtgctgacatggttgtccacaataacgagaattttgtatttacacctattcaatacaatatgtcccaaaatccggctttcatcactcccaagttgactcctaacacacatgtgggagaggtggcgaagagatgacgattagagtggcatctattgtcggagataggaggtccccgaaaaccgaggtaagatggcaccatagtgaaagggtgatcccacgaggggggaaggctaatgcgcgtacgcgccagcaaatttagctggcgcacacggcagttggccccctccccggtttcagcgtgcttttctttctcacattcctttttacgattttagtgcccagatccgggcacgtttttcctttttttggtttctttctattgttttttaattcttcagacacctctttacaaatgtagagttgaaagtatttaattttgacttgaaagttttcaaattttgtgttgaaagtttttatatttgagttgaatgttttcaaattttgagttgaaagtttttaaatttgacttgaaagttttcaaatctaggttgaaagttttcaaatttgggttgaaagttttaaatttgacttgaaagttttcaaatctgggttgaaagtttttaaatttgacttgaaagttttcaaatttgggctgaaagtttatcaaatttgagatgaaaagttgaaagttttcaaaatttgacttttaaaaattcaaatttcaagttgaaagttttcaaatttgggttgaaagttttcaaatttgtgttgaaagttttcagaatttgacttcacgcataaatttcttttcaatctgttacttaaaaaaaaatcttatcttcattatctaaaactaatggatttttttacatgctaaaactaacggattagttactagacgcgctatggaaaaaatcccgaaaaaaatctaaccgcgccgacgcgcggtgccgcgcatacgcgtgggtcttgtgggccggaagtacacgtcggcgacgcatatgcgccaattaggaattatgtcccacgagccatgcacgtgtgatcgtcgccgtgaaggcaaacaatggaacatcatattgcacgaggattacggcgaaaataacaccacactgaacttacaatattaaccctctctatgtgacgtggtttttctcggttctagggactatccaccaatgacagtcgcagctatcctcgttaccatttcttcgcctcctctcccactggcatggtgggagttgatttgggaggggaatattgtactggaggggctgaatgtaaaatttccactggatggccaaattagtttctaagtttgtgttatctgtactttgagctgagtgatacattaaatcaaaattaaagacatagatgtgcattttaaaatccataaatgtagatagtactctactccaaatttaaagactagccattattttactattagaaaaaaatagctactctaattttttcaaatataagcatgtctgaccgttaatatagataatatattttggaacgttcgtacggagtacgtgatagaaatgtgatagcaagggagcaaggagtgtccatgcctgtgcaacatgcggatgagcttcggtagaaaaaaataataatgaaatttaccaaaatttcgcataaaatttctaaaaacttattgtgctcccataaataattaattgcttcaagacatgtataaagacaaaatggaagatatctggtggaggaacgaaacaaataaaagtatttagaaattccacaattttattatctgaatataaaatctgcttcagtttttgttcgaattgtctaccgaactttcggtttaatcgcctcctactgcaatacaataaaataaatttgatatgtcctcatcatgagccgtccaattttggatactctcagtttctcaaacgtgtcgaattgctcagcagtacatgtacagtaatatatatattgtagaagtgaataagctaaacgagggggaataattaatttgattgtgatttagcatgcttaattgaattgaccacacgttgcaacttaacacgtacgcacgtataccatttatatatcttttgctactttctttaaagcaaaccaaaagaaattagaaaacgacgagactgaataaagttaaatttatgagaacaaatcaccacgcatatgaacaaaaaaaatggaagatgatatgggatgatagagcagattaaataggaaaaaaacggaagatcagaatatgggatgacaaagtggggtggttatttaatctgatgaatttgaagtgacttattttattttcatgcaaaatattcctgttattagttattactaaccaatatccaatctaagaagacttctcatctagaggttactgccatcattcacaatctcttggatctgatcgagttgagttattaaggtaaactgccattgacgtgcatgcatcccatcagaaagtgacactgcatcacacctaagtggatgagttaaaaagagggtgaagcaactagaaaaaaaaacccaatttaagccacacagttatggattaacacgccgccaatatggtcaggaaagttgggcatctacttgcaaaaatgtggggcccggatttgattaatgaaaatgtgattagatggtgatatgagagttttgagcaactaaatttatctaagcatgcatcctaccacttctttttttcttgctacataaagaatatacatgatagtgtatattatggtatcaggatagagtatagaccgaactattttggtacaagtctacatgtaaatgtgagtttcatatatagttaggtatgagttctacgagttcaacccagataggttaagaaaacgtcgattttctttgacccaacataaggtgattttgacggcacgtgtctacatgatgttggtagttcaatgaaaaatgacctagcttaattacagccaccagtttgagagtaaaatcttgtcctcaataatgagaaaaagtatcccatttgaacacatattattggtcaattaatattatagatatatgattttacattttccatggaaaataatttcataatagattattcatatgatgttaaactatataaatatttagaaataaatggttaaagttttatattataaatgggtgcccctcttttctttcaagagctacaagtacataaaagttattgtataattctagtatagttacaatctaattatattgcgattgcactatagttatgtttgaaagttttttactgaacaaacttgtgacattttttaaatattccctagaactattgcatatccctaatcttttgtataggtgcaaaagcactatatatatatatatatatggatacccatatgggactctatggtgcccgggctccaaggtataaaacacacaaattctcttaaatttttaaaaatttacaaattgtaagtagatatctaggtatataaatttgattcatacaaatacctaacaacaaaacaactcaaactcaactttatttcacaattaattattacatacctaacgaattatatgtctggatgttatatacctagaaccaaaatctaacaaaaaaaagtacaaactcagttcaaacttgtttgaacttgttagtaaagaagttaatgttcatatctaaacattttaaaaaaattcatactcattcaaattggatatatactcaatttgaatcttagagcccatactgtatgtagcaccagttaatttacctatatatatatatatatatacacacacacacacacacacacacacacaaaagtacaacactagacccttacttatatgcatgtcttactttataaccaagtaaatacacatatatcttcgatctattagaatcatatatactggatcgttgaattgaattataatttaccacgtctaggatgaataattgttgaacaatccggcggctaaaaggtccaacaaggagagttggaggttggaacagcctgtcacaacaggttttttgtacgcagttgttaccaacttcaacgccgacgacgacgtcgtgtggccaatcttcacctgtcaccgctggctcctgatggccggcgacgacgatagatgagagccaaatgaataagtaaacatctcatcaacaaaagccctaattaacatgctaattaagaggctatgaagccctagctgggtagtacttattttatttgtgcaagataggattagccttggtagttttagttaattaaagggggtgatttggggatggatggattgtgcttttacatccctcaaggcatcatcaatcattatccttcctccggctcccggcagatgatgaggtgtgatgcaggtgggatcgtgtgccacctggaggggaagattcctctttctctcaccctaaacttcagcgtttttcttagcctttgagcaagtttaatagtatagctaactgctagctctaatttatctatagccaatctaatagcttattcataaaatagttacatactacactattaatacctggtcccacctgtcatacacaccgtgtcttggagtccgtgctacagctggctacaaatctgtagcccgctgctcttctctctcctcatttatctcctcaaaatacgtttgcagctggctatagcctgctattgtacctgctcttagtggtggtggtgctagtgctacacgcacttgatgctgtaccaggataaataacacgcaatgcatgagcatcatgcccaccctaaaaggcagaaaattaacctcctctcttcctatgtatattgccatgtttaccgtgtattcatctatataattaaggtataggatgtgtgcgtaaaattgtttcattttgcattcatgtagataggtaaagctggtaccacgtctaattagttatgtgcttgttttccataaagatttttttttatttgcaccccttccttagagaattaaggtgccaaaaatgaagaatgtgattgaaggtacacaaaaaaggataagtgcttcccctgttggtattgcaccgtgaagtatcaggctcaaacgttcggctacaaaaacttctccttaaagatagttttggtcttactgtcaacagctagctagagttatgtcacaaacgtatgcatacacaaaccgacatacaaaccaatggtcaaaccagagaagcatcccatggtttccattacatacataataacttctttcatttatttgttgtgtgaagtaatacaccaatgatgaattctactacaaaagaaatagtgaaatcaatgacaactcatttttttttaccaaaacaactcaaagttttacgtgtatagtagaattaaatttatatatagttgtgtaaatttctacattgtgaattaagggaaggtaattcaatgaagttgtcagtcaaatttctactacattggtttatggagacatagtatttttttataggcaatatggagatatggattgatagtgtaaatccaaaaatgccgcttgaagacatgacgtagagatacctacatttgtacacattatttaatgagtactacaccattcaccatctatatattttattatatatgaatgcatgatatactacatgatgcatgcatttgcaagaaaattcacattgaaagtatgggcaactcttacttcctaactgtacatgcacatccctatttatcacgaatagagtagatacatatgcacgaataaatatacagtgagatcacaggcgttactcgaactcttgtttcgaagggagcatggaaaaaccattttgaaattcccaattcttgtacctacttgttcatttacatcaggctcaatatttatttgaatttctaactgttgaggctaatggagaaaataccagtaaacaatatagaagtgatgcactgttgtgaccatagcaaagctcaaattcaactcccttttgggcccaattctaaaattaatctcccatgtgaaacgaaatgccaatcccggtcttgcccatacattaacttaagccggggcataataattggggtggttaacttaatttaatcaccaagattttttgcctaatcattaaaaaaaagggccacatggccatttattacctggaaagggagggattaacccacaacatgccaatgcatggccatttttatactcctctgcccctgaaccattggcacgcggataccaccaacgcggctgacatgacacgtgggcccatgcgcatgtgggccccacatgtcagtggcgtaagcgtgtgggccacctagtggggttgggtctgggagtgggggggtgttgggggggggggggggtccgcgttaatcgccgggcacgttctgcacctctttcgctctccggaagggcccacattacagctgttataatgtggtcttgtctgcctcctcctctcactcctactactactcctttaattattatttttttgtttttctccaattctcctaactaattttgttcccacatgtaaacttttttttttggttttttggggatttaattttgcctttgtaatgatttttttggctgttgctgatgctgctgcaaagtagtaaaaccaatcttggtgtaattgtttttctgctgccccttggatcctccaatggtccttggtttagtactggtcatcagtgcaaacaattgcttctaactcagatgaattttatatttttcatctcaaaagaaaaggtattgatgagagtagaaatggtgaggtaaaataaaaagggtaattttgaggataatttatgactaaatttccagtgtgaaaaatactcctccagcttagtacagtagatcatgaatcacagaatccaatatattcccccatggggattgaggtagaggagtttttgtagaggtatttgtgctcctctcccttttattacaagcctccacctttctctctcatcccacagtttcctacccctcctttcttcttcaccagtttgtctctctctctctctctctctctctctctctctctctctgtcctttcggttttaactagcattaggcaggtggttaggaggggaggtaaagctcaaagctccctcccctgacagcgcagcatcttgtttgttttatctcccacatcatctccctcatcatcatcatcatctcctcttcttgcaagcacccacaacaacacaaactctctttcttcatctttctctctcctcctcctctctttgttgtactctactcaacatttctcaactttcacttcttcttcttcttcttcctttctctcttcacagctatcatattctcctcctgcttgctgctgctgctgctggctgtttctctctcatccatccaccctattatttattcaaggctaagtgatggtatcttaattcttttttcctctctgcctcctcttcttcctcctcctctctctctcccttgctgttgcaggagtataatttttatttttgccaggcttcttcctgtactggtgtttccttgtttcctccctttcttgtgcttcttcttcttcctcatcttcttttttttttgggttttctctctcctgccatccttttcacctctactagctctcctgatgtactgatcattccatcacctccattccccagtggtaacactcgtgggggaggaggaggaggaggaggtagtagcatgcagcagcagcagccagggggaggagggggaggggtgcagcagttcggcgcggtggcgccggagatgtcgccattctcgccggcgggaggaggcggcggggggcggatctccatggcggaggccgcgtcgcccatcagcagccggccgccgccggcgcagcagcagttcgacgagctcggcgtaggcggcggaggcggaggcggaggtgggtttgacgccgaggcgctggcggcggcggcggtcggcgaggagggagccagcggcggcgcgggggggaaccggtggccgcggcaggagacgctggcgctgctcaagatccggtcggacatggacgccgcgttccgggacgccaccctcaagggcccgctctgggaggaggtctccaggtaaaaaattcaacgccatgagcccccctcaagaattgctccgccgtcgatctcgccgccatggctgaattctcgtcggcgaaatgctgcatgaaatctcggcggcctccagaagcagtagcctggtgtgatttttggttaggctcagttaattaattaccggctaaaataaacacctccttttcactttttttcccttaaccatcgttcacgagcacagtgactttttttccattttaaaataatacgggtatcactctccttcctcacctttccaaagaatttttttttcatggccatctcttatcaagatggtggtacaatacaacacacgcccatacgcttcagatccgaaaggcatcaattccaattttgcaagcagaattggccataaaaatgcattcttttgcacaagcacaggagaagaaaaaaagatggaatttttactccccccctgcagcattctctctagtctcttcttgggatttgattcatcctagtttagctagctattgctgcatgtatgcacacaccttcctttctttatcttttccgatgggtgcccaaatcgagtaaaattctactccatgcatgcaactttcctgtgagggttacagcttaatttccttcaaattttggctcgccattgacgagctcgagcttaagcttcttcttcttcgtgttgtttttaatggcggcgtggtggtgggttgggtgcaggaagctggcggaggagggttaccggaggagcgcgaagaagtgcaaggagaagttcgagaacgtgcacaagtattacaagcgcaccaaggagagccgcgcggggcgcaacgacggcaagacgtaccgcttcttcacgcagctcgaggcgctgcacggcaccgccgccggcgtcgtggcagcgccatcgccggtgacgtcgctggccccgccgccggcgacggctgtgggggtgtccggcggggtgcgcgcccccgccgagccgccgcccgcggtggtgatggggaacgtgatgagcttctcgacgtcgaacacggaggagtattccgacgaggaggactccgacgacgaggggaccgaggacatgggcggcggcggcggtgatgagagggggaagaggaagaggttgtcggagggtggcgccgccgcgggcgtcggtggcggcggcggaggaggaggagggagcggaaagatgatgaggttcttcgaggggttgatgaagcaggtgatggagcggcaggaggcgatgcagcagcggtttctggaggccatcgagaagcgggagcaggaccggatgatccgcgaggaggcgtggcggcggcaggagatggcgcgcctcgcccgcgagcaggagatcctcgcgcaggagcgcgccatggcggcgtcgcgcgacgccgccgtcgtgtccttcatacagaagatcaccgggcagaccatcccaatgccgcccatcatcgccgcccccgccatcaccgtcatgcccccaccggcgccatcccagcagcctcagccgccgccaccgccgtctcaccccacccccatcacctccgtcgcgccagctccgccgccgccgccaccagcagcagcagcagcagcagcatcccagccatcgccgcaggccaccaagtcgccattgccggcgacgccgcagacgcaaagcagcatggacattgtcatgacggccgccgaggcgcacgacgcggggtacgacgggtccggcggcggcggggggcagccgtcgtcgtcgcggtggcccaaggcggaggtgcacgcgctgatccagctgcggagcaacctggacaaccggtaccaggaggccgggccgaagggcccgctgtgggaggagatctccgccggcatgcggcggctgggctacagccggagctccaagaggtgcaaggagaagtgggagaacatcaacaagtacttcaagaaggtcaaggagagcaacaagaagcgccccgaggactccaagacctgcccctacttccaccagctcgacgccctctaccgcaacaaggcggctctcaactcctcctcctcctccgccgccgccgccgcaccggccctcccgccgccggagcacgcggagccggcggtgacagtcgccgcgccgatctcgcagacaccgccgccgccgccgccacagcccgtgacgacgaccaagaacggcaacggcaccagcagtacaaacggcgcgaacggcgaaggaggaggaggcggctccgggggcatgcaaatgcaggcgagcaacggcagcgtcgtcgccggcaacaagttcttcaccggcgcggcggcgaagaaggtaagctaagctacgtgcatccatccgtgtgcatttccccgtgtggccgtagcgaattggcgcgtacacatgtggtacgctgctgttcgtttttggtgatccaatgctgattgcgtaacgctgcgcatttaaagccagaggacattatgaaggagatgatggagcagaggccgcagcagccggcggcggcgaacaacgccttcaaccgaacggacggcggcggtggcggcggcggcgtggacagcgacaacatggacgaggacgacgaggatgactacgacgacgatgacgacgacgacgacgacgacgtcgacggcaacaagatgcagtacgagatccagttccagcatcagcaccaccaccagcagccgccgcagcaccgccaccagcagagcgtcgtcagaccgaacgccgccgcctccgcggccgccggcggcaacccgcccggcaccgccgcccccgccacggcggcggccgcaacgacgaccaccggatctttcttggcaatggtccagtgatccatccatccatccggtgactctctctccttcctacacatgcatacctccatgcgcgtcaatggcttcttcttcttcttcctcctccatctcttgtaccatttgtatctacctacctgtcgcctcctccatggctcgtccatatctcaacaccatcaaaaagctcaaaaacctaaaacctcaagaattctcttcctcctccggcatatttctccattgattcctcatgcaagctagcagctatacatctccatgccaagaaagaaaaattcgcccatttcaagctgcatgcatgcccatcgatcgttcgtcgctggatgttcctagcaagaaaaagctagtagcatcgatccatttcttgattcgttcttgtgttaattacagtggtctctcccatctcgcgtctcctcttagctagtgttaaaagcaaaaaaaaaggaattggtggcgtggtaatttattgatttgttgtggtaaatttaataaggaccctccattcgtgagggttcacggagagggtttaaaacttggtgcggtgaaaaacggcacagaggagcggtaataacacctcgctctcgcggttaaaaaaaaaggaagacaagggtatatatgcaaaatgttgcggtggttgtggttgttacaaattattacacctcggtaaaaatttgtttggctatgtgtactactgctcgatctactgtggcatgttgcaagggcgcggtgaaaaaaaaatcgaaggtgaaaaattaaagatgtgctcatcaagtgaagtggcagtgaaaaagcaagagagctggtgctggtgtatgccggaatttttcccatttctcttttttttctcttttctctccttcttttatatgttttgttttgttttttctaattacctaaactgtccattatgtattacctgagtttttttttcttcctttcccaaactgttgttaccgaagttttacagtgtatactcgcgacatattatatgttacattcttgctattcttataccagcattctttctaaataagtgtgatgctctttgtctactttatttatttttagagaaaagaaggattagaggcagatgcaacgatttaaattacatgtgcagctctggttatactctaggatccaatgcttaatttattgtaaactttttagttttagatcccataaggatcgatctcgatctttcaaatattaatataaattgctatgccacgattagtataagcatggggagatagccctcacatgccaaagattagtatagcacaaggaaggcttgatatatagggtataaaatttaaagcaagtaattatcaaattataaccgaggtaaactcattaaaataactaggtagcatccaagctagatgtcacggtatgttgtcatatgcatgcatgcatgtaaataaaaaaaatgcctgcaaaaatttaggtagatcaaaagataaaattcggtatgatcttgatcaacttaaattgccagcacaaaatcaactagtagaaggatcttgtgtagatcgccctatcatgacaacttcgagtgctagctaagagagcatgtgctacaaagtgacacttgattaattatcacttgcacaaattcttgctacttaaaccacacttttatacacactatgctactgtatactactcccagtagcactagtcctgtaattaaaattgtgctcctagtacgtgagataccctaccactgtagttttaggcttggatgcctcggagttagagccagcagggggggggggggggttgcctagctatagtgagtatggctgatcctttggcaagcatacaaaattagttttggggtcaggctggcttggctgtggctggggatccgtataaaaacggttgaagtgtggggtgatgtgtctgccataaaaggttaaaaagaatggagctgtgggattgatgcctcctgtttaaattatgggagaacgtggaggttgcagggcgcgcgctcgttcaccttgctgcccttcgtagctctagctctactccctcggtcccaaaacaaaaaataacttaaaagaaaatataactttttctcctaatacaacgaatttgaatagagggttgtccaaattcattgtaccaaaaagaatcacatctagactgagggttgtccaaattcgttgtatcagaaagggtcacatctcatactatgttaagttttttttggacggagggagtatgtagtagtagcagcatcatcagttctaaggttgtaccagaaagggtcacatctcatatgttaagtttttttttggacggagggagtatgtagtagtagcagcatcatcagttctaaggtgggaataataattttaggatttttgatatgaaatggaatagtttcatattctaaatacaggagttcgatctcaggattttaaagaatttttgttagagaggtaaaaattttcgtattctaagagggattcggagagggatggagctaattctaagatggtggctcgcgtacgtgccatgtacctaggagtacattatatttgtggatttgaatgcaacatttccactattttcttttgtgaagggaaacactaggagggccgtataatacactgtcaagatagtgcactatgcatacacgttgcaataatttagtgataaatctatccattatcttaaaagaagagtgataaatttattatataagtttatcgtgtttgataatgtttgctatcttatgacaatagatttacatgagctacatctacactctaattccctagtacacactattcatgcatcttttctcacactcttcatagcttcttgggcaattggcatgagaagggagagcttggctctacactctactttcttctggctgcaggctgaatgttgcacatgggatggtgagaaagttaaaaaagagggagagataggaaattaggaacagacatgtccaggaggagcccacacaatgccaccttgcttcctacttgtgctcccttagcttttgttcctttatttttttaccactggctttttatcttgtcatggtggtagtaactattaagtcatatgtccaatgcgtaggagggccaattcatcatctgccaacctgttgagatctgcgtgtgtaaattcagtgtacaatcatgtggcaatagcatccgcatatgtataactatctagaccagtaacaagtgtaacaaacagttagaaaatgctagacaaaccaaattctaaaggcattttgcacacaaacctcaaaatctgaaacaatattccaagtccaagaaaaatttccttttcttacctggatactagggtggtgtttggttggagggactaaagtggagctaaactttagtcccagggactaaatttaatccctagttcccaaacaccccctaggtaatctgcaacagggccatccactgagagtttgtgcatggaaaaggcaggccctcatgcagagaggtggctgcagaagattcttttggtgagagagaagagtgaaccaatgctacttcaacgtactaccagtagtacgttttattcaggtaaaagatggcaaagtgcacagggtaataaggtgaaaaagagagaaaaaaaagaagaaaatagtactggcttaggcacattgagaattcactggccccggcagcatgtgcggtgactccacggttcacgaggcggtgttacttgagggctggaaactgggcggtatactgaagggcgaaaaaaaaaaactggagaaactttcgctaagtcaacacccagcgttacacaggcttttcactaggtttggttttatgtgaaggtgtagtttcaacatagtccaggggaagagcgaggggtgttgtcaagcccgaacaataaagaatgtttactagcaatcggtaacttttagtacatgggttgccgataacagaacaataaaaataccgacggcagagctcgaacagctgtccaactatctcaggagccagctccgccactgacatagcctcttgccagcgaagaacatttgggtatataagatatattataggagtacgagtacctctggtttattgaaattattgcactgcaaagacaccccccccaaaaaaaagagaagacaatattagatgagcaattctacggtccttgaggaggtaccatgaggtaccaaaaatttagtgtagaatttggtacctcatggtacctcataatac

SEQ ID NO: 59833 - DNA, 2074 bp, Oryza sativa
tgctccatgcttgaacaggctgatattgccctgtataatctttttgctgtgtttttggagtttgtcttgtcaaaaaggcagtgctcaaatggttggttggaacggctaccatgatgtggggaacgatagaaatgggcttaaaaatttcatccatgagtgtgctgtcatttttcttttttcaccgagagagagaaggaagcattgcttttcagatagtaacatcttcttgtcttatttttggtagtgagggttcatgttcttctccatatgctaactgttggaatgagctggatctacaggaatatttaacttataaagattagggactgagtgcatgtgaccattattggccgttgacgtgctggatttattttttttttgttcatcattagtttcaaagattcctctccccgagtagctattggttatgcctttgtgttctctttccatgaattatgtgtgacatgtgagaaaagaatcagtgattcactctttcagaaattggatggacgtgtagaattaataaggcggcttgtcatgttccctttatcattctctctgtcaaaaaaaaaacggtgctactgatctttcgattgacgtatccttgtctgaattttacgcttttttttctcatgtggtccatgaaaaaaaaattattttggtgctaaacttagctatcaatgttttggccaactcactaaatttcttgcatatatatcctcttttgcatattgattcagattccttctttgacagaatggggagctcggagaagaacggaactgcttatggcgagtacacctatgctgaactggagagggagcagtactggccgtctgagaagctgaggatatcgatcaccggagctggtggtttcattggatcccacattgctcgccgtctgaagagcgaggggcattacatcatcgcctccgactggaagaagaatgagcacatgactgaggacatgttctgccatgagttccaccttgttgaccttagggtcatggacaactgcctcaaggtcaccaacggcgtcgaccatgtgttcaaccttgccgctgatatgggtggtatggggttcattcagtccaaccactctgtgatcatgtacaacaacaccatgatcagtttcaacatgctcgaggctgcacgtatcaatggtgtgaagaggtccggctctctcttttttttttacatatttttactgttatatctcagcttagcctgagcttgttttatccatatcaattcatttgttacaactaatggtcctacaggttcttctatgcctcaagtgcatgcatttaccctgaattcaagcagcttgaaactaacgttagcctgaaggaatctgatgcctggcctgctgaggtttgtccatcaaaataattttaggctttagtgttatgttttagtaaaaccagaagttgatttcctactgttttaactactgtccagcctcaagatgcctatggtttggagaagcttgcaactgaggagctctgcaagcactacaccaaggactttggcattgagtgccgtgttggccgcttccacaacatatatggcccctttggaacatggaaaggtagaagtttaaccaattctccaagttattgaactgtacttgtactggggcatccttaactcaatttgtcaatggataggtggccgtgagaaggcaccagctgcattctgcaggaaggctcagacttccactgacaggtttgagatgtggggtgatggcctccagacccggtccttcacattcatagatgagtgtgttgagggtgttctgaggtatgcagctacttgtcacattattatctagatagaacactaaaccacacctgattagatgagaagctggtctaatatgatacaaacaatttctaggttgacaaagtcggacttccgtgagccagtgaacattggaagcgatgaaatggtaagcatgaacgagatggctgaaatcattctcagcttcgaggatagggagctgcccatccaccacatccctggacccgagggtgtccgtggccgtaactccgacaacaccctcatcaaggag

SEQ ID NO: 59834 - DNA, 39173 bp, Oryza sativa
gcatagtggccatctttcctatggggggagggagatcaggatcaatacctttttgtccagtgtcccaatgtatgctatgggtttttttaagcttcctgaggagttccacaaaaatttagaaactataagggggagattctattggcaggggaatgggaagaagaagaaatatcaccttattaaattgcagggtctgtgcagacctaaagactttggtggcttgggtttcttggatactaggatcatgaatttttgccttttgagtaaatggatcatgaagttggaaggcgattctcaagacatgagctgtgttgttcttaggaacaagtacttagggagaggcagttttttcaggagttctgttgttggggggtcccagttttggaaaggccttcatgagtgcaaagtctggttaaacaaattggtagttaagaagattaataatggagaaaaaacctagttctgggaggatgtttgggtgggagatgttcccctaaaaattttgtttccttccttatatatggtgaataatcaacaacatctttcggttagggaggttatgggtgctcctaattgggctctgtcctttagaagaaatctagaccaatctgacaaggctcaattagatcttttgaaaagtttgttgcaggatgtgaggctagatgatttgcttgacagcttaatttggcctcatgagaagaataagaaattcactactaaatctatgtataggctgttaaagtttgggggtgttgtggacagagagatgcaagagatttgggggtgcaaagttcctttgaaagtcaagcatttcctgtttttggctgggagagggagaataccttgtgctgatatcttagttcagagaaattggaggggggtactaaattctgtaaattatgcttgggaactgaatctagtaaccatgtgctttttacttgtcctatcgcttgctttgtttggtgctctgtaacagaggtaattgaagggggtttaattccaaccaatttttgggatggtataaaagctggtaaggaaaaactgggggtgaatttaggtctttttctttgtgctagtctttgctggggtttgtggttgataagaaatgaccttgtttttgaaaataaattggtgaaatcacctttgcaggtagtgtacaaggcaatttctttgatgcagagatggaaggtgctgctgtcaaaagaaagagatcgcgaggccttgatcgtgctgcttgagaagctaaaggctaagctggagtctctacgactagtggacgtgctaccggacaatattagtgtttaagtcagtttgtttgcttttggggttgaggtctcctagccgtttggatgtcttccttgatagggtctgtaagtcttttggggtttagctatctagcgcatgatgggcactggcagccccagttttactctgttttcctttaagtttctgtattcagaccttgtcatgtttggctttctcccaaaagccgggtaatcaaattacctattataaaaaaaacaattgaacaaagaattgagaaaaaacttagtagttggaatggtaaactaggtgggagattggttttgattaactgtgtgttatcaagtttagttatgcttatgatttcgttttttagattcctaaagagttcttgaaaaaagtgattattatagatcccatttcttttggcaaggtgatgaaaaaaaagaaatatagattgacaatatgagatattatttgtcatcctaaatatcaaggaggaataggtgttcataacttagaaatccaaaaccaatgtttattaattaagtggttgtttaaattaataaatgaacaaggtgtgtggtaagatcttttgaaaagaaaatatcctggtactaaatctattactcaagtcgagaggaaacatgggtattcctatttttttttgtctagtttcatgaaggctaaaagttcttttctaaatatgggctactggattattaataatggtgaacaagttagattctgggaggataagtggttagttatggttccgcttaatgtctgttttaggagagcattagttggtcagaacttgattatatggtattattttgtgtgttttaattgtgcatgttaatttaacagaggaggatgatatatttagttggaatcttcatcaaagtggtcaattttcagttcgatctatgtatttggctctaattaataatgggtatatagagagaaataagtttatttggaaacttaagataccacttaagattaaaagttttatgtggtatctctttatggggattgttttaaaaaaaagacaacttggctagaaggaattggaatggtaatttgagatgttgttttttataaaaaataaatcgatttaccatcttttcctggattatcattttgccaaatttctttcgaaatctatacaattcgcgtttggattatatcctccatataatatatctcatatatttaggaattggtttgtgggtgttaataaaaagaccaatgaacttaatcttgttggagattccgctgtatgttgagctctctggcttactagaaataaaattatttttgatatatcaccttcaaaatcttatttggttcttttctgggcaatatattggctccgggaaagggctcaattataaaagcatgatgatcatatcaaactaataagagatatgtgtcgtaaacttgagtcgacaatcatgcagctttttatcaacttcgggtggagattcaccaagagaattcaatagttgtggggtctttaccttgtttgatttttattagtttgcttttacttttgtttttgttactttagttatatactcattgggtgagttcatttttgtgtaaatcttataataattggctatagttcttgcgcaaatgccaggatgtcattccattattataaaaaaaaacaattaatccgagtccgacttgattccggagcccgatcgatcgatgtccgaactgtctcttctaatcgagacgttatatatatcatgctaatcctgcctgccacgacacccttcgtctacataagtgagcaagatagattagccagaagctaatcccactctaatcggtggcatgcatatatatcgattattgcatcactatatatatataggcgcctcaccgtccggagcgcgcaccgcggcgctgccggcgtcgtccgcccatgccgccgccgcccgccgcgtcgtgcggcctacacggccaccaccgccgccgccgcagaacttctccgtctccaccggcgtcgccactcgccgcgtcgtgccttcacggccaccacctccaccgcctcctcagaactgctccgtctccaccgccgtcgccgcccgccgcgtcgtgcctacacggccaccaccaccacctccgccgccgccgccgccgccgcagatcaactactccgtctcgaccgccgccgccgccaggtcgagcgggcaccacgtgttccggatccgcgactactccctcctcgaggcgatcacccccaacggcaagagcatcaagtccacctcgttcgcggtgggcggccatagctggcacgtcgagtactaccccaacggctacgacgccgatcacaccgactacgtctccgtcttcctcgtcctcgaagacgacatcgccgccgccggcggcgcgggcgagccggtgaacgtgcagcttcgcttccgcttcgtcgacgcgtcgtccaaccccggtcggccgtggacgccgccgccgccgccgccgccgtctgaattagccgacatgcgtggcgagaaggtgcgcgacttcgacggacaagggaatggatggggcaccgtggcgttcaagaagaaggagaagctggagagggaagggctcatcgtggaggatgggctggccatcaggtgcgacatcgttgtcatcacgcaatcctgcacggcgacgacgacgacagaggcctcgctggccgccgccgccgcggcatcgtcgtccagcgaggaaatggtttcccccaccaccatcgaggacaaggtggtgaacccggtgtatacaaaatggtgcttaccgccactgtttcagtaaaaacatagtctgcataagatcaagccgcctgacgtgatgttccaggtcggcacaagcggaagttcacggctaaccggcggttcgtcgccggccggtcgccgtcaccggccttcgcggcggagcaatttggcggcggccagacggagcaatgcaacgaccaccaccatcgtgtcatacaaatcgacggcatgaagcccccaagttgttcgacgcgctcagcttcatgtatggcggctcgttaccgatgagtaggccagattatcggcggtcactgctgtgcctctgctcgtcgcgagaagttaagcaagtactccctccgtattaaatgtacgacgccgttgactttttaacaaacgtttgacctttcatcttatttaaaaaatttatgtaattatcagttattttattgtgacttgatttatcatcaaatgttctttaagcatgatataagtatttttgtatttgcataaaaaaattaaataagacgaatggtcaaacattagttaaaaagtcaacagcgtcatacattaaaatattaaaatatggagggagtactacaagagaagcgtgtggtaagcttgttggtgttcgttgatctgtggcctagctgcaaggtgttcaagaaggcatgctttgagttcatcatcaaatcgtcgcactgtctgatgttgattgttcaaaaacaaaaaaaatgggaagtatggccgtgtttagttcgtatgccaaattttttttaagtacacggacacgcatttgaagtattaaacttagactaatacaaaacaaactacagattccgcatataaactgcgagacgaatttattaagcctaattaatctgtcattaagaaatgtttactgtagcatcacattgtcaaattatggcgtagttaggctcaaaagattcgtctcgcaatttacatgcaaactgtgcaattgatttttttttcgtccacatttaatgttctatgtgtctaataatttgggtagttccatgccaaaattagaagtttgactaaaattggaagtttgaagaaaaaagttaaaagtttatgtgtaggaaagttttgatgtgatgaaaaaattgaaagtttgaagaaaaagttgaaaactaaaccaggccttgatgtgaaggaatatttggaagtttgaagggactaaacactgcctatatcatcatctgtctgaactctgaactgtcgtactccctccatactcataaagaaagtcgtttaggacaatgtttaagttaaaccttgggaatataaatcatgaataactatcaagttgttgagtttgaaaatgtaaaaattagagtaaactgcactttaggccacctctttttaccaaagatgcaatttgggctaggtgtaagacatgtttttcacattagactagataactttgcataattgtttcaatttggacctccttttctatatgctcccctctttcttctcaagttgatgaagaagccaagctcaagcatagacttctggagtgccgcctaccgctgccttgtaatgcagccactatcctcgagcagctcctacgcaaccatcatcgtgcaactctcgctactatggccatggagtgccactggccgccacagtccttgagtagttccaacgtgggggccaagagctgcttcgctgccgtggcccttgagcgctgctcaattgctcattgctgtcatcctttatctgccatccgagagctttgattcgacccgttttgtcccaagctctagcttggtgagcttgaccatcattacgacgactgtacaggggccacggtctcaaggttgatgatctccacggggcattggggcttgctgaattgctgaaagttcaagcgttggggcttgccgaaagttcaagcttgacctcaacatgtctatactcacagtcacataaggtcaacgagagagagcgagctagagcctggagtttggagaggcaaaaaggaggttgaaggtgaaaccttttgcaaacttatctagcccaaagtgaaaaagtcatcttatccctagtccaaactgaaacattggttaagaaagatagcccaaagtgcaatttactctaaaaataaaaattatatgtatagatttgtcttgaaaaatactttcataaaagtatacatatatcactttttaataaatatttttatagaaataagaagtgaaatttgtgttttggagaccgtgtcgctgtcctaaacgacttcctttacgagtatggagagagtacgtgcggagtgaatggtcctatagcaaactctggacaagccaaatttttatatatgctgggccgtttccctaccatccattagggccttcgcccaccaatacgcttggtcgtgccccaccacaatacgctgggcctacaattgtttatgatgtcagaaatttgtcaagatacttttcccacaactcataaaaatttgatcactatttccgttcaaaacaaaattgatcacagattccatttgagtgtctgtatatatatagtacgtcaaccacgatcaggatctatatatatcagtgaccaagttatggtgactttgaacatatatatagaagaacctgatccatagtgtttaccgccatgatatttcaacatctggaattgggaatattttcttcgtgaaactatggtcgaaactcaaaattcatacttagagcaaggggcaaggctaatagccatatcaccttgctgcatgcaggcctgcagctagtttcaaaacttagtaaatatagcaattaagttatatatttttctctacaatctcccacacacaccttttgtttttctagtattaaattgggttgtttgaaggatggtagcaaggcacacgcatgtatgagaaaagaattgggcccacaacatggggagtagtgtgtagcccgacggcaaaacaatccttctctctttcacctaaaaaatctaatgtgtacatcactataggctgctgatatagttttatatatatctgtttttatattgtacatgtatacggacgtcatgagttaatttatttttataacaaacaggtcctattaccatcgctgttcgttgatcatatcggttttaagacgaggaattactttatctggtttaaggttcagagaagaaattaaataaaacaagagagttaagtgaactcgaaacagatatatgtctgtcactaattcatagattggagaaatagcatatatgttgaagaaacttatttatattctgtagatatatataatatccatctcactgcatatatacgcaataagtattagaacaccatgcgtgcccagaactgtactgggcaaatatatccgcttattcagtcattcattcataccaaatccaaccacagcgatatctcgaccgtccgatcagcgatcagtggttggcgatgatctcctgagccttgatctcgtactcaaagccatagctgctgacctttgagctgtccgccgaccagatgaacaatcccggcagcttcccctgccgctgcaactccttcgctccggcgatcccctgctccggccagagcagcccggcgacgtcgccggtcttgaagctggcgagcaccttgccgcccgggtagttcgccgcctgctcgtcgtagaacatcacgtacgtcggcacgtcggtgttgtcgccgtagccgtagaactggaagttgacgaggtcgatcacgccggcgtagcgccgccacagcggctggtagtagcgctgcaccacggcgtcctcgaacggcgcgatggaggtggtgatgttcgggtgccgcgccttgagctcggtgaggaggcggccgatgcactccacgaacgtgtcgacgccggcgccgccgtcgtcgttgaagtgctcgtagtcgacgtcgacgccgtcgaggccgtaggcgtcgatgatgccggagacggaggcgacggcgttggccacccacgagtcgacggaggtcggggagaagaagaccttggcggtgtcctgcacgctgtcgccgccgaggccgaccatgacgctgacgttggggtgcgccgccttgacggcggcgacgtcggccggggacaggttggccgtgtcccagtacggcgagaacacgccgttggtcggcgccggcgtggcgccgccggccgggctcgtgtagtcgatggcgaaggagaggatgaagttgaagctgaggtttgggttgatgggcacgtcggagaagcggactccggtgaactgcgcgccgatgtactcccggaacaggtacccgttcgtcatggctacgaccttgttgctcgagttagctgctatctgtctagctatctatttatacacgtgagcaaccggtttaattaattgttgattaatttagctttgactacacctatatgttgggggagatgagcaagcaaaagatcaggttctgatctacttactgttggatgcatcacatcagctgttgtttattaatgagaatataacaagttggtcatggtagataagcgaccaaggccgtgtttagttcctttcataataattttttttaagtatacggacacacattcgaagtattaaatgtatactaataacaaaacaaattacagatttcgcctataaattgcgggacaaatctattaagcctaattaatccatcattagcaaatatttactgtagcaccatattatcaaattatggtataattaggctaaaaagattcgtctcgcaatttacatgcaaactgtgtaattggtttttttctatatttaatgctttatacatatatttaaatatttaatatgacgaaatttttaaaagttcgaagggaactaaatacaatccaagtaaccacccgagcgcggctcgaaaaagagtgacatatagctagaacctagagttagacatgtgcacgccacgaaattggagagctagctaaggttaccatcttacgtacggtaaccatttgtgatttgtgcacatcggggattcatttatgaagccatgcagatcagcacgactcaaaattgtcttggattgggaattcgatcggacatatataagtataggagtgaagtgcaccagcggtctctaaacttgtgcgggtgtgtcatctaggtccttaaactcttaaaatgtatttttgagtcctcgaacttgtcttcggtatcatataggtccaaacaggctccgatccgctccatccgctaacgtggcatccacggtagcgtctacgggtcagtggggacccacatgtcagctctgtgcatcatctccaccgccctgggagccgagagagagagagagcgagagcaggaaagagagacaccggcggtgctcgacgcgtcacgcgtggccgggacgtggcaacgctgagctcctcccttttattcctcatacgtgtcgccttctcttctacattcttctggagccgaactactcggacgagagagagccctatgcctctccgtcgcccacattctcgtcgtcgatcgcgaagaagatgacgctcgctgttgccgacgagttgtctccatcgccaaatctttcccgttccaaacttcccacatcatgccgagcaaatctccttttgaccccatctcgttttatccactgcagcaacggaaacgcgaccttgcccacgagagctccggaactcgcaccaggcgtcgccgccatgaagtcgtcgctgttccaaccgacatggtccatctcaagccaagccatcgtgccaaagtcatcgcctcaccatcatggccaaaatccctcaagaaattttaagaatcatgcacagacgagggagatcgccgtcatcttctccaactccggtcaccgagtgccatcgccaatccctctctccccggtgagccacggactaattaatcgtgcatgcaactctttagggacctcactaaccacccatgcaccttctctaagcattccaccgctcaagcgagccgtcgccgtgaagccgacgttatccaccaccgccgggctgtcttttccattgccgctattacccagacctcgccatgccgcaatcaagttccagtgagcacctagggacctgctagactcgtatgcatgcatctttttgcactaaatcgagctgggactctacatgcacaggcgtattgaagaccaccgccgctcgtgacaccactggcatcgattccggccacctccggcgacgagaccaccttcaacaggatcgcaaggaagtcctcagcatttcttcttgtggttgtgtcggccgaagaatcgccgttcgccaacggcatcgtcgtgaaggaacgccggccggcgaactctgcggctgctgctgtgttctccctgtgcctatgataggtgggctccgctccattagcacgtatagaatttgattagagtaagtttaaaacatgtaaggttctttctgtaaatattgttatcatatcatatatttataaatatgactgacatgtgagtccccactgacacgtaggcgctaccgtggcatgccacgtcagcggatggagtgggtcggtacccgtttggacctatatgacacctaagacaagtttagagacataaaaatacattttaagaatttagatacctagatgatacattcgcacaagcttagagaccactgaagcacttcactctaagtatagctaaaggaaaaacaagaccgacttccagaccgtccatgcatgctggcacatgcatgcgtacacgcggaactaactgtgactagattgttcactactcggcgacacgttcacgttaattaattactcccaactaccacggagaaaaggtcatccgtaccggatggaaacccacaaagagtgccggtttttccaaacgacaccatgaagaagacacatattagaacacttaaaggtggcggttttagaactggcatctttaagttatacaatttgcaaagacaaatttacccgagccgatgcatcaaagcaacccaaaaaatcatccaaaaatctaaaaaagactacacatcagcatcacacaatcaataattgatggatcacacaatcaacaactacacatgggagctcgccggaactgtcggatctggcggatgggagcctgtcgccgctgccgctgcctcccctcccaccggatctggcggaggggagggcgccgcccgccgttgccgcctctcctcccgccgccacccgtggggcgccgccgctgccgttgcctcccctcctgccagatctagcggaggggagggcgccacccgccgctgctaccaccgcctccctcccaccgctgcacgctgttgcatgctaccaccgcgtgctagcgaccgagacactgcggtagagaaggagagagagccggcacagaggggagagggtgtgagaaagagagagcggtgggtgagaggacgagaggggagcaagtggataaggacgctcccttacctcccactcggcgttttattcctcgcctccccgtgcgataaaagaaaaaaagaggctgtctctcaattcggcttggctcgtttgatagggtgtcgtttttaattaaccgacacctataatatattaaagatactagtatctttataaaaagaatcggcacctatagtataggtggcggttcttctatagaaccgacaactatagcgtattaaaggtgccgttttattttttttcatcttttgaaggggaaaagcactatatgtttcggttttagctgatctgacacctatagtgccgacttgtatatgtcttttttaacagtgtcccaccatcccaatcatccctaacaaagaacatcaagaccaagaacaccaacacataatttattctaaaattaatcctcatcgataaggtgttttgtcgcttcgagtccaataagaattatctcatacttaaatgttgcatgggttgaactaataaaaattaatcttgattagtcgtatgcagggtatttcataatgcatatgtactctttgcacgaataaacaaaataaacattttgttagatgacgattatttttggagaaaacctcaagactcttaggcgataattacattgggatacagggaggagctactattgcacgttatgtcactattacccggacaaccttcgtatacagccagctgctagatataatctccgattgacctccatgttcaactctaccgacaccgtcgtcgtcatcgtggtggtggcagggtttcccttaccgccggtaaccgcgcgggcttatcgcgggggtacggtaatataaataccgcggtaacctccttaaattcaaataaatttaaaaaataatttgaatttttgataaattttacacggttttgtatggtttttcacggttaccgtggttaccgcgcggtaaccgtgcttactattggggcgcggtaaccccggcaccggcggtttaggaaaccctaccgtggtggtggtgatgttcaccaacaagctggctcccatgcaaaaaagaaaagctggaaagtttttctttttaaaaacacagtaaaaaaaacagatatttataatacgtaccctgcacacttacacctgtaaatgcacgtacgcatatattatcgagcaacttttaaaaaactgggccggtcaaaaaaaaaagtttaattctacatgaagggtctggtcctccatcatccccttgatctgatcgacctagctgggcttggtaatcggccagtactaaaaggaaaaaagtacaccgaacgtccttcaacttgtcatcgagttacaaaatcgtcccctaaccataaaactagatattcagcgtcccttaactaatcaaaactaaataggtccttcggtagttttgaccctggttttatcttacgtggcagttgagttagtgtgggacccacgtgggccctacatgtcaggatgccacgtcatctctctcccttcctcctctctctctcttctcttctcgtctcttctcctctctgggcaaagggtgcgggctgcagcgactagcggcgccgtggaggtgggcgtcggcggcggcgcagaggagatgggcaccggcaccggcaaagatgtcacacccaaatctggcactgccgtacaacggcacctgataggagcgtgtcgtaggaaaaacggcgcaaaccgtttcctacgaaaccgcgatcatagtaccagtcccaggacatagcgctggtacccacggtgacaaatatgaatcattgtaatccttaaattaaatagaggacttatttaccttaacttaggttgcagctcaggatagcccgagaatacaatcgacgacgcggacgaggaaacaccaacagcagcagcagcagcagtagcggaaccaacggtctaacacccaacaccacaggcgacggctgggaaccaggacaaaaccctaatcttcgcttaacttcatcttctcttcaagacggaggaactatatatatatatttatatagagcaagggtgagtattttcgtactcagcaagccatgggaattaagtgtttaatgcaggcttcaaaggaaaggctgttgtttttgcaattgattttatttaaactcctttttgaaacaactaagtgagtgcttctcaaacgacacggatgagacagtgcgtctcgtccggtcggagtatgtgtaatgtatcagtctttgattgaatcaggattggcacccggccacaactttaaaacggccacccgggcctagctgatcccgtcagccacagatgttccaaacatcgaacccaagtccacaacagcaatttcacaaatcagtagtcaaacaaaactacgctaaggaatcaccttacatccgcccatgaccatgggcacgactgttcgaacagtttaataacctctgcagagggggcacactttacccacacgacattactaacccggatcactcagcccgtgcagaacagccacgtctggtgaccttgaggctttcatgacaaggcatttcgagagccgacacaggtttaccatatgccgacgagaggggtcccagaccaacaacaggttaggtcccagaccatactgtgtcaggaagcccaggggtccttcccgacaccaccctggcgaatccacttgtcccccggcatcaaggctcccctgattagctaattactcagtcaggggtgtcccattccacccatgtggtcgtacttgatatatgtccggatgaaattccaaaggaatcggtccttaagtgcaagaataggagaccgtgctcccggcacgtcccctggtctgcgattttggaaattcatttagttcgcaagcaccgacctaggcgtcgggtttttccgagtcttttgcaaaacccaagttttacccatcgttagatattttaaatttgaggggaggactccgacgtgcgtacccgaaggcccgtacatcgaagtacaacagttgacaaaggaggtttaagtgttcaataatttaaggagggtaattgcagcaattaggattggggccggtaggctatctcgcaagccgcggccaatttacttgtgttaatcctatccatgcattatttgtggaaaagaaatacttagatttaaattataggtgcaagatggtcaaaagtgacttgccttgctcaaggtcttcacggagcttcacaaatctttgagaaaacccgcaatcgacgaaaatccggtaaccgcaactatacgcaaacaatcgaaaacctacacaagacccaaaagaaagatcctatttagcctaattattagtgccattaaatagatctcaactttagagaattactggaagtggaacggagtcaatcggagttacagatcaggagatatgaattttggaagcttaacttgattttctggacgaggaaaagatttatcggaattttccggaatacgagaaatggtctatggaatttatagaaataatattctcaagaatattattgaatttcactgacaagcaggaccaaggaaaaatgattcatagaattttggaataaggaattgatttgtggaacaagggaaaaaggatctattaaatcctttttggaaaggaaatcaaggagggatgtatattagacttgtttcgggtggcattggtgcggcccaaagggttgaaggaggctcggccgagccatttggccggtgtgggcacaaggaggcggcccaagaggcgtgcggagagagagagaggggttgggggggaggagtagggcagctgactgggtgccggcttgacccggtcaagcggggccgacggctgaggtggctgccacgcaagcgcgagagagggaggccgagctcgcccggatcggatggctcacggcggccgagaggcgccggcgaacggcggcgaaccggagtgggcggcgggcaccggaggcaggaggaggagaaggggaactcattccacggctcggatcgggaagacgtcgcgcaacgacggccggcggcggcggccaatctcgccagcacgccgacgtggccgcgcgcgagaagagcgaagggcgcgcgggctcgggcttagccgaaccggtatggtgttgcgacgcgcacgcggtgaagcgggacccgatggtcgccgcgtttgaactcggcggcggcgctatgcggcggcggaaggggcggcatggcgcgggagcgggttgggaggccggcgactggggcggcagcctgggaaggttcaaggggacacggggagggtcgcggcgcaaggaatcggcgagagaagggccgacggcggtggattgcggcggcagccatcgccggcggagaaaaggggaaaactcgccggggcaacgggagtccaattcaccggggaaggagcttctacacggctccgggaactcgtttcaagcaacgggcggcgacgagctagcctaggggatcatggcgacggcgagtgatgcccgggacatggcgagggcgcgcggcgagctgtggcgaacggcggcggcatggcgcggcgtgcgacagggggaagtggttcggtggggagctcaccgacgagagaaacagcgtcggcggcgcggatggagtcgcggcgaggtggacgcgacggcggggcggcgcggcaccgagggtgcgcggccggggaaggagggagggagaggtggcgatggggcagcccggagctccccgtcacgcgtccacgcacgcaccggctcctccggtgctcggcggcggacggcgacggcgagagcggggcgagcagcaacaatggcgcggcggtgatggaagtgaaacgagaggaggattcgatgggaggggcttgggtttttatagcggaggcgaggtcggtttggggaggtggaaaccgacttggcagtcgagcgctcggctggcggtcacgggcgacgcaagagcggcggacgacgaggatgcaaagagcggcgaaggcggtggatcggacggcgtgacttgaatcaagggagcgcgaggggcaatgcggcgagctagtgcgtggtcaaggtggggcgtcgagctgctgcggcagcgtcagcggcgctctgaccgcggcgcaagcgacagaggtagggcgccggtctgggagggaaaaaggaaaaaaggagagggggaaggggacttggtcccttgccgctttgggtgagggaggaagcagaggcgcaagctctggctcccgtctttttggtggttagcagtgtggagcggcttgggatgatggcggtggtggcggcaaaagcgggcggggccgggcggcacgcggtcacgggcggcgtcagggctgacgcggcggcgaccgagcggctggccacgagcgagcgcgcgcacgtgggaaaccgatgggcggcggcgaaaatcaaatggcggcggcgggaaggttcaaaccccggcggcgggaatcggcaaggcggcggtggtcgactggcgagagagagaggaagagagacgacgctctctcgggcggcacacatgcacagcacgtgcgaggaggaaggaggagataggcagaggggagatgggccgaggggaacatgatcggcccacaaaacttgaggaaggcgatttagactttcacagaggaggctgatttggagagaattggagtttggatttggattcaaatttgatatccgaactcgagggttcagggaggaatcaaggaatggattcgaggtggactcggatatttgtggaattaggacaagtatttggtggggattcaaaggatgcgattgaatttcggagtttgatttcggagacttgagtcggaattggaatcttgaggtgggcgattttgatggcgatgagagggaacaaagatggagattgaattgagatccatggcacgacttagactctcactcaaagaacgaaatttttgaaattaggattttgccgaaatagtttttaacgcctcacgaaaagcggagcgttacaaaagaggagatggtcgtcgttgtcggtgaggtgggggaggcggaggaggggaaggggaaggatggttgcggcggcatggtgcgaggcgacgacgaaggaggctgggccccattggccagctcagagcgatgcatcggaggggccaccgacgcagaagagggaagccctgccccggccatggcagcggcggcggcgcaaccgccgcaaaggaggctaccggcgcaccgcctctaccgatcgcacccgcacttccgtcatcgacagcctttgcaagaactccacaactcctgcaacacacgatctagatggccgcgacgaggtgctcggcgtggtggccgagatccaagagtggcacgacgcgcctccgcctccagatgctcgacgtcgaccgccgtccgccgcttccgtcgcctctgcatccgcggctccacccccaccaccgtgtgcatcctcgctcacctcgtcgccgcctgggcccacgccggtgagctcgaggaccacttccatgtcagcgtcggcgtccagcggccgcggcgatgacggcgacgagtgtccgttggccaccatatgctgaacgggatgctaaatctaatgggccgatcgaaatattaggaccttatacgccatcagaagaaaatgggttaggttgggttgggttgggtttggatggacctcttgaaaaagggttagaatggactaggtagagagacttgttgctgcggctagcgtgcggtactgtgttctcctgcatcaaagatggtttcttcctcaccatgaggaacatgctcggccacggcagtaactggtgcaaacaggcagacccaccaattcacttatagtacaaataaacaggtaacacgtcaggttaccagcttaattgtagtacaagtgggttaacgggcctgtccgtttgcacccttagcggtaagcgatgccttcacccacctcctcattggagcttgtttgtcactgctaggcatcaggttcgcgctttctcaatcttggtcaacaacatgcgaactcgtgcagatatcacaaacacacgtcacgaaacggtctacttctgccaatcccttcgaaacgtgtatattcctataaaaccggtgataaaatggtatatttctaaacctttttttcgtttgtgaaatgaagcagttaccatacattttgcctctcgcagtaaaagctgcctgaactgtcagttcagtgtttgatcatttcatataggagaaggattcatacgcaggggcagagctatagtagaggggtgcccaggaacctgatcaagaaaacattttagctacacaccacctgtttccaccatgtgtgtatcccctaatacaaacttagacactggcatcagcttaaactcgacctaaagtaaagtaaattaaacaagtggcacccttcttcatttcgttctatatccgctcctgtttatacggagtcggagtcacagaccaacgaagatcttgtcttgattctatcctggagctctatcgtattgtcatgataaaaaaaaaaaagcttcaattccggttgtgagtgtgagggagtgaattgtgtgcatgtgaaatcgccgaataaatcaattgcctgaatttcctttttcacggaatacagtacaatgtatccttgaaaatgaacttcggtgtcaagagaaatgtaaaacgaagtgacgtaacattaaattggatttcggcattgcaaaattcgatttcagcagatgataagaaggaaatatatatagttcttctgcagggagtgatagctgaagcctgacctatatctctttgactaccattgattaagttgcgaacgttccaattctttttccattttattcgacggttccacttgcaatcttcttattttgtcgcttgctctatccacgggctcttatttattcggcgcgaggggcccccttcacaccggtgcttgggagcggcaagaacagcgccgcccctccccactggcttctttcatggtggatccggtggcggcaacttttctcgcggcagatccttcaacggcggcttctcccgcggcggatcctttcaatgatgataatgttgttgttctcctttcatttttgtttttagatgttgttgttgttgttgtatcgattttatgacttgtgatctgtaatggcgatgatgctgattgttggaagttcgttggattgatttcgaagggcaaggcttagggatgacgcagggtggatgcgctcagtgaaccgatgcaacgagcctccttttttttcatcctaggaatcttataaaggtacctgtttctaaaccgacaccgtttactaggtgccggtttgaaaatctgacatccatatatcgccgattaccaatcggcacataagtccatttcttatttagcacgtaagtcgtgcataatgacgctcgatatataatacgaccattatttcgcaatttatttgctcttatttcataagtattatcacgaccgttcgatggacgatcagtggttggcgacgatctcctgagccttggtctcgtactcaaacttgtagctgctgaccatggagctatccgctgaccagatgaacaaccccggcagcttcccctgccgctgcaactccttcgcgccggcgatcccctgctccggcgagagcagcccggtgacgttcccggtcttgaagctggcgagcagcttgctgccggggtagttcgccgcctgctcgtcgtagaacatcacgtacgtcgccacgtcggtgttggcgccgtagccgtagaactggaagttgacgtagtcgatcacgccggcgtagcgccgccacagcggctggtagtagcgctgcaccacggggtgctcgaacggcgcgatggaggtggcgatgttcgggtgccgcgccttgagctcggtgaggaggcgaccgatgcactccacgaacgtgtccacgccggcggcgaagtgctcgtagtcgacgtcgacgccgtcgaggccgtaggcgtcgatgaggccggagacggagtcggcggcgttgcgcacccacgcgtcgacggacgacgtcggcgcgaacgtggcgttgacgccggtgttctggacggtgtcgccgccgagggcgaggatgacgctgaggttggggtgcgccgccttggccgcggcgacggcggccggggacaggttggccgtgtcccagtacggggcgaacacgccgttggctggcgccggcttggaggactgcgtcgccatgaagtagtcgatggcgaaggcgaggatgaagtggaagctgaggcccgggttgacgggcacgtcggagaagcgcacgccggtgaactgcgcgccgatgtactcccggaacaagtagccgttcaccatggccgccgatctagctagcgagtagggctagcgatcgagctgtggacgcggcgcatggcggctatgttttggtggctgccgaaatttatagcggcgactcggccacttgactccgatcaagttgggcggctcgcccggatgcatggaagcttggtgaaagaaggaaagaatttttaggttgtgtttggcgaagagcactgctatacatactaaaattttcttacaaaagtcttactaacaaatttctcaaccgtttgatttaactagatgaaagtgaggtgggattggaaaagcgaaatggatgaatggctagtattaaataaggtacaggtgtatttacaccttaagctattagatacttctattggtatccatgcttctacaaagaaagatataatattatttagagcactgctacacgtattaattctttcttattaaatttttactaacaattatctcaactgtttgatttaggtagataaaagttataaaaaaaattagatccacctatagcatgacactgatacatcaatgtaagtaaaaaattagtaaaaatataagtactccatccgttttttaatataagtaaaatatcagtgtcatgctataagtggatctaagtaaaaatacctcggtggatggtagaatttctgataaatactccctccgtttttaaatgtttgacaccgttgactttttagcacatattttaccgttcgtcttattaaaaaaatttgtgaaatatctaaaactatatatatatatatatatatatatatatatatatatatatatatatgaaagtatatttaacaattagtcaaatgataggaaaaaaaattaataattacttaatttttttaataagacgaatagttaaatatatttaaaaaagttaatagcgttaaatatttagaaacggatgtagtatatacgttagaatcttctgatctgtcaagcagacgtaattgtttgactatgaaagcatagtgtccaaatgcctccagaatggaccggcaagtctcagctatactcgcttcgtcccaaaaggataaacctgggtttccgtgtcaaacgtttaactgtccgttttatatgaatttttttataattagtatttttattgttgtgagatgataaaacatgattactccttccattacataatataaggcacaaccactttttctagatgttccatatataaggcatgcatgcatgtaggcaattaactattaccccttctccattaaattattacttttttaaatcctatatactcatgttctctaattctattggatgcatgcattgtatttattaggataatccaaactacaagatgatactccctccagtttcatattaattgatattttggacaagggtgaggtcaaacttttataactttaaccatcaataactttaaaaatatttagtttaaaggaactagaacaacatatatagatttatcttttaaagcactataataaaagtaaacatgcatttatttattatatatattataatagaaaaaataaggtcaaagatatatcttgtggaccgtgtcattgtccaaaacgtcaattaaaatgaaaccggaggaagtaataattattttcttgttatttgggttaggggtggttatgccttatattttgaaatggagaaagtaatactttatgcgtgacttgtctttttaatttttttcataatttttttcaaataaaacggacggtcaaacgttggatacggaaactcagggtttgtcctttttttagacggagggagtactcccttggtgggtgcacacactgacctgtccgtgaatacttttgatctattgtagtacgactaaatgaattatttttctttttcaaacataaattccatttttatgtttaaaagtgaaatttcattaaaagtactcgttcattgaaagcgtccatatatatatccctactgcttccccaagtcctaattaacgtggacgttggatggctttggaataattacactaggtccgaaccacttgatcactagcataagaaggattgaaaacggaacagaaaacttctccaccggtgtctcctcttttcacgattggttgtgctctagccacctcaaggtccgaaaggaacagcatcgaggcttcgacatgatggtgacccttaggacttggtccatttggaaggagaggtacaacccgatcttcaatcaatgcaatcaaactcggcccgaagtggtcacggcaatggcataggaagccgccctttggaagcttgcttggtctttgtcgccggcgctgctagcctggacctttaggtggcctgctcgatcgatgtcgtgagattaggcttaagcttcccctgttttttttcttgttttctcctctttttttttcttccttccctttttccttttattccctctcctttctcttgttatctatctcgtctctataagttttattcctcttaatataaatgtgtgtaatcagtattcctcaataagggatggaaaatcctaactgtatcggttgtcattttcattttatactgactgtttcaactagtaatggaaattcttggtaattgctaggtatgaacatggtagtcttttcgaaaacggtagctaaaacaggaatgatgtgttttcggatgctttgttgaaatctgtgttttcccagcaattttcggtaatctacagtcctttgtccagcccaataacctattggctaaggaagcctttgaggccataagtgactaaacctatacataacgctccacgctccacgctcgtgaactggtccgtcgcgtcctccatgttgcctcttgctcacgcaccgtatcatcggttgtctaatttgctctacaatggttctggtcttacttgataaggcactttcatccagaaccagcaaaattccatcataagtcatgttctatgacgaccttgtgatgtgatggaaggctgccattgtagaagtttcattaaggattacctactatgattaaaaaggacatccttaccaaaatggatgtcatttttttgtcgtcgtcataacttaatgatgttccaaatcgtcattgattcagtgaaaatcgtcacaaaccggctgccccagtactgccatgtggacaacctgatgacatggatccgacgtgggatgaattatggtttgacacgcggctaacctagcgaaccgttcttgttctattattgtttgacacatgactagctgagttattgacaatgcacgttttcttctgcattactcaaacgcaaaagaaaaaaacaattttacatggaactattatatggaccattaattttattatcagtgcttattgacatactaaacttttttagtgcattaggtagttgactttttccttgtgaacttcaactaacaatattttataattatttatcattatagaaagtgaaaagaacaccactagatttatcatcaaaagtactttaaaatatgtctaatatactacctccataaatgtatgacgccgttgactttttatctaatgccgttgactccataaatgtgatttgattcatcatcaaatgttctttaagcatgatataaatattttcatgtttgcacaaaaaatttgaataaaatgaatggtcaaacgttgatagaaaagttaacggcgtcatatattaaaatacggagggagtatatgtttgtctatgcacactaatatttatagagaatacgaatataaccaaacgaattaaaaaatcaactacataatatgttaaaaaaaattaggtaggctgagctgactatgagtagaaaaggaaaatggcacggctacccagccagagcccaaatttagcccatctcagcccaactcaccgttggtctgggcttaagcctggtcatgcttcaatatttttgggcctaggcattcgtgtgatatatttttccgctccccagataactacctcggtccaataccgaaaggccgaacgttgagctattcacaatacaaaggtcccgtttgataagtatccaaactccaactctcaacactaaactctaatttcattgagagctgactcctataggagctggaagtgggtatgaaagagttcggctagatttatcatctccacatcaccacgtcctgcgtcgccatttcgtcgaaattctagttggcgtcccgcgatcctaccaacacggtcgtcgtgcgctgctgcttagcccgcgcgcttccctatcgacactggcatccccacgcacagcgttgccaatgtcgctaacactcaagccgcgagtcgccacccgctgcaccgctgccctcgcgcgccgaccagccgcaccacccaaccgatgtcgccacgcactgccctatagatgttgaggccgacacccccgcgcgccaccttgctgatgccgccaatgctcggcccgcgcaccaccgctcgtcaccctgctgcccttgcgggccacatagcagccgcgccacgtaacggctgccaccaccggagagacataacaggaggagaggggtgtgaaagggtagtttagtggcatattgcataaatacatgaaaaaaataaagggtagtgaggggtgtgaaagggtagtttagtggcatattgcataaatacatgaaaaaaataaagggtagtgggtcttttgggatggagtggagcggtggactggcaaaaacctagctccacaatttagtgaagcaactctgcttattccgctaaaaaaaacgataaaaaaaaagaatctatactgtttggcataactccatgtcagtgttatggataaggcatacccaagttttgggttaagctcggtggggcctactatataccaggtcctatacgaaatcatgcctcgtatacgaaaggtgttctagataaggaagaagaagcagagttcaagttgaaaactacaaggactaagcggattgtatccatacttatcttcctagttatatttgggaaaggggatatctgtgggtataaatacaagaccccttagggagagacaaggacacgcacaatcataatagacacaatacatgccgccagacatcgacatcggagatgagaatcctagacataccccatttggtgccacagaggccgacaagaggaatctagcgttatctcttatctcaccgagttcatattcgagggagaatagtaccctgtcgtcgactacgtgtggtgttccatgccgctaagtcgataacgactagataggttatcccaaatattagacttgtgtgaatctgatgaataagagcaacaccggcttcggtcaacaggagtagggctattaccttacagataagaggcccggacctatataaaaatctatgtctcccgtctttttacctcaatctcgcgtatatcctggtacgaacgatctcccatactcgcaaataccgtagtcacgatctactccgtcgacactccagttctaggtaagttaaagttgggagctagagcagtgtcaaacgttctcgtatggctccactctttaattcgttctatatatccgcacatatacaggcacgtggatatagattagccccaatcgttttctctattcagcatcagctaataccaaaatttgaattttaaaacttaactttgaagttaactttgaagttaattttgaaggtttttcatcgaagtttatttttcagcattagcgcttaagtcgctaaaaatataaagttttatctataaattattattattttgccaatacgccgtatgacatattatccatgtttggccaagatggacttgtacataactacgtaccgaatcagtatcctctactttcaaagtcacattttatcactgacatatgagctgacaaatcctttatctacatatcaatgataaataaacggtaaggtcttaggtggtgtttacatccagggacttaactttagtccctgtctttagacactaatttagagtattaaatatagactacttacaaaactaattacataaataaaagctaattcacgagacaaattttttaagcctaattaatctataattagagaatgtttactgtagcatcacataggctaatcatggattaattaggctcattagattcgtctcgcaaattagtccaagattatggatgggttttattaatagtctacgtttaatatttataattaattttcaaacatccgatgtgatagggacttaaaagttttattcccatctaaacagggccttaaccatctacacatctgcatctcagcatctgcatgcgtctgaattactgtaattcattcaggcatcgccggcctgggacgacgatcgactcacgcacaactcacgagtcagaatgccagacacgaggcagatcatcgcagctggtccctagacacgtactccctctgtatgacgccgttgacttttcgatcaacgtttgaccattcgttttatttaaattttttgtgcaaacatgaaaatatttatgttattcttaaataacatttgatgatgaatcaaatcacaataaaataaatgataattatataaattttttgaataagacgaatggtcaaacgttagataaaaagttaacggcgccatacattaaaatagaggtagtacgtacgtacactcatatgcgggtacagatacgatcgagatcgatcgaattgatgccgtcgtacgtcgtcgccatcgccgtggtcgtcgtcgtcgtcgtcgctgtactcgtcgtggcggtggcgcatgaaaagacagcacgcgcaggggcgccgccctgagccggcacatgtgcgttcccggccggccctggtcgacggcacatgcacggccggcgccgcgcggccgcgccttcaattcgatcgactgatgccgatagccagcttaattaattaagctgatccccctttcctctcctcctcgaaatgggaatatatatggtgcaaatcacatatatacagtgcaaagttaaaaactatcgtatgataaaaataatgaacacttaagatttgttcacatcacctcgagtaaaatttttactcacagtaaaacttctactctgataaaatataggagtaaaatttttactcgagggtaatgtggacgtatctgatgtgtctatttttcgatcctacgtacttaggggtgatgtggatgtatctcaaacgtccattttttatatttatattagatatatggtttgcattgcatagaggcaatgcaatacatattttttcggatggtcatcaatgcctgcatcgctcatgttgacctagcccgccgagcgggccaccggcgactataaggagaaaattacgggcctattgagagatgagcgatgagattgggatagggatcaggatatgaaagtaaatagtgtttttttacagtcaatgaatagtgctacaatgagataaaatatgaaagatgttgagatatcatttcccaatcacaattgctaaacggatactttaatttagatggggtttgaaattcggttcgagatttccagaatttctgactacctattctcgccccccccccccaacccccttccctcgggccacgaaattattttgccctgaaagtttttttttcttttgacgaagactgcaccttcgcatcattgactccttagttgtagcttgatgtggtgaaaaatccttatcatccacatcatccatggatgccatgccttactacaattttagcttttagcttttgaatttttctgataaagagtatctttttagctgtaaggttcattagacttcttaaatatcattttttttccttctcgacttagccatctaactattagtgctcgattttccttctcattttctctctgcattaataagtggtataatattcttttagccttcttctttatatacctctgattttctaaaaatacattacttttaagacggagggaatactattagtcaaaacggtcaacaacaccttagccatcacaattggagtggtgtttggattcagagactaaattttagtcgctgtcacaacggatgtttggacactaattagaagtattaaacgtagactaatgacaaaatccatttcataaccctggactaattcgcgagacgaatctcttgagcctatttaatccatgattagcctacgtgattctatagtaaatatgtgctaattatggattaattaggcttaaaaatttatctcgcgaattagttctcatttaagaaattagttttattattagtctacgtttaatatttctaataagtgtccaaacattcgatgtgacatgtactaaaatttaatctcacctagatccaaacaccacattagactactccctccatttcatattataggtcgttttgattttttctaaacaaatcttttaaaattaatcaaatttatagaaaaatatataacatttttaatacaaaacaaatatattattcaatgttagatttaatgcaactaaagtgttcttactaaattcttctattaatttagtgaaacttataaaagtttgataaaaaattccgaaaggacttatgttataaaacgaatgaagtagctaataaggacacaatgaactgttagcggtgacacttgaatttgatgtttcctaccaggaacagtgcctatcctgtggacgtccgtaatgttgctatccagcaaacgtatatgtttgcaattttttttcccagagtattgctgttgtccgaggtttctagtagtattttgcttttccttttcttaatgacaatgacaaagacattaaagatatattagagaggttcctatattattcactgcgcaagcaattggttatgagatgttgattaatacgagatgatattaagggcagtcccaaaccaataacttagctagtttccgtactattattaaatatattgctagataagaaaaaactgatatagtaagagagttaataaagaagagagagaaaagataaataaatcatttctcatgtaacaaaccagctgcacaagaacaaagaattaaaacgataggatagatggatgaaaggaaagataagagtgctgattggatggaaatttattttaagaaatcaccaattgggtatataatttctatacgtaatgtctattttacatatataataagtacggaaactatagttgatactttttctaaagattgcccttacacacccacaaactggccagccaaaatctccagtcctagctagactaaaactcttgctagcttagccttttttttttgcaaacttacttgttttcgcgtgcacactttctgaactgttaaatagtgtgttttttaaaagaaagtttactttaaaaatcatatcaatttatttttaagtttcaaataattaatacttaattaataatatgcactaatggcttaccccgtttggcgtatgttctcaatcttctcaaatcctctcctctcaaacactttgaaaattatgccctctttaaaggtgcttctaatagctctggcttcttcgagaatctctggttttgtgaaaatctatgtttttcatattctcgctagatagatcctcaatagctatttctcagtatctcgggctccttacatagaattgtaatctaaggccatgtttatatctctcacgatccaagattctttgaagctcgacatttatagcaccacaaatttatatatctcgatatgcgattagattgataatatttttgggtgaaacattttattcctattttagataaaacatataattttaaataactataatgttatattaaaaatcaaatttagcatggatctagctaggatctgaaagtgtgccaatcaaggtttaaatttatagactttcagctccaaaccatagctagcctagggttgaccaggggtacgtccagggcctgagtccaccctgggtaagtggcacaggcagctaattaatggacagcattttcacagtaagcatatcaaatggtgctaactcatgaactatttttgttagtacacgtactccctctgtccctaaatatttgacaccgatgactttttaaaacatgtttgaccgttcgtcttattaaaaacttttgtgaaatatgtaaaactatatgtatacataaaaggatatttaacaatgaatcaaatgataagaaaagaattaataattacttaaattgtttgaataagacgaacagttaaacatgtttaaaaaattcaacggcgttaaatatttaggaacggagggagtgcatttcaacatctcctcgtccacaactccagaatgtgcttcgccgccgcgcgcctggaccatacgtgcaataagctaagcaaatgggcactcattagcagcaagaaccccacacactacgtacgagtagtcgagtaacagtgtccagtacagatcaggacgatcagatcatgtaccctaactgatgaagaacagtgtaacagatcaacgaataataaatggagagaaattccaatcaagatcgagatggcattcgtccgtactgttagctgctgtttgctatagatatatcatgacagcgcgcgcatccggttcgtaggtccggccggcatgcaaaagagagatcatgatcgatatcgatcgatcgatgattagtgtgcaaatggagtggaatgtacgttggcagtagttagacgacagcatatggcttgatatgatggcaaatttgtaggtgggtgctattggcaacttttttttttcaagaagacaatcacggtcaagacagcaaaatgccttatggtgatatggagtcaccaaccaccccgatctagccaaaggccaaatcaagatgtgttttgtagaaaaaaaggctaaaccggctagcgaagctgatttagatatcaaaatcagcctctaagccgatttagatcgatgtgaggataactacccatctcgtgggtaaacggaagatttacgagacaaacctacaaaaagataatcgcactctcacagcgatggtggatgacttacggcacaaatcgacaaagatggactaaaatagggtacgacagaaaacatggctgaaaagtaaagggaaaaagaacgattcgattgcagagattcagatattgggaattgggaagattaatcaaaccggccttggcccttatatagaggttggtcttgcctcctacagagattcagatattgggaattgggaagattaatcaaaccggccttggcccttatataggggttggtcttgcctcctacaagtcctccacgtccaactcggaatataaaccaatggaaacctggaacattccttcccaagcaaagaaacccaagacccgacgaaattcgcttcggactcagactctgatggtcagaccggccacatgcctgccataagaccagccctactagccggtcagactggccacataccggtggtctgaccggccctgtgaaggaaacccgacactttacaaacttttgcaattttcctctatttcatccatacgtgccaaatttaagtgtaaacacacatgctcccttgtctttttggtaaactttgtgaacctaaaagcatagaacacgtggtcttagaacgataatctaattaccagccatatcacttctcaagcatcttttggaccaattgaaagttgtgcaattccgacctcatccatggcacgaaattctataggcaatgcaaacactatgttgatatccatgctctcccttggcggcaaatcatagtattgattatgattcagaagcacaaatataagagagaatttgtatagtatgtcagattcttgcaagatgccgctgccgcttttccaccgcaacatctctttgctgccactcgcggcaaacttttccgtaataaaaagtggggtgcaacctcgctgcacgcactgcagcttagctcacccccacagtccacgaccacactgcctcactgcagcagcagcagctacgatgccattgccgagctcgtggctgttccacaagctgcggcggaggagaagcgcggcgagaggagaacccgacgtcgtaataaccggtgaatcacttgtatccaagttgtcctcatcttcatcttgagtaatcaccggcttctcaacttcaattggtttaggcctccactcttgtcttggcggcggccgcaactcgttgaaccttctatctctcaattcttcggctttcttctctttcaacttttgagcacaaagacattgcaaccttctctttcgagtagcggtcaagtttgcaggcattcacctttactttggctctgttacaggagcaatataatgtcccttgttaatgtatttgatcaaaatggaagctcttgtggtaccgttgaatttcttgatcgcctttggtccaccccccccccccccccccgttggaccggtcagaccggctacaagctgtcggtccaacggttggtatttcttaacgacattactggaaatataaattcccagcaatggcgcagaaatagtcctggtatatttatagttacaaaaataattcgcaagcgcatggatgtaccattatagcatttcacccgaaagtattccaaggtattgtatttatttaatcccaagggaatatttataagagagaactatactaataatttatatattacttatatacatcaaagtctaagcagtggttaattcatttatactgggtagagtgacacaaagtaagaagaacccagattatctcactaaataaatctaggctgtgtggaagaagaataagaaaagaaatcattcctatacttctaatatacacttatctttagtttacacttgctagtatacagtcatgtaaccaatacccctaacagtgcccttctgatgtttcgagagaccattcctgattgtcgagttccttactacagcccatcatggccatccaactgagatcaaatacggaggagtacccaccctaggaaagtgtcaaaggaatatatactaacgtggagaaatactcatacggaactgtcaccatcagcggcccacctctactgtcccgcagcatatatgccgaaataatgatacttaataatctaagcattacgcttacattattaaaatactattccctccgtttccggttataagacattttgactttggtcaaaatcaaagtttaactaagtttatagacaaatatagtaatatttataatagtaaatttatttcatcaaatcaataattgaatatattttcataataaatttgtcttgggttgaaaatattgctactttttttctacaaacttagtcaaacttaaagcagtttaaatttgaccaaagtcaaaacgtcttataacctgaaacggagggagtactctatatcctgtagaatgacatagagtaatcattcgcacgaacattattaaacccacaccattgcacctctctagtaagctagtcacacaactatatcgggacaaatataaaataaagccggtactttgataaagtaaagtaccgaaggtatataaagaagaatattatattaatttgatcagtcttacaaaagaagggagaaaagctgctagagccatacccgaaatttcctgaagactcgaggactaagaaaactattatattctactccactggcaccagagtactaaactaaacttaaaagagagattaagagcagcttcttacttgagtgtgtgttgaagtggagggagtgaatcctatttatagcttgagtatgatggttttgatagttggaatatgtaaaagaatatcttagattttcacaggcgatcagcttaacctagtcgcttacaaagatcaattttcacaagcggtgaaagttcgcctatgaagattgttgattttcacttgcctttgatcgcaggtggggtgttgggctttttgtgaaaactctttttgtttgccacttatttgtggttttgtagtagtgtgtactgcttaaagcacttattttaatcaatttatttttgaaaatattttaatttatcattaagacaatacgaggaaatagtaggtttagtgatctatttctctctgagatattcttttacgtattctagaaagagataatcatgatccatgaaaagtagtagcatgttctttcagcattccaaaatggttggccactactgtacatgatgaaatttcaaggataacgaaatactagtagccagcgcgtccgcaagtggttgtgttctcgttacatcattttctgcgcattcaagatatactccatatatatctgacggtgggcatttattttccctctagtcctcctaattagtttaggagataatagaaagtataatatttttccttttatatattaatttataatatttcttaacatatacacatatgataccttacaataatttgtgacaataggaaagtatatgtggccgtttagtattaattaatttgtttctaccggccatacatatattcatattatcatgtactatctccatcccaaaatataaaaagttatatagttaaacacgattattaagaaaataaatcgaattatatggtaaaaaaaatgtgatgggttgagaactggaggtagctaggtaagaaaattgaatggtggaagactagagtctgaagagttatgattggttgagaggggaatattagtcgagatattattatgttttgagataaattaaatgctaaagttgttatattctggcaccgaagaggtggtacagtatcatgcgtgcatgcatgggctcatctgaagaacctatagctaatgacagatgaatacaagccggtacacacatcaaacatgtacagttattcttttttttttttgccgggaaaacatgtacagttattcgtaggtacgctctacatggatccatattatttgcatggagatggcatccatttacttctccttgtcaacttgtggccagatcgatcagaacagtgacacacacctgctatagatagcgtgcagcgatttggccctgcatgtgtgttcgcgtgtgtgttcaggcctcgatcggagcagatctgtgcgccactgtttcaatcagttgctgaagacttcaagttactgcctacccctgcgtgatgagaaaagaaattgttgcgtgtgcaaccaacacgtacgccttctgtacacgtacatatagggtacagacacagacacgtacgtacaatttatagagtactcccttcatatttcaaatgtacgacgccgttgacttttcgaccaacgtttgaccattcgtttcattcaaaatttttgtgtaaatatgaaaatatttatgtcatgctcaaagaatatttgatgacgaaacaagtcataataaaataaatgataattacataaattttttgaataagatgaatggtcaaacgttggataaaaagtcaacggcgtcatgcattaaaattaaaatattatggaggtagtatatacacaagtctgtcatgtgtcgtccatcttttcttttttttttatttcaataattgtagattgtgcattctaactatacaaaagccgaggaattcacggctcccatggttaaacgaaaaataatttgtaaataaagcttttatatacgtgttcttagcgatttaaaaacaaagtctgaaaaataaattttgatgaaaaaaaaaccctaaaatcaactcaattttggctgataagtataagcataagcgaaaagatggggctcaccgtagccaaaagatgtgagtcatctgagccaattgtgctatatctgaatctctttcagatttctggttgtaaggaagatgtagttttgtcccagaattagcttgtgaggactctttggttaaagtacctagccagctatcaagaaaattcaccgtagccaaagccgtgtgtgagtcatctgagccaattgggctagatctgaatctctttcagatttctggttggaaggaagttgtaattttgtctcacggttagcttgtgaggactctttggttgaagtacctagcctgctaggtcatttaactcatcagcaaactgattgatcgatcgatttctttcttccaaaaaaaaaactatataaaagccggaagtgtattagttgtatcatcttattgataataattgtctctcactaccttaaaaaaatattatgtataaagaagagtttacatgtgcatcctacgaaagattaagaggtaactccgttcagtcataaatatttaatatttaggataacattcggtcacacttttaactttgaattaaaataattttgtgaaatcttagtaataatacttttcaagtcaaatatatgctcatgccaattttaaagtgcagtattcgatttgatagacaaaatttcaaaaaaattaccaaaaaatttacaatatttatgagcaaagagagtactatatattgagatatagggagaatcccagtgatctaatctatccttagtgccttagtggtgtttagatgtaggggtgtaaagttttggcgtgtcacatcggatattatatagggtgtcgcatggggtgatcgagtacttaataaaaaaaactaattacagaatccatcagtaaactgcgagacaaatttattaagcataattaatccgtcattagcaaatgtttactgtagcaccatattattaaatcatggagcaattaggcttaaaagattcgcctcgtaaattagtcgcaatctatgcaattagttatttttttagcctatatttaatgcttcatgaaggtgttaaaatgttcgatgtgacataatgtaaaatttttggcagggctctaaacaggcccttagttcttattcggttagtccccatgaaaaaggaactgaagggaatcaaaagggaataactcatccaaatcccgatctagatcctctagctttattcgatttaaagaggattgaaggtcattggagaaatcgcagggaacaattctacaccacaatagatatgaaataaatctgctcgaattctttcatcctgtgaactaaccgaatatggattggatggaggattaaaagaacaaagctttattggatccgggcatccgcgctgagcatgatgaactgtatctcttgaatgcgtttgccggccatgaggctaaatgctcaacacgtttttgttgcattgctgtctgagtttgtaaaaatgttctcccagttgttttggtagtgagctaggctggatgttttctcatagattaatcagctttgacaatttgtttgtcatgctttttgctatccagatttgtcctagtgtgttttctttgtgacaagcacttggtacactatggccgagtttagttccaaattttttcttcgaactttcaacttttctatcacatcaaaattttcctacacacaaactttcaacttttccgttacatcattccaatttcaaccaaactttcaattttaacgtgaactaaacacatcctaatgcttgtgctcactcttttagttggttggttggtaataagttcgtcactttccttatttgaaagtacgtactgaagtacctagccagctcggtcatttaactcatcagcaaactgattgatcgatcgatcgatctcccaatcagagcggcggccagtgtccagtgtacagtattcagtcttaagtcttccgccagttaatataaccaacaaaactggccttattcggtttggaggttacttgattccataggaaatcttgattcctatgaaataaaaactattcatacattcggttcatcggattcaaatgaaaaaattccatagaaaatcttatgccaatcctccaaaatgtactgattccatagaaatgaaaacatccgctcatcatcttttgctcagctcattgaaggaaaaaatagttgtactccaacactttgttttgtacatatatagattcctttattatttctgcatttcgtattacggcgatttggaaattcccatgaaccgaagaggccctcaatgtgaaaggccgtagtaaatactactccctaactataaattagatcattcaattaactcggtggcagtgatgagctaataacagaagtgcagatagagatagagaaagagagagaaaggagaagagctaggtcagtcagttacaaagtctgaattctgaaagcacattgaaggcctggcaagcaatgcatgtgccactgtactactccataaacagcggaacacaccagcctgagaatgcagcatagcagcatagctagctacctctcgatctcttccctctgaataatggctttcgatgtgttagtccgtaagagtgtactactccatgtgaaggcattgtgctatccctgtgtacaattaaatggatctctagatgtg

SEQ ID NO: 59835 - DNA, 30483 bp, Oryza sativa
  unsure (1)..(30483): unsure at all n locations
tggtatctaaagagggatacaggccaacccggagaaaatcaacgcctttctcaacatgaaaccgccaagctcccaaaaagacgtccaaaagttgactggttgcatggcggcgctcagccggtttgtctcacgactcggcaagcgggggatgcctttctttaagctgctaaagaagactgacaatttccagtggggacccgaagcacagaaagcctttgaagacttcaagaaacttctcaccactccaccagttttggcctcgccacatccgcaagagccgctactgttatatgtgttggcgacctcccaggttgtgagtgcggtcctggttgtcgagcgtgaagaggaaggccatgttcaaaaagtttaacgtacaatttatttggttagggaggttttagtgaggttcaagtnaagatatcttnnggtnncaccccctcagcaatgcatacatatcatgctgctaacgatataaaaaagctgacacaacggaatccataactacatagtagagaataagaataaatacaaggccccgtttagttcccaaattttttttcccaaaaacatcatatcgaatctttaaactcatgcatatagtattaaatatagataaaaacaagaactaattgcacagttagggaggaaatcgtgagacgaatcttttgagcctaattagtctatgattagtcataagtgctacagtaatccacatgtactaatgatggcttaattaggctcaaaagattcgtctcgcagtttccaggcgagttatgaaattagtttttccattcgcgtccgaaaaccccttcctacatccagtcaacattcgatgtgacacccaaaaattttcttttcgcgaactaaacgggtcccaagctgaggatacgctacctccttttcgatgttttgattccttgtctgatgtggtggcagccaatccattctttcctagtggcatccaaattggggacaaaggtgcaatgatgcctgcacaacacaaccacacaagtgagagttttggcaggtaccgatcaatggataagagtctcctagcagccgatttccgttcgattgaagacaaaatcagcgtggacgcggatataatcacatgacatcgtaaactccaaaacaatatctgaacagttcgcttggctaatcactagccaactgcaccagcgcgacagatgcaaaactagttcacgccaaaattggaagtttggttgaaattggaacgatgcgatggaaaagttaaaagtttatgtgtgtaggaaagtttcgatgtgatagaaaagttggaagtttaaagaaaaagtttggaactaaacaaggcctaaacagggtacaggggtggggacttgggtgtgttgtggtggttaccttccgggttccggcgcatctcgacggcggcggcggaagactgcatcacccgcggtgagcactcatcgccgacggatctcactgctttcgcgctccccaactctacactctggtggaatggtagagccaataggccatggaaaaatacgattagggagcttgcgcttccagcggaagagagagcagcgaggagatgcggcgactccggtggggaagaggctcatggcgaggccgcgacggcgaggcggctgtcggcttcgccggacgagcggcgggaccccgggagagggagatcagagagccaaaatacaaaaaaaaaaaaaaagaacggaaacgaacacaacgtggccctctttgcacggtccgatgcggatcggagcaagggcccaagaagagattagtcgaggacgaataaaaaaaagagagagagagagagagataagtcgaggacggagaaattccccaagccgccgccactaaccctagcttccgccagcacggtattaaaacccttccgctctaatttcctcgcaccattgatttttgttctgtgcgttcgtttcgatccaagtagttccccaacaatcctgctactgcggaactgccgattttgctgtcagtttattttgatcgcaaacagtaaatattagccgagcgtcgtttggcattatctttcaattccatgcttctttcaaatttgacccatcatgcatgttatcaaaatttactagagacccagaaatatgccgatgttctgtggtgacatacctatgtcctgttttttctagttagtttgcatgtcttgaaataggcttgtggaaagaacttgtgtttcgagcttcatgttagagagtggtgggatggcaccctctaataggccacttgaggtctctaattcttttgttttcccagtctgagtcagatctgtgtaagaatcttacatttctagtaatagaaattgggggttactcccttgttttaaaaaaaaaaggaaagacccaaaaaaaattcactagactaagggcatgttgggatggtagccattgccaaaattttggcgaagtgggtttgtttgatttgatgtgaatatatttggagctttttttaaaccttgccaaaatattggcattgcaattttccttgtatcaaaccaaataagtgccttgccgttaccaattttttgtgttgttgatttaggcacataagatccaaagtattcatcgtttcctgcagggtgcagatcaagttccaaatcaacctgattggtcctcaactttgagggtaacatgatgcgagacagcaagaggacgaggtccgcaccacccagagaaccactggaaatgacagaggacatgaccccaagaagcaagaggaggaaatttgtaccattcggagaaggtgcggtgctacctgaggagatgctgacggaggtgttcctacgactgcccattaaatccatccttcgtttccgggctgcctgccactccaggtatgcaatgttgtcttcccaggaattttgtcaactctacatcacaagaactgaggcaatgccaccacaacctaagcttctgtttatctcgcctacagcaaatttcaactccactgcggtgtacacgtgctcgccatcgaagcccattgatgacctactgttcacactcgatgatgtgcgtggaaactatgtggaagtggcaccttcaccatgccatggcctcaccctcctgtataatgctgttgcgccagcttactacgtcttcaatgcaactacacgggcaatcacacggttgccaccttaccaagatgtgattcatgccactgctggcgttgggtttgatgcccggacgaaggagttcaaggtggtgaggctttttcgaggaaaatcgcatgagatccattctgtaaagtgtgagatattcattcttgggggtgaggaaggggatcattggaggcctaccgctggtggagtacctttcaggttctgtagttttgctctttctgctatccgcaatgcagtggcgaacaaacttcagccagtttttgttaacggatttctccactggttgatcaacccctcgtttttactcaaagcaccaagagctgctatcatatcattttctctcactgatgaaaccttcagatggatccgatcaccaccctttgaggtatccagagtgcacttggctgagcttgatgatcagttgtgtatggtccgagaccttcgtaatggcttgcctactggtagcatgtttgaaatttggaggctgaatgactataactctggtgattggtcgcttgattaccgaattggtttgacagggaatttgccaagagatttacttgagccacgaattgtgaaagttattggttcctttggtagctacagatcaagcaagaagataatcatcgctacatctaagcacaaggtgtgtgcctatgatccagtttctagaactcttgaaaccattgtctcaatcatggtgacctgcagtgcctatcaaaacgagaaatctgatattagattcagttcatttacaaagagttttaccccagtgcataggacgaggaaagagatagggttctctactcccttgtctaaggctactaaggagatcctactccgattaccagctgaatcaatcttgaaattggaacttgtttgtaagcaatggcgtggattgataaagaatgaaggttttgttcatgcatactttgagcataagaacatggacaggaggccaaagatcatgcttgtgggtaagggctctgaaaaatcagttttcaactttattcccttgagtaaatggctccaagaggcaaatctaggcacaatgtttctggacaaaaaggtggtttgctccaagccttgccatgggttgaatctggtgagcattgagatgaaagactatctgttcaacccgtgtacaggttaccgcatgatctactagaacagagaccatcagctgtaccaggaatggtccaatttgtctagtgatcgctgcaaagactacaatccttttgtagttggcaataagaatgttggtatggggttttgccaggtgactcagagtcatgccgttgtgggaattttctattactggaaaaactacgaatctcatcagtattacttaacatgcattatatggagttgtagctcccaaggccagccactccccgatccacctctgcctgtgaatgacatgccacctgtttctctggatggtgtgctgtactggatgagtgaaccaaggttgggtcagagttatgagcgggccattgtcttttttaacattgccgctaagatttttgatgttatcccttgcccttcatgcattgcaatctgggacagcagaaatccatgtcacgcatttgtggtcgagcttcagggaatgttgtgtgctgtcctttcaaatccagttgcagataagttagatatatggaagtgggatcatggtctgtggagtatagcatatgcaatcaatttaaaattctggccagattattcccttgcgacaaatgttgtagtgcctctcgcagttgacccaatagatggaaaggttctactgaatactgggaggaagcttggtttatataatccatgtgagcaaacaatcgaaaacttgcacttgatcaggcgtcgcagcaacagaaccctggagttaacagaaatttccacattgccagatgccaagatgttcctaagaagttctctcagtggaaactattattggctccgtgcgagaagtttgctaacccttcaagtgcttcatcagggaagaatccattttactccagagaccaatctaaggagctaaatagtgtgagtcaaaaaattatgcctctggttcctatgttgtacgaggagggtttagcttactatcctacaactcctaaattgagagtattgtgcgattgaagtgttgtcatattatgggcctttttcatggctcttgttctgcctctcttatagctggagcgtaactaatatagatggccataaggcccgaggcctgaaggcccggcccatggcacggctttttggcccggcccaaagcacggcacggcctgacttggatcgggcccgtgccggccggcccgaccgccgggctgtgcctgggcctccccatcggcacgctgggctggcccggcacggtcgggccagcctggcacgatgggccggcaagccaggcccggcagacaaaatatagggactaaaaatagacataaatgtcactgtccaaagaatagggaccttaaatagacttattttagttatttacatatcacagcccaaagaagagggacgtaaaatagacttttttagctatatataagtcacagcccaataggaggaaggaaaattatacttattctgaggaaaagcacgatggcccatcgtgccttcgggccggcccgacacggtccgaggcgtgttgggccgtgagtgcggcacgtgggctggcatggcatggcccgatgcatcggtcgggccgtgctggcccgacaagcctcggcccaggcacgaccgggcctgggccgtgccgtgccgggcggcccacatggccatctatagtaactaaacggttccagctctatcaaaaggaagtgaaattagttggagtgctctcataaaatgaattattagataggtggagagttgggtttaggccgctttcgctccaaatccaacttatgaaattaaatttaagagttgaagctcatatatagtagctaagattttataatgttaaaatgccgtggtatgtcccgttaaaattgtagtcaggggtgaagctagcatcaaaacaaggggggtgcactatcattgagaatctacaaaatttcagtacaacactgtatattctaatttttttaagtgagaaattaggaatttaggggttcatgtgcatcccccccccaaacactatatagcttcgccactgattgtagttgtcatttcaagcccagcttttatagctcaaagaccttaacattatttcctactccatcactgcaagaatgtaaaggcggatgtgaaagcaacttcctactcaaatgcaagatatttcctattttcagctttctcactcgtactacgtattttaacgccccttgtttcacttacatttatacttatccgtgagatttattaataaaagaataatttatgtataaaacttctatatatctgtccttagcaattttaaaaagtaaaccatgatgaaaaattcacaaaattaactcgaaagttaagttttaaaatttaaacttcggcttgtaagaataagcgatagaatggtgctgtagattatatactcgtgtaacgatgaggtttcattgcctgagatcgagtgcatcatgtctcgagcagtcaaatattagagtttcctttagcccaagtcataactagatggattcacagttgatgagctgggaacactgggcgaacggggtgagaacggtaacggtaattcccggctgaccggcgtttgtttctgactttctaccggccgagccatatgaaaatggtaatcgaccgaaaaaaatatgaaaatggtaaaatatatggaaatggaaacggaaatggttttattgttttaccgatcgtttccgtatttaccgtattcttgtggaaattaccgtttcttataatatgataattaccgtagttctaaatatgtcgatatttatagggcatgtctctacttgacccatagtttagaggttgaatgactcttcaatcaaattcctaacttgagtgcatggctaaaatggagttaatttatgatttatatagtatagcttgaatttatttgtacatatatcatacttatgtaaagttttctatagtttaatgttttcatatttgttaccggtttccgatttgtaccgacatgtttccgtccgtattattccgttttcggttttccgatatttccaatatcgttttcatttccgactttaccgttttcgatatcatttctgagaaaaaaatgattatggaaatggttgaggtgttttcagatctttcatatcgtttccgaccgttttaatccctacgcgaacctaatactcctcctagtagtcaagaaagtcactgacaaaagctccctacagaaataaagaacttctgtaattaaatttctttctatagaaatatctgaagactttatctaggaattttagatagagatttttactataaatttagaaatcttttttaacgaaactttctatagtgaatcctttcacaggagttaaaaatagagtaaaaacctctaatgaacattttgaagaaatttctattaaagcctctgatgaaaataattctctaccttaagtagaacaaacaaattgcatttttaagtttcaatcagctaaaagtacttcgtctatctcaaaatataagaatttttagtaagtttagaacaatttagggtgtgtttgtgtttggtttgagggatcatgaatgggagacggtgatccaacttttaagcaacaatcaaaaacataccatgccccttattgaacaggcatggcagatggcatcactcttgatcggtttaattgtcggcccatcttgactggtgggctaatctatctataccttaatagttacacgctcgcgcatatatacatatatatacatatatacatatatacatacatatacatatacatatatatatgtatatacatatacatacatatacatatacatatatatatgtatatacatatacatacatatatatatatatacatatacatatatatatatacatatatacatatatatatatacatatatatgtatatatatatattgagggaatggttagttcatatctaataattggatggttacaaccaaatacttctacatagaatgccaaaaaaaaagtacttctacataataaaatttaaacgctagacatcctaaaatattttgaaacatagtgagtaatattaaaaacaaactggtaggaaatcattagctcactgaaacaagccatcgatcaaaacctcgcctcctagtcctacacccatggtctcttgatcgaggtgttcattttttttcctcaatcgcctcctacaaaacacgccggtgttgcacacccgccaatggtgtggaacgctgcttagagcagatacaatagcagactattaactaattataaacatattttaatgaaataaaagataagagagaagagcaatgggctacagatatatagtcagttgcagcacggactctaagacgcaatgtggatatgatgggtgagaccatatattaatagtatagtaagtaactattttatgaattaggtattaggtttggttatagatgaattggaggtagtagtgaactgtactattaaactttctcttatgtattgggctgtgtgggtcaagtacgcctcgctttgcgtcgtcgagactcgacaagacgagaagcgtctacagaaagctgggcctcgacccggcccagaaaggaaggaaggggaaaccaacccaaatctcgcttgcgcgtcaggccggcgtctccgtgattctccccgtcccgcggcgcaccggcaccggcaccggcaccggcggcgagatggcggactgggacggggtcccggcgagggagcggcggcagatggaggagatcctgcagctcgatatggaggagctcaacgtggagatggtcaacgacgacggctcctcctccgaggaggcgaacggcggcgacgacggcgccgacgccttcctcaggtcgggcgacgcccctccctcgtttcgccatttttttaccctctctgatgcgacctagggttctctaagtagaaactgggtcgcagcgtacttggttacctgctaggggtggtggtactgtgcatttctactaggattgaaatacgtcaacctaagaattcaattcaaccgatagcatttcctgtccgagagagtgaggatgggaggcgttagcttatgatttgatgtttgtttccctgatctcgcatgtggaggattggtgatttcagctcgggtagactagagagcgtagggatttgagggaagggggttactaggggaagccacgatccttgtcagtgtgtacccttgagccttgaccaaagtttcactttgggcatattgatttactctctgattttttcaatttattggtgggtgtgctgtgtgccacgatatatctgtagctcatggccagatacctggaaaatttttgtttgttagtcttaactatggttttgagagatttcacattgttcatttcctaattcctgattatcagagataccgacagggaaggagtggctagcacttctggacaattcacattcaacacatctctagcctcgttgcacacctatcttggtggtaaatgtcctcgctatccttgctatatgatgtttgatgctgatagaaaagaaagtgtaataagactctttatgtgtcactcagaggttgatgatacacggggtcgagtttctctcttagatggtggcacaatcctcagcttgccaatgctatatcttcaaggtaggtcttgtatgtttgtattttatttcgttaatccgcaatcttgattatcatgccagcgttgaagacacactaattagtgatcacaatttttttttcatgccatcatttctccatattattttgtctgcatgccagcccttctaagttacattcttttcttttgaactcacttgacataacctggtctattaacgtatccactgttattgttaatgttaaaaagagcttgagcaatactactatctatttatatagacttattatttcagaggaattgcacataccatttttagtcactatttcctttatattgcagttatacagccatgtgaatatacggagtactttgtagtgagtttaggacctgaggtttcttttgataattgataatttcttaatgcatatgactagagaagtggcatccaataatctaaaaggctacaagcatccctaaacagtgttgttatgtcgacatttttctgttccagtcctgcgggttcatgatacaattggatattaactccatgggcagtgaaatatattcttaattttaaatctggaacataagaacaggcacaaatccttacctgtctctctcctgactaatgcataacagtgatagtgtaaatgcgacaggatttttctggtaggttatcaagcatcaaatttattataatatgaatttgtttcaggtgttgtcctatttcctggagctaccctgcctctcagactaattcagggtagatttgtagcagctgttgagaaagctttgaggcaggtcgatgctccatgcacaattggtgtggtaggtgccagtctgttgaaattaactaattttatttgttgaattcctttccaatgacgcagtttaattttcaggttctcatgtacaagcgacacagtactcgacattatgctaatgcttcagttggaacaacagccgaggtgttgtacattttctctgctgtgcttcaagttagaatttgtttatcagttagtcattttcaccgattcttcatgtggtttggttgttttctgtgctgccaattgagcttttccgtagccagttccatcatccttgggtgatttgttattatttctacaggacacataagttaccctctcgtcacattttgtaattaagatgatctgcttaataaataaaaacatgagggagttaatttatatcattcaagaatcaggacccagtcttagcagttagcatttaatatttcttgtaaatgggacaattgaatcattcatttagaatagactgatatccaatatttcagaatttccttcacttggtcacaatatctctatcaaacttttggagaatcatgtactcatctagttttctgatacttcacaagatctagaagaccaacagaacatataaagccccatcgtttggcttatctgcggaataagccaaacggcgtatttgcaaacgaaaagtaatttgtgaataaaacttttatatacgtgtccttagtgatctaaaagcaaaggctgaaaaataaacttcgatgagaaaacctcaaaatcggcttcaaatttaaggttgaaaattcaaattttggctgataagcataagcataagtgaaaagatgaggccgatatgcactgtgatgtcttgtttacatgtcaagctcggtcattagccccttagtatgatttatgtataaagtgatgtataattcctttcgaacagcctcacaaggtaagctggtattttgttatttctttaacagataagacaacttgggaggatggatgatggttcattaaatgttgtagcccgtgggcagcaaagatttcgtctgaagcgtcattggatggatgttgatggggtggtaagtataaatttaattgaagatatattattctgaattaggagctggagagaagttaggttcattttttctcactcaacaggtgtggggtgatgtccaaatcattgaagaagatactcctttaagaaccccaagggatgcatttgcacagctagcatcatgtaacagtttacggcagcatacctcctcaccagttatcagtttggatgtctctccaatcaaacaacgggatcatgtggattcagaattggattgtggtacaccatcacctaaaagcactgcaagcaatcattcagcgattgattcaaggatgtgccattcagattcacgatccagcagttcaatgagatcttctaatgaagatgggattttcatgcatgagcagttttacagccaggagctacatcctttaaaaggaagtgcagcagttcagtcaggcgagaataccaacatgggtgaggaggatttttgtttaacatcgctcagatccttgtcaagtgcaggaacaagagatactaaggagcagcgtcagtacattcttccaaagcaacattttcaggcaccattatcattttggcctcggtgggcttatcaaatgtacgattcatatgcacttgctcgtagggctgcaggtaaagtgctcccatattcatcaaactgagccttacaatgcattcttgtcattcatggattcttagcccaacgattgtaaattcttatgttttatagataccactccactagtgtttcccatcaaaaaagaacttcttattggatgattgatcgttttgagtgttattgagcatctcgctctgtatgtttattttaaccaaaatacactattgtcatttgctgcagacctctggagacagataatcacacacccaagcatggatgattacgtgagaaaaccagatcttctgtcattttccattggaagcaaacttcctgtatcagaatctgtgagacaaaagctactggagattgatggaatctcgtatcgtcttcgaagggagattcagcttctcaaggcctttaatctcataaaatgtagatgctgcaaggtaactatctaccatgtttggaattgctaatttatcgagcttctgattggaagtaatggacttattgttggccatttcgttactactttaaaagaaggtgaattgtttatggtggtgttgtatgttaatcatatgagtctgtcacccgacagctcaccattgcaattttttggacaaccccttaatttttcttgaattgcacagtagttaaatatctaactgaatacacatacacagacacacagtatatgagttggtctataatcaaggagtttaagcactgtcaagttctccctgtagcgaagttataattctgttaattggtatcaaccacaagtatttagctagttttccatataaaatggataactattctaggtcatctgtatcgtagcaatttcatttaccatgtcatggcctgctaaattatctgtatgtacatcccattttcatttttcagcagggtatgacatggtacagtttgtcgttgtagaatgctgcagctgcagcattggaagaattagcactaacataaaatcaaactacttgatagttcatattgatttgctgattaggctcatttggctgctaggaaaacaatgctccatgtaacctggttttcgttgatcataaacattatttggaaatggcgtgtagttacatcaaagaatttcaatacaaagtttatcactctgtgttgacatgatttgaactatggcagtctctcatagcaaagcgtagcgacatggtagtgatgtctactgatggtcctcttggtgcgtatgtcaatcctcacggttttgtccatgaaacaatcacagttagcagggcaactgggcttgctcttgatggcaatccttcaacggttcacagctggtttccagggtaaatctacagtttctccttgttctttgtaatcttcatgtccatcatacaccctttaactgtaaaaaactaagttcatgcatgattttcttcttgtaaccaactttgtttctgctgctatgcagatactcgtggacgattgcatcatgtacggactgtgagtccaacataggctggttgttcaaagcaaccaagaagaatctgcgaccgagatccttctgggggatccgtagctcccaaattgcagatgatgcacaagaactagatcaggacgaatgatgctccgtgtacagtagtaaactttgtgtgcccctccctttttcttatgaagttatggaaaacactttattctctggtccataggcctagttctccgtacctgagtagtggtcgttgtgacgatcgctatagaataaccacttcctcctgtgtgtattacacaaccattgccttatgctaaagttccgtcacagaattttctgaaatgtagtgttactagaaatccatagtacaagatgaatgatgatatgatcagatgtttcaagcaatggtttgacatgtcttatgagcacatagaagttggtgcttgataccttcacttgaggcaaatactcgtgctgtagtggtaattggtaaactggtactggtagtgagctagcactggcagtgccatgtttttgctatctgtactgaaattggggccaattgcacctgacgagcagcaactcaatatgggcatatggcatcctttttttccctgcgtattgtccttttgtttcagccacagtagcaattggccggtattccattgccacctttgatgagagggagggagagagagacctcacgggtggcagcaaaggcaaaggagcagcaagaagccgacagagaaagtaaggccatggtagaatgacaggtgaggaatcgatcagacgggaggaaaacaacaccgaaaaggaatgcacttctctgcttttgtatatgcatgcacctctacctacccattcgcgatgcaccaatgaaatacgttgccaaataccttaaaatactagtctattgttcaggtgatagtaatattgacactagtagttctctaatctctagttgctagtcttgtttatgttctattttttcttgttgcaatagtagcacatgatcgtagtaatgctgtatgattgatgattggatggcatggaactatgaacggatcaaacttatctcgataatatggtaataacaaggagatgtagacatgtactccagcattgtagtcagacagccgaatcacgaagctagtgtggaaccatgacagaagaaggcactactcagaataaatccagtcacgggtttaaaaaaaaaacagagagagaggagaatcatcatcacaaagctaatgcaacaacagcacaagcgtacttccgcatgagaccaagcaaggaaaaaagaaattccaaactgtccccaagaaaattcctgccccaggagagcacagcgccggcctgtacaggtcatcgttcccaataagacagggggaagctgagaggcaaagagcaccaccaacaacgcgtgcactgaattgcattgcacatgggacatggcaaacaccggcgcgtcgccacccgcgcatgcacgcacgggcgcgggcgcggccacgggcacatcctctcctgcgactcgtgagccgtgtcattccatcgcggcttcctgctcgatccgctccctgccatgcccgtgaccgtgatctccataaattcccccaccctgtgcgcgatgcgtctatcccccacgataattagtaggcctgccacctcttgccgcgagcaagacgaccacaccaccaaccaccatccatggcggtgtccgtgtcgtggtcgtgggcgccgcggttcttggcctgcgtcgcggtggcggtgttgcttgttacgtcgggtttgggcggtgcggccgccggcggcggcgggcgacgccatgggcacacgaaggggttgcggccggggaaggcggcggcgaaaccgtactatccggtgaacgcgacggcggtggaggcgatcgagcggcagttcacgcggtgggtgcggtccatggtcgggcgacgccacagcacgttccagcgcgcgctctaccgggggctgctgcccacgcgcaccctcgtcgtcgacaagaaccccgccgccggcaacttcacgtccatccaggccgccgtcgactcgatcccgctcatcaacctcgcccgcgtcgtcatcaaggtcaatgccggcacatacacgtacgtcactcacgtggctacttaatttggtctctgtaattttcttccacacccccaccgtatccagagcgttcgtccgaatgcctacaccgatctccccgtgcaccgtgcagtgagaaggtgaccatctcgccgctccgcgcgttcgtgaccatcgagggcgccggcgcggacaagacggtggtgcagtggggcgacacggccgacacggtcggcccgctcgggcgccccttcggcaccttcgcctccgccacgttcgccgtcaacgcgcagttcttcgtcgccaagaacatcaccttcaaggtgagcaccactactacactacaaatgcggcatcatttgtgccgtggcgtggctcattcgtttcgtctgtcgcgtgggcagaacacggcgccggtgccgaggccgggggcgctggggaagcagggtgtggcgctgcggatatcggcggacaacgcggcgttcttggggtgcaacttcctcggcgcgcaggacacgctgtacgaccacctcggccgccattactacagagactgctacatcgagggctccgtcgacttcatattcggcaacgccctctctctctacgaggtacacacattgcttctttctcttggttgcatacacatttcctccatgaacattatagcagggaattgcatgcaacccgggtgattaggttgaaggtttgttgctaaccaagatagataatttaattagcgcctgaaatcgagtcaaacaggaaatctatgctcaatcctgtgtgtcagtgtccagtgctacagcccaaatgcacaacagatacaccgtgtcagtaaacactggcccgcagctttctgacagggcactggcctactgtggcacctactacaatgcaccacactggagtcacacagaagaaagaattctactatcgaccactgttaaaactcacagggttacagtagaggcaaaccactattatcggccacattagccccccgatcttgtgactggccctactacagctacacgaaccagatggtgccaatgcgttgtgcatgcccgtgtggcacttcgtttaatgcgaaatccaacgcaaatggaatgttgatgagcccactagtaatagcatagtgagtaatcagcctttcggtttttaagaggagtgtggtaaaacctgcatcgcttgtcgttggcgccggcacggttgccggatggggttttctggagcccggcaggttctctggtccccctggccccaggcgccgtgaccgctacggcccgtgacgcccatagctggacgtctcgtgccgtgcgtatggccccaaaccgtagcgtatgtgtatagccaccagtctcctctgcaaatcctgctcactttggtcgtacactttaaaatctggtactagtccaacactactaccagtagtaaccgacttttttttttggtcagaaatcaaaaattgacctttgggacgatagggtcgtccaagctccaagggaaacatattatctgctgtaccgtgctctaactttaagtgattgatatgtgtactatcccacatctaatatgtccacatgtcaatgacccattcacccatatcaaaggatagttctgtagagaatactcatccgtcgtgcaagtgcgcaacgcacctagcatggttcgaatgctagactttgtaatagtattcaccgtatttcagacattcagtaatactccacacaccacactagtggttattctaacgtgtgttacagtgtgtgatcgtaaagaatactagggtttacgcaaatatttgatcagaaatcctttgccgtgtattactttggtcatgtatgtactcagtactcacgttggtgacacgattgcagggatgtcacgtgcacgcgatcgcgcggaactacggagccctgacggctcagaaccggatgagcatcctggaggacacgggtttctcgttcgtcaactgccgcgtgacgggctccggcgccctctacctcggccgcgcctggggcaccttctcccgcgtcgtcttcgcctacacctacatggacaacatcatcatcccccgcggctggtacaactggggcgatcccacccgcgagatgtaagtagctaccactagtacagaatcgaacatcgtgaacgatcatatcactactattataatgatatgtgggtctcatcctatcataccccacccatcaatatttgtgatgatagcgtcataatggtagaggatgtgaaccccattcacccctcacatccatctcgttcttgtgttttttcgctaacgatgctggtgttttgtgtgtggttggtggcggtggcaggacggtgttctacgggcagtacaagtgcacggggccgggttcgaactacgccgggagggtggcgtggtcgagggagctcacggaccaggaggccaagccgttcatctccctcagcttcatcgacgggttggagtgggtcaagttgtagcaccacgtaggagagaaacacagctcactcgactattagttaacttgtgaagagaaaagaatagaacagaagaagtggcagataaacactctgatttgattcgattgcagatttcaactttgcagttgcattgtgagacagtcctatactgtgtccggccttcgcctcggttttgttttggactgcaaacagtataacatcaacttaggcccactggcccaggcagtagagaggtagcaatcgatgcgatctccctgctcagcctagaagcccatagagaattgaagtggggaaataggcccagaaaaaggttagagtagtgtagcagaagtgagcccaacaatcacaggtgtgttgcttccatgttccaacacgtatagccttttcgaacattattccttttttttcaaacattattctagacagacattttaatggatttctgcaaacttttagtagtagtagtattatagacccagtggccaatctctaataccgatttcatggttctaaccctggctagagattgggccacgtggcgccctgaaaatcaagtttgcctccctgcgaatttgccacgtgtctccttggctctcctcccgcattgtttgatcgagtatcgacggctaaaggctacagctcgctgtggtggtctggtggacctcgttagaaaactggaattttttttccatgaaagtgctccatccctaatccacccatcttcctcccggacgcacgcaccgccgtccccccgccgcccaccggattctccaccacctgcgcgccgcggccagcgccgcagtagaccacccgctcgtgtcctccttcaagacgctaggctcgtcttcttcaacgccgcccggccaccttgccctcccctgcgttccctgccgcaatgccgctgcctttcctcgaagccagggccgccgtcaattcgccggcaagagtcaccctctaacaggcggtggccatcgccgatacaaacttcggctagatccggtgagcccacgagagaaagaagggagggggcgctagctagcagaggaggagaggaggcggcgtgcgctggtgagaggtggcatcgcatcagatccttcgccacctgcgcgtcgcggccaatgacgccgtgatgaaccacccgctcgtgtcttccctcaaggtgctgcgccgactcgtcttctcccccgccgtcgtgcccgcgccgaggttgagggaacgtacgcaagcggctgctgtgcaggctcgatgtggagcgcggcgcgagggctgcggccaagcggcggcagcgatgtcggcgatggtcgtgcgggcctaatgtggtggcagggcagggcggacgaggaccgacgatctgggatcaacacggcggcagcggtggctggggcactaggcactggccacggccatgtgaacccaatgtggcagcaactgccgcgccgccgaaggccatgtaaatttgtgctccgcaaaggctccatgaggtgtaggctccacatatgtgaaaacgacggcggctggctctgctgcaaggtttgtgcaattcattctacaattcattctacaatgcatatcttgcagctaggaatcatgatatttcttttaaataattaccattatgtctctcaaaaaaaagtatgcagtatttattgccaataaccttgatttgaaaagggtgaaaatagtttttgttacatatagttatgagttacatatttaaacgcactttattaagtgaaaaaggattgctctgcactggacgcgtttcagattagaagttcagatttgcaagatgcggtttatgggctttcattccattctgttcaaggaacttattttcatggttgctgtcggtctgaatccataaaactcttctatgagatgtagcttactttttttttttgagtcatgtcattgtatcatgcttgctctattaaaatttccatcctcattagctaatagaaagcagatcgtccgatttgaatctgatttccatcgtcaagaaaagcggtgattcacaacctatactcatctactagctagcttaacttatcagaaaattggaaaggacctttatcaaaagctgtgatcatttcctcaacaatgtatgtctatatcttagataatctatattcatgtctttgataatctacaataaatctaactactaaacttaagtaaaacaaagttatggctacctattatctatacatatatatattccaatgcttgtgatatacatactattacaatttcatcctcgatctttaaattctaacttgattaggcactatgtcatactttggcagagttgtaatatcactgaactgaaactttcatatgacaaaaatggccattaatttgtatagatcagctgctgctgcagttacagtgcatctatatgtcatggtgctgtttggctggtgctttaatcagtttgttacatgctgaataaaatgtcatgatctttgtacatgctgtcaaagttgcaaattttagctacatgctgccaaaaaatttcatgatctgtgactctgtgtatgtgctgccatgatgaaattcctaagctgctggatttccaatttctttgttcccctactcaatttagaagaagtaagagttgtggtcaaagtgaaggagcgttctcagaataaatgtgctctactcttttttttttaatcaattagtttctctggttttgttttattcaattccaatattatggcatggcattgatagctcaggaacaacatcaatattcgactgaaactaactacaatatacttgctaaagtgcatatctgcagctaaaacaagcaaaaaagttttggatcttaacgaacaatcatgtaaatagcttatataactgctaaattttattcacataatgctaactaaatttaagttccaaatgccttgctatgttttctttttctttctttcttttttctattgcagattagtgtagcggcttcctgaccaaaggtgtaaagcatcactgctatcaaagtcatttgactgatatctgattgacgtcctcaacggttgacacatactcatcggtcaagtcctcaacgtacatggagttgaataagtttgttgcaatccattagcaaacaccaaatgcagagttagttttttggtggtacaagatggttatgcacatgagcaagagaggcagagagcaagtgaaggggcgcaagcaacgatgtatcacacaactcacactcactggtgctttgtccagcaccaaacctcagcaccagatttttgtgccaataatcacatcagcttgggagatgtcttcctgatgcggtgggcaaaggtatcgagggccatggaaccggttgatagcccgaggagcaagagggatttacaggaggtggaggacagggaacgcatcgcagacttgttctgtacatgtttattagatcattgtgacagagtgacatgttgcactatcaagtaccaatagttggttgggattggaatgatcaaaatgagttgttcatgttttagaaggctgtgtgtttctccattttagtttagatttgagaaggttctaggtttttcctttaaccttttcactctgtttctcgcccaacataactcagtttttctccttttcactctgtttaatttatcaatttctaaatagtgccacacggtccaatctccggtaaaactgtcagcttgagaaaagtgatgtggaggaaccatgaactcaatgtcttgctgcattgaactaatatgaataaaagggtaaagtttaaataatttcaggttttaaatagatactccctccgtttcacaatgtaagactttctagcattgtccacatacatatagatgttaatgaatctaaacacatacatatgtccagattcattaacatctaaatgaatgtaggtaatgctagaaagtcttactccctccgtttcacagtgtaagtcattctagcatttcttacattcatattgatattaatgaatatatatatctagattcattaacataaatatgaatatgaaaaatgctagaatgacttacattgtgaaacggaggaagtacgttgtgaaatggaggaagtaaaacatattaggtgtacttatcagagcatttcattcatttatttcataaaagctggtcaattacgcggcacggcattttctagtcatatagtataccactaggattagaagtactgcactgtagtacttactacgagttgtagtaggtattcgactcctactgtcctacattgaactgagccactgacaacatcaagattaggcagcgtatttttcaggggctgattgatgaaaactaacggatgattttctttatcatggatttgaattaaacagtagtattttatattataagtcttaactgatatagtttaaaacaggttatctaaataacgtaataagaaagttttttaaaagaaaatgtctttttttttgcggggaaaagaaaatgtctttttagaagcgtgaaatacataatctgtgctgataacgggccttgacctgttacggagagccaccgaggcgacaaaaacaatcttctacagtaccgtagaccgtatgcttctgcatcataactactcctacacagaatcagagttcggaccaatactaaactgtcaaaactcagatctactgttgatctagatccaccagcagtagcagcagcagataaaaacaaatctcaagtccatccgttccgactcacaccgtcagcaaaaacaagattgacagctgcaggtcgtgtcctcttcaatggagtccaaatcgatgtgtgcattgtcgcactgtcctagctccgcggtcgagaatagctgatggaaataaattccgcgcagcgatcctccaaatgctgcaaacgagtgacatattgtatcgagttcgaaaaagtttgaacagaattcagtggttagctgctgacatgtgcttggttaatgaaaacaatatggtcactgcacatttcagacggtccaagatgctactagtaacggttaagcaattccctcatgcatctcgggagacacgcacaagtccctttgtactttcaggtgtgccttttatcctaagagacaggattatctacatctaaatctggttctagagtcactaccagaaatgacagacaacatcaacagccaaacaggaaaaacgctgtgcacatgacttgcacatcactttagtgctcgttggaacagtgttcttattaatgtatagtactgtatagtattcatccccgtcttaggtaagctgttgtatcaggatattgttaaatggtcagtagcgctcattaactctgaagaaattctgaagactgaaaaggacgggatcatctctagaggtggccaaacgggcagcccggggcacggccgaacctgtagcaggcacggcccggcacggcctgctacagtaacgggccgtgccggcacggcacgagtagccgtgccgtgcttgggccgctggccgagcccgcgggccggcacggcacggcacggctactgtagcaggccggcacggcacggcccgcggcacggcacggcccgtttcgccggcggcccgtcaggcgcggacagggcgggcggcggtcgaatgggaaggcgccacgtggcactaacggctacttgaccgttcaaatttgaaaataaccgttgggaggctaaaaaattcataaaaatttcgaaaaaattccaaaaaatctcaaatttcgccctataaatagggcatgaaccccagccatttctcctcatcccacactcctcatcttgtgctctcaagtgttttaagtgctctctttgttctcaagtgtgcattttttttgattttgacaaaatttgctcaaattttgtcaaaaatcaaaattagtttcgtagttcaacagtttgatcgcagaggtttgaagagctcgcggttggaaagatgtaagtaatattcaaatttgtgtattatttgtattgtgtttgtgaattcaataaatattcgaaaatttgtttatgtcggtttaaattttcagaatggatccgaactttccataccagtcgccgtcgttcaccttgggtgatttcgaccccaactacatgtcggggtttgacggtacctccggatcggctccaactccaccatctgtggaggaggtacctgttcatacggctgtcgttgaggaggtaccggttcaggcggcgacagcttcggaaggattttccggaaccgcgagcggaagtgtttcgacacacaccggctcgaagagatcgagaacctccgttgtgtggcaaaacttcgacgagataaaggaaacatgccccgacggaagggaggtatcgaaagcccgttgtagaatatgtaggcaaattttatctgctcgttcttctggtggtacaggtcacctcaagcgccatgcggagtcgtgtgccaagaagcaaggaatacaactccggcagcagcaacttatggtaaacccagacggtacggtacgcagttgggagtacgatcccatggttgctcgggaatctcttgtccggttaatcgccaggcaagatttacccctgaactttggggagtcccctgcttttgaacattacattcagcaatctcataaccctaggtttaaagctgtgagtaggcaaacatcaactagagatttagagaatgtttatcacaaggaagcaactgcacttaaggaactgtttagtacatgtactttctctgttagtgttacttcagatatatggagtagtggagctagagaggattatcttagcgtagttgttcattttgttgatgatgattggcaattacaaaagagagttttagggcttaggttaatagatgtctcacatacaggagaaaacatagctgaaagaattagggaagtaattaatgaatttaatcttgctgataaaatatttgctgtcaccctagataatgcatctgctaattctagggctattgaaatattgcaacctttattttgtgtgtatgctcaatcttttctactccatcagcgttgtgcatgtcatataattaatttgattgttaagactggcatgaagagggtaggtgaccacatcgatgctgttcgtcaagcaatcgcgtggttaactgcttctaacccgcggattgctgaatgaaagaggttttgcaatgcggccggtgtgaaagctcgtaagtttgccaccgatgcagagcatcggtggaatgcaacgtatttaatgttaaaagttgttttaccttatagtagtttactttctgattttgttcagtcacgtggtggcccaagaaacagtgacgggtcttcagtactgaacgagcatgtttgggcaattgtccaaaaatttcaccaatttctagaaactttttatgattgtactctaactttgtcacaagtttattatccaactgctaatataattttgcacaaccttcttgaaattgctacattatttaaagaatacgaaaatgatgacgttctaactgaacctgtctttcacatgaaacaaaaatatttgaaatattggaaaaatatacctatgttgtatgcttttgcttttgttttagatcctaggtgtaaattaaggggattgtctgctattttatcacttgttggagatactataggtgtagattatagttctttttatactgaggttagacgtaaattatatgaggtttttagaagatatgaagtaaagtttcaggaagttcgccagcagagaccccctcctatccccactacaggtaagaagaagatacagtggggtaggatttggggtggatcgtcttcaagttcaatccaaggtggtggcagttcgtcggctacaagtggagacgcctcttcgcatgttgtggccgaagagttgtccggttatttggacagcgacgccatccaccacgaagcacaagatttcaacgtcctcgggtggtggaatgaccacaagataacatatcctgtgctttcaaaactagcacgggatgtgttgacggtgcccgtgtcgacggtgtcctccgaatcggccttcagtctatgcggccgaatcatcgaagaccggaggacgactctgcgcagcgaccacgtcgaaatgctactaagcgttaaagactgggagcttgctcgacaacatgcccaatacactgcggacaaccaagaattggccgcccagttcgagcaactctacctggatccagaccaaccccagtagaattttgttagaagtagttctgacctttgagctgtactcttttctttgtcatggttttctcattttcccctatgagtttttacatgacaaagtttttaacgaggcagcatgtatcattgtatcctgtaatgatataaacatcaataaaggtcattactatttttaacaaattcttttgcaatattttcgcaagtgtggatttatctttaaattatttcaaaataatgaatcacaatctatatttttaaatttttcaacacaacaaaaaaataccattttttctttttttttaacattagcaaatcattacttttttaaaaaacttttatttccattttttaaataccattttttcattttttaacattagtaaatcattacttttttttaaacattttatttctatttttattttttttccttatacatttcctttgcttttttttaaaaaaaaacactgtgcactgcaggctggcggcctgccttcacgggccgccgtgccccgaacggcccgtgggccgcaggcgtgccgtgccggcacgggcacggcccggccatccacgggccgtgcttgggccggcggctcggcacgtgggccggcacggcacggcccgtttcatcagccgtgcctaacgggccgtgccgaaacgggccgtgccggacccgtgcccgtgccgggccgggccgtgccgcccgtttggacacctataatcatctcggcgtccaaatacgctcaggcaatgaatttggccactctttttccgagccaaaccagctctggacgtgttatcagacaaccaccgtttgcaaccatgtagggagggtactattttagcgtccttttgcctgatgcttcacatcaaatgcacgtcaacatttaagccatccataaagcaatgcagttgtggtacactgcaacaaacaaccacaattttgtcttcagtgcaaaggatctgccagtgccaagaaggcaggaactcgtccgtgtactctttacttcttccttcccttaacttccatgccatttcagctatcaacctatacaggtcggtatcagataccgcatcagcatttaagggggagggatttaggactgtttagattgtagccaaaataaaccttattaaattttgttattgccaaaattttagcaggatttcttatatatttactaaagtttggcagtaaattaaatgtagtcactttttgacaactttaccaaaatttgataaggttgaaaatggcatcaaggtgaacaggcctttgtttttttgtgaggtttagtccctctcaccaaaccaccccgtaaggcctgagtttagttaccaattttttcttcaagcttccaacttttccatcacatcaaaactttcctacacacacaaacttccaacttttccatcacatcgttccaatttcaattaaacttccaattttgacgtgaattaaacacaccataagccacactgtcagaaaaacaaaggaatggcatttcggaactgtatgtacttttgtttcttcctcctctttttcccttcctttggcagggattcacccgtccaatttctcataggtaagtgcagtaatttagaccgttttggtaattgagaaacccaaattaaatttacaattttataccatgaagacaaactttactctatgacacttaaaagtttatataattaactagtggacattgtaaaaacatatcatggctagagaataccctaaaaacgtgttatgtttatggaaagatattttcgatccaattaaaagagaaactcttaaaagaaaaacaagaatgtcctatggctacaagtttctaacctaacatacgagtgaagacggattatgatatatactaacaatgtacaccttagagtgatggcattttaagagttgcataatttcaaagctttcactcaagcgctaggttagaattttgtggccccaaataggtaaaaatgtcgttcgataaattaccaattatttattatccttcaattatagcacatttataggatatttatcagtaaattacataagatttagttgtcgtggaataaaatttgtcaataagaagagagagaatgtggttagagctgtagcggtagaacagattttattccctgctcttttgccatactcgagctacatattctggtggtactttgcgaagatttaccatcttagtcctaacactaatatgtaccgaaagttaattaaaacacactcctggattagcattcgggctccggttgtgagtaatcaccagagctgatcgaggtaataatctctagtgacgtcgtcgctgaactccgagtcctcgtggcggctcatctccgagctcttcaagctgatggcgctgtccggccgcgacttcctcgacccggcgcgggccaggctaggcctcggctcgccggcggcgccgtgccgctgcctcggcgcgctctggcaccgcgcacgcgccacggacgacgccgtgtccgccatgtaccgcgggctcacgacgcgccccttcgccggcgacgccgggccgtggtaccccgccgggagcgcggcggcgagccggggcgtgttgtgcgtcgtcttcggctgcgcccgcgcatcgtgctcgtgctcctcggcctggaggtggcgcgacggcggcggcttgtagcagtagaggtgcggcgaggacagcggcaccgaccccggcgtgccgtccggcggcgggtcggcggcgtagcggctcgtgatccgggaagaccggcaccggagctggcacgtgtccatctccacgatcctcgggctgcggtcgaagttgatgtcgccgccgtcggacacccgacggcggtgcaccaccggcaacgtcaatgtctttacccgccctccttgcatttgcacgacaatcctctcctacgtacaaaagatgctcaaaaatttaacttcatctgataaaatcaaggtgatccgaggaggcatcacagtgaaaaatctcacctgttcgacggatttccgcgatgaggccatcttgatggcgcgagaggaggcttggagcctcatgagcgcttgcagcctctgcagagtcgtcgctgcttgcttcctcacaaggtagccacgtaccagagcttgtatcttgacaagcgccttgagagcgcgcaatgccctcctagcctgcatttgcggtggaaaattcaaatttttacagttgcttcgaaaagcaaatcaacagaaacaatatggaagtttttgaactatatgccatgacgactaggcttgtgtccccactgtgcagttacctaagcgtttgcagcaaatcatcactaaacaaaaatatcctaaaatgtggaatttatctatagtaggaagcagattaaacaatgtgcattgtgcaatggctagctactcaacggcaagaaactatcaaacaactgctgccattaacaacagttagtaaagtgaagtcaaatctcctgtccaatataaaaccaggagaatccataccacctactccctccgtcccattttgagtttttgcttgtaacgtttgaccactcgtcttattcaaaattttttgaaattattaattattttatttgtgacttactttattatctatagtactttaagcacaactttttattttttatatttgatgggaaaagggtacaaacccttgcgcatacttatggattaccaccaaatccaccgtttattggaaacaccctaaccgcttataaacgattatcttctttgggcgcgggttgattccaaccttttaattttttcaatacacatgaacttttaactttttcatcgttt

SEQ ID NO: 59836 - DNA, 34024 bp, Oryza sativa
  unsure (1)..(34024): unsure at all n locations
ccctctctcccaaacaccccctgagtaaggctgtaagggctaagggttgcacccatcatctgtgtacttctgccgtagtgatgtttgcagtcactgttaatctgatgatgccaggtcattacaaagtgttaaaatggataacatcgagcattgttgcaaatcacggaatattttctggctatcaatcatacataatctattcatattcagaattgaaattatagtagcaaaagcaagcttgtgtgcatacaaagaaaataaaacaaacatgtttggaacacaatgtaaatgagagtttttaagtgtgtgctgtgctgatactatgaatattatatctaggaagttactgatttttgttgttatatatgttgaagagtattatgaatacctagcaacatgatatatatgccatgtttatggttcatcaattagagaatcttatcataccatggtgacccactataataaacatggtgtatgttgcaggtgtaaatcaacgtctgagaggaattgtgttcaggataatagcttcagagataagcattcattaaaattccaaccaaaacctgggcagtgattattgtttcaatgaacagtaagtaaattgataattctgtgtgctaaggtgctgtcgtgacattatatgtaaactattcatagcagaattcctgactcaatactccactgttgctttttgtttagaattgcaatacgtgaataatgtatttgtagtttttgtactatcttcaacatctttacaggaaatacaattattgctctctgcttgtgtggctggtcctgggagatgttttactgcttgctgcatatcgaggttgaaatgttttcgtttggggggtgggggggaaaggtcactggtgggaggttgaaatgttctgtagaaagatgtcgtcatgagaatgtcccgtagctaaagggagagcgatgccactgtaaggatgaatagtgagccatgccattgtccctttatttaaacacattacccgttatccaggggaggtagcaactgctagctttcatgtactctatttctgttccccattcatttatcattcgctgccatggcagtttgatctgcatagattagaatttgcttttgtgatatgtttgaaactttccttgtgtttgaacccacgtcagattctcttatcaagatgtgattgaatgtactctttcgaccaatcattgaatgaacttattttacaccttttggtaaatgatactctttgttttttctgcaagggcaaaggctactagtttgccacgtggcccactgatttgagagaattttgtttgtaacttcaaaggagctattgaaatcgctttctttctccaactttttttttgatgtgtacaaagtaagaatcttttcggcctattataatcctcccatcggtgtcaatgattttatcaccgcattatgcttgaactttgaggtgaaaaaaatgatagtatcatttccctatttgattgttcctgcaatgtgtcaccctagaaaatttcttattttaggagttattatgattcatatatttggactcaacatatgttatttgaatataagaggtacttactaactaaaacattatatcagatgaagtaattcatagttttcattttttttattttcccaaaaatgattattcttgttctaagccctgcatgtgtgaattcttatggccttgaaaataaattgtcaactggacggttatttgtttgtgcctgtgagatattaagtttgatgcatcaagtcttgaaagagttcttacgacatatcagaagttgtcgcttgcatgcttctacataattatgtgataccgagaggcactaattttgtcttttcattgaatgagaaactgagtgaactaaaagcaactacaaaggttagatactttcatcttggatctttattaaataaccgagattattaaggttggggttgatgtgggaaagatactttagtaatttgcaatataatttgttaaaaatctagttgaccattagaaaatggtgtgaatgtatttttcatcacaaatccttttgttagttttataatttttagtagaatttagctataaaatttaatgggcggattttataatactgggtcctatgtcaactgaaatactgacaatatttttgtactgtagcctctataaatgatcacttagttatagatgagcaattttgatttctgaacaccaaatatacaaaatagtatcctataaagtatctccagaatctgcagctattcaagtcactgtctaaaatgtggatagatattgcacaccctgggataactcacttgtatacgaactttaaaatatcttcacttatgttggtgaaggaatagtaacaggctcctgggctatataaatgaacctcatgttctactttctgtaacttaggtgatcggcaacctgtgtattcatttttgggattgactcctactttaaaggcttcacttcgcctcatttttttcctgactgttcaatacttgtgaatggagtacggtaatttgcgacgtcaagcagcttccttgaaaaagagcctcttcgatcaggcttgtgctctgttcatctcaaatttcaagcattatagttgaggcatatctgagactctgcaaatatatccatcagtccttttgctatatcttcttctgctatttatcattcagcaagacatagaatacagtgttttgatggacatcaccttacagtcatgccattttaattgccataccatggattgacactattgcacacagataatgaaaacaaagctaaggagaatcagattgaagcacattatattaatataagtgggttatcgatatttctgtagagttcattccatttcgtacttatccccaccccagttagcaaagaaatgctttaaaatcaacgcctttcaccatttcggaactctcttttctggtctttatcttagtttaacatgtgttaagtgtgctggtttaacaaatcgttttgtattgacagggttacttggatgagcaattttgtcaggttgaggatttgcaggatgaagcaaatccaaattttgcagaggaggttgtttccttgttttttaaggattcaaccagggtaatgttgaattttgagcaagctatgtaagtggtgacaatttcataaactagacctgtcttgattatcttttcacattcagcagcattattgttggttactaatatctaacatcacacagtgagaagcatccgaaagacttcgccagatgggacacacacatgcagcaattgaaaggcagctgttctaggtaagcctcagctcagtttcttgtgagatctccatgttgtcatttgacggaactggcactgatggacttttacagggtgtttgaattttattgcctttttaggaaagtgtatgcctagtgcaattacccatttgtctaggaaaaaataatcctgcctttttccaacaaaccacctaactttgtttagaaaaacattgcttggagaaggagagccacacatcgcaaggtcggtttgttgggtgaaaatgaacatgattagattttctatattttgagcatatgctgtaggtaaacttaatttgaaatcttaagtttttaactgcacacaattgtatctttcaaaaagactatgtatgtgataataattttatcactaaatctaatttagagtgtcaagaatctataaaaagctaactaacattaccctataaaaactatatggccttagtttttctcccttcagtcttcaagaaagtagcttaactttcctaactggcatagttctcaggtttttatattaagtttatccttttctcaatggaagcaaatatgacagtttcgaacacaagctgaaggagaacttccagaagcctgatgtacctgaactcccaccacacgcacacacaacaaagaaaagaccttcaaataatggcctgcttaatatcttgtgaaattctagtgaacggtcagggaatatgttaaacagagatatttacagagacccatattgctttgattggtgcagccttgcaggtgcacagctggtagatcatgagtacatgctcactccttatttcattatttgacatgataaaagaagctggcaatttgcttagttatacatatgtgataatcttttgtgtactttatcaatgcttgacatgatatggtttgtcacagcattggtgcctccagggtgaagaatgaatgcacttcattcaggaatttctgtggagaagaaaacgccgaagggtatctctctctctctctctccacttttatgacatgtggtatggcatggtaaaagttcatggcttgagcattgtgattttcccatgcccatggctgttactgggtgtgctcgtctgtgcttgcaggcttgcagccacagcggctgtggcagttgtaaatggctgccggctgcagctggtttcaactgccgcagctgcagtggctgtggcaaccagagcatccaatcggcctgatcattacggaaaaaccaacaaagtaaatggctaagtgccagtctgccaccttgtcaaacttggcatggctcagtcgaggcatgtagaagtgtcacctgtcagccctcactgttatgagtgttagtacctagttacacatgcatattctgatgggtgaaagttcctcctgctagtgaactggaattagcccttgccgtctatctttttttgttcaattcattggcttatttcgtatgatgatagatctctactactattgttatgcagttgcacgagatccttccagaaagtgaagagggagcatgccgtcctcaggcagaagtgggagtcctacttccaggtaatcttcaccagccacttcgtacccagctttcattaatggcaatatatgtttgttactaaggttgtgttcacctcgttaccattttcaagcttgccaaattctagcaagacaacatagcattaccaacataaccttaccaaaataaaattttgtaaggccttaaaccaaataccacctaatgttactatatactccctccatttctaaatatttgacgccgttgactatttcaaacatatttgaccattcgtcttattaaaaaaattaagtaattattaaatcttttcctatcatttgattcatcgttaaatatactttcatgtatacatatagttttacatatttcataaaaaaatttgaataaaacgaatggtcaaacatgtgctaaaaagtcaacggtgtcaaacatttagaaacggagggagtatttcaccaaaaaaaaaaagggtaatgccaaagtttggtaagttttctttctgcaacaaactgaacacacctatggctaataaaccattcatttctccacctatctcataataaacacaacgtggctttgtgcagctgttgcgacaagctggtcctgctgggaccgcgactaggcctgcgggcaagtaagctataagcagccggctattgaattggtctcgggctgctgctgccgtggatgcgactaggctggtacacaagagcagcctgccgttgttctagtatgccactacggtgaaaacccgtatatagacgtgctacgacttatgagttgtgacatgcatgtctgcttgtttatgacaaaaataaaaccgatcaagattactacatcatcatgagattgctctctttgcccttattttgtccatgctgttgtccagattgcgatgggtttatatacagctataaccacagatgaaactgtccggctgtgtcggtgaccattgctatgctggagatagtgtgatcggccgacaaaagtttatgaaggtaatcaggactgatagccctgatagtgtgataggtattactgaactaactggaatgacaggggtgtatctgatatctatgtgatggacatgactgagctaactactactaagataagtactcctatatgcaaaagcatgagctatgttctaatcttggcggttaagttgcaaccactcaagatgtacattttgtgtttggctccttttacagctctgttacagtgttactgacaccggagcaaactctgacgacggaaaatttgaaaaccacaacctaagggtgtgtttagttccacgttaaaattgaaagtttgactaaggctgtgtttagatccaaagtttggatccaaacttcagtcatttttcatcacatcaatctgtcatacacacacaactttccagtcacatcatctccaatttcaactaaaatccaaactttgcgctgaactaaacatagcctaaatttgaaagttcaaagaaaaaagttgaaagtttatgtatgtaggaaagttttgatgtgatagaaaagttagaattttgaagaaaaagttgggacctaaaaccggccgaaatatgcaagtagtagttcctactttcacacaaccaatatggttcattccatgatgggaattcagaaatatttcctgtcaagctctcgctgagcagtgagcaccagcacgatgggaaaaagtggagtagcatttcgccgccggctttcatagatctttttttatctttttgaactttttaattttttaattttaaaactaaatatttccaagacttattttcaagatttgaacggtgtgacagtgttatttggtcacactgttctaatatagacaaaatgtctagattttgtaaataagtttcagaagtgtttattttttaaaataaaaaaattaaaaagtacaaaaagtaatttaaaaaaaatcctttcacgataccggcttgcggcttcacggaccgaatcaatcggaggtagccagtttggccactttggcgggagtgcgattaaaacctgtttgacgacgtcaactctccggcgtgccggcttaaggtagggctcatgtgtaaaagaaaaagaaaaaaaaactcaggtcgcctgcacgatgggaaagggtatccttgtaattgatacaggattcggcgtttgagtttggactctgcactctgccgcgcacgtcgtatgaatattggagcttaatcaggtcccagggattcaaacgcgtaccactattggttccgataaagatgttctacccaattggctccttgaggattccaaaacaaagaaattgtttactggagtacttcttgcgttgttcaaattatgctagactatagtaggaacaaagaacaaagaacaaaaatatgtctatgaatagttccacgcttttcaatgcttcaaagtcaagcctcaatgaggttaaaattttctattatcaaaatccaaactaactggaaagcaccaccggtgatatggggagcatcgaaagcaaatcgaagtaatttggttggggtttttacccaccaaaatttaaatcttggtgcgcatacaagttagcaatattagaaatttggtcttgtttagtttcaaactttttcttcaaacttacaacttttttatcacataaaactttcctacacacaaactttcaacttttctatcacaccattccaatttcaataaacttttaattttagtgtgaactaaacatacctttatcgttggcttctctttttaaacgtgtgttacttttttttaagatcttgttgttcatattattagatctttaaacgtgtgttactgtgttaggggatttattcatgagtgtattagtgtgatattacatgtgtagtagtttgtgtacgttaattggaaaaaaaacgaaactattcttaaaacaaattcgaattgccggtaacggcgaccagagcaaaactcacgcaagcgaagtttcaaatttgaaaacgaaattaaaaaaaaaaactcacgcgaacaacaacaaacccgcgacctgcgcgagaggacaaaccaaaccaaaccaaaaccaaaagcgaaacacagaggacaacacaaagcacggccggggggcggcgcaccgcgcacgacggcgacgagacgcgtggcggagcaacaaaaccagcccccgcattgccccgaggcggcgccgcccgagctcgaatccgcccaatctcgccggcggcggcctcgatctgagccgaggccgccgtgcgccggcccgggcggcgaggaatggggagcgtggacggagatttcgaggggctccaggcaggtgaggcgccccgctgatccggatgctctcgggagtttgaattctagccctagctgctcgaggtttgggttgctgcgagtttttgtgattttgggggtaaatttgtggcgaggaggagtggtggtcggcgatgggcgaacccgctttttctgcgctctgatttagtggttttcgagttggaattcagctcagcgacctcagtgattcgtgcatattcttcctctggttctaggcttctagctatcgccagcccagctattgttcagttactatgttttagtgtttgaagttagctggcgaccgctggattttgaattttttgctgtttcgatagtaaaatgtttgccgaagaagaaccgtgtgttaacccgtttttgtgccggagggttcaaaagttttattattatcatttttgatctgagatatcagttccgagctgccgatctgagttgtgatttttaatttctcatacttgctttacatgatggtgcaaaaaacattgtagcggatcggcgtgcggaagtgattgaatggctcaatgcgttactcccggagtactgtttgccactggactcatcggatgacgagttgcgggagctgctcagtgatggcacggtcttgtgccatatcgtgaacgcactcattcctggtgttctcgaggtgtgtccttttgggcttgaagaattttggcttttttgttgaactgtggatgttgatattggtgctctctggatgtgagtttttgtttgtttaggagtcgtggggtgcttatgcatcgtcagatcaacatgcaggccatgtgaagaagttcctcgcagtggttgctgatatggggttgccaggcttcagtgttaaagatcttgaggaggtgaggttggtcttatcatactatgtagttggtttgcagaaatgagttctgaaatgcaaatggttgagattagttttcttaaatgtttgcgtgctagccttattgtgctagtcaatataatggtgcttggccttgttgctcatggtattgcgttgctgacaagttttagtcatgcatacacatataagtagaactatatttctagagttttttttcccattataatctgtgaggaataaatgaataacctcttaatatcgcctaaccataattgcactatagtaataactcaaattctgtgatagattgttgactgctagaaaaggaggttagattattagttctagatttattctatgccggatgctgtcatctaggaagcaaatctgcaaaaaggattgacaccgcatagttaaaatgacatgcttttaaatactcgcaattgacggaaacatgcaagcattggagcaaatccccccaatttcactatttgtggatgtaagatgttacagtttttcattaaaaaaaatgtttaccatttccaaagttcctgattgcttatgttaactcataacttgaccatggcagggttcaatgtctggggtagtggactgcctcttggttctgagggaaagtgtgagttctggattacgtgatggtacttccaaggctcctttgaggaaaaaatggcgagttccagaaactggtgaacctcttgtccctggtgtggcacaagggaagacatcccctggagaggacaagaggaatggccttccagaccctaagtctcagcagaaaactcccatctttaatggtatgcacattgttgactattttggtgcatagtttaaaaatattagttgaaaagaagtccctacatgtttacgctttggctctagaattctgtactatatagtcaaattctcaaagggaaaatgacatgggctatttgtgattgggcacttggccatgttgtggggggtcaacgatttattggttgaagctgtagattggacaactatgttcaacatagaatcttagtggacatacaaactttctgatgaagctagatttgatcatggtggggtggttactttaacgtttcttaaattcaacatggcttccaagctccaaactacaaacttgttaacgtgtatgcttgctgcaagttgtaactcaagctattgtgtataatctatatctgggtcactactgttccctaccttttagtttataatagctcgtcatatatgctgcaggacgaaagcttcgtgagattttccaattaaaacgtggatcctatgctgatcttccggctgccaagatttcagaaatgatgcattctaacagtttagatgtaactttccattgcttatgcttgttgaattgttctatcttgttgtttgctattcctttcctaacagtaattaccttctcacagaatgcaccaacccaatcccttcttagcgtcgttaatggcattttggacgaaagcattgaaaggaaaaagggagaaataccacatgtatgtctgtgtttctgaattgcatgctctctttttcattggtatcttttaaatctaataaatttatctacctcacctcagcgtgtagtgtacctactgaggaaagtagttcaagaaattgagcgtcgtctttgtattcaagcagagcacataagaagtgtaagagagtcttttttccctgaagcctatatatcctttagctaataaatgcaactcatgaatcagatgtctcttgttgcagcaaaatgtgatcattaagacaagggaagataaataccattcaaaaatcaaagcacttgaaatattagtaaatgggacaaatgaagaaaaccaggtaaatattcagtattttcattgttataataaattacataatttagaagttctcccccctaactgatgacattgtggacttcctttcttcagatggctataaaccggcttcagataattaaggttagacctacactgaaaagatttgatttcctacatttgctatctttatagtacatttgctatctttatattattgtaataatataaacaaatgaaatattaactatataatgtttgatcatatattattgctataaggatgatatttgatgttaattttgttaccgcctagaccggtagaaattatggcaactgttatatcaactatataacatattatatatttttttctgcattcaggaagagaagtcaaaaatagaagagaaaaggaaacttggtgagcaagatgttgctcggctaatgaaagaaaaagaaatttctgaaaacacaatagctagtcttaagaaagagatggaagtcatgactagcatgcatgagcaacaacttcagaaaatcgaactgaccgcaaagcaaatggaagaacatttaactaccaaaattaaggaggttgagtctcttttagtgcaatcaaacaagaaaattgaagaagttgaggctgcttccctgttaaaatcacagttgtggaataagaaggagggcatttttcagaaatacatgaatagtcaacaactatatgtcaaggtttgtttatctttaacttgctcttacttccttttgtttttcatcttatttatgggttattgcttgaaaatgacagggtttaaggatatcatcatggtctataaaaaatgagatgcatgcccttgaaatggagttgagagatgagatgtccaattttggtatgtgttgtataatctataaagtaaacatttacttgtatattttaacattgtgttgcttaaacttttgcaggctctggtttaaagtgtttggttgatgctgctgaaaactaccacaaagttcttgctgaaaatcaaaagttgttcaatgaagtgcaagaactaaaaggttttttactgctcaaattttttatagcttcagaatgcacctattgatgtccatttcaatatctgcctcttttaggtaatataagggtgtattgtcgtgtaagaccatttcttcctggtcaagataaaaaatcaaccactgttgattacattggtgaaaatggtgagcttttgatctcaaatccatttaaacaaggaaaggatggacatcggatgttcaagtttaacaaggtttttagtccattttcttctcaaggtatatttttttacaatggaaatctggtataagcttatctgtgtgcaaataaattctaatacttatctttcaatttacagctgaggttttctcggacattcaaccgctgattcgatcagttcttgatggattcaatgtttgtatttttgcttatggtcaaactggttcaggaaaaacttacacaatggtactaacttttaccgatattttactggctcagcattgttgttaacttatattgatcttttttattggtattgtactggttcagcatgatgcactgctactaacttttgatcacttatgttctattccaataattttgttcttagagtggacccagcacatcaaaacaagattggggtgtcaattacagggctttaaatgatttatttgatatctcactaagtaggagaaatgctttctcttatgaggtgggagttcagatggttgagatatacaatgaacaagtgcgggatcttctgtcaaatgatattgcacagaaacgatatcctttttcatacttaaattgtcatttctaattatatttctggtacctatgtttttagtttgtaagagaatggttgtgttctctttaacataaaaaaacacttggcatatggagcacctctcaacctaatggacttgtcgtcccagatgcgagcttacacccagttaaatcaacatcagatgttttagacttgatggaaattggacaggcaaatagagctgttggttcaacagctcttaatgaaaggagcagtcggtctcataggttgagtgactgataactgaagttaaactatatcttttttgctctcaatatgattttattttgaaacacattattctatgcagtattctgactgtacatgttcgagggttggatgtgaagaatggatccacttctagaggatgcctacatcttattgatcttgcagggagtgaaagggttgagcggtctgaagcaactggagatagattgaaagaggctcaacacattaataaatcactgtctgctttgggtgatgtgatttttgctttggcgcaaaagaatgctcatgtgccatacaggaacagcaagctaacacaagttcttcaaagctctttaggtaatcaattatttagttgaaaaatcatgcatgtggagttagatttatggtttttgtaactataatcttataaaataatctcttgcaggtggacaagcaaagacactaatgtttgttcaaataaatcctgatgttgagtcatattcagagactataagcactctaaagtttgctgaaagggtttctggagttgagttaggtgctgcaagaagtaataaagagggaaaggatataaaagagctgctggaacaggttcttgctttttatgttctgtctgactcatcattaactgaaatttctttgcttttgttttacataattgctgaactatttagttctaggaagaaggggaatccttatgtgtaaatttgatgttcatgcaacaaattttcttgcaaatactgaagtaatttctaattgaacttagagctctattttagaatgttgctgatgttttactcaaaagcatggccattgttctcaacttcatattttccacaaatttattcaaacattctaaagaatcagcagtaaaacaacagcaatttccaagctattcctgaacgaatgttctcccaatagtaatacaagttatcatcaatattaggcttgatcctgaacaaatgttctcccaatagtaatacaagttatcatcaatattaggcttgagatacagaaaacctgctgcaaacaacctttttttttgtctagtatgaaaaaaatataaacaaatcaaaatggtgacttgttgtgatgttctatgtaattattcaagtctatatgctgctagtggtgtaaatttctagttgaactcatgttatggtttgtgcttgccaatgagacatgtttctgttataatgacaattccttctttttactataaatattttgtcctcccaacttgaaaagtcacttcacatattttgtccaggttgcatctttgaaagacactattgtacgaaaagatacggaaattgagcagctccaactcatgaaagacaaagtcaaatcgccaagttttgcagtcgatataaatggtgctagcatgccaaaaaattctaactctgacctaagatcagtattgtcaatcacaacaaaccaacagagccaactatcagatcctcagagttatgctgaggtgaacagagatggtggacctacttcatacactgacattacaccaacatgcttggatgaagcagattttgaggacaatgcatcagaagatggtttctctggaggaaccgactattctgttggctgtgctgccggtgccagcgttttcccaaattcctgctcagatagaaccgcagatacctccatgtactctcatctccctatatcacttacaccaaactaacttgcagctattaattgttctctcattacatttactcaatttgttgtaatataatcttattattctttatgcaacattatcttttcatgttgtgatgaagaagcattaatttggtacctcctaatgattgcagtaggagaatttcatcacgaatagctcgattcagtctcacaaagaatggacaaccagcaacatccagaccaaaaccaaaggatactgctccgaagactccaagtatgtactataagccactaatttacttcaacagattggtaactattactgtactgcctacacagttttagtatatgtgctcaacgagttcaaattatcatgccaatatcagaagacacttgccaactttgtcttggttttcaaaaacaaatggtaattttttgggaatagaaaggtcatgttgctccgtgcaaataatttcatacacatgtggttgctattattgtaaaacttttagttttttttaaagatatttttcaaatttttagtgcactgtccaaatagtttcatacctgcacatgatgtaattaattatccttggttattaatgagaaatatattgattatcagatcaaacgagagttcaatcgagccaattgataggaggctcttcactgagggcatctaaaaggtggcagaagtagagcacgctccggttgctcagttgtattttgtatgtccagaatgtgaaaataggcgaagtagctgtaggagacaatgtacttgtaagttgtaactctacagatgtgagagcattctgctgacgaaggacgagcagctgatgactcatcctttgctcatacagatcaaatatccaggaaaggattcccttttctgttctccatgtttcccctgtacttcaatttttgtcatggttactgcatctctggaatcaaacgtttccaattttggaagaaacactggtattttttatttttattttgctctgagcttctgacgtacttcgagcatgctcgattctttgggcaagccaaatgttactgggcatggaagtctgcgtggtgtaatggaagagagacagtttggttctctctctctcgatcaatggatgcttgcatcaccctcggaatcaatggtgtaaagcttcgctttggtcgccctttggacctaagttttggagtttgtcgattctgatagcaaatcaggtctgaaaaaattataatcgcaactgttttaacaaaatcactgccgctgtttcttttttttcgaacacactgccgctgtttctgtaattactgtaacttgttcagatgagaacggtggcgatatcgaacttataaagagtagcacggaaataacgagttgtcgccgggcaaagtccaaatgtatatcgctggagcactgaagatcccttgaagaccagtgactactgaacacttgtgcaaaagagctaagcagaaaaactgaagaactgaagccttggtaaaaaaaaaaacttatgcaaaagagctaagcagaaatactgaagaactgaaccattggtaaaaaaaagaaaacacacaaaaacacttatgcaaaagagctaagcagaaaaactgaagaactgaagccttggtaaaaaaaaaaagaaaaagaaaaagaaaaagtgaagccttggtaaaaaaaaaagaaaaatgcaaaagagctaagcagaaaaactgaagaactaagccttggtaaaaaaaaaaaagaaaagaaaaagtgaagccttggtaaaacaaaaaaaaaaggaaaatgcggtgagcgtggatcgaacacgcgaccttcagatcttcagtctgacgctctcccaactgagctatccccgcccttggttaattaatgatctactacaaatatatctgtatccttaagctatctcatataaacacattttacatatatcttcaagtagattatgtttatgttgcaatgtaattttgtgtttaaaattttattttgagagattgaacaaatcctgccattctgcatgcataatgaccccgtaacttataaacaagaaaagggcaaatcatgtttgatctttttaaaggggaacttacaaaaaccacctcaaatatcacactgagttcgagggaagaggattatctgacttatttccctctgactttgagtcgcttacgtgtggacccactaagtagagggtccatatgtcagtgacacaagttagagggaagtaagttagaggatctcaatccgagttcgagatccctgtaaaaccatttgtagcaatatcctttcccaattgtcactgcttgcacatatgcgatatccatcaatacgatccgatgtctacgctcaagccgaacctgatatgcaaacaaacagggttagcggaatcaggaaatgtagtaattcgagtaagtccaaccttcaaggaagaaggaaggcaatccgtcgcttgtttgttgcaagttctttccttttctctttccttatgtgttatatgacttagcacatcttttgatatacatggactcatcttccggcgacccccatctctaagagctgagactcgtgattaccatcgcccaacaacatgctggatgccagatgccgcaatcgtgccatcgagcctacccaatattactggtgaccacggctccttggctagtactccctccatcccaaaatataataacttttagctctcaagatttgtcccaaaatataacaacttctccaccaacattctcttcccaaccaatcacaactctctaccattcacttttcccatctacttccactactcaactaatcacaaccctccatcattcatttctacccactttattaataactgtgtcctactataaaaatgcttatattttagaatggagggagtagtattcaggtgagcccatgtggggtttgcggctatgagaacgggtgggcataggtgaattaggaggagggagatttgtgataaatcatcttatcgggagtatcgaattgagggtgacatttgggatggttttttaaattttcctttttaaacaagaaatactacgttttaccgttgataagtgattgactctacgaactgctatcaacgaacattaactctacgaaataccattaccaaagtgttttttcttctgtttctgccatcttcattaagtctcccattagatacattccgttaacacgtcatacaaaaaatacattttacctatagaaccatatctcagagtctcagagtaggaagtgcttgatatatttgaaggggtaaaatggaaattttgcataaagttaactaggtgcatttgatactaatgctagtggagttggcatggagaaaaaggaaaaaaaattaaaacactcttatgtgatgttataccataaaactcccgttctcgagtatcaaacattttctcctcataaataggtctataataataatcttatcatctgcaatgcgtcatatgacatagtacaatgtatgccttttgtgcatttctcgaacaccaagcccgtctagctcagtcggtagagcgcaaggctcttaaccttgtggtcgtgggttcgagccccacggtgggcgtccattcctttttttttctctcgtctccactccactggttcggagaaaccccatgcttgagctcgcggacagctcagacggagaagatcctcctcactttcttcagtttcctccggcacaacgggcagctcccgtcctcctctgccaccctgcaaccacagcgtttgcaattttatggtgataaggtttacaaaccctgaggttatcgtaattatcacggacgataaccacggttcatggtaaccacgataaccgttaataacgataatctcacttaggccgagtttagtttcaaacttctaattttttccatacacatgaacttttaactttttcatcgtttcaattttaatcaaacttttaattttagcgtgaactaaacacacccttaaaacagtttagtacctcgtgccgcacgcgtggcaggtggcggagtgcccgcaggggaggaagaagcagtccctccgcgcgtcgcagcacaccacgcataggtgccgcccctcgccgccgccgccgccgccgcctctttcctctacgtcgtcgtcgtcgtcttccccgtcgccgtcgtgcgagacggagtcgtacgacgaccccaggctcgcgtcgtcttcctctttgctcgccgccgccgccgacgacgacgacagcagcgaggctctcgcgtctcctcctccaggcccgggaccgaacagcatgttcagtatatcgtacatgatcagcagtgcaacagccaacagaactgcaattcagagggattaataatttagtgtgcagtcaatcctaccattaatttgagaggttcttcttgtaggtgattattgagttggtacctaatccgatgatgtacactatccagcgaggtccatatgacagcttcacataatgaccatcagaattcagtccctgaatgaaattgtgcactagactagtcagtactgcatccggctaaagtgagcattgtacagtatacgagaggaatctgaagatgacagagaagacgctttttgtcacctctttggggccggatgacagaaccacaacgttttgtcctaaaaacggcagtttgtaagtgcaaagagagctggccggtgagcatgtataatctgctgcgctggtgttgtagaacaaggtcctgattctgaattccagtagcacctgccagatgaaacctctgtaacaaggctgaagatgccacaaaaacattttggaagctctgtcgctcttgacacggggtaatttaccgttacatcctgattgttaaagtttcccaaggcaatgaagtactctgaagagagattgatagtctgcttgattgttccatttcctgtgattacacatcctgatagcattagtatacggattctcccggggtactgcaagtctgcaactgattcttagtcaatgagatcatgcttaccgtgcaccaagtgccaagataatgtggtctcatttgctgatggattctcagcccattgcaagaagctttctttgcctatgaagcagtgaagcaccaacacgcaagaattttaatggtgtcagtgaaactctgttactgatatgaaaaaatcacacttaaacacacttgttcatatatctgaacctttcttacctcgcgcaatgatcatgcagattggacgagacgattcagtttcactcctgacgctgtaagctacttctatctccgatcctctgttaaggaaatacacccattcctgcagcacacaacatggagtatagtaagtagcaactaatcttcaattctgaaaataactgacatgatcatgagttcagagtttcaaacagaatcacacagatgataacgcagcattaccatgtgagaattggctggtacgacggcgcggcgagcctccgaccaagcggctgggacgccgagaggcggagcgaccggcatcccgtagagcaccaacccattctccggcgaccctccctccgtccttgcctgcaagagcgagtgcacacattaaaacactcgtcctgactgagctcgtgcagagctacgggaggatggtcaccttgatgtcctgcgcaaagaacgagttcgtctccacaagcctcgagcaacctgagccgatgacgactagctccggcgagccgtggtaataccccaacatcaacgccgccggcgctgttccatcaatgtaaaggatcaaagcgagttatagcactgagacataggccgtgttcaggtttcccagcacgcaaagtgaagctcgtattattgcatgattaattaagtattaaataatatttttttaaaaaatagattaatatgattttttaaaacaacttttatatagaaagttttttataaatcacaccatttatcaatttgaaaatcgtatgtgcggaaaacgagagaggtgggttagaaaaatgggaggaataacacagccatattatgtgttgtcgatcagagagattcggagtaactgacccaagaaacagaaggcgaggagggtgacaaagcagagcactgccgccgccatgactgtaaagtctgtacccgtcgccggcgctggacagcaagacgacgcgtgagagaagctgtgaatacctgaacggatcacggccgcgggggattttgtggaatcggtgtcttagctgatgtgtcctggttcggtagctggctcgtgctccaactaccattccacctagccgaaagaacagagcagtagttagttgagacttgagacagaactcacagaaggcaattcgacacgagttagcgattgacattaggcttattcattttattaccactttatttgggctttggaagtagagaatagaagtaacctttgacgattagaagtaactatacagtaacggaaaaataactttaaaaaataattacagtattacaagtacattactagaggaaaataactctaaaaaaatagaaataactttacatggtattaaaagtaactttaaaaaatagaagtaactcatgtaagaagtggctacactggtagaggaagtaactctcaagaaaaatataagtaacttttcatgtattaaaagtagctctttgaaaaaaaaatagaattaaacatcctgggaatacctatattgctagatgatttaaaaataagaataaaatttagaagtagttatgatttgtataagtcacttttaggtcttattgaatttactatcataaatatctgagaagtaaattaatcaaatctagaaataatttacaacaaaagtaatttgcgtatataaaaaagtaatttacaacatatatatttatttttatcaaaatataattatgtaagatcttgttataaagatttaattaaagaatacaatgatactatcagagtgtggatccagtatataatttgaaacaaaagtttatttgaggcttagctattatgactattttttctttgttgttgcatacttgcatactcggaaatacatgaatgctaattagacataactaatttcggaaagtgcactcggttaaacatcgtattaattatgaaagcacaagctttgtagtctcgtccatattttttactttgaaatttactttgtgatcacgatcacttgtcgagttgaccccctcatatttaaaatctggcttcaccactgtacatgaacagtgtattttcatgcttaggcatgatttagtttccaactttttctttaaacttttaacttttctatcacatcaaaacttttctacacacaaacttccaatttttccgtcacatcgtttcaatttcaatcaaactttcaattttgatgtgaagttaacacacccttatttcctttaagaagatcatctaacggcttcgatccttgatcctattcagcattgcttcaaatcatttgtgcagaactgctcagctaccactttttgatgaggccttcaaacaactcttgtctaaaagaaaaggagcagctgatggagccgccgtcgccggtgcccaacagtacatccttctaaaatccaggacgacgcatgaagaaatcgaggcaagtttccttagaacacggcaatcatgctgctccgcgagcgcgatgaccttccccactgtgaacgcatcaatgtcgtacctgtcgtcgccgtcgccggctgcttgttcctccatcttcttcttcgtcgtcgtcatcatctccggcaacgagtcggtgtacgcgaagaagagcaacgccttgaacacccgcgcctccatgccgtcgacgcggacgatgccggtgctttggccgacgacgacctccttcgcagtcgttgcgccgaagagctctaggtcgaagacggacgaccgggcgtcgagcacgcaccggtgcgcggcgaacctctcgccgccgacctcgaacaccacgtcggcgccagtttctccgcggaggaggtcgccgaggtgacggtgcaggtcggacggcggcccgtcgacatcgacgctgccgggcgccacttccgccgggcggaactcggtgacgacgacgtcgcatcggacgatgaaggaatcgttcttcagatgcctcctcctcgacctctccaagattctcctcttgacgaaccggctcggcccctcgccgcgctcccgctcgtgaagctcgtcaaagacgacgacggcggcggcggcggcgctggcgcttgctccgcctccttctccgcgtcgccggcgaaccggaaccggtgctgcgcgtacaccggcgcggcgacattctcgtcgaggatgaggtcgaaggagatgtagtcggcgcagccggagttcttgccgttggggtagtaactgatgcgccattgatggcctccgatggcgaacgcgctcgacgtcatgtacactccggtgggtatcggcgtggtggccatgtagccgtcgatcgtgaggaggttgtacccgctcgtgacgttggcttggacgatggaggcggatcgcgacgccatggccggcaaaccttggtgtgttggaaatgcaggtgccttcagtttactactccgtcatcgtatgctgatcggatcagatagttaattaggccctctgatcttgtccgaatctgggtctgtttgtgcatatcgttggatcacgcgtacacaaggacgaagggaagtttggctctgaacgaccaaatgggccgtggaggctaatgagccggatcaagaaacccacaccagcaaattctccctctgttttcgatggttttccctgcatctgtacaactacacatagcagtcaaagaatgactctaaaaaggtgataaaatacaggcggtttcatgcgcctatgaatataacaaaatataatactagctacgattttatccctctaattcatctctgaatatgttaaaaaatatgtaagcaacatccatatctcaaacatagagaaattgttggtagaaactaattaatcaagcacgcaatatgcacaatgataggtccaattcggagcccacatatataacacggctataacactgtacaacgagctgctatctctgtctcaggttataagatattttgactttggtcagaatcaaactacttaatgtattcaactattgattggatgaaactaatttagtactgtaaatattactatatttatctataaacttaatcaaacttaaaatagtttgactttgatcaaagttaaaatgttttataacctgaaacggagggagaagtaactttcagagcatgccaatcaactcctccgtgatgaacgggcagctcctactcaggtggtagaaaccatcagtggctaacaccgccattagattgtctggaaagctgacaaaatctaagcaagcctttatgaggccatgggccatggcaatggtactggtcaaccaacgccatgatggacgccactgtgcccacgtcaatgtacttgcacaacttgctctcgcatatcagcttgagcctctccatgccgtacacttcggctgcgacaagcagacgctggcatatggcttcttcctcctcctttctcatctccggcaacgagtcggtgtacacgaagaagagcagcgtcctgaacacctgcggctccatgtcgtcgatgcggacgacgcatgcggcgtcgccctctttcatcgcgccgaagagctccgccttgaaaaccttggaccgcgccgcgagcacgcaccggtgcgcggcgaatctcaccccgccgccgccgccgacctcgaacgccacatccgcgtccttccctgcacgaattaggatttaggagttcgccgaggtgatggtgcaggtcgggcaatcggggaggcttattagcgacgacaaggctttggggcgccgccgtgtcatcgttgacgacgacgacgacgacgtcgcagcggaggtgaaggaatcgttcttcatatacctcgacttctccaagacttccctctcgatgaacttgcagcaactccgccactccggtcagcgtagttcttgagacacgtcgacggacaaggcggcggcactgggtcagaaatgcccgacatattactacgaatatttggatcacataagtaaacaaagttcctttgtttctgtttcactattctgcttaggaaggtacatgtcatttgctagcacatgtttgcaatttatctcgtatggagcaaatagaaattaacccgaactcttgggttccagagcaccataaacttcattgcatatgtaccgcaatcaatcctccaaatgaaaaatcatatatgggaaattaattattcaaatgggcaaccagtttcatgcacaacataggctaggtccttccatctagtatttgtaaatctattttctaaagctgtgtcgaagcaagatttcagcaataataaaagggggtggctgtcaagctaggaaagtggatgggtttggagacaagaaattttatacaggttcaggccttcttattcaagaagtaataccctactcctgtccggggatgattccgccgagtgtgttattaattgtatagactgggaaaaagaatcgccttccaagaggcacacggaccctccttatataagggaaggagtccgctttacaaaatacagtccatatcctaacggaatatgggattatagataaaatacaatcgtaaccgactaagatcccgggtatttccttgacatacaagtttagaacctaacccgagtattcatagagatattccatctatatttggtaccgtatatccgactaaattacaaccgtcatgtcgatatgggatatccataatctccacagtagcccccgagaccttcgtagttgacaaaatagccttctcgaaacaaaaaacagtagtccgagtgcttcaattcaacttgctccagcttgccgagtactaaaaatcaaaaactgtgaagggcgaaaataaaacatggtgcatcgagtagatgcacctaattaggtgtagcccctgactatgtgattagttgaaaaactaaacatatagtcaagaaccgagtggttttatagcgaagcacgcatggtacttagtaagatacccagccgactgcttctcaacttgaatgtatcaaggacaaaaaatacaagaagggccgagtgataaacactcaaaggtccaaaaatagacatgtttgataggaatccgagtaaaaatctcataaaatgacccaccaaacaggatagaaaatcatggtaattaatgagtccaatagcctaggctgtgacccttaccataaccaaaataagcatataacatgctaaaagaatgactattaataaaccagtcatctcaaatcaacccaaacagcttttgcagcctaataaagcttacaaaaaaatggtataacacctttctgtcaggcacctttttatgcgcatcataataattccaaagaattattgaatcgcgttaaaaaggattttaacagcattaggccacaccatcgtaaacacaaattgccaaagcaaaaagtgcctaagtccctagagatcacaacagaccacgctgattatagcattgggctgaagtactgtacaggcccaggcccattagtgctcccgataccctaataataccgaagtaaaaaacgtctcttcgtcttccccgccgagactctcgccattttccccatttcctgctacagtgcaaaactacgccgggcaaactagggttcatcaatccgctccaatccacactcaaaaacttcacgaaatttctccctgcatccaccgctccaattccccatccctttccagccgtatctcgaactaaatcagaccatccatttcacattcatggcggaagaaagagaaagcttcgagagtcagtgggcgccctccgatgtgacggaagacaatctgaaggagatggtggcgcacggcgttcttccagcaaaagagatcatcgggtggcgaccggcatttggtgaggcattcccgacctccgatacacacgaaatcgtggtatttgctcatttcttctacggtggattttctcttccaacctcaagatttttccggggaattctgaacttctacgggattagcttgcatcatctgaatccaaactccatagtgcatattgccaattttattcatgcctgcgaagcttttctgggcattaggcctcatttcgccttgttccgctgcatcttcttcctcaagccccaaccaaacaagagtaaaccatgcatcgttgggggtgctggtttccaactcaggggaacactaagccaaaaatacttctccatgcccttcaagacctcaaataaaggctggcacgcaaattggttttatgttcaaaaccccgagcctgttcttctcgagtactcctgtcttcctccagtttatcgggatacttggaactcactgccaatgggagacgaagctgcacaagcagtagaactgatggagaggatgataaagctgaaagaacagggccttcaaggagaacagatcacccggcactttatcaagtgtcggttagctccaatcaaagaaagatctcgcacagccttcgaatttgacggcaagcatgacccaaaccgtgaagatccagattctcttgacttcaaggtcatgaaggaaaggatgtataagatcttctcaaacgccatcgttgtcagctacttacacttgttgccagtcgtaccgttcaatgcattcaatcctcctccaccggtacgtattcatacacttcaacctttctcaaaacatgatcttgctttcttgttgaatcagttaacaatgaaggatattacacccaggaatttgctttgatgaagtcggatcccccaatcgctcaacgccgatcgccccgccaccaaactgggcaagggagcggaggaccaagaattcggtctgaaactcaaccaagtgcttctgatccaatcggccagtcagattctcgaaagaggaagctggttctaagtgacgacgaagccgatgataccgccaggaggcctggagaccgagagacaaccaagaaactaccaaagcaggctactccaaggtagaaaacatccagtcgccctgtgccaaagatcaggaagtcttctaggtgcaactcatataacgatctcttttgcattgatgcgcacccattgcggcaataatactgataatcaaatttgcaggaaaccatctgatatagatccgtctgggaaagactctgacccgactaacgtggacacaagttcttccaaagaaaccgagccaactgctgaggatcatctgagtgacaatcaaccggcaaccgataatgtagaatccggtgatcaacccccgactggaatccagtcggccgaagccgaagccggagttaatcaggagcccccgactggaaaccagtcggacgcagggccaagccaagagattccagaagtcgaaacccaagcagacaaccctcgtggacaagacgccagcaatgaccggagatctggatcccctttaaaagtatccgaatccactcgtcctcgtccagaaatcattacaggtaaacactttgtccgaaaccatgttgacccaaataactctgatcgatcgtgtaacctttgtcaatggatgcattaggaccaatgatcggtgatgaagaagaaattccccgtatacaaacagccgaagattcgtgccctcctattctggtcaagtggtgggatgacaacttgcaacctcaaggaattgtaataaaccggcaaaaagaagacgaagaggtatgcctactgaaaaaggcactcaaccaagcgactcgcattgtaaatgtaagttccttgacgcctaacctcagccatcttgtttaccgtctggctcgagcgctgattaaactgctccgcagaggattcatcttaggaacgaggcgaaaaccgcaaccctagagagactagttcctcatcttggaaccctcgaagccaccaggagtcaactgcacgaggccagagaacttaccaagaagaatgaacacgatctgagggatcggattgctgagctccaggagtccaatttcgaactgagtggctcatcaaaaggttcgcgcaaactctgcccaactgatttgtgctgttatctctgtaatcttgattaaccgaagttaatgtagtgcaagctgccaagatatctcaactagagaagcagatccaaactctggaaaatgacaaggcagagctggcaagacagagggattcggctttaaaggaggttgaaggtaccaataatcaatacctcaaaagccattatcttctacatgctgattcattaatgtgaatctgttgacgcagaccgcaagatcaagtctcaagcacaatttgatgtcttagttgacaagatcaacaagcttgaaggagccaaggataaagtcgctaatgccgctactccacttatccaggccatgttcttcaataacgccggttcgagtacacttgatgctgccgaaatcttcgacaagctgagagtcgctacagatacttacttcaagaacatcaaagaagctggaagtatgggagcaagtctggcattggcgatgaccaaatccctttatccaagagttgacattgatgccattgatggctttgtagacgggacgagcgaagaagctgctcttgacctcatcagtgatgcgtagaaagcggctgacaagattgctgctgatgtagttgagagattccaagatgtcgaccttcggccaactgggtctgataagtctaatgatgaaaaaactgatactgattgatataacaatgattttgatgatcaatgatggtggaagctcaatttgtacaatactgatgaatttatgctatgcttggtgttccatacttagcttctgatttcttaaaagcctttgtcaagccttattgagcctaaaacccgcaaaagctattaaaaaccttcagtcctcattggctaagtcgaaagaccaaacagggcaatgataaatcaagtaagcaaattgaattgataaaaatcacactccattattatcataatggccccctgactgaaaacttcaaggaaaaacttgaagttagcagtcaaataggaaagatacaagcgaaatgcctaagcataaaatcgacgaaggtgttcaatattccaagaattgttgatgagagtactgtcttcgcgcttgagtcgataagaacctggccgagtgacttcagcaattatgaacggttcttcccataagagagataatttatgccgatcccgtgttgtttgaattttcctcagaaccaggtcgccgactaaaaaggctcgcgatcgaacattccgattatgataacggcgcaatccttgcaaatatcgagtcgactgaattaaaactgcttctcgggcttcttctagtcggttgatgtcgtctactcggccctcttcatagccctcctcgttgaagttccgaaatcgtagtgattcaaattccacttcactcggcaacattgcttctgcgccataaaccaaaaagaacggcgactggtcggtagcccactaggagtagtgcgtaaagaccaaagtacggacggcagctgatctacccacttgctagcatagggacgtagtcggtcaaaaactcgtgctttgatcccttgcagtatcatgccgttagcgcgctcgacttgtccgttactcatagggtgtgccacggaggcgtaacaaattttaatgccgaagtcttcacaaaagtctttaaatgctccgccagtgaattgagtgccattgtcagtgatgatcctattaggtaccccaaaccgatgcacaatgttgatgaagaaatctctagctttatctgctgtgatcgtgatgaccggtttagcctcaatccacttggagaatttgtcgatagccacaaagagatgcgtgtaaccgccgactgcccttttaaacgggccgaccatgtcaatcccccagaccgcaaatggccaggacaacgggatggtttgcaactcttgggctggcaaatgaatttgtctggcaaaaaattgacaaccttcgcatgtccgcacaatcttgtcagcgtcggacaccgctgtaggccagaaaaaaccttgccggtaagctttgccgacaatggtccgtgcagcggcatggttaccacaaataccaaaatgtatatccttcaacaactatatcccttcttccaaagacacacagcgctgcagtattcctgacagacttttcttgtacagctcagtctcatgaataatataaagtctgctgcgcctggaaatccgctcagcttcatttttgtcttgaggtagttcttgtttgctcaaaaattttataaacggttctctccagtcggcttcgatcatgcttatgccttgaatatccatggcttcgactgtctcttttctgggcacggtcggttcgtaaaggtgttcgacaaacacatctgaaggagctgcttcccgttttgaaccaaaattagccagtctgtcggctgcctcattgttatgtcgaaggacatgggtgagctcgagtccatcgaatttattttccaacttgcgtacctcttgtcgataagcggtcatattatcatctagacatgtcacgcccgaaaattcacaagtaatttccgaacttatttgtgcataaaatcctcgtccaggaatcagccgaggtacacaaactgacaatttaatatacagattcatcaaattaactaaaacgataaatacttacttaagaggcacttagtcctcaccaagaagaaaattgcagcggaaaataaaatctagcgaagctccggctccactcccacaggcagctcaactggggtataagccaaacgtcttctccttcgcaacttgtcttcaactgaggttgattgattattgcaaggtgagcatatgacatactcagcaagccacacagcaaatatgcaagtgcacaaggatatcaaaggaatggcataatattggctcatttgcaaaagcagcatttagcaaaatatttaagagaagtaaaacagtggagtaattaatcagaaattttaatcaacactgaacagcacacccatgctgcacaggcccaaccatcctgaacaaccatacccggctgaacagatctaactccaaaccaggagctaagcaaattattatcaggtataacatccataattattgtgagaggtgtgagactaatcacgaaaaacattgctcaactcgcccataaccgcgggcacggctattcgaatagttttactctggccagaggtgtaccactgtacccacaagacacagcctcaacatcatgtctaccatgcgtcgcgatactggaaagtacccgaatagaggctgtgacaataccctctgcataacacaactcaccacagtgcaccattcctggatcataatcacccccttataaaacaaggcatggactccccagcgacccccgtgggcttatttccgccacttctcagtctggtgctccgcaatgaaccatgctatacaaaaggtaaagccgttgcccacgctggcttgtggttggcacggttaatgtttcacaacagtagctcgcgaaccggtccttaattgccatgagcacgactctcaaaaccatgtgctcacaacccaccattatcaagttttagttggcaagtaattaattaaccaatcacgattgaccatcgtgagctaccattaaaccatcattaaataataatgaatcataagttatcccaatagtgtgctaatgtttctaagcatggctaagcaatcatatctaatatctagttgaaccaatatatataaagctcaactagtccaattataatcacccaaggtatcaaggaataaagtaatcgagaacaaaagggccataacaaagaataggttaattccacccaatgacattcgaaaataaatgcacagttgaaataaatagagaatttaaatataggatcaacatgctcaaaggattgtgtttaggatctgtgtgacttgccttgcaataatcggtcttcaattaatcttcttgaacactcccgacgcactcgcgaaccttcgcaacgacggaaacgacaagctatcacgcaaaacgaggaaaaagactaataaaaaccaaataaacaatacataaaaagtaaacaaacatgtagatcatatttttagatgaattatgagacttgaacggcctcattctgacttcaaatgaatttattaagaattttacaagattaaatctaattaaagcccatttaaaaagaattaaataaatttaattcaatttatggacaattttaatatgtagatctttattttaaacaacttttgcaacttgaaccacattaaactgagttaagatgaattagttatgaatttttaaagattaaatcggattaaaacctttatatggattttaattgaattatgacgcaataatgaattatttttgaaaaggaaaagaaggattattgcgtcagcggctagggtttcggtggaccgggcgcacgggcgacggttcacgggaacggacggccgagatcaaccctatccaaaacggacggctgagatcgatcggtccacgaccggctcacgggaaaagggacgatgacgccagcgatgacgtcaccgacagcggcggcggctcggcggagcggacagctcgggcggcgcacgctcgccggcgaacggcggcacttcggcacaaacggagggcaccagcacgtagaggacgacgcggcgaactcaccggtgaccaaaacggcggcggaagaccaacggacggcggcggcgacgaggaggaagcggcgaagctcttcgggtcgacgacggcgacggcgctccgacggtcttcggcggcggcgaagcggtggacggggacagcgatgacttggcgaacccgatggtggcgacgtgtcacgcccagaaattctcgaaccagaatttctaagctgaatgtgcattgaatccctgtccaggaccagccagggtacacaaacgacaattgttgacatacagatccacgtcttacaaaaatagaaaagattacaaatgcagcggaaaagataaaagcgagctaaaccgggaagcttgacttcagcagcgggcgactccactccacagacaatccttgacggcagcgacgaaaccaaatttgacaaaacagctccaactaggaaaatcttcagctctggtgtgggggaaaagagagcaagactgagtactacccactgtactcagcaagtcataccggtagaggaggtatgatgcaggatataaccaaaggaggctagaggttcttttgcataaagctagcatttaaaagcagtagttgaaagcagtaaaacagttgtagtaattaatcaatattaannnnnnnnnnnnnnnnnnnnnnnnnnnnnnnnnnnnnnnnnnnnnnnnnnnnnnnnnnnnnnnnnnnnnnnatctccaatnncgcgg

SEQ ID NO: 59837 - DNA, 27226 bp, Oryza sativa
aattcctgcagccctgagcactgcctttttgacaagacaaactccaaaaacacagcaaaaagattatacagggcaatatcagcctgttcaagcatggagcaaccaataatcttcttgccaccatgatctctgatggaaatattacaagcagaccatctcaactactcctaagagtaacaagtaacagtagcagcaagtgcagagctcatccggaaacaccatctcaactactcctaacagcgcggggcaaggcaagctagagaccccccgcatatttcgtattcagacaacacaatagcaggcaggcatgcatgcatgtgggtttcagcacttgagctccaatcctctgaataaaatctaccggaaacaaacctctaatcgccccccggaaggatggacccgtcccgaggagaaaaaaacaagaagaagaaaaacccaggatttacggattggattttcttcccccctaacaacaaacagaggatgaacaccatcaccaccaccaccaccaccaccaagcacggaggaggatcaggagagggaaataccttggaggcggcgcttggtcggtcggagagggatcggaagcggccgccgcgcggggtggagagagagagagaggggggagaaggggatagggaggaggaggatgatgatgatgatgagagggagagatctcctcctccaatggtgcgttatttatactggtctccgttgggacggaggaggagaggagcggctttattttcttttcttctcttttgggaggacccacacaaatctcaagattttgatctccctttgttgcttgaaaaggcaaaaagtttgtactactaaattgtttatcattatcatatccttggttttttataaagggtttatcatttccttgttgataagagatttattagcttccttgtttagctatgttagaggtgtttcggttttagtatgcatgtgttggctagtgaatatttttagtgtcagttttatgtttacattttataaagtggtcatggctataaatttttgctacgaccaaaatttttgaacgtgatagtactgtgtagtattacgattctggtttaccctatacgatagtgcagcttggattagcttcatcaccaacgccttcagtatggtgacgtctataaatttaaatttgttgaccatggggaagtcgctcgcgtttgatgatattgtttgctccgtatagttatgccatctatataattctaacggaaaatttataaagggttagcctatatttatatggtacgtcaatattctctagaacatatgatttaataatagaaaatctacgctagtataagagaagtgtaaaaccacatcttagctcttacataatgggtgtgttcggtggacatagctgcggctgtacagccacagcatttacaacaaatgcagtaaaatttgtaaagataatattgtactgcatccagccacattcacgactagttgcaatttagcccaagccaacaagcccaacatctatcacacgtcctagtgatatgtgaaaaaaaaggagacgctaaaaattgcgaaaaaaaaatcggatgagtaccgaaagtttttcttgaaaaagaattatggttaagagctttaattattttccgaaacggaaggagccagctaggctcctccaatcaaccgtggacatatgtcgtccgtccaaatatcattaatccctttctcgaccaaaaaaaaaagcattcgtcacagtgccaacactcccatccagctgagtagaaaagaaaataaaacaattcgtgagtctccggaaaagaataaagaattaattgtccggaaaaatgagagagaattcgtgagcaaccacccctctggttgactttccctcagagcctcctcgggagacgagccaggcaggcagggtcagacaggcgcgtgcgagcgagcggtggagacgggccgggctgggccgggcccacggggcggaagtaacgtgacacgaggtgggcctcacgtcggccggcggcggtcaaacgtgaggaagcccgtgcgcgtgcggcggcggtgggtaggtggcgctggctggtgcctggtgcctgcctgatggagtggtgggtgtgggtcagctcacgtactcattttgagttgacgcgggtattcaggttacagagaagtttaatagtatagtccactactggctccaagtcatctagacaacgtaataaccaatttatacaatagatgcttactatactattaatatctagtcccacctgtcatacttacattacgtcttggagtccgtgctgcagctggttacaaatctgtagcccgctgctcttctctcttcctttatatctttaaaatatgcttatagctggcttatagcctgctattgtacctgctcttaatgtatcacgtcgctgttaacttttcacgtaacgtttaattattatattagttaaatatttagtgtaaatatttaaaagtataagttaagagtatagtttctttcatgataaaaaaccataacaaatagatgatatttatataatctttttaataagacaaatgataaaaaatcacattgtgaaaggggctgtagcctagtggttacaagagactcagtagcacctgaggtcctgggtttgacttcttatgggagcgaattttccaagatttaatggcattgtgcttttaatagtaggtgacatatcctcaaggatttgccggcccggtccagttttcaaaagatgcttatatgggtagggttaaatggcttcattaaaatgaaaaactagattgataacaacattaactccgaaggcaattagttactatctacaggagcgagcagaggttgacaaagctactccctccatcccaaaatatgaggcacaaccacttttttctgtctcataatataaggcgtgcgtgtatacatgcatacattaattattccaatcacattgcttgaatatatagatatgattcaatcaaggaggtgattaaattctttcttggtctttgtgttaggagtagttgtaccttaggacacccacaatggtaaaataaggtgctctctataaaatatgtacatctcagcaatagactagattaatagtaaaccacctcaatagtatgtctacatgggtatctatagctctctaatccattgcctcgtttttctctatagactatctccaggttagtagatagctttgcgcgctctctctcttcatttaatctcttccaagtagaaaaatatgctgacatagatctcttgtagatagcctatagataatcattgcgggtgcccttatattttaggatggatggagtaataaaaataggaagaaaagaccaccgaaactgaggtaggatgaagagcattggcattggcaccgattagattatcgtgcttggtggcgaagaacctcatagagtctgcggtgcaaggacgctctgagctcgcattcatcgtcacgggcattggaagaattgttttcagggaatagggaagtgatcatcgcgaagattcagcgaaatcaaaataatgttagccatactctagctaatagaacccggtgtgaatctcttactgagttctggccggatgataaatgtaatttcatctcacattttgtttgtgaggacttatttgccacgtctaaagttttttttactagttttgggacgtgctacctccattccatatgaattgggacccaccttgttgattcctagtaaagtttttgtcaaatatatgtactacaacttataaattggagttataatactccctctttcccaaacataattatttctctattttcgtaactaaaaatcattatattttaggatagaggtagtatgtgtttaataaaattagagtcaaacactattcttgctctcttttaaaacatacacacatgttataaatgtgtggtgacggtagcatatgtgcgggtacgattggtcaacggcctagccggtcgaggatcatgacacttcgtcgattggtcaacggcctatattaagagaggagcttccataatcaatgcttcgaggatgtggggatgttggcttcaactaaaacctcgttaataaatattgtgtctaagtatcgtcatgtttagattttttatgatgctctttcacgttttgatctcaatgtaggttttttttttaacaattcaatgccacaaatgtacactgtaggagaaaaattttgagtgctaaaactgcacttaatataggacagatatggtatttaagtatatatcactggaatataatgcatttactacttcatggagatgaattactaactgtaagttcgtgggaaacttgttttcacagttgctgccgactgggttaaattagcccatctggggtttatatttagtactactaccagcccagaatctcgcatgccatagagccacttgtcatttttgttcatcctaagtctcaactctcaaccacggatactttgcgtcttgtctttcaaaagtggtacttaaccgagttagtaattaactaattattagggggtaggagtacagaggaaacaaagcccctgaccagatctaccttcttcaaaacgtcaacgttgaattttaatgtattacgttgggcgaagttttttaattcaattttgcatggtatctaagtaaccctttgtcctaggatggtttttagggaaattaagaaagtacagtaaaagattatgattgtttaagaatgaaattatgtgaaaaaactataaaagaaaaatagtggtaattggttgagacgatggataggtgaataaatagatactccctctgttaggagaaaaaaaaccatagttttagcctaatgtacacttcttcctcgtattatctctcttatcattttttttcaattttatgatggacactatagttttttaacctattgtttatatttttttagacggatggagtatttactatctccattggtttaagagtaccattttaaccgtcacaatccacgtagtaatatctaattctcgatccagatcactgatcggtgaagtgacctgtcaacgtagctagcttctctccacatgcattcagtttctacacgaatcatatcaaaactaacgaacgtgcacactgctgaagtataccgccttgaaaacctggttattggttgaacaaaacgaaacagggtgtacatgcgaatcttgattgaattaattaacaatatataccgagaattattagagtgcagtggaagtgcatgatcccatgtatcattatttgtcttggagttggttgatgcattgactgcacatgtattcagattatttcagagctgcaacacacagcaactttgattgtagcagtggtagattccagctgcagaggcaagcgttgaatgattgcaaagcagcttgttgacatgtactgtagaagcagtccctatcgtagcatgcacgatcattgaacaagccaaaagtataattagtatagcgcaatgcaattaattagttaattaattaatggctagctctgttcctgtgttccatgtggaagtttctcaagcaagttcttcgttcctgggtaattagtttgttaattaatttcatggtgacgaacacctttgccaagatacgaggcatgcttcttctgaatgttttctagaacaagggatatatacttgttctcctcctgaaaaataacaatcaattggtgttcgggaatgatggatcacttccgataagaaatctagtgattctcttctaaaggcatggttggttcaatggggcgatgagagctgtaacgtgtaatggactaatggtcacaagatgaggaattgagaaatcagaatgtattcttgtgatcccttttccctaatcttgttgggccagtgactcggctgttgcatcaaccataagaaacttggggagtaagtccacttcaactccttaaatatatgttcaatctgattcatgtcactcaatcatatcttgactccccaccattaaaataggtataaaacgatctcctcaatgattttaagggtggttttcattgaagtgactcgctgacttagtctaatcattgagtcagcatatggggcccacatgccatccccctttctctcctccacccctctctctccctcaatcccttgtcttctggctaggggtgggtgttcggtcagaccgaaaaattcggtctcggtcttccgttattcggttagttcggtcattggaaactcaggaccgaatttcatccaaaaaaatctcaggaccgataaattctgtctcggtctcgatctgaccgatttttttcacagccgctggagagtggagacggaggcgacgccgaggcggaggcggaggcggcaccggcgccggtgctggaggcggaggcggcggagggcggaggcggctagggatgaaaacggagcggatagtttccgtccgctccggacaaaaacggatacggataccttttggatcggataattctcggatatttcggatacggatacgaatacggatattttctctcggatacgaatacgaatatggtatcagggtttccgtcggatatagataataattcggatatccggtgaacagtgctattcggatatccgcagtacccatgagacataccccatttctttctaactctataaccttcaatatacctttatagattttaatagtagtttatctcttaacactagtccatactattaatattatttaaattttaaaaaatatttataaattataccacattttatataaaatgagctaattatatatgttgatatttatttctattagacgttgagttggttttcgtgttccgagaaaaatttgtttccgtattcgtgtctgattatattcgattcttattcgtattcgagataatccatatttgtttccgtattcgagctatccgtattcgttttcatatccggtaaaaaaatatgaaaacgaatatggtatgagcattatccgtccgtatccgctccgttttcatccctagaggcggcgcacacggcggggccctagaggcggagacgacgcacagggcagctgcgcggaggtgacagactgcgggagctccaccgtcgccgtcggtgtcaccagcacgggggagaaggggatggggatgggaagggctcgatggatggaggaggatactggtggtggttggttggataaggttgtgggtggataaggttggttttgctgaggaggtattgggcctaataggccaatgctatatttcggttttttcggtcaattcggttaactgagccctaaaaccgaattgctcgaactaaattcggttagtagaaagtgctgaccgaatttttcggtctcggtctcagtcatttcggttcggtctttttctgcccacccctacttctggctttggcggcaccagtaatggccagcgcgatgcttgggtggagggaggttgaggagaaggcaacggctaatgggcagggagggggatgtaaaagcaggcggtgctagagcctgttgtcgtgagcctcagtgaggaggagaccaaggtcactgccgccttgtctccgcctctccatctaggaaggctagtgtcatccacctcaaggctggcggggacacgttcaccttttcctccttggtcgctccacttcgaggctgcatccctgccgtccaagccgctaaatgtcatccccgattttgctacaccctcggttagggccgtcccgtcaaatttgggggccatgtgcgaagtcataaagaaggataaaaacttaattgataattgatgatataatatgacaataatttatactccataatatatttgatagcaatgtaaaatggtctaaaataatatacctgtgcataatattcacttgaaaagcgacattcttttagtgtttcttgaaataaaatcttcaatgatagctttatattgattctccccagcataccaccctcaagtgctatgatagccaaaccattaagtctttcttgtgacattgtagatcgcaagtatgacttcaatagcttcaatttagaaaaactccattctgccgatgcaatagtcacaggaatggtcaataaaattctatatgcaatagttgcattgggaaaacaatcatgccgcttcaaaaacttcaaaatttcaacagggcccaacttttcttgggaaatgaaactttggagaaaaatcaactcgacatgcaattcagtagcatcaatatcaaattttccatcctttttaagtgcagcctcgagacgatcacaggaagatttcaagtcattgctatcctttgatagcaatgtgtcagaagtaaacaagaagccaaaaatcttttgataaccttgatattgttcaaatctcctggtgagagaggaaatagcttgatcaataacatgaataaaatagttgattctaaatgaatcctctgcagtttgtgaggcaacactttcttcacctcggttctcatcaaaatgtctctttcttttaatttcacgctttttatgaaatgttgtaccaatattcatttcaagtgcaatttctttagacatcttcaatgcatttaagaagccagtttctctataacctttgaagaaagaaatcagcccctgcactttctcaactgcaacatcaataagcatatcctttccttgcaagctcttacttactaaattaactgcatataaaacttcataccagataactatcgccaccaaaaattcatactctccaagttcattatttgccaaacctttagcttcactactagttaatggttcattatcactttcagatacttggagtagagcctcacgtatctttgcacattgaaatctaatagcttttacactttcaacacgactctcccaccgagtagttgacactgacttgagaatcaatcctgtcatattatcttttagaatatgccatttcttagtagaattagcaaaagtagtatagatccattatatgattgcaaaaaggtctttagccttaccacgagtctttgacatatcacagagtgccaagttgaggctatggcaaccgcaagaagaatagaaagctctaggatttatatccaaaagattcttttgtaccccttgatgttttcctttcatatttgacccattgtcatagccttgtcctctcatatcatcaatatctagatcaagatcctttagttatctctctagcacatcaaaaattccttgcccaattgtatcatttatattcaaaaaacctaggaaggattcctcaatggaaacattaccttaagataaatcaacatatattataattaaagacatttgttctcggtggcttgcatctggagtacaatctagtatgaccgagaaatattttgcgctctttattttcttcataatttcaaccttaacatcacaagcaagcaaatgtatcaactcattttgaatcctaggtccgagaaaatgaacatgagtttcctcatttgtaatacgccgaatatgttcttgaataaccgagtcaaactcagccaacatttctaccatgcccaagaaatttccattgctatcttcatacagtttgctattagaaccacggaatgctaaattatgcttagctaggaattttacaattacaagaattcttaacaaaacctttctccaatgatccttttctttctcaagttgtcgttgtgcagctttatcaatagtttgatccttctgcaatctattacacaattcataccaattggtcatatttgaaacatgatttggacttgtttcatgttctctaagtctagaactcaaatgtgaccagtcattgaacccctcatttgccaactgacctttgatagcgatgctctcttccttttgtaaataatttgcaacagaaacagaatactctatcaagttccttggaataaacaagccaatctctatcatacttctctctgtttgataggattctggtgtataataatgcagatctcctaaacaatctatctttaggacctttctgaattgataagtcccttttaggacctaattgagcaagaatgtcaagttgtttagcatcaagagaatcccaacaccttggatcaaaaatttcaggctgaaaagcagtgtctgaactgtccaaatcgatatggacactactgtcatcaacattatcaccatcaccatgattttccacttgttcatgtgtgctctcactaagaacatcgtcaacagtggtttctatctctgtttcaccatcattaggttcattggcaacatcactatcaagtgtctgatcaccggatggaccttgtgattcttttgtaatatacctaaacatagcccctctctgagattgagttagatcttctattcttttttttcttattacgcttttcatagtcggagtcatatttcctattccgatttttcaagacatgtcttcaaaattaaaatacaggatgtaactatgtaaagaaaaaaattgatttaatgtatacagtagatgaacctaaaagcctaataatctatacatgatacactaaaattagagaatagggattagtggattacattaccagattgctgattagagtaggcgaccagccagtagccgactaggcataggggacaggggcgtcggcactcaggccgtcaggcgctgcagccggcaaggacttactccctccgtcccaaaaaaaggcaaaccctgggtttcgtgccaacgtttgactgtctgtcttatatgaaatttttttataattagtattttcattgttgttagatgacaaaacatgattaatactttatgcgtgacttatctttttaattttttcataattttttcaaataagacggacggtcaaacgttggacacggaaaccagggtttgtcttttttttgggacggagggagtaggcaggcataggcaggtaggctcgccgacgatgggtcacaggcgacaggcgtcagtttctcagttctatcctccaggcggcgacgacgacatggcgtcaggacttagcgatgacaccgcggcaatgtgcaggatgtgaacggagagagagagagaggcgaggcgtcatttcgttttctgtgcgatgccgcgatcgaaggcggaacaacgtaaacaaaagaagaaacaaataacagattttcagggctaattgggctaccaaattacttattgggctacatctatatacatatatagtgttggagttttgggccaaggaggccctgaaaattgggggccctatgcaggcgtgctggccgcaaagccccagggacatgcctgccctgggttgggagagagatagagagagcgggggagggggagtgctcgtcaccagccgccgctacccccctcgcccctcgtgacttgccagttgccatcaccaccaccagtgtggagaagagaaacatgatgagccgagcagggaggaaggcccgaattggaaagagaaaggggagagagataaggggagaaagagaggaggaagaagggaatgagagagaggatgatatttgggtcccacatgctgacttagccggttggactaggtcaacaagccacatcagtgaaaaccaccgagaaagttattttgcaccagttttaatatttggggatcgagaaatatgaatcagatcggacctatatttgaagggagttagagggcctatttgggagagcttctagcagctgcaactttccgcagaatcttcaagtcccccaaacagttcaagactacgtttgttggaattcctaacagctgcagtttcttacataatctctagctcccccaaagagtccaggttgtcatccagattttgaatagtacaatagtaaatccttaacttgcctagatatcataagcgagaaagattttctactacaaaactagttgtactgatcgaccgttcccagagtttggaatttcgtttcgaaatttctgaaatttcggttatttcgccccccaccggcaagtttatatctcgcccgaaatttttgtttttttttttgcaattttttatgaatttggtcaaattttattcaaattcatttcaaatttcaaataattacggccaaaaaaattcaaaatttccgaaatttcaatgcctccgatagaaatagcaattttgaattttaaaaccctgatcgttccccactttgagagcgttacgtacatgggcgcctactcctcatccgccagaccgaacggcacggcgtggtcgtgattgtcgccgtcgtcgtcatcatccgccaccaccagtcgctacgctggtgagggctccggctccggctcggcagccgtcgctgtaaggtcgagcgggcaccacgtgttcgagatacgcgactactccatcctcaaggcgatcacccccaacaccaagtgcgtcaagtccggctcgtcaacgccgaggagcgtgtccggccgctcccgtcgctagccgttggggtgagagaggtgttgggggagaggggaggtgaaaatgcggacgagaggtggtgggggagaggagatggtgagagatgagtgaggaagtaaagagagggagatgagtagaggacttgacgttgggagggaggagacaaaaggagagggatatgacgtctccttatcttgtgcgggccaaaatctaccgccggcaaaaatcccttcttcgcatgtagatctcttatgaattttcacaaacgatctttactactccctccgttttaggttataagacgttttgactttggacaaagtcaaactattctaagtttgactaattttatataaaaaatagtaatatttttaaccaaagacaatatattatgaaaatttattcaattatatatttaatgaaacttatactggtgttgtaaatattactacttttttctacagagttaggcaaacttagagtagtttgactttaaccaaaatcaaaacgtcttataacctgaaacggagagagtagacattatctaaatctttttacatacaatattttttttaacccaactagtctaggaaaaacaaaaggggaaatgttcgcaaaaaatgttttttaagtaatgccacacataccatgtacaccaagtcaatcaatgatacgtagtgcatttcatctttaacacgcccacagctaaagagtgtgggtggccggacgcaaagactaattgaaccgaaacaactgaacaggaaatctggatataggacggcctttggtcattgattcattgctgcaaaactgatgcgatgaagagacggggtaaaaacggtattgaaatttcccgaccgtaccgataccgtttccgcaaaactaatataataataatatttttaccgatgttaccgttttcaaaatttagtttttttaatttctatcagcgtagcattgaagttgacattaaatagatgaatttataaatatggaaatttcccgatcttttccgttcgttttcgaaaaaataataaaataatataccgtttccgaccatttccgaccgttttcatccctagatgaagtcacgttgtgaaatcatgtgtgatgaataattagtaaaagtaattattgtttggttcaagttgggagaaatcattactaatgttaaatttagggccttcttgatcacttctattacccagagctcgatcttttctcataacagcttagagaacaagtaaatatctatctattatatactaaaagtccattaaacttcctacaaacgctcctaattcgccacgtgtcatcttataaacgttcctaagtcgccacgtggcactataataaattagagaaatttctaaaagttccctagcaattgattttcattaaattaggtggacccattatttaccaccattagatttatcaaaaaaaaaattgcctaaccccagaccaggtccaccttgggcatgtacttatattactactagcaaaagtacccgtgcgttgcaccgggtgattacggagtgtgtatattgaccaaaagtgttgtttggtttagcaaaagtgtccgtccgttgcaccgggaagcgtacagatcagaaaaatatgcaattaattaaaatacagattcgctgaaatatttggtatttttaagtaggtatgtgtataattaaataaatttacaagtaaagcaagtgtgagaaataaaatgatatggttaaatttaattttattaaattctccatgattagttgcgctctttgaaattttattggaattttgagagctaaattgctaattttaataatacaaacatcatttaacaattatttaattagaaaaagaaagaaaatacttccttttaggtttgcttcaaaataaacacataataactatatttgtaatgcttctgaaaaaaataaattactaaaaatgaacttcttctctttttcttcggcccgagggacctgaaatagacttatttccgtccgttgccggtcggcccacgaccttatgaaaaccctaaccgtaaccctaactctccccctcccccccaagccgagtcggccgcctcccccactcccgacgccgcctctcgccctccccctttccccaccggcgccgcttcccctcccctcgcctccggcggcgctgctacctctccccatctcccgcctctccctctccccccagccggccgcctctcccaccaccggctcccatcctccacgctagctgtggtggcggtggcggcgcccttttcccatgctagcggccacggcttcccccacggcgagcggcggcggcgcccttcaccacgctagcggcagtggcggcggtggctctccttcccatctcgccgacacgacgcagcgacggcggggtgcggcggagacggcggcgacggccgtccctctccctctccccgtcggcgtcaacagcgacgtcggcttcgtccgaaggtggatccatcagcggtggcggccaccgcgggcggatccgacagcggcgctcccttcggcggcggtggtggcgtcggcggccgccctttttttttgcaatttttttccatggctattgctaaccgaatcagattgagcacgtggacgaatgggacgaaaatagatgtgacgaaaggaaaaatatgaatatttatattagttatagattatagaaaaaatgccagtgcgttgcaacgagtaaactaaaattatattaaatataaaaatattagatgattaggatttagttttacatgatatgagctctttaagaaaatctattcctaatgaaataaaaaaaagttcaatttaagggacctcaagtgaacttattccatgcggagtagaacaaattcgggacagctttagggacattaagtaaacttattctgtgacaagcggcccaatagtgtgggcggcctgggaaggcccgacgagggagaagctgagcggttcgatctgatggatggtactgattgatcgcgccctatatataaaagttgaaagatcaaaccctaaccctaaaaacattccccaccccctccctctctctcagtggcaccgcctctctccctccgccgctcctccaccccccccccggcggcgccgctccccctccccctccacggcggcgcctctcccctccccctccacagtggcgccgctccccctccccctcgccctccacagcggcgcctctaccccctctttctcgcctccctcgtgcgacggatccggcgtcggcggtgaccgtgggtggatccggccgtggtggtggcggccgaggacagatccggcggcggcggctcccttcaacccctctcgcctccctcccgcggtggatctgacggaagtggtggcgtcgacgccgaccgcatgtgggctcggcggctgctgctccccctccccggtgtggcgacgcggctgggagcggcggtgggctcgagagccggtcgcggcggaaggcggcgatatcgacgacgacgacggacgacggcgacaatggcagcgacgacggcgaccatgaggagggcggctccggtaggcagctagggttagggtttggattttatttttgatttgggatattgattttgtcgagattgatggttttgatttgggattgcaattgagtgattttgtgattcatatagtttgagaattgggggcaaaaggtttgggaacaatcatgaatttttttttatctgactgggattttttgggggtgggggagggacaaaaaatcccctggcggacgatgtgatgaccggaaaaatacgaatatttatattagttatagatatgtatgtacgaaccgttttttttccaccttaagccggcctgtacgtattatgtatgcacgtttgttttaaggataatacgtacgtacgttactttcacctcttcttctctcaatttcttcatatttttacacatatttcttctcctattatcatactttattagttagaaaatatttttttctgttaaacaattcaacagctataacatctaaattatgggtatgtttagatcccaaaaatttttagccaaaaatgttacatcaaatatttggacacatgtatggagcattaaatatggatgaaaagaactaattgtacagtttgcatgtaaattgcgagacgaatctttcgagcctggttgcgccatgatttgagaatgtgatgctacagtaaacatttgctaatggcagattaattacgcttaataaattcgtctcgcagtttacatgcggaatctataatttgttttttattagtctacgtttaatacttcaaatgtgtgcccgtatacttcaaaaaagttttggccaaagaactaaacacggcctatactactaattttcaatccgctcatatctttcaatttatttatgactaaatttatagctaactataacatataaataaacactataaaatgtataaaacataattatatgtgtgcgtactttctcttcttcttttctctcgctcaactcttccgtcttataatttttaactaattaacaacataatataaaaataatcaataattacaaaagctaaataattatgattcttacgtcatatatgatttttaaaagtttatttgaattgttaatgtattcataattaaataaataatttaagatctatattattcatatttcactgtataaaaataaacaccacctgagcttgcacacctatcctttatgcatcataaccaaatagaagaaacaaagcattatgaaaaattaaataagtaatatatcacctcaaatcattgtatatcctctgtagcgcacttaagacgtacatcacatgtacatcataattaaaaacaaaaccttagaaactgtaagaaaagatatctactcgtaagtttcatttaataggtggatccattatttttaaccaatagatataattttagaatcttaagccatcatgtgttgcatcttaaaatttagaaaaatcagaaatcagaaatttgataaaataaggaccaacatgcatattttttaagttgcacatataatttctaatctaactattgctctattcataactaaaccaataatttaaagatccataacccctatattttgagctggtataaaataaaactaaaaaaataacatatcaataggcactaaattgaactatttggagaaaaataaaataagtttgtactttgcactaaaattggaccaaccattacatgtttcatttttataataatttttaaatgcttacatattaatggccttgcatctatcctatacatattaatgcttacatatttgctactattaaatttaattttttggacccatattgactatattttcttatagatatagatcataaatattacaaggaagcgatgatctttgatatgtgtttgttaatttatatgtaagtatgtaacaacttgcgtaaatctgaaccaactaaaaacagaaataacttgatggtacaaatagttttatttactaacaacaatagttctttaggatttgtggaaaaataccactaaacattcaattaaacaagacaaaacattgtacttttaatttacgtttaatttgtagattgttttctaaacaaattaaaaatagatacttttgaaacatggcaggtttttatatggaccatagataattatttatacgaatgaattaaatattatatattttaaaaggtaacaaaaagtttgaataaattatctaagaaatgccgatgagaaaaattatagagaaatagtacttttgaaacatggtagttttatcccgttgatatttcgtttatataagtttttcaaacgcagtataaaatacatgcccacgcaatgcgcgggttctaaagacaatttcgaacttgctggtatgaaacagtagttatatacataaaaatcggagaagcatctcagcccatgtttcattcattgatttcagctatcaaatctcaaaaatgaataaaagaatggagtgtacatatatacacttcacagaatcaaattcaatcccctctgtgtcaaaattgttcccggacaaaatcaaatcctctccgagcagaagctactatacatacgatcgatcgaaactcctcctcacacggcggcgacgtcgtcgtagacgacgacggcctgcgcggtgtcaaactcgaagtcgaaccccgacggcgcggtggcgcggaagccgcggtcctcccatgccgccgccgccgccatggcgccggcggacgacgacgacaccgcctcgaacctgaagccggccgccaccacctgcttgcctgctgcagcgccgccgtgatccgccgtggtctgcggcggcttgtagtacatgcgcgccgtgtgcgggcagtgggagtggaacctcgccgcgatgcgcacccccatgtccagcatctccacgtaccgcgacgacatctcctgatcgatcgatatgatttccttccaaagcaagcaagcaaacgcggctctgttcagctcgctcttgatctaagcaattccgttcttttttttgctccgagcgctgggatcgatcgaggaagcgggcggcggctgggttatatatatggttggaagatcgatcgatcggagagcttgagttggcggaggcggtggggtgtgttcgtcgtgggttttgtgcatggtgtggttcctggcttttcttggcgtgggtgtgggagaagaagaagaagaagaagaagagactcagtttaaacgtgcccctttgtgttgcgcctcggccagcactcagaaggaggctatggaggcggttgggtagcggtggttgcgcttgcgcatgcgcggaacgagcgtatgtgttgtgttggaatgaattattgtagatacaaagctttcactaatagagttttgaatggacatgcaggtgcagtaatagtactattggttaattattttcaatttttctatatatttgtcgacagatgttattacagtacaattgtggtgtaattacactgtaacttacatgtaattacactataagtataatgtaacttttaaaatctctccgtaacatgttgttccagtaaaatagagatcgtgggaacaaatcctttcacatatatgtgtgctgtgattttttttttcttcctcaccagaacaaatcttgtaatatatctaacgattcaaaattatgtgaaacttacatacaagttacactatagttacatgcaaattacagtataattacatacaagttacagtgtaattacattacgattgtactataattacatctgtcaaatttttaggagaaaatttatcgacaaatgtataggtggtcccatttttttccttggattttcctcttttttggtttaactgactgcaattctaagctcaacgcttttaataatggtgtctgatcgtgaattaatcaagaaattccatggagtattgtttttgttataaaattgtcgacgggtgatacccgtagaccggatatagagggtattggggtacgttggtacaaggatctacgtagtacgacatcaagcaatcaaaagacaagaattatactggttcaggccccttgataggtaatagccctaatccagttgatatgggattatatggtggaaaacacaggttacaaagaggacaatggaacttatcggatccgacgagatcgtagtcgagttgattcgactagctctcgatgacttggctcctcgcagattccgacttcgtaggctgtgttggttgtgttggctctgagattcgatcccttgagccctccccggggggtcctttttatatcgcggatctggaggtctccaagtagaactcggaggtatcagaccctatacgatacgtcaacgacccagttctgtccgagtaggattctttccttttgtaaatcccgtgaaaggtttccttagaacatacaggaaatatccgcatgcacgtggatatgccatatcgatatgtaacgtatatcgaagggtagagggtatgcctaacccgtaaccctgacaaaaatactccctccgtttcgaaatgtttgatgccgttgacattttagcacatgtttgaccgttcgtcttattcaaaaaatttaagtaattattaattcttttcctatcatttgattcattgttaaatatatttttatgtaggcatataattttacatatttcacaaaagtttttgaataagacgaacggtcaaacatgtgctaaaaagtcaacggtgtcaaacatttcgaaacggagggagtataaacatagcccttttacggtaatccatcttccatcttacctctagaaattaatcgttgcaacggagcaacctcgtgagctctggagaaatggacggaacgaccgcctgccacccgatgctggtagaaatgttgattatggcaggcggacaatgcaaccaaataaaacattatttttggcagacaaacatgttaaaatgccttcttgtaaaagaattttagcaaaacaagaacacaaatttccaaaagaaaacaagtacataaatcctagcacgatccctaagctagatcgatcagccaccacaccccgctacgaccgctacagtggccaccggctgtggatccactcgtcttggggcagcccccatctgatctagccgtcgaaaggctgtctgcggtggaggaggaggagctgagggagaagacgttgagaggttgccgatagtggaggtggagctgagggagaggaagttacaggatgccgatggtggaggaggaggagccgacagaggctccccaatatctggccgtcgcgaggctaccatctcagttgttgcgaagctactggcagtggaggaggtggagctgagggagatcatgtcgcgaggttgctagcaatgaaggaggaggagcctatggagcctctaccagatccgatcatcgcaaggccaccggctggtggacaaggagctgaggcgcacgtcggccgctctcatcgctagccgctgggtgagagaggtgatgggggagagaagaagggtgaaaatacggaggagaggtggtaggggagaggaaatgtgtgagagaggaatgatgaattgaagttaggagagggagaggagtaaaggacttaacgctggggacggagcagagaaaaggagagggaaatgacgtatccttgtcatgtgcgggctaaaatcgatcgtctgcgaaaatcctatttttcattctaacctcctatgagtttttgtagccgggtatttagtgaacaccatccaaatttttttatatacagattttagagctatacgcataatcggagctagtgcgttaccttgaaaagtactacctccgtcccaaaaagccagtcattctgtgttgaagaaatgtcccgtaaaatttgtcgctctagcatctgcccactgaacttagcatctagtctattccatggaatcattctaaccctcctgattttagctagtaataattactctttccctgtgtaacagtgccactactagtaccatgcatgtaccatgcgatagatagcagtacaagtactagggacaaggattttctacacctaggtgccatagcacctatcatttgcatgcgactcaaataaaatcagatagtgaatagtacccatacagtgcagataaaatttgttattttttttcttcatatatcgatcgaatttagacttgcatgtttgcatactgtcttatattatcatggactatcttatcaaattttatgaattttttatacaactgtttaaattatatgcatacacctagttgccatggcacttaggtgtagacaatatttctgctagtactagtgattacttaattacttgttgtatttttttcttacaatatgaagtgacaaatgcaaccactaaatagggacaatatggtaaattttacttccggttaatttatccggccaacttttttttcttacaatatgaagtgacaaatgcaaccactaaataggagcaatatggtaaattttacttccggttaatttatccggccaaccttaaaacgactggctttcccgaacagagggagtatcttcatataagattttttttttgagatttatcaaaatccacgtcatttctatacaatcgtagatgccaacgcaaatatgctggtaagtatgagacagtagttgtatacgtcaaaatcggagaagcatcaaccaatgtttcttccattaatttcagctatcaaatctcaaaaataacaataaaacggagtgtacataggtacattacattcacataatcaaattcaatccctttgtgtcaaaattgtttccgggagaaaatcaaatcctctccggccaaagctactatatatacgatcgatcgaaactcctcctcacacgacggcgacgtggtcgtagacgacgacggcctgcgcggtgtcaaactcgaagtcgaaccccgacggcgcggtggcgccgaagccgcggtcctcccatgccgccgccgccgccaccgccatggcgccggcggacgacgacgtcaccgcctcgaacctgaagccggccgccacctgcttgcctgctgcagcgccgccgtccccgcggccgccgtgatccgccgtggtctgcggcggcttgtagtacatgcgcgccgtgtgcgggcagtgggagtggaacctcgccgcgacgcgcacccccatgtccagcatctccacgtaccgcgacatctcctgatacgatttccggctcactctgatcttgaattgattttcttcttctccgagcagctgcgaggaggcaaggccgcaggggcggcggggaaagatggatttcgaaggggaatcgggcgatggctgggttatatatggttggaagatcgttcggagagcttgacatgacggaggtggtggtgtacgtgtttggcgtgtgcttcgtgcatggtgtggttgactggttgctggcttttcttggcgttggtgggggaagaagaagaagaagaaggcgagactcagtttaaacgtgcaccttgtgtctctctcggtcagcgcgacgatggaggcggttgccggttgggtagtggtggttacgcttgagattgaacgagctcagggtgtgggtgggatttgttggaggccaacacatatattagcagattatcgaatccgttcctttcaaaaaaacagtagaggtgcgagaagatgtatgtagtttcgagtcgacagtaatagagatgtgagaacatgtaaaacacccgtgcactttcctttaccctcgacaatatcacacaagcaaaaatggacagagataaagggtgtaactctctctctattagatctattgtcgttcgttgagtataagcaacctcaaaccctaccccaatataaatataggagataaatcttatttcttgcctgattcggattgaccaacaagaaatttatcttttaaaaaaaaacttttctccaagggatttgttttataataggattaactcaacaaagtcttaaaacgacacccacatattcaacaatagcctaagtgcaaatagcctctaaaaattcaacaatatcggcctatttgtttacttaatgtcagtttcaaaatttttactaaaattgctacaaataaaatttctggagtggctcagaaggttttttagtcccacacagatagcttttatacctgggagaaatgttatggagggggttgttatttttcatgaaacgtacatgagttgtgccggaaaaaagagtggtgtacgttttaaggttgattttaagaaagcttatgataaagtaaaatgttcttttgttcaacaaacgttgagaattaagggtttctcgcaaaaaaaaggtgtgattggatttcttcttttatccaaagtggacttgttcacattaaagtgaatgatcatgtgggatcaaattttcaaacatatacgggtttaaggcaaggggacccattatctccaattctttttaatatagttgctaatatgttagctatattaataaagagagcaaaaggtaatggtcaaatttctggagtggtccctcatctggttgatgatggttcatctatcttacaatatgctgatgatactatcatttttaagcatgatttgcaaaaagctaaaaatatgaaattgattttaactgcttttgaaaaattttctagtctgaagataaattttctagtctgaaaatttaaggaaaggaatgtcatgagcaatatttaaatatttttgggtgcaaactaggaaattttcctgttagatatattagcattcctatgcattttagaaagcttagtaataaagattagttaacaattgaaggtgttggtccagaagtatgttagcatggcggaaagcaaggcgacgagcacggcggcgctagggcgtgcgtgcttgccggagagacgacctccctcgccagcgacgccgaagaggggaggtaatcgagacgtttcgataggtgggaaatggtgttggaatacccatgggttagcccaagggcccgacactattcacgcgggctggagtggtggggctcgtggaatccgccatggatggtccatgcgtgatctgctcccgagcccgattaaggaggtttttttgtctgcgagctgggtgtgggtgccgaaagggggttctctgagtcctcatctagggtttccagccaccaggcgagaggtcgtgcgttttggggcgacgacgaggcggatctggagagctccggcgagactcactgacgggagatccttcctcgaggtagcgaagggaagtatggatcgtaaacctcaattccaacgtcctgatcaatgggttcccaataagagaagagcgttcgaagaggaggggggaggtgggaattgggggaatcgaaatttgcaggaaagggaggaacgtgaacttcggaatcggttgatggggcaacaacaacagcgcgaggaagggaggtggcagcaagttgagagaaggggggccaacaaacagtggcaaggagacagaaacagggagggtggtgcttgggagggaggggatcggcgtccgactcgtggaaaggagaagctgggggaggaagggagatcaggtccttcccagaaggaagagatcaagtgtttcaactgtggagaaagtggttatcatcaggtgaactgtcagaaacctcctctgtgctatgtctgtaagaatcctggacacatctcatctcattgccctgttcatgttggggggagtagctctaatttgagcaaactagaagtaaagctaaaaggttatggcatacctgagcagggttttttcagcctaaatgtagataatttaggtgtggctgagaaaggggcacaattcagaggaatcctaactgtggagaaaggggctggttcagtgcaaaaggtggccaatgagatgtctcatctatttagggagaaaaattgggattggaatgtgaagcaaatcagcagtaataatttcttgattgatttcccgagtgaagatgctagaagacaagttactaagtcagggggtttgtgtttaagacctcatccatcaaagctagtgtaatagaatctaagatgactgacaatgctgtggatgagctctttgtgatctgggtaaaagtttttggtcttccaggtttcgccaaaaagcaggaaatcattagagcaatatctgatattgtgggtgaatttaaagaagtggatgagaaatctttgaagggggaaggagctgttaggataaaagtgggatgcttggaccctagtgctatcaactattctgtcataatatatattaatgacattggatataagataaaatgggaggcagaggttgatacagaggggacagggtctattgattggggggggacaatgatgatgatgatgctgatgatctggatgatgattaccctccaggaggaaagaaaggtgggggtcaggatgccaaagggagtccaaagaaaaaggaacctgctaaggatgcagatagcaaaggaaggattgtcagtaagactcaatctgccccccagttgttaaaaggaactctaaaaacttgcaaaacgccataattctgtaggtggagaatgaggtgggggtcactgctaagggtgaggatcctattgaatcaattaccgtggagaaaaaggcagacaaggcagtggtgttatggaagtcagaggaattttcacaaccagaattgtttgagcaagtttcacaggaggaggacaaaagtggtgaccttctcaaaagaatggatgtggatttaaaattggggggtgttagattattcacagatgaagagggggagaaatgtgctatccccgctgactcagacattgagttgatgagggcagaggaagatgatgacagtgaacaactagatctggaaagtgaagcagagatacagctcaaggaggttaacttccagaaagtcaggcacaagaaaaagcaagttagtttggtcaagagacagagttctagggtgaaggataaagaggtatcagttcatctaaaagctgagctcaggaagtccaaaatgaacatgacctcaggtatgtcatcaaaaaattcttatgcaatctttcattctgttagtcaggattatcttatcaacattgctagggctaggggaatctctttgggtgacaattctgtggaagtgagatgcaacttagatgctatttgtgctagggaattggcacaggctactatttttgatgcagataagagtttacaacagatggctgaaaaagcaagtttggaggaagaaggggggcaggaagtccccccaaatgg

SEQ ID NO: 59838 - DNA, 1473 bp, Oryza sativa
  unsure (1)..(1473): unsure at all n locations
atatatcttaaaggtgctggatttgctgccctccgagcgatttgggaagccagcgcccaatgcgacgtccacacgtcataataaaataaaaaaattaataagcgttagattaactgcgagcccagccgatccactcatcaatttttgcagaaatcccctcgttatttcggtatttacgatcgagtccactgaatcagagccgttcgaacccacgcgtggacacaatctgaccgttcgtcttctatctagatggctccgtccttgcctacccgtggaatcggtcgccgctcgtctccccacgtcgcatcccgtcgtccccatcgagcaatcctcttcatccctaatttcttcgtctagaggcggcatcgatgctcctcgcctcctccaagatcttccatcgtaggtcgtcgcccatgatggcttgccatctgctatcccatgcccacatggtggatgcatgatctcctctcccgtcgacgcactccgtgtaaccgcatccatcggcgtccgtctccccgtacggtggctaaccagattagccactgaccagtgcctccgtacacggtagttgggttttgttctgttcaagctccctcctcggctgctccgttcatcttctctggatttctctggtgagtccgctgcattctttgccttcttttatccccttctttcactcttctacggtcaactgcatcaacggctgcaagatggagctgagttgggagtctgagcaggcagcaacaggaggaatcagggaacaagggaganaatgtgaggaaggaggaaactaggatacctaagtaatttgctaatgcagttttaggctacctattcaaatccctcatcgcatggtgtacattcacattcagataggattggcttgatatttaggaggtaggttcatgctttatcttaatttcgttattttttttattttcacaaaattgttcaatttggatacagctaactttttcagtctttagaggccaaatcaaggaatgcaaataactatgaagatgtacagggttccttaagccctctattaaggtaaagaacatggaaatccaccaagtagaatagaagttatcacaatctgaactctgttgtattgcatctcaaccataactcgagctgtcaactttcaaagggttttcatcctgtctatatggtcaaatattgccactctgtaactaattaattgttgtaaggtatgagatcctcaatccagtgcttgtgtattaatttacttattgtatcaagctttcctattaacaaagttgtggtttcttgttgttcttgttctgtatatattgcaattcaatatttttatatcagctactagatgccaatgatttttgaaaactgacatggcacctcacttggtcgcattgacgaaactagagtaatgttccatttaatttcagcgatatgtgcagttcattatgatttctctaatatacgctctgtcaa

SEQ ID NO: 59839 - DNA, 1472 bp, Oryza sativa
tcctgcagcccacccatgtcaatattatgcaaatgaaacatcctactgaaatagctattattcggttttaaatttttgaagaggactttactaaattgttctttcatctaggacagcgatgatatctgatcattctcaattgttcttgatcttcagacaagtgaaaaatcgtaggtcagttttgaaggacatatttcctcttgcaaaatacctattcctgtctagagggccaatccactatcctcagctcaggaaaacataatggatgaagctgtcaattgttccactgagaaacaaacacaagataagataatagggaacattcatactgcattgatctctgctctgagttctgagcaagaggtaatccttatgaactttcttatttgatttatttctgagatgtgcttattaaatttttgcatggtggtattggtaatgttatattgactatcaggtcaatcttgacgcttcttgaattgaatcaatgcaaaaagaggatatttatttttgctctttgtatcatggagaattagtagacatttcatgttcagatattatagtcatatctttggaatggcaagacaaacctataccctttttaagtgctaagctatacataattatttttatgttacctcaaagatgcgattcagaatatttttaggttttgcaaattggacatactacagagtgctgaggatgcagtaacatacaaaaccttcgttagccgcacatgatatataatataattgtgttttcagatgtgccaaatgacatgcatttgtagctcatctcctgatgaaggtgatcatcccagagcttcagtattgtgcgagctattctgagatacactgccactagagtcgctccaatgtaagttatttcaagcagttatgttctacttgtgtggttatttgtttaaacaagaactgactgcccattcactttagatttggggctcccatgtaatattatcccacctaccatactgtcttaaatctagcaatgctcatggtttggtcggtctttgttttgtggtgggaagataagaacaaggatatgtttttctgtgttggccttgggatcaaccaactgatgttccagctattgccaactcaccgacctaaatgaatttgtatcgccgattcgtaatattgagcttctaaaaattatccctacaaggattgtgcatattcaatcaatggtgcttgccatttctgaaatcaggttcactaaatggcacaaaatgcccctttgtgttatttgatatagttgcaaccgttgtgatcgaagatgttttgccatatagttactacatgcattgattcttccatgccaaatatcccagcatgacacatcactctgccaggatataatgcatctccaacagactatgtaatccaagcatgaaaacatgctaacttcctgaatctaactggaagtgtacattcttaaaccatagcagtacg

SEQ ID NO: 59840 - DNA, 3853 bp, Oryza sativa
ttgatcttaaccctcttttcattgatcaaaagctaatttattatcctatttctcatcgcctttgtttgttattcttctcttgtttgtttggcttttgtgaagccatcccttccttccgtctttaaaggcatcgctgccgggcggctgttagctgaatcgatcgcaaggaaagacaaaggaggagagttcagtcgacttgggatcgagtagaatcgccggcttctgctgctattgcggtactcttccttccttgaatgtcgtttacttctccaggtgcatagcatagcttttttttttttttttggggggggacggagaccgacgagattaattgttgtttctgttttgaagctgaccattatatccaatcccaatccaatcgacgatgggcctctctcgtcggtttctgaacctgatcgtggacaaccgcatccctggagccaaatcgctgcgctgcatcgacctcaccctcgcgcgctacaagttgttcaacactacaacacctgctgcactgacactgaatgggaacggaaacggattgaagaaaaggatggagaagatttgtcttcccagcccaatcttcaacttgggagcaccaggcgaacggatacacatgttccctgctttggagcgcagggctttctctttggaccagtcggggcgtggcctccttctggaggcagacacatcccgtctggtggtgatgccaaatctccacaagcccaagttggaacccattgccctctacatccccggcgctgagatagatctggatgaccttgatggcggcggtggcggtactctttttatcatggatagaattgcgaaaccacaggaggctgactatttgttcgaggctttggtgtaccgcatgttctgttccagctacttatcaaagtcctgggactgccaactcctcccaccaccgccgccatacgtcgtcaaatgtggcgttgactttctaaagatcatctcatatggtttggttaaaggtggctctgagatctgcatatccatcgacggggttggtacttattgctttgacactgtgaaacacacttggattgaagtgggcaagtggatgctacccttccaaggcaagtttgagtatgtccacgagctcaagctctggtttggcttcactcccaacgatggccactttgctgttgctgacctctctgccatggacgagtacctgcaaccacagatacgccactgctggaacgaacttgatgagtcactcatccaaggatggaagcagatacgggaccctcagcttgtcaacctggggtctgccaagttctgcattgcaaggttctttcacactggtgactttggcgatggattgagtggccagaatgtttctgtcctgactggtgtagagtttacccatgccaatgttgaccatgagaatattggattgatcaagcacaaatcgagatgtcacaagtctagctgcggtgaggagaccatcacggcagttttctgattaatttaagggctgactccccatcctttgaataattttctgtctctctctttaagagaacttgtgtctcgtcctaattttactttagcataataaaaatgatacttcctccgtttcataatgtaagactttctagcattgtccacatttatatatatgctaatgaatctaagcacacatatatgtttagatttattgacatctatatgaatacaggtaatgctagaaagtcttacattatgaaacagaggttatgaaacagaggtagtaccttcgttgtccgcatgttgtaattgtctcctgcacttaagtaactgtaccatttactactactagtaactactataaacttactcttaatttatgtgttgtctactgcaatggtaaaattcgtttcaaatgctttcttggttttggttggagcggaaaccaagaaggaatggtaatcttgtgtgcttcctctgtcccaaaataagttaaccgtgcgggacttttccagaggaagagaggatgatacgtgatgcggtgtatattccttttctgaaaaaagtctaagttatactacggttaatttcaactttttcatattctatcttgatcttaaaaaatatatttggaaattatcgtgacctcagttttcatcttctttcatagactttgattttctaaagaaaattggtttcttaattctaaagatgccagtacgtcactgttcattttgtagttaactctggtacatgtttatgtgaaattttgattattcagcagttgaaaggaatggaggattgctttgtgatttataatcacctgtgctgctacttgtgctgcagtcaatagtctgatgggaaaaatggaattgaaccactgcaagtgcaagatatactgaaatcaaatcagtgggtaaagtctgacaagttatctgctgcactgaaatctcctcatgcgtttgtgagcaaggtatccagtagcattattatctctgtatattttcagagtatatattagttgcaacagatagtcgtcacatatataatctatagatggccataaggctcgcccggcacggcccggcctaggatcgggctaggcacggcccaccagcgatcgggctggaacggctcagtcggcacttcgtgttgggccgtgctggcccatgggctgcacctccggcctaggcatggcctactagcaatcgggccatgcagtgctagcctgaaggcacgggtggtccatcgtgccttctttgaaataagtctatttctcctctctcctctttgggctgtgacatatatgtagctaaaataagtctattttatgtccctattctttgggccttgttatataatacgtctatttttgctccctcgtgccctacatatggttgaaattaagtctgttatgcatccccacactctcgtacagggcctagtcgtgctgggccggcccagtgtgtcggtggggaagcccaggcacggctcggcggtaaggccgtgccgtgcttgggctaggccaaaatgccgtgccttgggccgggccatcgagcctcgggtctatggctatctataataggaaaaagtacaccgaaggtccctcaacttgtcatcgacttacaaaatcgtcctccaattgcaaaaccagatatatgacatccctcaacttacaaaactgttcactttaggtccttccgtggttttaaccccggttttgtccgatgggacagctgagtcagcgtgggacctatgtgggctccacatgtcagggtgtccaactcagcaccttctctctttcccctcttctctacctttctccttcactttcctttcctctctcgtgtctccgacgagcaatccggcgaggtgtgccatgaactcggtgttggtaacgcacgcagcgaggtgcggcggtgtccgccgggagaatgccgggattgtgccgacaagggtcgggttcaggcagacgcatcgcggcggctgcaacggcggcggcaggagggacgacttgagcgcagctggagtcgctggataggttcaattgggcggggtatagagccgtcgtcgacatggcccgcgacgaggggctcagcctccgcgtcacgctccactctggcgaccccgacatcctcttcaccgactgctccagcggccgtgactgccacttcttcgccgtcgacgagctccccgttatccacggcaaggcgccgctcgactgctacgacgccttcttcctgttaacgatgaaatttggtaagtccaaagtcatcatcagctgaaagtcactatcggcttccgagttctagaagcagccgatgggagttgtcaagtcgccatgctatcatgttcttagtggagtcgaatcaattgaagg

SEQ ID NO: 59841 - DNA, 10141 bp, Oryza sativa
gaccacggaatgaggaattttggggatagggttgaggggcattttgaccagtttgagctataaaatactccctctgtttccaaatatttggtatagttgacatttttagtatatgtttgaccattcgtcttattcaaaaatttttgtcaaatatataaaactatatgtatacgtataagtatatttaacaatgaaccaaatgatacgaaaagaattaataattacttaaattttttaataatacaaacggtcaaacatatttaaaaaaagtcaacggcgtcaaaaatttagaaactgatgaaatattttattattattattttttaagtgaaatcctaacggtgtacaccctccgtcccataaaaaaccaacttctgtagataaacctggacaagcatgtgtccaagtacatctcagaagttatctttttttttgggacggagggagtagggagatataggtcaaacggtagcttcgattttaaaaagtagggtgaaatagtcaaagttaaaaaaataagtatgaaatagtcaaaattaaaaaagtaagtcagattagtagttaagatctagaacatgatcaaataagcaattgtccctaaaatttttagctacgtatctcaatatattgtgatagaattataacgtatagttatataaataactagctgggtggcccgcgcaattgcgcggctagcacccaaacaaaatcatatatttttagtatgattttacttaaatattattaaatagataccttgttgtcttaagattttgaaagaccaaaccttatcacccccgtatttctaattaaatagtttttaaaaatcacaccagttactatcccttacttttgtcatatcttacttttgtcatatccttctttatttgtttgctcaatctatcccgggcgggggagtgatgtgggctgaagagaagggagagggagggggaggagaagaggacttgggaggacttgggaggaagaagggaggactttggaccacatttgacctaaagagagggagaggattatttttgcgttttttattttaataaatatggaattggtttttgttgttttaaaataatttcttatgctcttatacatgtttgattatgtcttctagtatttaacagtaacttttacccgtagggaagtatgggcattttgctattgagttaataaattaaaacccgttagataattacgagaagaagctagcttgatttagggctgaaaaattctttccgtcgaagaattcagggacgttcttacttatgttgtcaatgctcaggcctacactcgcttaatttatggcctgatacatctccatgtagagactgaattcagttcccatcatcgaaaaaaaaaagaaaagaaagaggtcaacgtcttgtgagcaaaccaaaatgattttcttgtgagcaaaccaaaaagaaaacagagagtatacctgtcaagccttgttatctagctaattaaggatacattacacatttattataaccagtagcctattgacattgctaagtattcaaccatgaatataacttaggtctctcacggtccggttaatcttatcgcacgcaataaagaacaatttttcgggaacgcgtaaaaaaaaaacagttcggttcattactttaattactgcccctttcgtactaaaataaacaaacacatctcacggcgagcaccgactcactcaacccttttatcggcaaggcgctcctggtctgaactgatatgacagtgtgacactgacatactctagtaaacgcttgtttattttagtactgtccagaagaaacattataccattctcatgcaacatgtcaaatcatctagctgaaaaccatagcaaaacaggctttttactagtagaaatactagaaaccatcgtaaaattgcttcctggttatctgcaatggaaatccaggacttcttcagagctgcactccaatgaactgggagacactgacttgaatcaagtctggaggagtgcatatgcatatgcacgagagtcttacttgtatgatgtcactagtagctacgctttctaacttttaactgcagagaaatgtctctttcttttctaccttgtgttgtgtgattcaatgtagcatagatactagcacagaagcttcattttaggccgataattccttctctcgaagaattcagggctctttaacgttgtcaacgttcaggtcacaatcagcctcgcaagttcaggtctacagtcttgcaacctaaacaagctggttttcttcattctgattctggaagtaagaaaaacagagggcatacttgtcaagcctacccggatttaatgtgttggcaacttttttgacaagtcgacaagcacaattgcaacacctaaacaccttgcggtgatatagagtctctaaccacctcgatctagccaaagggccaaatcaagatgggttttgcaaaaagaaaagctaaaccggctagcggagccgatttagagatcaaaatcagcctctaggccgatttagatcgatatgaggataactacccgtcttgtgggcaaaacggaaggttttcaggacaaacctacaaagaggtgtcacactctcgcagcggcggcggatggtttacggcgcaaaccgataaagatggactaaaactagggtaaaatagaaaacatagtaaaagaacgattcaagtagattgtattcgggggttttacaatgaaccggccttatcctttaaataggggttggtcttaccctctacaggctcttctccacgtccaactcgggatagaaaccaaaggaaatacgaaacatgccttcccgagcaaggaaacccgagacccgatgaaaacagactcggactcggaccctgacggtctgactgcccacatatctgcggtcagaacggccctactagccggtcagaccgcccacacacctgtggtctgaccggtcctatgaaggaaacccgtcactttccaaactttgtcaatttttccctatttcgtccataggtgccaaatttgggtgtaaacataatgttcaacaataaaagacgataacatctgctttaacatctagggcgtgtttagttcacaccgaaattggaaatttgattgaaattggaacgatgtgatggaaaagttagaagtttgtgtacgtaggaaaattttgatatgatagaaaagttggaagtttgaagaaatattttggaactaaatagtagaggtgaaaacggtacggaaacggacagaaacgacctttatcgtttcgttttcatatttttttcggaattgaaatcggaatcggaaacccccggaaacaaaaacggaaacgaatattatcgaaaccgaaaacggagcgaaaacgaaccggcgcggatacggtaacaaaaatttatcggaatacacaaacccctcaaactgagggtcaaactttgtcaagtccaaatctcaagtctcaacattcaacaatacatcacaaaacacaaccatatcaaatccaattgtttctctcagcagtaccatcataaacacaatctatgcagtctgtaacttcatatttgcataacaaatattgcatggagttgcataacttcaacaagcaacaacagcaagtcagccatagtacatagttcatcacaaaacattgctgagaattacatagttcagcaatagtagaagtataaagtcagccactatataaacatatgttagtaaaacaagcacaaaccagggacaccaaggcacaaaaatttcgctccaggttctccattcaccagtcaccaccactccaccagtggggcttgagtcggcggcggtgacgaggacggcgcgagacggtggtgcccgggacgacgcaagacgtcgggggcggggacggggacggcgagcgactacacgagacgcggtggccgggacggcgcgagacgttgggggcggggatggcgagcaacggcggggtcgaggacggcgcgagacggcggtggcgactggcgaggacgaagcgtagggggcgatggccgggacggcgcgagacgagctgacggcggtggcacgagacggcgacggcgtgaggggacggcggccggcagcgccagatctggcgcgtggtgtcgctgccgccactgcaaatcctcacccggcggctgtgtctctcactctctcggctagttagtggccggctagacagtggagtagtacactagttactagtgtgttgcagtgttgggctgggctagtgactactgctagtactagtgtgttgggctggccggttggacacaggaggttttatggactttgtaatgtcggaaattccgagaaagttttcggaaagtttccgaccgattccgagtaccgtcgaaaactgctattattattttcgattccgttttcgaaaaattccgaaaaaattccgaccggctgattccgttttcgaaaaccagtccggaatccggaaatattccgtaccgttttcacccctactaaacagggccctagtaaaaccatctgaattgatatcaacttgtatctgcattggtgaatctatctgacactgacaagtttcaaagttcactgtcggtccagttctctgtctcactaaggctgtgtttagttggatccaatgtttggattttggttaaaattgaagatgatgtgattgaaaaattgtgtgtgtatgacatgttgatgtgatggaaaaagactgaaatttggattcaaactttggatctaaacacagcctaagatcatttacaatgcaagacgaggcgtgtggcaatgtagagccacgtaggcggagtgcatacgtggaagagaggaaggggtggggctcccatgacttgagctggttcgcgtagcctcgtttggctccgataacctcatcgaaagaaaccagcttttgtcagaagaatcgtgggaaaaacaagagaggaagggtagagactcgaaggaggaggacgaggcggcggcagcagggttcatcgccagagacggcgaggaagcggcggccagggcgtcggcgaggaaaccacgaccacggccatcctcacgccgcgccccgacgagccgcaccgttgtccacgtcgccgcagtgaaggatgagatggcgcaacaaaagctccggtacagagcaatttcagataataaatgcattcactaattaaaatatctacataactagtacataccaaaccaaattaatgccctatttggactgcaaaaaaaattcagatacagctattcaggccctgcaaaaatcagttcctagctgcatcccaaacaaggccgaaatgctctctgtttttgcaatttcaaaggggtactgtacataagtatatatcatccagtgttcatgagttcatctgcatctgatatgatgttcaggcatagggccattgtgcatgccattctgcattattggatgaggcctttcatcaccaccctgaaacccatcgtttccaactttttggacagcttgatcaggtgcagggttgctgtcaatgacaatatgaagtggccttgattcttcagtggcagtgctactagtactgcctccatgctccacatcatgaacatgagcttcgatcaattttacggtccttgagatgagaaagtatcttgaggtatctaaattttacagtaaaatttttggtatcttgagatactttggtacctagaggtatcaaattttgcactagaaaatataataactctaggtactttctcaaggatggtaaaattaccctactaattacacaaaaacttgttgaattcctccatggatgcaccgtgcacatctgaaaattttcagttgagtggtgtacagtaattcccagaagaaaaaagtgaggtgattagtactactggttgctaaatccatggggttacaccggctaatagttactgttgacagtacaaacatcaaaagtttaataacatgttaaatacattggtttctagcaaaatatatgttggttattttcaaagcatataggtttaggttaaaaaaagagtctagtcagttataactgctaaccaagttagtttcaaaaatcattagtaacttctatgaacgagggagtacatcctaactgctgagaaatttctctcttgctacgtagcttgtgtgatccgatgcgtcatagataattacgcagaaggttgattttgggtttgaaaattccttccctcgaagaattcagggttctgcacatttcgctatttagagctgtcaatgtttaggtctacaatcagtatatcttccaagcgaagcaacctgactttcttgcaagcagaaaagagtggacacacgtactgattccctgattcaggctgtgtttagttcacgcgaaaattgaaagtttggttgaaattggaacaatgtgacggaaaagtttgaagtttatgtgtgtagaaaagttttgatgtgatggaaaagttggaagttcgaagaaaaactttggatctaaacacggtgtcaaatgatcaacaagaaaagttagcattgcttcaacttatcacagcctgtatctgcattggggaatctcatctgacaagtcacaaagttcatcatcggttcatgtttttatctcagtaactggtaatttacacaatattttacatatttacatcgacgcaataaaaccgtcaaaacagaacaactctagatggtgaataaacccactaaaatatctactcctacataactatatccaaccaaattaaggccctaatttggattgcaaaaacattcagatacaactattcagaccctgcaaaatcaggaaaaattcccgggtcccaaaacaaagcccaaatgctatctgattttttgcaatttcaaaggggtactgtacataaccacgctgacacatatcatccagtgttcatctccatctgaggatgatgttcaggtaccgggccattgatgcaattctgcactggatgatgcctttcattgccaacacttgcctgcatcagttgggcatcctgacacccatcatttgcaacttcttggacagcttgatcaggttcagggttgctgtcaacaacaatctgaagtggtcttgattgttcagtggaactgctactagtactgcctccatgctccacatcatgaacacgagcttcctttgcgcatttggcgcaaattaccctattcacaacgcttatcaggagcatcagagcagagatgcagccactgatgatgaagaggccagagaaactttggagtgtgagagggtttgagtcactgctgctgctgctgctgctagggtttgcatcacctcctgtggactgttcagatgagccaaaccacttctcttcaatttttgaaccttcagtctctcctgtaaggttcaagatagctgtagagagatcatgcaccagtggagaacctagaggaaatacctgaatacaaaaacatgatgcaaactaattagacaaaaaaaataacttgttgaatttcttcatgtaagcaccacacatctgaatgttttccgagaacacgcaaaaacttttcgcgatatactaattgcaaaaagaaaagaaaattgaagaattctgaatctaccaaagtgaacaagattgagaagcttacaaatccaaatccgggggtcttgtagaaccgattaaccatctgaaattctttctgatattgggggttggataaaaaagaagttaaataagggatctcgtcgacgatcgccgacactcctccattcatggacccctttctcagagcttcagcatactccttttgtgttccataagaccttaacctggatggcatgaaccctcgttttttcaggagtgagccaacaaatgatccattttgatatccaacatagtcaccggtaaggaggagctgatccaagcttttcaccgatggtcggagcctctttgcagttagcatggatgacaagcttgccgtgtagctctgcactaggatcagcactacaaagcaccatatcaccacaacaatttttgacaaagggctcttgataatttgacctgtttgaacattgaaagaaaccaagtaaacctctaatgatgcaattacaaaggagcaattttatgatctttggtgaggtaccacaatttccggtatgaaataaccatacccttttatactaaaatactaaaaatatacctaaaggagaccaaaatttacactataaatgtcatacgtctcgttacctttttcaaagtaaaaaaagatctcgttataataactatgtgctttatttatgtttggaaaaaatgtacaacaagctgtactctctccattcatgaataactagcactattgactatacaactgtcttaccttgaccataaattatttttaaatgatcatattgtaatgaatgaaaagttatatggttatatttacgatgcaacacagtccgataatataactcgttttcaagtatttattaagacaagatcagcgatccaaataaaacatgaatactaccggcgtcaaatatttaggaactggaggagtaaaagtagtaactatattaccatgagaaaacgtcagggtggagaaagcaaagtaggaagcagtgctgagctgcctcacacttgatccttggtactccgggtttcttggctgctcaatcatccacacgacgaagccggtgtagaagaagaagccgatggtggcaagccagagatccctggtcagtggcttcacgaaaatccattggattggcttggagtcgttctcctccggcaccagcagcgacacaccggacgacgtgtatggcatcgtgaattccacgaggttttctcggtcggctgtgatggtcacgtcgcccactgctgcgctgaacttctgaagataccataagacagaagatgtatgtcagcacaatttcttagaaatgtcgtcattcaaagggacttggcttaaattattaggccctttttgacaattgacacaaatataatttgtttaaaaaaactagctatttctagttccagaaatctttatatctaaatatgccaatgtatttgtagcaattgaatgagttattctgtttgtgttttataaaaaatatacaatttcaattcattataatttaactttacaaactctagttttaaactgatttgttttacatttttatggtcttattttgaggctgcgatattatacgatacttcttacttagatttcccaaggaacatacggactttactaattattttatataaaattttcggtaaaattcctcaattccaaatgatatataacactgctaaatctgatatctcccatataaaagtgaaaaatataaagtgctcttttcgtggtaaattggtgaagcttatgcctttgatttgttttagttttcttatatttaatataatcagccttgttaggaaaaaacaaatgttttcgaaacataaaaagtattttttactactatctcaattttaaattaattattgttttagttttgtcttaagtccaaatatgtttatctttgaacatcaactaatttatggaaaatcgtaataatttaccacacatgttgacagagctcggggctcctcaccgggagaccgcgcaggcccccctttgccagttcggccgggggcttagggtgagatctcaagctctcgctgtgtgtggaaagatcgcgtgccaggaagaaacgcgagacacggacgatgtatacaggttcgggccgctgggaagcgtaataccctactcctgtgtttttggtggatctgtgtaagagcaagttacaaaaaatcaaccagccctctcctctctcgggaaaatccagccccctctctttgtgggcatggtcctccttttatatcttaaggggataccacatgtaccctttcctttccaaactggacttttcttctctttatggacggagattggtatggttgccgtccgaatgacatttcgatgggacaacccacacctaccttcactcccggcggagacaggcgcaacgtgggatcgtggctgtctgttgctgacgcgaccagtgtcagaccggtcacagatcggtcattcttgtcctctatgcgtcagttcagcgatctggatgatcacccttctttttgtagcatcttggctgtaatggttgggatgaagcctgg

SEQ ID NO: 59842 - DNA, 6533 bp, Oryza sativa
gtcccttgtcacccattctatttaatttagtaggggatgcattgacggctattttggataaagctaaggaaagtggaacttttgaggggttagttcctgatttaattgatgggggtattacacacttgcagtatactgatgataccattctttttgttaaagctggtgatcataacatcctggtgctcaaatttcttctattctattttaaggaaatgtcagggatgaaaataaacttattagaagtgtgaggtctatgggtttgggatggataagagtaccgaactaaggtttgctgatatgctgaactacaaagtgggtgatttgcctctcacctacttgggcttgcctatgcatgttgagaagattggtatgagggaattatgttgtatcactcagaaagtgaaaaaaggctccagtaattacttgacatatgggggtagggagataaaaatctcatgtctatccagtgtcccaatgtatctatggttttttatttacttcttgatggttttcaccacaagattggtgctttaagaagtagattctattggcaaggtttggtaagagaaaatatcatatggtgaaatgggaggcactgtgaagactaaaagattatggtggaatggggttcttggatactaaggtcatgaacatatgtttcctaagtaagtggattcttaaattagaaaatgggtgtcctgacatgtgctttgagatacttaggaagtctcttcatccggtagattggtgatgagtggggagtcatctggcaccggatgtgcagcaagaaattccgccaaggcttggcccttaattgctttctgcggtacaaaagtgatatcatattccatcatgagcagggcccatttactcgatgcctggggaatcgacgtcatcggcctcatcgatccaccttcttcaagggggcatcgcttcatcctcgttgcaacaggaagaagtatttgagtaatgacagtttctttgagagctcagctataccgttgtctcaattttggaaagggatgcactattttaagaaatggctggaaaggttgattgagaaaaagttttacaatggggtttccgtgttcttttggaaaggtgtgtggtgtgggacaaactctctgagggttcagttgatttgtatgagattagttaccagcagggggctagtgtgagtgatgtttttgatgagggaattggaagtatgagtgatgtttttgataagggaattttagaaggaacctgaatgagcagaaagatagagatttatctcggaatatggatccgattgtttggcctcataataagaaaaaccttttcaccaccaaatcaatgtatagaatcctgacttttggtggggtgaaagatgccgggatgtgtgagatctgaaagagtaggctgcctcttaagattaagcattttctttatctggtgggtaggggtagacttccctgtgcaaatcagttagttaagagaaaatggagaggggagactgaattttgtaagttgtatgacaaaactgaaaccactgctcatattatttttggttgtcctttagcactttttacatggtgtattgtcaaggaggccctggacctttctggctatcctaacagtttttgggtctgtgttgatttgtagaaagataaaaaggagactaaactttggatttttcttctggggtgtctttgcagggctttgtggttaactaggaatgggtgagtgtttgaaaacattctagtaaaatctccaatgcaggtggttcaagtctttgtcctttgcacagaaatggagcatcttgctaagagagaaggagcgtgcgctgctgcaaagttggcgtgaagcaatcctgtagaaattgaagcaagtcaggcctcaaacgctgccaggagatctgtggtgctgcttcttaagtaaaaaattgcttttgctgtgttgtttcctctatgctcacggtgtaagctggcgtccccagcaaaaacctaaagctgtttctttttcaaattttattttctgtaaaagactctgttatctctttgggctttctttaaaaagccggctccatgcttgatctgtcatcaaaagaaaaaaaattctgggagaaatggtgaactcctgaactcgtcatttgttcggttcagatttcagtgttgttctatgtcatgtccagttttcagtgcatcctgttggctgcaatagctttgctggttgaaacgagtccatgaaagggttatgttgctgttcagcattggatggcttccttacctgctagtccatcctactccctctgtcaaaaaaaaaagctaatctagtattagatgtgacgttttctaatataataaatctagacgtgtctagattcgttgcgctaggaaacgtctaatccaatactccctccatcctatgatatagcaacaattggatgtgacactttatagtataacgaatctggacaagaagcatgtccggattcattgtactatgaaatgtctcgtcctatactatgttgctatattatgggacggagggagtactagattaggttttttttacggagggagtaacatagtccaaatacctgaacattaaacgacaagacatgtaacagtaatgcgtagttattattggactataagggaatgaattcgtcagccgagacgcaatacatcacaaatttgcaccccgtagcaatacatcacaaatttgcaccgcattacaggggacgcgcctgttcggtgctaaaaactccatcgagtcaaaccatgcagtcccaatgatttggtcatcaccaaaaataaataaccttagcctgtagtaagaaaactgactgctcgatctactcgtattcgtatacaagaacagttctatatacttatgttgttacgataggtttcattaagtctctcattggatggcgtaatcagtcaaagaaaaagctaaattttaaattttcaaatttaattttaagattgtttttaagatattttctacgcagtttctttttcagtattagcttttaagtcaccaagatttacgtataaatttaattttattccctaataagccgttttgatttattaagtaataagccaaatgatgggaccttaattcttttctgaaaacttatgcttgtccagctcctaaacattacaatttttttttattttctgaaaactttttccatcaacttttatcagagaactttttaaactaatgtattcaactttctaacatttaattcatttattcgtactttcgaataactatcatgaacttattagtttcatatcgaccgtacgtatgtcaactataaagaacgcatgtacagtatagttaggagtaggtagatatagtacagccttgagtacttctgaatagtataactgaataactgagactttctcttgacagtttgtacttgatctatatatataatatacttgggaaacactctgaatttctgactggtttcatatatacaccaaacacacacatataaagtaattaaaaactgtcaactagctagctatcttaacagtgtattggtcgcgtaggagtatatatcctagctctagtttctacttaattatttaattaattagttcctgtatacatgtactactgcttatatatacacatgcagtacgttcgtctcgagatgtccatgcactgcgagcacttgttaattagctagctcgactaagctcttgcttaatttgcagtacattaatttgttgcacgtacgtaatacggcaatggaggagcaccgtcggttggctatggcggcggcgttcgtcatcctgctcacggtttggagttcgccggcgatggcaatggcggcggcggcggcgacggaggtgcacagcttgggccttaattgcaatggtaatgctaatatgagtgaagaaatatgatctaaacttatttgtatttttcaactttactagtacacattgcatatcgctgcatgcacgaattcaatatagttttatattatccccggatacttcggtgagcatttctatggaagtacgaattacactttgaattatttatataactacgttaaaattctatcccaatatatcgagataagtagctaaaaattttagggacaatttgcttatttgatcccattctagatattaactactaatctgactctatttttttttaactttgcctatttaaccatattttttaaaatcgaagctaccgtctgactaagttctccctacaccattagggtttcacttaaaaaataataaaaaaatacttcatccgtttctaaatatttgatgccgttgacttttttaaatatgtttgaccgtttgtattattcaaaaaatttaagtaattattaattcttttcgtatcatttatatattgttaaatatattaatatatttatatgtatacatatggctttacatatttcacaaaagtttttaaataagacaacggtcaaatatgtgcttaaaaagtcagcggtgttaaatatttagaaacgaaaggagtattttgtagctcaaacgggtcaaaatgcccctcaaccctatccccaaaattcctcatcccgtggtccacactcatctcggccttctcggcggcgcggctagctagctgcaagcgcgctttcggcggaggcggcgcgcagagggcgcacggctacggtctcggccgtccgtcgcggagggacgacggaggctggcgcgcggcggagggagggacgacgacgcgccatacctgcctgcccctgccgcctccatcacgtacgcccctgtgccgtgccatgtcttgccctccggtatggttagcctctgctgcttcatttcatcctctcctgcgcgcccatcatctccatgcgccggctggatggatgtgttgctaatctcgtttgaaagaattaattattttctgaaccttcttatccaacgagattttctgaattatgcgacaatgctatgtccttgcgattaactctctgtatggtgagatatctgtttatctggtttacgtacgtgaagtgcaaattaaagctttgccaagttcctgttaattcactagcttgtgtctcacatttgtctgcaagtttcctttaatttacgtttgtcaaacctttaattatcaaaattcgtcaaatctaagacaaattaatttgtcaaacctttgtcaaaatcgggtaaataaataaaaacttttgataaagtagggtcaaatgagcaagggcataaacgatatttttattacaggttaacaccattatgttgccttctcgtaatagggtcaagtgtgatcttcatttttaaaaaagagggtcaaatgagcaaacttaagaaaacagggttaaattgggagttaggctttaaaacagggtcaaaaacgcaattgccccaaaattttatgcataatgaaggtatattttgacaatgttggctatgaatttattgtctagcactctacatacttacttacaaatggtagtagcatatttgttgcgataacactcatctggtagaaggatatatttatgatcgtggataattccacctgcacggaatttgagtagtattttttttatgttgggctaaaatttgacatgcaaagtcatccccgcctccccacaccaactacaccgtctgaatcagagctaccttcctgtaggtgtctcctcggcacccaacccctaaaggccgtggatcccatatccatccgtccatctaagttgaggaggttcgctcttcatcttaattcttttttgagaattttttttattattaaaagtttgcggggagttcatcttgacttgttcactccacgaattcttagttttttttatttaaaattttcttatcttatgtgggccaagtttgtgaatggttattgcaatggcagtatcgtagaatcaaacaagcagtacacggaattttacaagtatccataaaaatatagtggaggagggaaaaatggaaatgttttaatttgccatatgtacttgacttctatgaaatgcgcctaacagaaatgtgcaaatatatgcaaagaattattgttgttattgtgcagtgaagttcatttttgctcataggacatgagaatattggattgacaattgacacgaactaagtctgtgtttagttccacgccaaaattggaagtttgaagaaattggaacgatgtgacggaaaagttggaagtttgtgtgtgtagaaaagttcgatgtgacggaaaagttgaaagggaaaaagttggaatttaaacagggcctaaccttttttctttgtccctgattcagaaaccaagaggataaatgctggagtgaggaggaacttaggatgtttgcctgaagtttatcataagaaactcaagattgctgtgccactgaaacatggctttagagcttttgtgaatgtaactgaccaaggtgtcactggctactgcattgatctcttcgaggctgccgtgaataagttaccataccgtctgatttatgagtttgttgtcttcgaccgttcttatgacgagct

SEQ ID NO: 59843 - DNA, 16440 bp, Oryza sativa
attcccatgtaggccacgaaaaccacagagcatagcataagatttgtaaattataatatacctctgaaaaagatagccctgcatttctatctgtgtaccaatagaacattccttcttgaatgtccacgctcaaagcaagagacatgtacatgtaaacacatggtcgccatacttcaggacattttaaggttgccatcattgttctacttgcttctacaaacttcatatgggcctaattttttaacagtagacaggaaaatgtcaatccaggaaaacaaaatagtacttatatctgacatgaaaaagcaaaattgtttaccagctcatatggaaagttgggcatatggacgtcctttatcatcattccagctaggattaccagggcagaaggtattgccaacatgccaagggcacccttgagaaacacaagattaatctatgatgagacaccgtcacaagaaaaactgaaaaagcagcagtggataaaagagagaagcaccaccaccaccacttcacttatatttatgcagaaacaggatctttcagtggagaataatttaaatttaaattgattgccaggactatagtaaagtggtataaccattgtgattctcatttagaagtacaaagtactaacaaacaagtaaaaccaacgatactcacttgagagcctattgcatggacaaggaaaccacttattgagaatccaataagccctcccacagatgcacagaatccgtttaagcttatcatgtcagcagcaagatgagggtgcactatactgttttcagcaacacaggcatctatagttacatcggctattgccacactagcacttccggccatcaatgccaacaacgcgaacaatacatgaagcttgctgtggagagataatacaagcatcgcgactactcccatgaagcctgcaattcctcagcaaacagggaggcataatcaataaaaataattccataacctgtaactgaataacagtcgcacttaatcaaaggaacattatgttgaggaaataacagtagaaaaaaacatatcatcagacttgtcagtactaaataagtcaccgggaacatgaaactatgccacgttcctcgtcccgggaacgccgttcccgttctgggaacacgggaataacctcgtttccccccatgttaaaacataaaaaatgtagcgtcccatgttccttgacccatcgatccgggaacttttatgacataggtactaatgctaccgtgctacggcaacagctgatatatttgagttagacagcaaggctgtttatagtaatgcacctacataactgcattgatccatccaaattaggtaatggacaaaatttgctccttcaacccttttatgtagttcaatgatccaaaatattaataactcaatggaaaactgttctatgaacttcggcctaaataattaacactcctcagctaaagcctagtaatgaaaagagatagtgtcccaaggagcatatcgaaactcgatacgcttccttgctacaatttcagcatctaatcatcagacatcactactctcaggtcctaaaatttcagtttgcgattcatgattaaccagtaactcgtttttttttaacaaaagatgattaaccagaagttttccattgcaatcatcatcagcagcagcaaaatgggaagcgtgaagtactgttaccacctgcgatgacgaagtaagggcggcggcggtagccggcgatggggaggacgtcggtgaggaggccccagagcggcttgaccatccacgggatggaggtcaccccctggtacacctgcgccgccgacggctgcacccgctgcacgtccttccagtagtagtccgacgccacccgcatgacgccgccgccgagcccctggctggcgccgtacgtcgccaccacgcccgccacgaagctccagtgcagctccctccccagcatcctgaaccaccccaccggcgaccacgcgccgccgccctccgccgcatcgacggcgaggaggacattggcctcctcttgcctgctgctgctcctcccccccttcccctcctcctcggcgcggaggtcgtcggcggcggcggtggccggcgacatcttcttgcgcaaagatctctcgcctggttttacccgaattgctccggcttgaatctggagctcggattccagcaccagatttgggtttcttgaatccaaagctcggagctgcgaggtaggtgcatcagtaatcgaatcgatccccaaaaagtcttaaagaatcaagagaaaatgtcggggtcttggcaagaacatcaaatccaactgctgcttcaacctctcagctcctttcacatgcttactactccacacagatagaaaacaatcgccaaaaacagaacagaaaaaaaaaactatatgctaaatttgccgcagaatgctgcctaattgcatccaaaaacaccactcgagtatataaacagcagagatttggtgcctgaaaacaagaaagaaaacgggggaaagaagtggagccgaggagttattaaatttgcacgctagaagtgaggaagtccaaagaaattgagagatcccttctggttggtgtgcaggtgtagtagaggtatagatggccatatggcccgaggcccacggcccggcacaaagcccgcaattttggcccggcccaagcacggcccggcccgattagggtcgtgcccgtgccggcctggcccgacagccgggccgtgcctgggctgcaccctcggcacggtgggccggcccggcacggcccgatcaaataaaaaaaatatagggacaaaaaatagacttatataatcgtataaggcatggcccaagaaaataggtatacaaaatagacttattttccagccatttaaacacaacccacagagttgagggaccaaaaatagacttatttccagccatttaaacacagcccacagagttgagggatcaaaaatagacttatttccagccatttaaacacagccacagagttgagggaccaaatataaactctttctgtgaggcagcacaatagcccatcgtgccttcgggccggcccggcacggcccgactagtattgggccgtgcctgggccgtgtatgccgcccgtgggctggcacggcacggcccggtgcatcggtcgggccgtgccggcccgacaagcctcggcccaggcacggccgggcttgggccgtgccgtgccgggcggcccagatggccatctataagtagaggagaggatagccgtttgtcttattaaaattttaaaattttaagagaaaattcgatctttagtataggaaataaagcggtaccaacaaataacacaaaaaaaaagtttccactttcgatccatagcataggccaccgattttttttcgtcctgtagcacttccgtcgcattttgaagtaatagcgttagatcgggagtagagaaaatttttgtcggactcatttgcccttccttccccacattccccaccaggtctcctcttccgctccctcctggatggcggcgcggcaaccatcggcgtgctgggagaacgcctcgtctccccgccaccgccgagcgagctgcggcgctcgtccggcgcatttcttccccgccggcgactacttctcctcctccaccggcggtggcggctgaacagatgatgatgatggcgccggcggagtccgtggcgcacttcgactctgcgctcagctcgctcgtgtcgtctccgcagggcggcggtgatgagatggcggccatcggcgacctgatcggccggctcgggagcatctgcaaccacggcagcgccagcgccaacaactcgtgctacagcacgccgcgaacgcgagcccgaagctgtccaaggtcgccggagccggagacgacagcgactcggcggcggcggcggaggataagctggagccagccacaaagactacatccatgtgaggatgaggaggggacaagccgccgatagccatagcctcgccgagagggtaattaattaattacctaattaatcaactaattaattagatcctaattagctttttgctggtgcactaatccgcgcggctcagcttcgccaagtaggagcagcatctccgtgaagccgtcgccatcgtcgtcgaagatggccatgctctcgctgtagcagcagcgagcacgctgctcgacagcccgaaccccgtccacgaagtcggagagcgggacggtgggtgctcgctggaggaaacggcggaggaagcgccacttgtgctgctccatggcgtggagctcgtcccggccgcggtggtagggcccaatggacaccagccggggctcgtacagctgctgctgttgtcacgacgggagccggcgggaacacggaatggtgtgcggctggtgacggagacggcggcgacgcgactggggacggggatcgtcgccgcgtcgctgtttggcgacggcgccatcgtcgtgggcaccgaccggagagaacgagatgacacaggaagacgaagggcaaatgggtccaaaattttttttctatacttcaatgtaacgctgttagctccaaacctgatggaagtgctatggagcgaagaaaaaccggtggcctgtgtttctaatcgaaagcgaaaaatttttatgctattttttggtaccgctttttttcctatgctgttgatcgaattttctcaaattttaactgtaattctgcgcgctcgctaactgaaacctacccctatgcaatctcacagcttctgacaggtgggacatgctggttgggaccacagagcagtgagggtaatgcgtgcctgtacgacgagtgactagcttaaaaaaattatacgagttgcttcgaaaaatcatattaatcatttttcagaaaaaaaaaatattagctaatacttaattaatcacatgataataagccacctcattttacgtgataatacgtgttttacgacctctaacataccgaacacagcattagacgggtacagttaccgaaaattggcccttttacaaaatttactgtaagagtgaaccatgtcgaaaactaattgtaaaagtgagtctgacctcagcgcatgtagatgtaacatcttaacactagggttggcactgtgctactccctccgtcctaggaaacccaacctagtatgtaataggtgagttttttttttttttgacagatgaagtattctccaacgtgactcgaattttccaaattagcatagttcagcaccatgagagctccggatcgaatgaacctgttcatggtactaccatgtatggtgaagtggctctagcctagtggtagagcacctttcactctcatgtcttggtggctgtggttgtggttgtgggttttttctttaaaatatcacatgttttgttccaattttattttataaatatcacaataaaaaatgagaacttaaattataatattaatattaatacaatatttagctcaataactataaatttgtattttttgtacatcttaataaataaaagttacatctttctgtttaaatttaaaaataaacttaagaacccatttgaatcgcaggattgaaaaaggtgatgaatagaaaaaatacaggattctaatagaaatgtaagtgtataataaaagattgcaaaacacggaaaaaatacatgaatgatcgtttaattgtaccacaggaaaaacgtatgaatcggatgagatagattcaaaggaaatttttcaagaggttgggctcttgctaaatttcctccaaaatctacacacaacgagtcatttcataggattttaataggatttagaaagtttcaattctttaaatcaaagggccaaatagaaaaattttctataggatttaagtcctacgagattcctatataaattctttgattcgaagggactctaaaacatagtatgaactatcagtagaaactagttttcacttttcagaacttgatggtaagcctcccgtgaaaagaaatggaaaagatgaagtgcatgggggttcaaatctatgatgcaaggataggagccacagacccgaactaaatttgaaaatatattgtctatttattttttctcagaaatattcgggattcaattttttttgcacaaatataccgtcggtatcgctcaacggatatgcgaaaatgacgtgggcgtgacaacgctgacaatgtcgcacgacgacggcgcaaaaccactcgttctcgcgcagcgctggcgtgagaccgagcggtctcgcacaacaaaacagattatcatttcaaaatggcttaattagtgattaattagcctgattagcgaattaataaattattaatcaatcactatctattattaattaatcaataatcatgacaattaatcactaatcaatcaattctcaaaacggtttcgctgtttggccgtgcgagacctctagcattgtcacgtccacgtcattctcgcgcagtggttaagtgatatcgatagtatatttgtgctaaataatttgaatcccgaatatttctgagaaaaaacaaatgaacaatatatttcaaatttaattcccactaaccctacaactgagctaagaacgttcaaacaaatatggcttccagcatatttggaggcagcagaggtcggcgccaagccgccaactgtgttggcactgagatctcatgacgtaccgaaagttgccacctcggacacaatctcagcgtcaagaaagcttaagtgattcagacacgatgccactacatctaattcgtttcccgaaagttgccaccttggacaatacaccaatagattgaactaggagtgtttttcccttaccccaaaattcttcttctcaatgtatgtcaccgcgaactaaaagcgcacaacgcgaactcaactggagcttccgacggcagtagaatccagcaccagccagagctcacccaccacgcaagccgcacaattaggaatatctgattgaaaataagaatcaatttgcacaattaggaatatctgattgaaaataagaatcaatttgccacaatggcagtgtttggtttggttcataaataattctttcgtgtttggttcataaataattctttcgattttacatgcgtactggtctcctcctggagcagagtgtagacgcggctcaacacctgttgtgctcgtgacttcgtaacaaacgtagcctaaactgcagtttgttcagctcaatcacaacattttagtgcttacctttttaacggaccacacaatctcatcagtaacgaaagatattagcaaaaacacatagcagccaccaacaacacatactcaacacatagggcatactcctgtgttcttggtggctgctatgtgttcttagcactacgaaagatattagcaaaaaacacatacgaaagactgctccaaaccgggatgaagacaagatacattcaattcttaaatctagctacagcactaacacaatttactgcacccacagagcaatgtttgtcagggtaagtcatcttacgcttacccctattcatctagaagaccaatgggtatccataatgaaccgtaaaaccaacccaaccgtaaagtctgtaaccaatatcccactaagactgcatggcatcatctcctgcttcacccggcacttcattgaacatgtactggctctgatactccatcaagtactgcgtcgatctcttgacgtccaggaacagctggtagaccctgcttatatcctccatctccacaaccttacccttgcgtttctggcaagctaatgcagccgaagtgatcaggtggatagcatacctcagggacgtctccactcctatctttgtgagcaaaaccttagcatctgcagacatttccacatcttcttcatcgcacctgatgtctaggatcttccggatatcatcctcggtgtaaggctgtgtcgtgatgattaacagacgatcaaggaaatcaggtggtatcccatgtggtgatcggtagtttgtcccacgtatggatgtgatccctcggttagttgcaatgactagaattggagccatgtcattttccaatgcacggtttaggaaggagaagcattcgatatctagcatgtggacttcatcaataaacagaacaccagggacaatctcagccttcccttcctccctccactcagcaacttttgtatcaatctgctctcgaacctctgcacgaatttcaccagtgtcaccagtgaaaagtgcaagaaaaccttgtgtcctggacagcaataacaaaaaacaaaaatgagtttgtgcaaagatagtctcacttaatttttatggtaggtagaaaaccacatctgaaagccaataatcttggtctaatgaccaaaaaactaccaagccagttataagttagatttttggtgattaaaaaatggaatgttcaaaaagattcaccaaagaatactatttagaacacatcagatagttgtttggctgataacatacttagagagagagagagagaggagagggagacagaacacatcacaatcacgatcagttcatgatttcaaactagttgaagcatattcatgtaccttgtcttggaacatggttcatttatgtgcacatgatactccctctgggctgataatacttgtcgttttagacaagggtgatgtcaaactttagaatctttgattatgaatcatttttaaaatatttttctttcaaatatggtgaccaccacatggatagattagtcttaaaaagcactttaataaaatcatatatttgttaacacttttatacatattataatgaaaaataatggtcaaagttgttttttgtacactgtgcccttgtccaaaatgacaagtattatcaacccggagggagtaattgctaagctatccaaagtaccattaggcttgactaattttcatcacattatgtcctctagcaacatcgtgcaggtcctttctttcacaagagttacaacaggaggctgctctctattgttatttctctacgggccaaaagaaaaattagatctgatttgggcagctgaattgtatttcagctccaagcccaacaagatcatatatgccatccagtagtcagtagaccatattttcttagtattggctaactgtgtggatgcggcacttagtagggagaaactgatccaactagggctgtccaaatccagtttaaccgagttctgtcaacccgcattttacatgtctgcaggtgaatgaatgagatgactaggtgcgacgtagtcactggaacactatggttagctatggtttggccaattttgctaatgcaggaatgctcaaccctttgatctagttccagcgtcattcaataggatttgggtggtgctgagaatgggacaggggttgtacagtataatgcagggacttccgtgcaaagagcatggtcacagtgtaaggcagctaagcaagattaaccgatttcaaatttattatgtgattctgatcactgcagatacacgacacagaaattattttccattcaggctcagaagcaaaatacaagattgtaaggcagtccttaatttggaatttggagcgacaagctgacaagtgatcctttgtgtgcaaacgctggaacagatttttcaagactgaaaaagaaactttggtggctaagctatcacctggataattaacatacaagcaagcacacagcacatatgtccagggtaactgaaagtcaatgtgaaataccagagctgatagaatttgaaatacttcagttggttatttcacttgtatctatttttcagttgagtgataccaaagctgacagagacttcacttttgtccgcttactcgttgcagtaagatgtgataacaaacgccctttaatatgtagttctctactatgccaaaatgattaaatacttcaatgtagatttcttgtcaggtagtatgaaatatctactccagtaatggacgaatttttgggaagggaatgtgaaattaccggctattgatgacatcaatttcatgtaaggtgacacaatgcacgacctccttgcgcttctggagctcgccctcggggcacttgacgaacttggtgtgaggaccaacagcatcgtaatcccgcgacctcccgattgagcggccaagcttggtcaccttcccggaggccttgtcgagcgcaaccacatccccgctctgcaccttctccttccccagggcctcaatcatcttgccgccgagctcgtacacggtctccatgtccgtggtcttgagcgtgaggcgcccggtcttgccagccgcggcgacaccggaaggcgcggagctgccggcggcggctgcggcggagacggggcggtcgatcgagatctcaacgacctcgccctcgatgatctccgcctcctccttgatgcggacgccgatggagcggcggaaggcctgggtgagcgcctcggtcttggagaggtcgagggagaagagctcggacgcggcgacggaggcgaagggcgtctcggcgccgagggacttggcgatgcccatggcgagggcggtcttcccggtcccgggctggccggcgaggagcacggcgcggccggcgatcttcccctggcggatgagctgcaggatgagccccgcggcgcgccgcgcggggagctgcccgaccatcccctccgacgagccgcgggcctccagcgaggagtccagccccagcccccggatgtgggagtgcgccccgatgcgctcgatccgcgtcaggtcgcggctctccgacagccgcttcagctccgccatggccaccacccgccgccgccgccgacgaggtgcttttggcttcccgagggtactaaaagagaagaaggtttaaggcgaaagggggggaacgagttctagggttttgccagccagcttgggttgggttgagtggatggatatatgaagacgaagacgaaaggggggagcacggagaggtgttgcacacctgcacttgtgacataatgggccgttactagttgggccagatgtctttttcggcctgtttggaaccaaagtttttcctattggattaagtccacatgacgttcctagtctattaatcgagtttaaatcgcatccccgaaccgcaatatctttgacctcccaacttgcaaaaccgggttgaattaggtcctccagtagcatataaggccggtttcgctgacgtggcatggtcaacctacctgagttagcatgggccccacatgtaagtcgcaaaaaaaatcccttctctccctggccgagagtagtcgccataatagtcgggtgtggcggcagcgaagctatgtgtccttggctgcttgcaggtccaccagccttgcgtcccgggtcatcgcgtctccgtcatccctgagtgggaacgatgatggatctaattttatgcaaattcaaatggcatgactacgtatatacgatttgtaatgccatttatctgaattgacatatctgcaatagcgtggatccaattaacccttacataaattccgaattcatgtgtttcccctgtaccctaccccatcattgaactctccctttaataacgggggaatttaactatttgcaactattaggtttgtcaattatctaaatgcccctcttagaattgcatttatttttttgccattgaagagagagaacttcttaattctttgccacttttgcatatatagcacgccaacaaggttgtcccgtcatcttattccttctccacctcctctctatcttctctcccccttctctctcacctccggcatcttgttggacaaacggcgagctcctactcgtcgagcactgagcctcgctgagccctctgaaggaggagctcgctgaccggatggtgcccaagtatggccgtgtcacgtgaggttgggggttgcggcagacattgtcgactgcagaagtgtcctaaggaggatgacgaggagagtccatggaccgaggcacaacgatgaagcggggatgcggcggtgtggaggagggaagggtggacttgaggaaaagaggcttgctactggcaatggcgctcattcgcggctccgcgacccgtttcacttgacctcactgttgacaatggcgctcctccttatcaacatccaccgcgagcacaaaaccctcatcttgtgcgccttgtcctcctttggtgacagcaagctcctgggtccctgccgcgccacatctccacctaaccagccaagacaagggagctcgctggctacccaagaagatagccgaaggtgaggaaggagagagaagatagagaggagggggagaaggaagaagatgacggggcggctttgttggcgtgccacgtatgtaaaagtggcaaaaaaaattaagaagttgtttctctctaagggcataaaattaagtgcaatttttagaggggcatttggataattgacaaacctaatagtggcaaatagttaaattccccttaataaccctctagggccagattctcaaattctcatcactcgaggggttaaaatgtaaaagagcgaaaaactcccgcgcgccaaatcgtgatggaaccctaaactccaccgctcccatctcgtctcgatcccctccatttcaaatccacactccgcctcccctctccggccgccgccggcgagatggatctctccgccaccccgtccagatccaaatccggcctcagatcctccccgaggaagcccgtcgccgcccccgccgtggcccagatggacctctccaccccgtccaagccgacccccaggcggaagcccaaggcgccgccggtggcggctccgatgtcccccgtgaccccgtcctccgtccgccgctcctcccgcctcctcgagacgccgaccaaggtaacttccgagacccccgtgaagcccaccccaaccccgaagcggaagcgcgccgcgccgtcgccgtcgccgaagacgccgacccagtccgagcccaagcggcagcggcagaggcagaggcagaggcagcagccgaagaagccgaagaagagggcgtactaccggaaggtggtgtacgacggcggggagttcgccgccggggacgacgtgtacgtgaagcggcgggatggcgcggagtccgacgcggaggacccggaggcggaggagtgccgcgtgtgcttccgcgccggcgccgcggtgatggtggagtgcgacgtgtgcctcggcgggttccacctgcggtgcgtgcgcccgccgctgcggcgcgtgccggagggggactgggcgtgcccctactgcgaggccgagcgcgcggggaaggccatcgagaggcccaagccgccggaggggaagcgcatcgtgaggaccgccaaagagaagcttctctccagtgatttgtgggctgcacgaatcgagaggtcagtgaaaattgtgctctgtggttattttgtagtcagtatggtaggcagaagttgattccgttcaattattgtttcgattcatttcaacttgcttgaactagccacattacgacgaattctagtgaatcttatagtcagaatgaggtagcattgagcagtaatgacgaactggtggtgtgattgtgtgaataggatgtgtaacggcgcatccttgtcatgatttagttgttccagtaatgaattctgcatagacaatcgtttgttctggccttgaattaggtctgataccccatgtccccagcaaaagaaggttgcatcagtaattggggttggtgcaagatgcacctggataatttctggatgtttatcgttgcaattaaacctctagttctctactgtaacaatttcactcgactgcttgtaaagtttgagacatacaatttcttaccaataccgttggttgcaacagtttatggagggagccagatggaatattctgggcaaaggtaagatggtatattatccctgaagagactgcagcaggaaggcagccacataatttgcgtagggagctgtaccgcaccaatgatcttgcagacattgaggtgataagttattttcgagtgataaattggttcctttggatggtatttttgttcattattcattctgttccttgcttttatggcttttgcagatggaaacaattcttagacattgttatgtcatgagccccaaagaatttaaggatgctagtgatcaaggagatgacgtattctactgtgaatatgaatatgacatacactggcataattttaagcgtctggcagacatcgatgatgaacctgaggtacatgtactgaaacttggttatagactgttcatagtaggagtgtaggactcaggggcaccattctggtagtcaagaagtgaacctcatcctactctgttattgtagacaaaggaagatcctggcgacgagccatacaatgctggtaatgattatgtcagtgactcggatgaagattctgaatatgatgaggaggaagaacctactaaatgtagttctgctagaacacatcaatcacatgcgttggctgcggtaccaaccattcctcgtcctccccccctcttgcctgtctcctctctgctagtgttgcacttcatgctttactgaaatgacatgcccatttgcagaatctgcggaaagggaggacatatggcctacaaaaaattgggatccgtaaaattcctgaacatgtccggtgtcatcaaaagaccaatctggagaaggcaaaagcaaccctgttattggcaactcttcctaagtcgttaccttgtagggataagtatgttagtacatttttgcagcttgtttcaaccactttcttttgcaaactgcttttgagttgaagtctcatgtcagagaaatggaggagatatctgcatttgtgaaggatgcaatttgcaatgatcaatgtctaggacgctgcctttatattcatggtgtaccaggcactggcaaggtaactaaccatcctttactgtcccctatgatggtttgatgtccttttctgtggctgaaggctaagcaatattttctgtgcctactttttcaacctgtagactatgagtgtacttgcagttatgaggaggctaagatccgagcttgattctgggaatctgaggccttattctttcatagagattaatggtcttaaattagcttctccagagaatatctacaaggtatgtgaacttctatcttggttgaatactatgattgtcctagtaaaccatatcagccatgttaaaaggattataatgcatataattttaatatatgcaggttatatatgaacagttgagtgggcatagggtagggtggaaaaaagcccttcattatttaaccgagcacttttcaggtggcactaaaattggcaaacaagcaaaccagccaattattttgctcatcgatgagcttgatcttcttttgacgagaaatcagtcggtaataatttgtagctgaacctgttgagtagttcagcaattttgtattctattgtttggaaaatgataattgtttgatatttcgttttgtttgtcactttgttttaccatgtagattcatgttcattgacatttgagctaatgttttgtcaggtgctgtataacattcttgactggcccaccaggccaaattcaaacctagttgtcataggtacctatacttttgtttgttttacgtgtgattttagatggccttttaattactctttggctgttactgaacgcaggtatagcgaacacaatggatcttcctgaaaagttattgcctcgtatttcaagtcggatgggtatccaacgactgtgttttggcccatataattatcggcaactgcaggagatcattacaagccgtctaaagggcattgatgcctttgaagaccaagctattgaatttgcttctagaaaggtttggaatgcagtgtcatgtgtaaatcttttctattattcacccatgtcttttctgtgactgttgctttgtccatcctatttgcaattttttttcctgaagggtgaatttatgcaacatgtcttttgttttaaggttatttcattattttgttctctgcatatgaattttccatgccattaaacacctttttgctaccgcttgtccgataacaaaaactttggatgttctgagttcctagtcaaactaataaatgagtggcaggtgctgtaatcactctacacttttcccttttccaacaaatactgtacagaacacattgtctgtttagtcaatgattgcatgccatacgtgtagcagtcttacttttgggggatgaacttacaaactaaggaacacctcatgatctaggagatcaattatttgtgtcatctgtagttagttacttaagacacttagcaatttcttttcattgtagttcctttttgtatgttcctgcaagttcagttgacagttgacaccaacggaagccagtggactaactgcattcacagcactgtggtttggttgcacactgactgttaagtg

SEQ ID NO: 59844 - DNA, 6291 bp, Oryza sativa
acgatgacgaacagaccggagaaattttccaaagtgagaggcgtggaatggctgccatgatcatctgtcaactgtgaatcagtcttgttggtaattcttgtcatgtccaagatggctactgaaagattatggaccaatggagaacctatagggaatccctgaagagaaaaacacggtgttagtaaccaacttttgaccccagaatgtatcatagtatagctctttgaaggatgaggtgtaaatgtacgaactcattaaagtgatagtcttacaaaagcaaatccaaggatattgtatgtctgaggaaacacccagaactcgttagaattattctggtcagacataaaagatcttatataggggatttcatcaacaatagcagatactttcccccttctcaaagcttctgcatattcttttccatttgcataaggctttaacctgtcttctttgaacgtttgatttaacaaggagtacacaaatgatttattttgatacccgaacatagtcattattgtgacggagctggtcgagatcaaccactgaggggcggagcctcgatgtggttagcatggatgacaaactagccgtgtaactctgcatagtatcaccactgcaaagcaccatattaccacaacaatttttgacatagggcttctaataatttgacctgtgcataatgtaaccaagaaagtaggttatttcagaagtaatattatagaataataaataaatctgcatgtttgagatgtgagttataaccatgagaaaatgtcattgtggagaaagcaaagtagagagaagtgctgatctgcctcgagcttgatccttggtactcctggtttctgggtcgttcaatcatccacacgacaaatgcaatgtataagaaactactcacagcagccaaccacagctgccatgtcagcggctttataaatatccattgaattctcggtttggagtatttctcagcgagcacaagaatagacaaaccagattgtgtgtatggcattgtgaaatctacatgtctttctcgttcggcagttatgctgacatcacccactgtagcattaaacttctgaaaatcagaagaacgattcagtgagagaatgacaggaaattaaaaggttataattcaagccttgcaaaatgccaagaaagcaggtaggagtaaggctcaccccagaagagacgctgcctactagatcatcatatgaaccctcaaagagacagaacatatagcatggaggatgatctaacttcttcatagcgttctcaaatacttcgatgctaaaaccagtggcatttatcttgccattaggaagatcagtaatgttcagaaaattttgaaaaccatattttcgtgtcacagcaatcctgagtgtctcgttagatttctcactcccacttccacaactactttttgagcatttgtcctttgattcaatagcatttcttctctgagtttttggattaaggggtgttttagtgccatgtgttactgctaatccaaccctattgtggcctacagaagctgattgagaatcctctgttacagctccattgccattgctgctaatgtcaaagctatagttgctggtgcttcgattttgggggagcccagaatatgatgtcctagaacatactcccctcgcaccttcaccagtgatggttacaatctcgtacgatgatagcttgagcttctcagcaagctgataaaatgatatggtgtccgctgagtcggcatgtgttcttctggctacaagcacaccaccctgacccaattctctctctattgtctggaccactgagctgaagagcctgcatatctcagttgatgtggcagtggctggtattacattgtatgaccagagcagaatactttggttgtgcacatcatcgatgttcggattatccaggaaagcagcaaaattgacttctttatttaacctctgaggttccctgctaatgacgaatgccatatcattcttcgtcaggtatttagctgcacagcccataggatctgtccatcacaatttatgtaaagcttcatcaataggtatatctgtagcagaaaacattgaaattttcctactttcgacaaagagcgcatgtagaaattagtttttttttcttttcagatcctccagaaatacctgtaagacattaggtatataactcactatagagatgtttgtcttataattaacactactatgatataacactaccacttaatactaagtagtagtagtaaaagatcttgaaggaaataccgctgacttgattaatgcggaattgacaaactgatttggtccagttggaacaggatcgagttgtgattttggcaggaactgaagtgacaaaaccatcgtgtttggaatgctcataggaatggaaacaaactccaggccggaattgagggccatccagagaatgcgagaaagccctcagcgagctgggcagagccgatttgtatagcgcatcaacaaaaaaattaatcattcacgaaagaagaaaagggtgatccaggcaggggctaagccaggatttagagatagggggtgctggcacaagccttaagaactcaccggcgcctcggtaggcaatggtgtgaatcttggtggctcaaatcctgcagagtggcagattggcctcacctagtcgccttttgttcgctctaaaatacatagtcgcccctcgtataattatattttgaattttgtggctatttgtcatttgcactaatatatacataaaatgattgttgatatgattttggatttatttcaacacattcttctagattcatatataaaagtgaacttattttagaatggtgggtgtatgtctgagtccgaatgtaccttaatatagaataaaaagaaccatttttaaactaggtcactaaatagcaccaactttactcaatacttagaatgacacaacatcatttatattcatgctttttagttttggagacttgcaaccacatcgcgttatgttaattaactcaagtaattacttaaagataaaacctattagacacctagatataggctcaacttgcaactgattaatgaactaattgtatggattagatggctaatcacgcggggtttgcatgcaacgcatagggatgaggggtgccaggcccaccccggcacccccggtggcttcaccactggatccaggaagcaccaagggtgtggtggtggagtcgtgggtgcatgacttgcatgactccacccaccagggttcaaattctggtgcccataaatattagacacatgtaggtaaacattcaacaggatttcagtgatattatgaatgtgccgttggttttcgtctcttagcccatattttagcggacgtattcgcggggtgctgtgtaatcttatgaaaaaaaaaagcagaagaaaaaggtggcccatgacggcactcaccgttggcggtgagagcgatttgggggcggcggaggacgatgccgaccagtgcagcaccggggcccgggggaggaggacggggagggagggcgtacgtgacccatgagtagaggaggcgggctgctgccccaagggcggcggcgagccgcgcgacggcgcgaggggcctgcggcctgggtcgcgaaggggagaggggggattttggcggcggctacacctggtgcgatgagcgacgagatcgacatgttactctacctccgccctaaaaatatgggctgccttgtctttctcctaaaatttccggcctttttggataagctagatccttccttattcagattttaagagtctagtactccctaaaaaaaaataatctagatgggatttgatacttcctagataaacttatatccaaggctgaacttcagtccttttccatcacatcaatctgtcatacactcacaacttttcagtcacatcatctccaatttcaaccaaaatccaaacttcgcgttgaactaaacatagcccaaatatgtcgtatgtcgtagatgataccaaatcaattgtcttttttaagaccaggggtatactttaatggctccaaaaattcatggattttgaaacgataccaatgcatgtgaattacaaggaggaaaagtgattatatttcacgtttgaacacgttgcgtgttacaacgagaggatgaaaggaggacgagtccgaatttaagaagagagtagagatatacaactgtactttgtatatggcattgctatcaatacttagttataatttcgtcttaccatgatttgacgacttacattttattgtaattttctcaattaatatgagaatttctaactttcgggcaaatcttggtaggtgaagtcaagaacgaacgattccaccgccatatttgtggtgtttcgccgtgttaaaactaattcataactcatctttttttattatataatttgcacatacatttgtttgaagtattaaggacaaaaccattttattttattaataatttcaagaatcaaaattactccctctttcatattagtcgttttgatttttttttcaactttttaaagttagtttgatcgtgttataaaaaaaagggaaaattggttctatagcatcgaaagattgcgattttggttttatagcattgaaagtcacaagttcactttgggagcactaaaagtttgctccgttagtgtatatagcatttccatcgggcttccgttactgcacagggatgcctgtctgcttccgtcaatcttccactcgaccgccggcggccccgccgtcgctgccatgccctcgtgctggagcagccaacgccgccgtcgactccttgagctattccacacggtcccgcccctaacagccaccaatcacattatcacaccttaaatttcccgtgtagctgcctggaatatcgccgtccccttaaatctgtcatcgagcaatccgccggcggcagtggtatagaacagacacgctcgaatgatgtgtatgtggtctggtcatctgggccaacgacaacaacaagaagacctctggctagattgactccgatcacaacccaattgaatcaattttttttatgtgcatgtgtagatcgtaagagtaactagtactagtatttctctagtcctgaactcctgatatgctccctgctcagcaagcagcagtcgagggggcctgaagctgcgcatcttgttgccgcttgggatagaaatttagaatgagaggcatcatggcttgtgatttctgtggagaagatgaagggggcatgaactgatttgtctcagcctgaccgagacacccgagacgaaggggcaccgtcgtcgtcagtttaacagaagttagcctcaagtatgacagaaatgctatatgcactaatggagcgaactttcggtgctaataaagtgaatcggtgatttctgatgctataaaaccaaaatcgcaatctttcgatgctatagaaccaattttgccaaaaaaaatatagcaatatttttaacataaaataaacatgttattgaaatatgttaaatattagttttaatgaaactaatttaatgttgtatagatattgttaattttttttctataaatatagtgaaacttaagaagtttgaatagggaaaaaaatcaaaacgacttataatgtgaaacaaaacaaaagaagtactaatatagttggataaatggatatacgactataaatataatagaagaaaggtagatatatactagcacactagctagacatatgttttttagatagtgagatcagataggtagagaaagttgaagaacacaggctctttcttagtgacactttattaggtttaactaaatttataaaaaaaatacaacaatattttaaaaaaatatcaaaatatgtttagtgttaaatataatgaaactaatttagtgctataagtgttgctattatttttttataaagttgattaaactagcttttaaaaattttgacttaaaagagtttcattatattaaaaaacgacttatattaatatgaaatggagggaatagcaaacttgttatgggatatcatgcatataggtgcgtacctactatattaacgttagcatgatacataaggtatatatcatataacttatgatagagagaatcccttatatgtcactgaaaattggtttgatcctttatatgtcactgaaaattggctatttccctatatggcattggtccaaatttgtgcaccctcccatgtcactcccgtctgttgaccgttaactctcaggtaaaaaagatgtatttgcccttctgagttgtcct

SEQ ID NO: 59845 - DNA, 29472 bp, Oryza sativa
atcagcaaaccttagttcggtactcttatccatcccaaacccatagacctgacacttctaataagttgattttcatccctgacatttccttaaaatagaatagaagaaatttgagcaccaggatgttatgatcaccagctttaacaaaaagaatggtatcatcagtatactgcaagtgtgtaatacccccatcaattaaatcaggaactaacccctcaaaagttccactttccttagctttatccaaaatagccgtcaatgcatcccctactaaattaaatagaatgggtgacaagggaccccctatcttaaacctctgtagttcttaaaaaaaaggaccttactctccatttatatttacagacatcttccctccctgggttatctttttgatccacccaatcatacaagaatcaaagtttttcttctgcataacttcatacaaaaagtcacatttgactttgtcatatgttttttcaaagtcaattttgaaaatgataccagcatcccccctcatcttcagagtgtgcatttcctcatgcaaaataacacaacactccagaatattcctcctagggataaaagcagtttgtgaccagctaatcaccttatcagccacctctattaatctccgtgttacagctttagtaatgatcttgagaatgacattctataagcaaatgggcctatattgcttgatggtattagcatctttgatttttggtagaagagaaataactccataattaaccctatccacatctaaagcccccatgtggagatcatctaacatttcctttataagatatttgaattgtggccacatttgtttataaaaacccacaggaaacccatcaggtcccggagctatattagatttcatacttctaatcacagcttctacctcattcatagtgaaaggtctgacaatagttgttttctcctcatcagatagtctcagcttcttggcccaaacattatcatgcaagtgaacctccctgtagtgatctctgccaaaaagttttttttgtagtaatcatagatgtgttgttgaatctgcctcaaatctgtgatgacctcttccccctactgcaaagaaaaatggctctttcttttcctccaattagcagccatgtggaagaaagaagtgttggaaatccccctcaaaatccaattcttaccacattttctttgccaccaaattttctcctggacgtctaattccttttcgaactcatatctttcctctattcagattcaaacaactccctctcatattcaaacaactcctctcatatgatctatgatctctgtcaatttctgttctaattattcaaacaactcctcttatatgatcctatttatttaccccgatacagcaaatgaacatgaaacatcctcctaaaataggaaaagagtgaataaaaacacagtagcaccaaatgtgcacacatgaattatctaccattagtccataactagtagaaatatttaacagaagttagagtacaccattagtccataactagtagaaatatttaacagtagttagagtacagaagcaacaactagttgagtacactcacatcaagtgaaataatgcgatataagactagataatatgtatcaagtgaaatcacgctatagcatctagtttcagtgcaccacaagataaaagcagagactcttgccaatggcttaaatttgccacaataaagcctccgacgttgttgaagaagtatacattaccgtcacaagatgagatgtaaagagccttggggatttcaaattgatcaacgagaccaagcttttcccatgtttcacgcttcatgaatgcatcgcagcagatatgcgggtaccgtctctccagttgagtttttacattgaagcactgcccgtctctccagttgattagtgagttgcatcagtctgttgatagtacctttctcaaccaagtggactgaagcatgactatgcatagataatagcctattggaaatttttcggcagattttgcatagtagaaaagcttccttgagaaattgagggtgcaaattggccatgagcaggtattgttggacgtgcagaaggcataacttgcacggatggtgatgttgcttaagcagcagaggtaggaatttgcctagaagtagcgcttgctagagtaactgatgggttagcttgcacaaatgacaagattgcctgggcaggagtaggaagttggccagcaccagaagcagagcttgcttgagggactggtggttgccgcagtagtaagccatgggacgagtagcatttcttcaaagccatgggacgagtagcatttcttcacagaaacttagttttttccattctgactctgtaaaagccactttgatattggcagctggaatggagcttagtgaatgacccaatccaagcagaccagttgttgatagaaaacacgaggcctgggagatctgcttaactccagtgcaggtccaaaactcgccttcggatgtatgagcgtgccagttgatttgatcctgcaatcaacaagaaacaaagacaaagaaaccgtgattaaatccataaatgatagccgatcggctagatgccgatgacatatcatttatctttgagccgatgtcatgtgtaaatcgatcggcaattgttaagtaaacaaatcagaactaaatctactcgatcggctgtagatatcaacgatatataatccttatatcgatatataattgaatcaagtgattgggatagatcggtcactttgccgagacagtataaatcacttagatcgagatatatattaataatgagattatatatatattcatagcatagccgatcagatagatctaacgtgtatcggctaatactccaatactactttatattaagatattaaagcaaatagaatatactaaacataaatctaatatacttaaatgcaacaagatcttaacatagagggcagatctaacatgttaattgagcatgtaggacaaaagcaattggatcagataagatcggctgaaactccgatactaccctaatcggcaaccagtaggcaggctagagattgaaattctaagcacgacttaatagatcaaactcaactgatacagcattaagtatgaaaagaagaacaatatctagacaatcaagccgctggatgtttcatagagtggtggatatctcatataatctaagccaacgtcgttatttaacctaatcggctaccttctggtaacagatgttagccgattgtaagttagatgacgatattgtcaaggattatgcaagatatatgataacttgacggattacataaacaagattagagtatcataaagatggaagcactaatctcgagaacacaagccgccataacaagttttacctcttgttgaagatcgaaaccgatgcagctcaacccgaaaacaataactcgttgaaataaaactaaagcaaaaagggtggcgatgcgccgaaattgtattgaacgtgtgtgttttttattacatagggctcgaggtctatttatacccgagaaatacaagatatgtccatattggacacgactcttatctctaacaaactctaagataccataagtctttgcggcagacttttgcccacatttatctctaaggaatttatataaaatatcctaattaatagatacaattgccttcccaggactctatccatgcgtggcaatcatcttgaagcacatcaactcgaacccaatgtcgcacacgggtcgtattgtcggaatcggctgtatcacttaaccagtccaactcagacttagccgatcccagtcatagccgatccggactccagccgattcttactctgtttccgaaaaaacccttatcctcgattccgcttcgatttcatcttcatctccgatgctgatattaccaaatttggtcgttaacaccagtacctttgagagtggggacagagggagtaagatttacctaggcccccacgtcgccctgctccaaggcgacacgggcagcgacgccactacccgctgccaccccctcccttctctcctcctccgcctcgccgccgcccgagcggccaccgacaaagctgggcgacggcaaggatggggcggcggggcctctcccttcgctcaagcctcggtgggcgggggcaacgccgagatttgagtggagggacgccggccgtcggcactatttccggcaccgacgaggccggtcgtagtagatccggccccttcgcggccaaatcgggcaagggcggcaccggcagtgccacttctggctcgaggaggaggccgtggtggatctggggaggtgagtccaacctcccgcggctagaatgggatgagattgacagcacggtggagacggcggcaaagtcggcggcgtgcacggcccgggagacgcatgctcgcacgagaggcgtatggcggcacagatgcgaccggtcggctggggcagccggaggaggaggagatgcgtgctgcggtggcaggcgcgtgaattgtgtttgatgcggccaacagagtaggaggacagcgtgggcgacggctgggaggccgtcgcgccccgcgagagaccggcacatccggcggcggtggaggccagcgcgttcgaaggcatcgaggtggagggaagcgcattcggcagcgtctaggtggaggccaacgcgtccagtgacttcgaggtggaggctggcgcgtcctggcaggtggcaaagccagctcggctagaagcagaaggcgaccccatcgggttgcgctcacggcaggagatgcaacgggtactagctgcgccaacggtgagttgcgggaggtggatctaggctggctagtgatggggcactagtgcggcagactttcgagttgatagaggttgttcaggcggcggagctccagggcagcgacggtacgggtgggtgtggacgtttgcaggtgaaaggctagctcgggactgcctgagccgataacggcaacatccttggatgttgtgttccctccttggggcgttgtcgagcagcctctctccccttcctcgataggactctccaggtgaaaaccgagtctagttggacgggcaacggtgatgtctttgttgccatggccttcttgaaggcgttgtctaggacgtctctattcctttccttcgccatcttctcactgtttggacgctggcaggtcttgttgtcatcatcaggttagggtgagagatgagcggatctccttctctctcgccctctccctctcctcaacccctctacgtgaggataaccgggatcttttcattgtctttcggagttaagctggtgtttggcgaggcgtttgtaacccccttgttggcctagtggcaatcggccacgcttagtggcggtcggcttggtgctagtgtcttctccagagtgctgtgtaaagagctgtcaacttgtggtggcggtgtgtttgttttttttcctggttacaatcttccagggtcgttaaaaagaacctttgggagcatgcactcccaaccaagtcgatagtactttgtaattttgacatagtttctacacatttgtgccaagatttttgtcaatgagatgaattgcggcatatgcagtagcatcttcaccaagggctgacagctcccgtctcaatatcctgaatacctcctcatatagcttggatatgagatgaaggggcataaactctagatgataaatgatcagcctgggatcgatatttgggtctacagcatatgctcttaccccttgcaggtatggggcaacaaggattgggggcgaagagagatactttttgagttggcaaaaagtctcttctgcctcctccgtccaggtaaatcccctagttatgttgagaagcttgaagagagggatagcccattctccgaggcgcgagatgacctgggctcccctcggcttaccatcttaagacgtagatctttatatgtctccacactccttttagggaggaatgcgtgacatacaagggcataaggggccccagatcccaaaccgaactgggattcgggctccccttgatttatagtcttaagatgtagatcttgtatttatccacactcctctcagaaaggaatcatgacatataagggcaaatgtgagcacggatcccaaaataagccgggacccaggctttccacggccttattctaaaaatgttgatcttgtaggtttttgcgctcttctcaataagtgatacataacctacaaggtcatgggagggcccaggtcctgagctaaggcagggattcgcgtcccgcacccctcaatctatgaaatcagtttatgtcgtgagatggggatcctgggactcaccctatagtaggtcccaagcccccttatacttattacgcgtcttagattaatactgatataagtacaccttttgtattaatcaatatggaatgctaggttcccggggaaatgggtaccgtagttcccatttcattgacaggccccatgaaggaaaaccagcgccttccaaattttgacaatttttccctacttcgtccataggtgtcaaatttagatgtaaacaacgtcgaattggatatgggcgacatacaaccaactcaaaatccgactcaaacatgcacgacatactaaaattttagtggaaatattttcaatttttataatagtagagataagtagtagtatatgtatacagacactaagtaattaagtagaaactactagctaggatactcctacgcgaccaatacacggtttatacactgtctagttgacagttttttttgtactatatatgtatttggtaacgtagccagccagtactcagaaaattcagagtgcgtgtttccagaggtatagactgtcaaaagaaagcctcagttattcagttatactattcagaagtactcaaggctgtagtataaacatgcgttacagaatgtagaaataatcaatcatttgactttgacttgaaatttgaaaggcgtcccattcattatatatagttgacataagtacgatcgatatgaagctaagtttacgataattattcaaaagcacgaataaatgaattaaatgttagaaagtcgaatcattagttttaagaagttttatgataaaagtttatggaaaaagttttcagaaaaaatcgtatggtttaggagctagacaaacataaccgccataaaatctctactattataaaagttgaagatgtttttgccagtattttttttacgtcatatgtgtgtgagttggtttttaagttcgttcgcttttgaaaataaatatctgtatttgagtcagtttttaagttcgtttgtttttgaaaatacaaaaagagttgtataagaaatctcttaaaaaaactcgcatgctaacttgacacgattgaactcctaattgtaacttatgattttctaaaaatatatatatccaagcgaattctcacagcgaattttaccttaactaagccgcataacaataatagattaaaatagccttcacccgttgcaacgcacgggcattttttctagtaagctaaaaagaatgaaacctatcataacaacacaggtatatatagaactgttcgtgtatacgaatacaagtagatcagcagtcaaattttatttcttacaggctaaggttttttatttttagtgatgaccaaatcattggggctgcatgatttgactgaaatggagtttttagcaccaaacaggcgcgtcccctgtaatacggtgcaaatttgtgatgtattgcgtctcggctgacgaattcattcccttctagttcaagaacatgaatgttctactactttctactgttacatgtcttgtcgtttaatgttcagtgtatttggactatgttaagatgcaagtaggacggactagcaggttttataattcgtctattctaatcataattatagttgtacctatatctttattcatggttatataagtagattaaaattgagtgtatatgcgagttgcatgtgtgaaaacgagtgttgccaagcctaggagaaatagcccgacaaacaagacacaaaacttacattctctatttcagaaaaaaccagtttttgaaaatatatctggacataaagctatgtttagatatatagcccgaagttttttttttttacagaggaatagtttacaaatatagtggcatgccaaagtgaaaacttttttcataggcagattaaacatgggactaagaattttcgcctgtatataataagcaagaatttaaatatgtcaagttgcccaagttgtatataataagcaaagtagcagcgccattttatctgcgatctgttgtttctcgttagtcagtagatgcacggataaaagcgcccaagcaaaacatcaagtgaacatcattcagcatgaatgtgatatagttagtgtcaatctagagttttagcgcagcttacaattgaccaaataaaggttcgtttcaaaaaaaaaaaaatctaaggtgtgtttttttttcacacacgcactagtaatacaagagtatatacattgccttcgcaaaatagaaatgattattacagtctaaacggttggtagagaacaataatttcaaatgataaataattaaatattgacatgatcaattactaaaatatgtacagaacgatctaatccacggccttcctgcattaatttctacagcatattggcaaacacctacaaaaaatgaagagacgagtcattcttattttcgaagttccagagcacgctccgtgtgacagtgtcaacatctttttgtcagtattcatccggtctggctggaatttgcaggcacagagccattctgaattggtccaggctcttcgccgtcagcacgttcgacactcccatggatatcctgggaactgtcaattctgatttcatggtgaggtcgatcatccacatagccatcacccatgacgttttgtgctgagttacgttcttcgcgacctccatttccaccatccgcatcgggacttcgcacttcagaatctctaattctggtgtaattggcaagaactgacttagaaatgcttatcatcagcatgagagctgagatacatccagtgatgatgaaaagaccagagaaactctgcaatgtaagaggtgtcgaatctgtgttaggaattgcatagcttggaggggcagccgttgtgccaaaccattttgcttcgatccgtgaaccttcatccccacccgtaacatccaatatggcagttgaaagattatgcaccaatggaaaaccaggaggaaacgcctgaaagcaaaaaagcacaatgccaattagtccagcatattttgtccagaatgtagtatatctcttgaaggctgaagagcgaatccatggaagcaatagagtcaataacgctagtaaataataaatgggagttggggatttgccccatcactttatgtctcattctcatttatttttatcttcactttttttttatcaaacttatggctgtgtcttatgacagaagcaaataaactcattctcaatgcaaataatccatggaagccgaagatgtaatccattttcattatctaaaaaaatggaagcaatagagtgagagtgagaggcttacaaaaccaaatccaggcgtcttatatatgcggctaagcatctggaattctttctcgtaacgacggtccgaaagaaaagaggttaaatatgggatctcatcgacaatagcagacacacctccattcatggaccccttcctcaaagcttcagcatattcttgtttctttgtgtagggtcttagccttcttttactgaaaccttgttttatcaaaaaggattccacaaaggatccccgttggtatccaacataatcaccatcaaacaggatctgttcaagatctgtctccgagggccggagcttcttcgcagttagtatggatgacaagctagctgtgtagctctgcacaagaaccagcaccacgaagcaccagattaccacaacaatttttgacaaaggacttttaataatgtgacctgtaacaaagacaataggttatttaagaactactgcaagaaactaaattaagccacttatagtgaatcaaatatagcctgcaatttggagctctaagtactaaccatgagaaaatgtcaaagtggagaaagagaaatagagagcagtgctgaactgtcttgagcttgatccttggtactccagatttctgggacgttcaatcatccaaataactatgccggtgaataagaagaagatcacagtggcaacccaaagctcccttgttagtggcttcaagaatacccattcgattgttgatttagagtcattctccatgagtacaagcattgacacaccagactctgtgtatggcatcgtgaagtctgcatggatggttcgctcggcagttattgttacatcccccactgctgcatcatagttctggtagtaagaaccagcagacataatgtaagtacttgattctttgattatgatttgcaagcacagtaagtaaggctcacccctgaagacacacgctgtactagctcgtcataagaaccgttgaagacaacaaacttataactcagatggtgtggtaacttcttcacggcagcctcaaatacatcaatgcaatagccaccgacacttctgtcagttacattcagaaaagctttaaaacctggtttccatggcactgcaatcttgagttccttcccatatcctctaggtagtgctcctaggtctctcctcaccccagcattagttctcttggtttctggatgaaaaaaggattggttcatgtccaagtctcgtgtcctatgagcaaaattgaacatagcacaacaatagcaagaattatttgtgtctatttgcatgatagaaggaaggtcacaaatttcctaagcaatactgttaggtacagtccataggagaagtgcatatggcaaatgaaaacatttccctcggctatatttttattgataatagtgactaacgcaacaggttatatttttcttttttgaaaccactacagcaggagctctgccggatatattaagagggagaagcaaaagtctggcaggaaggcaacattacaggagagcgatctttgcggcaggagagaaagaaacaaaaaaacagtgcctcaaggagggcggaaaaaccagagcacgctactaaatgttcttctatttggttcaagccatatattccaccaagttaagccccccaggatttgcttctaacagaaccaatgcaaggtcctcctctttatcatcaagggtaattcagatttttacatcctatcagaggtatgcaagtgcactgtttttttcttaccattcaatttctttgtgtatcacgggtggcactacctatatttggctcactgaacattcagctctcatatatcgaatgattcaagattaaatccctaagttagtcctcctactattcactactaattttatcctaaattacttagaagtcactaggatacttctacatagcaataacaattcacaaactgatcctgcactagaaacaaaaccaggatgaacagcgaacctcctccaagttggacggatggggccatggccctgcgactgcgaggcttggtacggcggagccgccctgcatgcgcgcacgcgtgctggaagacgggagctctgaacccccccccccccccttccgtcggcggcggcaatccctacttgtcagacggcagccagcagccagcagccggcgccgcgccagcgtggtgtgattgggggtggtggggatggaggcgattggtgtagaatagcggttgtcgcaaccgctaacgccgccgcgcgcctctcctccattggagtgcgccggcggcatcaccggagggagtggacgccgacgaaggggttgcggctacggatcacctatctttttttttctcgttttcttttacgtattactccgtatgatatgatataaagttttacaaaaatcacactattgataattttaatctttgatcaaccatgattttttagttatacggtcacaccttaactttatgagtatttttatccatagtgtaaatatacatagccttttttaaattttgaagttttttttttacattttgatataagaacatatataattagttacagtttttgtgaaactttataaatataatatatggatttatgtgttatgtgtcaataaaattttggttttgtataacttgatcataatagataagatttattttgttaatactaggggcatttattttcctctcttttctaggtgccctattttttctcgaaatattgtgttgtttaagtacaaccgggccccgcggccacatgtcatacacatggcaaaacagcaaatgtatacgtggcacgtttataaatctccgttttgcctgttgcaagaactaatcctatcgttaagactgctgaaatctacctcggatgagtttcaccgctccttaggaatgtaggaaattcgtcggaatttcagacagtttagctcgatttctctaatattctttcgaaattctcccgttcaaaaggaggcctacaagatgaagtgtttgatgaattggtggtaaccacgagcctataagggcagtcccaacccatagtacccataagcagtgtctatggtgtcatgtcaataagacatcataatagaaactacactctacaacccatgatttcttaaagtggaccattaataaatgtatcatctctcttttctatcagtcatatttattcttcatctattatgaagacactattatctcccaatgcaaaacttgatagtgtctagtgcataggttctcgtgttgaagttgtgtcttgcatgagacccaatttcttcctctcttcactctctctctcttaattaatatagtgccacacaagctaaaagtgctatatggcaatgtagttaatgtcatagacaccatcctaggaggagggttgggactgccctaatgatagccgagcacttttgtgtttctttattttgggcagaaatccataagaaaaaaaatagtatactactctactttatagtaagttagtcgtggttagacacatactaaaacttgaatgggaacacgaacatagctatatccacattcgaagtactccaatttagaactaggttaccataatttagaacggagttagtagttggttctattcccatttgcataagtgccatcatttagaactgaatattttgttttagcatgcacaaaaacattaacatgtacttagaacagcaatttcagtgactcactattacaggtctctaaatgtactactttttacgttctaaaacacttatcgtggtttattttggtacggagggaggatatcagaattcagaccaacgagcggttaccatcgccgtgagcagccgtgatagcacccgtgcgcgaaccactgccattcgggtccaagcggtaggcctccaacgccacggaaacatctcctcccgtcgtcgccgccgccgccgccgccaccgccgaactccaaacaacgagcaggacgggcaccaccgccgccgccgccgccatagccagccgccgcgcctccattgctggtcaacttacataccctacactacagccagtggtggagccagaaatttaaacatgtgggatcggtttgtttttaagtggggtcatttctctaatttcgtttagagaaatgactacagctcgcgacgaccacaacgtacgtatatcgaactacatgtacgtaggtagtatgtgttaaataggcattgggaattttgggatcaatcaacacgttcgcccggtcttgctggactatttctctcctctttctcttttttttttccattttgttgattaacgtgtgatttgtgtggctgtgagcagccagtcaagaaattcaggatgcatatataagttttttttttccatggtccatggagatatcagaattcagaactgtatcagcaacagtcaatcatttgacttgactccaagggtataatgacacacaagttggtacagaatggttcatagctcatatagtcataggagcacgatacaagtcgtagatcattcaatcttgtttttctctgcaagcgcttaattagggcttattcgggcatcatatgaccaaatcattgggatctaattaattaagcttgcacagttgcactgcacgacctgcatggtttgagtcaattgagttccacttccactaggcttgtatagcatcaaaccgcgtgtgtcccttttaaatttcttctccttccagaaacttggctactagttcaatgttcaggtctactgacatgacagagatctgtatagttctcccggtttacattgacatgagtcactgaccgagctgctacaaatttttagttccacagagaccaaagaaaaccaggagaaatgtaatggcgcggaaaagaatgcacaagtttagtttgcaagattcagtggcattgtgtcaaggtaaggctgtgtttagatccaaagtttggattcaaacttcagtccttttccattacatcagcctgtcatacatatacaacttttcagtcacatcatctccaatttcaaccaaaatccaaactttgcgctgaactaaacacagcctaaatacaaagtttctcgttacaaagtagcactgacattagctgtgagttttagaatagcttacagttgactcttgcccaagaaaaacttcgttcgtcgtgtttgtgctatattacaatcattgtcaatctagagttcttttagaatagcttacaattgagttttgtcccaagaaaagaaaaacatcaactgaacatcgttcagcatgtttgtgctacattacaattatcattacaattattgcaaatctagagttttagaatagctttcaattgactaattaaaaccaacagaagaggcttacacagttaagcaaggccatgcaacaagcaggccaaaacaagtgaacttttttctagcttcagagccattctagtgccttgggagttgggatagttggtgcagataactgttcacactctttatttgttttcagtcctaatctggagggtatcagcaggcacaggatcgtcgatcgaccatgacaatctgcggtggttgtggttgagcttcaccgtaacaaacaactctctcgccactatggacacggtctgaaccgaagcctctcatctctttgcatttgtcatatagaaacttgctaaagtttatcaacagcacagcacctaaaaggcacccgacaatgatgaaaagaccttggaagctctgaaaactgatacgtgatgagcctttgctgtgactgccataataatccaaggacgaatccatgaaccatgtcttttcaatcttcaacctttcaggttcttccgttaagctcaagatggcctctgaaaggtctggtaccaatggagagcctttaggtaaaacctgtcgaaaagtaaacatatattgtaaagccaaggcagaatgctcgaagatgcattatactaataaataacaagtgcaagaagcttacaaaaccaaatccacttgttctgtcaatggggccaaccatctggaactccctcccgtatttcgagcagaaagaatttagatagggtatctcatcgaagatagccgaaacccctccatgctttgatcccatccttaatgcttttgcatattcctcctgcgtgctataaacctttatcttgtggtcatcaaatttaagcttcttcagaattgattgcacaaatgatccactttggtgtccaacagaatcaccattggccaaaagttgttttagatcagtcactgaaggttggagcctctctgccgttagcattgatgacaaacttgctgtatagctctgcaccagaatcatcaaaactaagcaccaaattaccacaacaatttttgactgaatgctttggatcttttgacctgtccataggattaaaaaaaatagattatcaaaaatcatagtagtatcaaaacaaattacagcaaatactgaatcacagtagcatatgatagcatccttaagagtctttcagctgacccgacaaaaaacaataaaaaaaagcatccttagaaattaataagttgaatgtacgaagatgtatgtagttatgtattttatctattcaatagctaggtctgtaatgacataccatgtgaaaaagtcaaagtggagaatgcaaagtagaaagcagtgatgcactgtttccattttgacccttggaaatcgcgatttataggtctttcaatcacccatacaactaggcctgtgaagaagataaagatcatagtggcaatccataggtcctttgctagtggctgtaggaagatccatgtggttggttcatcgtcactcttagatagaacaagcatcgaaacaccagactctgtgtatggcattgtgaaatctacatatctagttcggttagcaataattgtcacatcaccgactgctgcatcaaacttctgttgcacccagggaaacggaaaggcaacaagtaaattagtaataatgagtttattcacaagggaaaattagttaagaatacaaaataagcagagctcaccttgtaaaagacctgggatactagcaggtcatatgaaacagcacaatcatagggaatgtactcgtagcgtagagcatacggtaatttcttgacagctgcctcaaacatatcaatgctgtagccactgacagttgatctattcgtgttcggattagtctcaacattcacaaaagttttaaaatcacgtctcactggcacaccaatctggagtatcttagcattcactgggaagtcccagcctttgggcactgttgttgaatctccaggccaaacgatattttccagatcagaagaacttgtgctaaatttagcatcaccatggataattctagagttcacagacattgtgagtccagaatcaggactataaaacccgataactctagttttctctccaataacattgacaatctcatatgtgggaacctgcagatgtctatcgataagcctgaattgtccagccaatccatcaaactctccttgcaaaatggaattgaggagttctggaccagcaggcaatgctgggagatcatctactaagttcttgcctatgtttcccggaggatgaaaagttgggttcaaagatctggtcctatgaaccttctcagttgctgttgcgactgcccatgccacatcataagcccataattgaaagatagtgggttttgccatcctaatatcagtatttggatggtacttagttctgaataaggtggtaaatcgagagctgaaatcagtgatccttgtagattctgcaatatatggccggaaaccaacaattccctccatgctttcaatggaatgttggggaagcacatcaaggacaataccaatgctatctgtgacaatccagacataccctttagtcatcataccgagtgcttttgcccttgcaaagaggcgggaagcacgggctggcaacatgtggacaatgaagacacgcgtctgcatggtcatgagcttgtatagttccacatctatatggttattgggggaataagcagggaaggcagaacggttaatgacattaaccccgacaccttgaagagcatcggtaatggaagggaggatgccaacaccataattgttgtcttcatagacaagaacaacatttctccattcataggctttgacgaatgcagcaatggaggccacctgataggagtccttggaacaagcacgaatgaagtacgggacatggtaccgagtgactgcatcaccggttgcagagaaagtgatgacaggaaccttggtcttgttcgctaggtaggtcacaaattctgcttgtaaagtgctctgaggaccaataacaatggcaacattttcattcctgatgagatctattgctgcaggatatataaaagaatgatcagttcaatgttcaatacatatgccaactgtgcaaaatatatgctgtataaccctttccttacatcgaacactccaagatagcacatagaagaaataaatcaatagcaaaatttgaagaacatgtaacaccttaaccaacatgtgcaaatctttctcattctacccatatactagcattttattccaacggttccattctactagaaaacaagctatgctacatcttagccagatttactgcctgatgaacagcaagaacgatctaacctcaccaacaggcccagatttacttcccaagttcaaggaactaattgatcgctttcgatttacaattagttgcaactagttcatgacataatcactgaagcaaagcaatctacctggatcgatggattaaatctaagacagggtacggttcagtaacagatccaactgaaaactgtttggatttggttggctcaatcaggtttcgcgggagctcataccagcgcagcgaacagacgattccgctcaaaatcggtgcctggatcctccctccttcgccaatcgctgcctccgaccatgactccgatctcccgatcccctccgaatcaagtcgacttctacacggcccccgcgagtgaatcccatcagatcactcctctccttccccagcgaccaaaatcagcggcgagctgaaggggcggacggcggcgactgcctctctcctctctctctctctctctctctctctctctctctcgtcttccttcgcgagttcgcgttatcgcgtttgctttttaattttttgcttttttttagggcaattccttctcggcgatttgatatgcctttttaactgatttgcaattgattgctgttatcttcttatggtttggctcaatttttttctaaaaaaaaaattaaattatggtacacagctactattttgttattgttctggtggcaatggtacttataaattataattgaaaattcggtttgatatcactaaattttactcttcaagtatttaaatatttttttctttcaaagccagatagattagatgtcacatgcatgattacaccgctaatcccaatgcaatctcatttggattatgtttgtcgcaaccactcctatgcatgtgttggccgctcgtgttcagtgttcacagatcacaacacaagctactacagtagtagtttatcgttacaaggattagagtatctatcaatgcacatatagcagagagggaggtagagagaatcttggctagacacagatttttgaagatacaaagcggagagtatctatctatgcaaatagtggagctagggtggtgttattctctaattaagatatagatttttttctcgattttcgttagcatgctttttaaactgctaaatgtgtttttcgtgcaaaaactttttatatagaagttgttttaaaatatcatataaacacatcttttaagtttgtaataattaaaaattatttaatcatacgttaatggttttctcgttttactagacctaactataattcatcttcaccaatttcaaacacatattcgcctctgccaacttcgcaaagtggctaatcaaaatgcagtgacagttcaatgtgcctccttgaaatgagggattggcaaagaaatattggagaaattatttttctatagaacctttgaaggatatgaagatttctataggattgtgctcatatggttaattatatatgaaaataaagaagatgttggatctattgtgaaacttttctctctttttttttttaatttagcgatgccgcaagagtagccttcttaccttctccactaatatcagtacataaatgcacttcttttctttattagtgaaagagatagtcttcctgctttcttattcgaatttttttctataatatatgtaatcaaagggctcctttctccgtttcatgtgctcttaatttctgcatggttgaaaaaacatgtactactttaattcatttttctttttcttacagcgcagtgcagtatgtgccaactatggataggatttgcttgcatgcaaggtagcagggataataatttacacatgcacatgtgtgtgcaagcagtaaccacagctcccaacgaaaataaaatccatggattcttgggtatcatgtgcacttagccaggcaccagctggctgattacactataattatcatttttcctgaaaaaaaaggacctggaaaacttaaataaatccctactgacataagttggcctattcatgcatggtcagtctgcagaaccttaaaactgttcttgcacggttatcatatccacaatctaatatgcccattggatatgctatttaacattcaacagaaatttcgaaaaaaaaaatatgtcaaattttttgaccatgtggatgctctttgagatgcgtacagacaggcaaagaccacaacaacactaggctaccgcacctttttttttaagtacaatgtaaatggagatttgctatatatatttaacatttgacagaaattttaggggaaaaaactgtcgactttttgggtgcggggatgtgctttgagatacgtacagacatgcaaagcccaccgcgacactaagctacgcacaacacctttttctaagtacaatgtaaattgcatgcaacatatacaatgtaaattgtattataatttcgtgcaagttgtaatataattacattataattataaactatagcatagttatatatttagcaaagtttttttaataatatataaacaggccaataaaattatttaaaccacactttgtagtttctattttttattgtcgttgcttgcatgcaaccaattaatcctcatgcaaaactaggagaatcatttattttgttagctttttttttagctaaccaagttcacgtgaatgcaatttggcaacaatatcgtagacaatggatcaaggctggctagaattaactgatcaaagtattaccacttgatcgagagaggtaagtgagcagcttaaaagaactattaacagtccaatgcatggattaggtgatagattcttcctttatatattgtactggggtgcagtagagtgtttaattaattattgcacgttgagttcgatccatctgtatttgtgcttacgtacgttttaggtgcattttttaatttcctcttatgtattatggattatcatagaaatatttttctaaactgtatgattttctaaaagattagtacttgaaattcaacttttaaaaattttaatatttattaattattttgtgtttaaaatcgaataattatcataatctcaatttcgttcataataaatcatacattagaactttagaatatgtattctctgtcctcataattagttaagctagtgttctggccgatgctcagtctgatgtctagtttttagggggtgtttgggagaaagggactagggacttattttttggagaaagggacttaagtttagtccctctcttctaaacaccctcttagtccgcagtccgcacacttttcaattttctcccaataaaaaagaacagaaaaactttttttagaagaaaaagaagagcagcgacaactgtcatcacatattaccagccttatcttttttcacttatcacttatgcttatatatacttatcagtcaaattttaaatttttaaccttttattcggagtcgattttagagttttttcatgaaagtttattttttacccttgatttttagatcgctacgagcacatatataaaagttttattcacaaattatattttatttgcaaatatatcgtttgtcttattctttaaataagccaaatgatgggaccgtaaacaacgccaaatgtaatcacgtcattaagtaaagcacttcatgattaggcgattgcttagtcacttcagtactagagctagcttagctaccaatgtcgtcgaagtgtcgaagcaagtgtatatacctgcagacgcggcggcgacgacgtcgccgcgggagtccctggcgcgcagcgcgacgcgggtggcgaactccgggtgcgccgcgtacacgtcctccagcgccatctccatgctcagcatgctcttcttccccagcgccgtcgccaggtccagtatcaccccgacgtccaccgccaccctcgccgccgccgcggccgccgccgccgttgtgttgccggccgccgccgcgacaatgagcagcgggaagaagaagaagaagacgacattgagactacgacgacggctgcaggtagcagcagaggaggctgcttccctcctggagccaaataagcctctaggctccatctcagtggcagtggctgtgtacactactacactggttggtgccactcgctagctgctagctgtacgcctggcaaatactcctacatgatggtagtacttatatactgctatatgcatatataatatggtttcaaaaaagaatatatgcatatctcttctctacctctactattataaaaattgaagatatttttaccggtattttggcatgtcatacgtgtttgagttggtttttaagttcgttcgcttttagaaatatagatccgtgtttaagttagattttaagctcatttgcttttggaaaatacaaaatgagtcgtataagaattttctttttttaaaaaaacttgcatgctaacttaagattaaatacagactttatgattttctaaaaagaatatccaagtgggttcccatagtgaattttatcctagctaaaccgtatatataacaacaataaaattaaaatagcatttacccgttgcaaccgacgggtactttttatagtttaatataatgtatgtgattgttgcccgatagacacgatgtagagatcgatgactattgacttaaccgtgtctaatggctctatgttgaatagtataccgtatcaagcctgctaggatcgaataacaatatgtttatgttatatatatttattgttttgtttcatatgagtgctttgtctctctatatgcattcattatgaccgaacaatgcaacacatattgagtgaatctataccgatcttacagagaaataacccgcatacaccgccgctcatacatggaaataacattgtagcatctgtacctaatcgttgtacaagtgtgtcaaggtcttgtttgagaatattaagattctgataagtagcaagtagccaactggttatgaactgaagaagtagggtcttccaacttattgcattttctggattctataatttaagtgagactctgaactatttatacgagagagttggaggttctgcaacaagctagctagctaccagaagctcttgaaacaaaggctgatcgagtaattaacgtttccgggtaatctccaaggtaaggatttgtctttttcatcgcggctgtttgtgagacagcttctattcggtttaatttcctactagcaagctgcttgtcagtatgacaatatgtactagtaatatatacacccactagctagtccattacagctaactagctaactctgaagttaagtgagagcatgcattcatatcgagcagcatcgctgaataagattaactaagaaaaaaataaagatttaggcctcgtttggctgcctgtgtatattatacatgtgtgaatagttccacccgtgtattgagtgaatccacaccacccacccaatacacagcatgattcgatataagggggggctggtggttcgaccggtaatgcccaggtttgactccacagcaagtacgtagtgctagctaagctaagggtatgcatgaagagttgggcagagctaggtttaccttttaggtctcgtttgttaagtaaaaaaataatataaaaaatacagaaaaacctaagaaataaaataccagaatagaaaatccaacatgtatatccatctgtaattctaaaaatcctgctttaaaaatttaaaaaaaacacaagagtagaatttcacaaagaaaatagagaaattaacatgcatgcgcatggatgaacttgttactgatccatgaaatatttataggtgaactagaataattgattcaacacaaatcttccaggtagaaacagcacacaccagacatacacatccaagcatatatgacagtaataaataactttgatagctaagtctaccacagaggtttaatttaaagtctactaggtgttccatctatgaataatttctttgacatgaaacatccaagcaaaagatagacaactccaacagcagcatatctccctactttccattgcatcttttttccatgcatcacctgaaacaaagtacaaggcaaaagattaattggctccatatctgccgtggcaaactgactgctagcaacagagagaaactagagaaaagagctaataaggaagcttgcaaattcctaggacaagagcactaagggtgtgtttgaggagaaggagattgggaagatacgcaaaacgaggtgagccattagcgcatgattaattgagtattaactattttaaatttcaaaaatgaattaatatgactttttaaagcaactttcctatagaaatttttttgcaaaaaacgcaccgtttagtagtttgggaagcgtgcgcgcggaaaacgaggtgctttctcaccctatatcacacaaacgaacggagcctaagggactaagaaaagttggagcaagatgaaattaattgtgcattttacaagctatatcttgataaataagtagaaatgcttatattttggaacggatgtagtacatttaaacaaattcactctgtgcatcttcaaatttgaataaataagctcactccaagtatcagtgttatcattcattcagcaaattcaaatcatgctttcagagcccagtactgctcacccggagagagcaacaataatatattagaatatatgtatataaaagtttacactccccaaaaaacaaaagagcatgaataatatgtaaggcataatgagcatcatttttagcataaataatacacctgcatctcaggtgatgctacaatgtgaaaactacaaatgtatcatctgccaatctgctcaacatttacccccaaaaaatagttttgctgagcatcactgaattgaagttttaggtgatacaacaaacaaaatccaactgtttaatatgattaaagtgtagtactaattaatatattcatcagtttcatagaggcaataacaagacaaaaggagcagtaccagatttacgcagttgtaatcttcctccttaaccacttgagtcgtgtagagtcttttgcaatcatgaaaatggccatgttttgtggatctttgaagacatcataagccaggaccttctcatcatccgacatatcttccatgctgtccacaacagcaatgcatactgggatcgggaactcatcctcatgcacattacttcttgccctttcctgctgcataatttcagtctcggcttgcttctctttaaattccagaaattttcccatcatctcaacaactttcccatcctggcgacgcctttgtgttgccttttctgttttgtcacttgtaccagcatgcttgtttgttgcacttgcaactctttttcccattcttgaccttgtagcggcatcacttgcaattggctgttccactattctcaggtcgtcatcatcactttcagcattgtgtacatgagagtcaaaagggaaattctcatcttctcccatataatgttgtgtgacagtagcttgagaagtttgagaaggctgtgtgagaggaatatgagaaggttgtgtgacaggaacttgaaaaggctgtgtgataggaacttgggaaggggcaatggaggtgaagttcatggttctctcggcagtgtcccacaacagaaagtgaagtcaagtaatgtttaggagaactgaatagaacatgcttagctggtaggaaaataaagattcaacaatggtgacataccatcatatagctctcctaaagcctcaaacaatgggaaagatttattccggaattttttggccttaggatgagactgtttattgaataccagaaagaaaagtaattagcaaatgaaattaaagcaagaactatatttaagaatttaacaagaattaacagcaacgagagacaagaaatctcacaataatgatgttattccaaacagcttcatctccttcaatcctgcacagcttatcatcctaggacacaccactttgttttctcgcttcttttagaactctatattccctcttcaactctctctctttgtcttgaatttgaacctttgtaaaattgacataggggaacttctcatggaaggatttgactattcagttccatgcttctgtggaccacccattctgactcctatagcagtcgttgttgtgatcatgtagtaggtcaaccaaagctttttcaagtcctgcattccaactagctcttgaacgatcaagtacagttggaatagagaaccacacataagctacagataattacatgtttttaatctatcaacctactgaacttgagaagcccatatgtgcatttaacatgacaagaaaaagcccataccttttggcgatgcctttttcttttgatgtcttgaaatctttggagatggctttctttggacagctgcagcttggattaaattgaactttggggaccctcttccaaatattgttgctgcgaataaaaaaaaaccgttatcaaatttaagcatgcaaaaacatcatgatgcaaatacaaaagcaaaatatttcatgagaccagttaagactcacatttattaagacaagttatgactgtagtcattccacatatttagggctatcatatctctaaccgtgtttccatcatctacttgactgttaagggacatcacatcattactatattcgtcgtcaccttcagggacatcaataaactgttctggagatatgttgcttccttggtgattgaaccaaccctcatccccattaagcatccgtataagattgtagaacaccactgtggcaactggaatcttcacttggttttcaatagaatgatgcgttccaacttttaaaatagggaaccgtttcttaagaacaccaattgctctctctatgtgactccgcaatatggcatgcctatgattgaacaactccttataatttcttggtcgttgctgtccacgcccaaattccttcagatggtatcgaactccacggtacgatgcaaggaaggatggcgtgttagtatatccaccatcaacgagataatatttgccttgaggcacattgaatcctttaagcatggctgacctaagaaccctagcatcagttacagatcccttccatccagatgatataaacgaaaaatttagatcaaaatcacaaaccaacatcacattttgacttagggtaccctttctattcctatatggggcctgaaggtcttgagaaatggtgataggaacatgtgttccgtcgacagcccccaagcaattttggaagtaaggaaagaactgttgatctatgctaatcttccagtgagtttcaactccagtaggttgcttgataaatctataggtcaaagtgggattacattgaaaaccgccataatatgtcggtgaatcgtttctccactatgatggaattcatgttgtagatcttcatagctcgcattgtgagatatcatgtaaagaaaaaaaaaatccaagtttctcctctaccgtaatacctctcgtgtcatgtaggagatgttctgttcgaagatatgtcgctattgctctaaatatgttaggctccatgcggaatgcaacaaggcaaatcttttcatgtccctctaaaatatttctgagttgttcttcaccgtactgacttgaagtatgccttactcttttctctatccctccattactagttaaaagatatagggcaggcaaccagaacataataatctcctcatcctcctcatctcttctcttcctaattagcgaattcataccttctaactagaaggaatactgaatatttaagatgaccgcagttagcaaaagaaaaaaaaaagtttcagcactctagtttttagtttcaacactatatatgttcataaataattaaagctaattatgcatgtgtatgaactgaacactcactttgtttaatagaagtgctatactactatgctagtatgctcttttgtgcattcaatggtgttagtgtaaaatactgtaatgtgtgctgcttgctatacatttgtatatcatgcagtggtggtggtacagtctcagcagtgtgtagaggagaactactagttgtagtttatttctgctcaaaatctctttgcactgacacaagatcgaagctagtgattccctaccgtgttttgttcccttcaggatggctgtactttgcatatctctaagcattgacataccttgtctccaatatttctcttgcagatcgtcaaaccctagcaggatggctgtactttccggatcttgaaggtcctagcagcaaaacaagtggatgaaagaagatgggcaaagaaaatgagatgagatgaaggaggagaaggaggagaggactttgaaccttgatcaagcgagtaggctgccggggcgacgccggcgatgaggcgacagacgacgacggccgatgaggaggcggtggatggctcggagaaggtagtggcgccggcggcacaggaggatggcgaggacgtggtggacagctcggagaaggcggcggcgccggtggcgcagcaggacggcgaggaggcggtggacggcttggagaaagcggcggcggtgcaggagaagtcgcgagctgcggcgtgcacgcgagagagttccaggcctcgggtgaggattattctctcacccgtgggtcggcatggatcgagccgcaatacacagcaatacacgaacagctaaatgcatatttgggctggatgtgggaattgatccaggcgtgggctgcattccacggaaggacgggtttggggcctattccacatcgaaacacaaacagccaaacaggccttagctgggatgttccccattatcgtgagactagcagactaatcaatttcaccttgcaagattattcaattagtaaaattcagttattcccggggtcttatactatgttgacttggcgttgacgtgacacggttggtccgggagacatggcactgtctacgctgacagcgagtccggccgtcgtcagggagagatgctgctttggtttggttggatggagccttggatctgtcactgtttgtccgtgttactagtataattaatataatactggagagatacgatatatagtgtgaagattacttaagaagggataatttctctcacaagattaagaaggcataagtacaatatctagctgggaaaagaaagacagaaaggctactgaatgtttgtgtttgttgagctcagaatgtaatgaattgtggtgatatatttacatagt

SEQ ID NO: 59846 - DNA, 19418 bp, Oryza sativa
caaccgggactaaagataattggggccctgactcgtccggacaattttttgaaccgggactaaaaatgatctttagtcctggttggtgttaccaaccgggactacagatcaaaaagtttttaaccgggactaaaaatgatctttagtcccggtttaaataggaaccgggactattgtggattttagacgaccgaccaaagatggtttctctagtagtgtgcgcagctacagggaagggaaggaggtgttcgtcgcgcagcgcgagctccagtccatcgccttctccaccatatacagcatccgcttcccgggcagcgagtgcatcgcgacgaagacgaacctgcgccggcgacatctcgccaagaaggtgagaggcacgctcaggcgatcatacgcgagcgcgccaggccgccgccgccgccaaggaggacagcggatatggcaacgacctcctcggccgaatgctggaggccaacgcggcggtcggcggcggcggcggcgagaagagcctactagaaaaaatatttttgcaggcgaccaaaagtagtttttccaggcggggggaaggaccgcctctataccaacaactgtgacggcacaatcgtccgcctgcgaaaatgcactggatgaacaaaaaaaattggcgccccgccggccctgcgcctcgcctcgccgccgccgccgccgccctccccttgtcggagtgtaacatcctgaaaattcccgacaataaaaaacactaaaattttgaactttttaaaacttttgcatcatgctggttgttatggttactattgcttgccaaactataaactgtcacaatggaaaattaaactaaagctatacaactaagtaataattataataataatatatttatcatgaaccctataaatatttacgcacaagaaatcaaagtcagacaaaagaagtaatttaatttatggattaaatattaaatacttgaaccatgcgatgagtgtcatgatatctgtatacacatgaaatgatatccattcaaataagtcgagctctatctataaaatagttttactgggaataatcaattcgatattacataatttgtattgaatcacaaatattgaattgtagaaatccatgttgtggtaaaaccaatctaaaaagataaaccaatatgtgtgaaaacagataaataccaaaatcccaaaatataggaaattataaaaatctaggataatattaaatattggacaatattaaatttggagaaaattcacatttgaacacttaatattgtcactcaaatacttttgattaaatacacatttaattggcaaaatttcctcaaattataaattaagcaaaaccctaaaagaatggaaaatggagaaattagaaaagtatataataaaaataaaaatatgtgctatattaaattttaataacttaaacatggtgtattttacattgtgacaaaaatggtggcaatagtatatttttcctaatggcaaaataccctctaaaataaaaaaaatagtcggctagcactgttcattagcccctaggtgttcgatttggatccttgccaccctagccctcttcctccccactgctgcgacgccctagctggccttgagccccaagccgccatcgccatccatcgccgtcgacgtatcgtcgccgcgcgcctcttccggccgcccctcgcgccccgcgccgcctcgcgccgtcttgtcgtcgtcgtcgtcgccctgccgcgccgcttactgtcgctgtcgccctgcgcgctccgctgccacgcctcctagcgtccctttccgccacacgccgtcgtgtcaccgtcgccgtcgctctgctgtgcgccgcgcgccgtcgccatcgccactgccgcgccgctgccataccgcctcgcgccccgctgccactgcagcgccgagccccatgccgagctgcatcgagtcccgccccacgccgccgcgccgcgtcgccgttgtcattaagcactgcccgccccctccgcctatataaccccccccccccccccgcggccgcccgttgcttcccacaccaccctcaccacctcccctccctttcccctctcttttccatccccagcgtcgccgcctcttcggaagcagccgacgcgcctcgccatcgaccccgacgccgcgtcgccgccgaccacgccgccggtccggtgagtctccccctcccccaccgctcgtcgttgcgccgcgccgcccaccggttccagccgagccgcgagagtgagagagagggagcagagaggtagaaaaagagaagagaaaagagaggatagagtggcccacctgtcagtcgtagtaagttaataattaggttggaataaaaataaaactattaggaacagtgccatttcgcaattagttgaattaggaactttgaactagcataactcactcattttaactcagattatagtgaaacttgaacctaaattcatctaaaatcataagctttccaatggtatataattcactatttaataaagtatatatataattataaaataattaatatcaaaagattagattattggtcaacttaaaaatatgctagtaaataggattgatattgtaaagtagagtagatgtaataatattggtctttaacatgttttgtcactgtagcaaccacataaataattataatcaatgtttcaaattaatggatgtataggaaaataatagtgccatttattaatctatgtccaaatataattaaacccatgaattatcagttatttaaataaagttagccttataattaggtaaatcaaacatgaatacacatagatgagtctttaatttgtttatgaggaataggaacagagttgttatgatagaaccacccaaataaggttgagttggttagcatccaataattactcaaacaggaaaatcacttgtcaacccacttaaatcacatatactgtacaatccatttaaaatcatacataagaacaataatctaccttttgcatatattaaaccaaggagtctatgacaaacatttgtagtggataaatactaattatagtggataaatactaattatagatcttgacctaatataatctaagttcaattgtaaattaggattattcattgtaaatctacgtgatgggataatctgtaaccataatatgattaacctaaacaactctaacatacaaagcatggataattgttaaccttttataatttattgtgataaataaaatatgttaacaattaaagtaaagcctccatcaataaaacaataatacaaatgattcactgtacttatttgattgatcctaaatccatctgacaacaaaacctctagtatatgaccattttatttagatagatgcatgtgtagccataatctttccaaagtcattagctagactaaaccacatattagccagaggtatatctcatttatacactattggttactcctaaatagaccacgatgacaacataaagattaagaaactttagtccttatcacgattggaatcccttagcaagcacgaatagtatgagcaaccctaggttcgaccccaacaagtacattttgttgtgcataattgattggtgtttgaatattggtttttcttgcatattatagaaattgtatatcggttaatcgtgagacaacgtatgcagcttctaggaggagaaggttgatcaagaattatatcaagaataaggactatcctgagcaagcaagtcatcactattccttgaacatgttgatccaattgcgaaattattttgtctataaataaaattgcatgcaatgatgaacatcctacatgtgattatgccatgccttgattattgtttaccccttattccttcgtaaccatgtttacgtatgaagtccctagtcaattatgataaatgcttagaaatgctattctagaatcatgcatacttatatttatcaaatgctatatgcttaggtaattacctttgggaaggtaattgagatgcggcatataaagacatgagcgccacattgccatgatattgatgacatgatttgtaaaagatgaaataaaactaaacaactgttttcaactgggcggacggaggatttgggtggtatctggaaaaggctactaccgtccccgtcaattaaggatcaagccatgaagttaagcatgaaacgacccccgtataaccgtacctcttgaatgggtataggcctagcggattagatagccgagcggaggcagtatccctgcatagatggttcacccctaagtgaggcagatgcgctacggtggggcagccgttgaggtagggccgcgaggtgtgccctacatcggtgtcgccattggtaggactgccatgagagtgtgagagagaacttaacgtgtgtgtgagacttcttccccgggagcgccagaactcctctcactgctagaaatatagacgcctagagtgcatgaggatgtaagttcatggagcgggtactgccaatgcgaggttatcgaaaagttttgccgtgacgcgtctcatgtgttgggacgagactcatgtgttgggcagtcgcggagtgcgggtaaagtgtacatccaatgcagtgtgagtaaaacaaatctattcgaatagccgtgctcgtggttattgagcaccaggacgtgtattacacttggctagactctaaattcttaacttgtgtgggatggttttgtgtggttttatgtatgtcttgttttatatgagttaatttccgttaaataccaacaatataggaaaatgggttatttaaaaaaaattgttcgactaggaaccttaatttaatttcctctagttcccagctgtcacccgtgcaacgcaacacgcatataatatcaggtcccctagttgctacgttatgcaaacattgtcatatcattttagtaacagataagatcgtacgtatatatatatataaattcaatctgacttgatcgaaatacgaagaactaataaaatctagtgatatgtctccagcgaaaaaaacaattgtaaaacgccatcatacattctttccccatgtaaaagaaaatgaaccggtgaaacgttgggtctgtttggtacagctccaactcagtcaaacagtttcagctccatcaaaattggaagtgaagctgagtggagctttctcaccaaataaactagagttatagagctgggtttaggtaactttacaactccacttcagacctaactcctatagctaaatttaggagttggagctataccaaccaagcccgtcatcgtgttcagctcgaaaccgaaaatttcgacgaaatttctccactgctgtaacagctatagctcaatgtcagtgtgtgtgtatatatataatcactgcattttcacgcacacaccaactaatttatcactcaaaggtgtgcgagaattaatctgccgttgcattgcatggggatctgccgtcccataaaggatgcacataaatgaatctcatcatgtactacctccgttccaaattagtagtttcttgtaatgtttaaccactcgtcttattttaaaaattagtgcatatataaaaatgtagaagtcatactttaaagtactttaaattacaaacaaaataaataataattctataaatttttgaataagacgaaagataaaaagttacaaacaaaaactaaaagcgacaagtattctgggacagagatagtactaattaagggacctaattaaattccaaactgttatgttatattatgctactatgtagttaattcaaaatttaatttgatcatgtaaattaaggtatcatatatatagagaaatttcacaaaactcaataaaatataccaaaactttacactgatatctcgtgataccagtatctgaatgtatataccaaattttacgctagaaaatatataataccgtcttaagaattacctcttacatcccgttacctcttctctagctactaactcgatctctactttgattaacttatttgtgggtgattaacttatgctagaggtacgtgcatgggttgtgttaatttgtgtatgcagccgaagaccttatcaagaacgcacaggtgcaggccatcatcgtcaccacggaagcgcatacggccgtggttgcccgccttcgccgccgccaccgcgtccccatcctcgccttccccatctccggcggctctcctccgccgtcacatcatccaccccaccatgcaacggcgacggcgccgccgttcggcgccgatcacacttcagccaaggcggcgctcaccggcatcctcaccgccatattctcatcagcacggcgcgcaggcggctcgccgccccatggccgccgctacaacgccggcgctccgactggtcgtcgtctcgaccgccggcgattggcggggagaaggtcatcatcgtcatcgtcatcaggcgaggttctgaggatcgccgtgccgcggaagaccgggttccaggctttcgtcgacgtgagaataacccggacaccaagagacagaacatcaccggatactgcatcgacgtcttcaacgccgccatggccagagtacggcctcgccggaagtatgtgttccacgcctttgacggatcgtatgatatgatgatcttgtacgcaatgtatcttcaggggtaagccttgattactcccacaaacttgtttatttttagttgaattttttagtccttaagaaattaactcgagatacctaaattttacacgaggggcctcatcttttcacttgtgcttatatttatcagctaaaatttgaaatttcaacattaaatttagaactgattttggtgtttcttcattgaagtttatttttcagcctttgtttttagatcattaaaaacacatataaaaaagttttattcacaaattatttttcgtttataaatatgccggggctgtaaattttttggtactacatgtaaaaaatatgatagctctccagggtaccttattaaaaattatattatctatactccctccattttaagttatttgttcattctagttttgtagtcctaagtcaaactttggtctttgactatcaatatttctaaaaatctaaaaactaatatagttaacacaataaggtttatgtttccagatttaacttgaataatattttcataatatataattcacatgtgtcggtgatatgggaccgggagtattgcgcccggaggcttgaggcagatggaatcgcccacgtggcctggcaccttcggggacgtcgggcccgagggtgaggtgtccgccctcctcctgatttccccgagggggggtcgggttgctcctgccccgaccccgagggccgaggtgccccgaccccctgtggggtttgcactatgtacataggttgggtgaacacggtagggctcacctaaccgcatttattgcggtctggtcaagcgtgtcacgttgcatgcagcgcaatgcagcgcgctcttttatccggtctgtgaccagtcacagaccggtcggatcaacggttaggtggcgactggtggtctgacgcacgcctcgccccgtcccgtcaagacgagagcctttaggcacacgtctccagccggagctagcgtgttacctcttagagatggcacgttagccctggttagatgaataccaggcttcatcccaaccattacaggcaagatgctacaaaaagaagggtgatcatgcagatcgctgaactgacgcatagaggacaagaatgaccgatctgtgaccggtctgacactggtcgcgtcagcaacagacagccacgatcccacgttgcgcctgtctccgccgggagtggaggtaggtgtgggttgtcccatcgaaatgtcattcggacggcaaccataccaatctccgtccataaagagaagaaaagtccagtttggaaaggaaagggtacatgtggtatccccttaagatataaaaggaggaccatgcccacaaagagagggggctggattttcccgagagaggagagggctggttgattttttgtaacttgctcttacacagatccaccaaaaacacaggagtagggtattacgcttcccagcggcccgaacctgtatacatcgtccgtgtctcgcgtttcttcctggcacgcgatctttccacacacagcgagagcttgagatctcaccctaagcccccggccgaactggcaaaggggggcctgcgcggtctcccggtgaggagccccgagctccgtcatctggcgcgccaggtagggggctcagcgtgtgttttctgagctctcatactcttccgtgtgggccaagtttcccttgttcagcctaatggccgagcaagcaaaggcgcatgacctctctccgagtgtgagcggcgacgacggggagccaaacccgcgccatcgagctcgtactcccccacctcctccgcgccaaagtcccaagcggggggaggcgctcgagagagtcgaaaaatccgcagcatcgccagtcgcgggtggtgcaggagaacggcgagatggggagcgtcgcctcctcgtctacggcgacggcagcacgccccagggagtgcttcaggctgctggcgcgctcctacgtcacccgcccgtcgtccctgacccggagtctccagcccagcgatggctggacgacgtggccaacttggtcatgacggcacagcagcgcctgggtgctggtggacggtccgccactaccaggacctccggcgccgccaccaccggctctgtgtcatcaaggcggagggcgcggcgagcggcggctgctgcacgccattcggctaccactccctcgtcggcgcctccgactcgggaggatcagcatgaagagccggatgcccgcctcgacatcgagcgccgatgtagtgatcggcgtgctccccgcgcaacggagggtgcctcttcgtccagggtgtcacctcgacatggacgtgagggccagccctccgtgcccccggttggtggtgttggctgtagagcctttgtggcgagtcttcggaatgtccgttggcccccaaggttccggcccaccatcaccgagaagtatgatgggagcgtcaaccccaccgagtttctccaggtctatacgaccgggatcgaggccgctgggggagacgacagggtcatggcgaatttctttcccatggccctgaagggacaggcgcggggttggctaatgaacctgccacccgcgtcggtccactcctgggaggatctgtgccagcagtttaccatgaattttcaaggcacctatccacgcccaggtgaagaagcggacttgcacgcagtacagcgaggggatgatgaatcccttcgctcgtacattcagcgtttctgccaagtccgcaatactataccttgcatccctgcacacgcggtgatctacgcgttcagggggggtgtgcggcacaaccgcatgctcgaaaagattgcctccaaagagccccagactaccgcagagctttttcagctcgcggaccgagtggctcgtaaggaggaggcctggacctggaacccctctggttccggtgtggcagcttcggccgcccccggatccgccgctcagacagggcggcgtgacaggaggaggaagaaaaggtcggtccattccggcgacgagggtcacgtcctcgccgtcgagggcgctccgcgggccacccgaaaggggaggcctgcgagcgacaaaaagaaagaggctggtactcccagcagggagcgcccagccagcaagtggtgctccgtccacaacacctccctccacgatctcgcggactgtcgcgcagtcaaaaacttggctgagcgaacgaggaagtgggaggaggacatgaggcaggaacgccgtgagggcaagtccgcggcagttccctccggtaaacggcgaagtgaggccagacagaaggcccccgccgttgacatcgatgacggtgatgatgacctaggtttccaagaacctggggccaccattgccactgtcgacgggggagcgtgtgctcacgtttctcgccggagtttcaaggccatgaggcgagagcttctcgccgcggcccctactcatgaggcgacgcgtcgggcgcggtggtcggaggtggccctcacctttgaccagaccgaccacccaccgtgcgttgcccggggagggcagattgcgatggtggtttcccccaccatctgcaatgtgaagttggggcgtgtcctcatagatggaggagcggctctcaacatcctttcccccgcggcctttgatgctatcaaggccccggggatggtgctccagccgtctcaaccgatcatcggtgtgacgccggggcacacatggccgttaggtcacatcgacctaccggtcacctttggtggatcagccaacttccgcacggagcgggtgaacttcgatgtggcggacctcagtctgccctacaacgcggtcctggggaggcccgcgttggtgaagtttatggcggcggtccactacgcctacctccagatgaagatgccgggccccggtggccccatctctgtccgtggcgaccttaaagtcgcgctcgcctgcatggagcagcgcgcggaccacctcgctgctgcgaccaagcccgagggtggtgacgagaggcttggcacctccgcccccaccgccccgaggcagcggattgccacatgcgacgaggtcccggtcaaggaggttgccttgggcgacggcccatccaagaccacacggatcggtggtcttctggatggcaaataggaagacgcgctcgtctccttcctgcgggcaaacgctgacgtcttcgcatggagaccagcggacatgcccggggtccccagggaggtgattgagcaccgtctcgctgtgcggccgggcgcaaggccggtccggcagaaagtgcggcggcaggccccggaacgtcaagccttcatccgcgaggaggtggcgagacttctggaggccggattcatccgtgaagtcatccatccggagtggctggcgaacccggtggtcgttcccaaggcgaacggcaagcttcggatgtgcatcgactacaccgaccttaacaaggcatgtcctaaggatccttaccccctgcctcgcatagatcagatcgtcgactccactgcggggtgcgaccttttgtgttttctagatgcatactctggttaccatcagattcgcatggctagggaggatgaggagaaaactgcgttcattacccccgtaggaacctattgttatacatcaatgcccttcgggttaaagaatgcaggtcctacttttcaacgaactactcgaatttctttgggtagccaaataggacgtaatgttgaggcttatgtcgatgacttggttgtaaaaacgcgcaaccaagaaactttactttcagatctagcggaaacttttgagaacctccgctccgcccgcataaagctgaaccccgataagtgtgtgtttggtgtacctgcgggcaagcttctcgggttcttggtctctgcccgaggcattgaggccaaccccgagaagattcgagctatcgagcggatgcgcccccccagcaaacttagggatgtgcaatgcgtcaccggttgcatggccgccctaagtcgtttcatatcaaggctgggagagaaggcgctacccttgtttaagctcctcaagcgctcggggccgtttacttggacggaggaggctgaacatgccctcactcagttaaaggcatatctcagctctcccccggttctagtcgccccggagccaaatgagcccctgctactttacttagcggcgaccccccaagtagttagtgcagcgttggttgtggagcgcgatgaaaacaatcctcatttcgtgcacccccatcctgtgctaacttggcccgggagcgagcggggaggagaagcccccgagtcggacggtggcctacggcccctgacgaccggagtcggccctctgcccgcttgtcagacggtgctaggtgcccccgaccctcaggagggccccaaggccactgcgggaaggccgcacttaacgccctctgaccccgaggctaaccctgtgctgactcgacccgagaaagagcagggagaagaggcccccgagtcgaacggaggccagaggcccctgacgaccggagttggccctttgcccgcttgtccgacgatgccaggagcccccgacccccaggacggccccgaggccactgagggaaggccgcccctttcatcctccgaccccgaggtcatcggcacagaagacaagtgcaccccgaaaggccacttgaacgaagaacgccccggggatacggcccctagcagagaggatcggccccaccgaaaggtgcagtggcctgtctactttgttagtgaggccctccgggacgctaagacccgataccctcaggcccagaagatgctttacgctattctgatggcctcgaggaaactgcgccattattttcaggcacatagggtcactgtggttacgtcttaccccctcggtcaaatcttgcataatcgagagggtacaggacgggtggtaaaatgggcaatcgagctttctgaattcgatctgcactttgaaccacgccacgctatcaagagccaggccctcgccgattttgtggcagagtggaccccggctccagagaccgtctcaatccccgaggccagcacgaacccctcgcagctgcctcacaccacctactgggtgatgcagttcgatggttctctgtccctccagggtgccggtgcgggggtcacgttgacctccccgacaggagacgtccttagatatctggtccgccttgactttcgagcgaccaataatatggcagagtatgagggactccttgccggactcagggtggcagccggactggggatccgccgtctcctggtgttaggcgattcccagctggtcgttaaccaggtctgtaaggagtaccggtgctccgacccgcaaatggacgcctatgtacgccaagtgcggcgtatggagcgccattttgacggaatagagcttcggcatgtgcccagacgggataacatgatagccgacgaactctcacggctcgcgtcctcgcgagcccagaccccaccgggcgcctttgaagaaaggcttacccagccgtcggcgcgacccgaccccttaggggagacggatgcgcctgaccgacccccgaggcccgtcggagtccaggcctcgggacccgaagggagcgctccaagctctcttagattgatcgcttggatctctgagatccaaacatacctcacagataagactctacctgaggaccgcgaagggagtgaacgcgtacaacgcatttccaaacgctatgtgctggtagaagggaccctctatcggcgcgcggctaacggaatcctcctgaagtgcattcctcaggaacaaggcgttgagcttcttgctgacatccatgagggcgagtgcggagcccattccgcctcgcgcaccctggttggcaaggcctttcgtcaaggattttattggccgacagctctcaatgatgcagtcgatctggtccggcgatgcagagcgtgtcagttccacgccaagcaaatccatcagccggcccaggccctgcagatcataccactgtcatggccatttgctgtctgggggcttgatatcctgggaccgttcaaacgggccccgggcgggtttgagtatctgtatgttgcgatcgacaagttcactaagtggcccgaggcttatccggttgtcaagatcgataagcactctgctcttaaattcattaagggcatcacggcccgttttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcagaaatcctcaaaggccttaaaaccaagaccttcaatattctcaagaagcacggcgattcatggatcgaggagttgccagcggtgctctgggcaaaccgaaccacaccaagccaagcgaccggggaaacgcctttcttcctcgtctacggcgcagaagcggttctcccatccgagctcaccctgaggtctcctcgggccaccatgtactgcgaggctgatcaagatcagcttcgtagagatgacctcgactacttggaagagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggactgagcaagctctcaccaatgtgggagggtccgtatcgagtgatcggcgtcccccggccgggctccgtacggctggccacgggcgacggcactgagctgccgaacccgtggaacatcgaacaccttcgtcgcttctacccctgagggggggggtcgggtgtcaggtttcgggctcgggctaaccacgcacccccctcgggtgtgcagggttagccgggggctaccacacatgcacaaccttacttttcttatttcagcatttcaataaaagcagtttcaatttcctaaaggttgtgtctgtgccgtttttccttctaaagaatcttaacttgaaataaggtcactcgtgctcaaccttgccctcgggggctcggttcggtcagctaaaatcgccaagcggggcccagaaccgagccgtgccccggggcgtggtgaactccgggggggaatcggcaaaaacccacaatcgggtcacccataaccctcggtcaccatgttcccggcctggccagtctcgacatgtggatctccccaggcactagccccgacccgagccatttgaggatcgggacttgagcacgagcccttaaatcaagctaaaatgcaaaaggaccacggcacaaatcatcctcaactcatatgcataacaaaacaaagttaacatagaaatttttcatcatttttgattgcagattaagttgatctatacaaaaagaagaaagaaaaagaaaaaattggagattggcgggggcctgggggctcattccaatgcgcccgggtcgctggccccgtcgccaccgtcgtcctcgccgctggcgtcgccctcctcgtcggagctgggggcgaacgcgagccgaggggccgacccctcgaagctttggacgatgtggttggcggcatcccggacccgcgcgcgcgcatcgtcctcggtcccgggagggaactcctccagcgccatccatggggagaagccggggtccctggcctggtaactcgctaacacgagttccaccgctccttgggcgaggtccctcgaggatgacttgatggtcttctcgagctcctcggggagttgttggacagcccaggccatcctcctaaggtgcggggcgaggccttccagattggtggagcgcgaaattgtctggcctttccagaggcccgcttcccgaccggcgcgatccagccgggagactgcatcccaaagcatgccgggccctatctcacccgacaagcggagggcctcggcttccccggtggatgagtccagggcgcgctgcatgtccgcgacgttgagttcggcagctgcgaggcgggcgactaagtcgctttcgcccgtagccgccccgccgctgcgcttcctcgcatccagctccttttctcgcgtctcgaggttagcagcctgctgctccagcgcggctctctcggcgcggatgcattccagattgcggcgcgcctgctcctcctgcgctgcctcgcggagggacaggctgtccgccagccgttgtgtcgcggcctcggactcctcaagagctcgctcccgctcagcaagcgcgtcctcgcggagccggagcgcggactcctcttcggcgcaggcggcctcgtgcgccgccagcgtcgcctcccggatagcggcggcggcctcgcggtccgccaagctggtctccacggcgccggcatgatcctccagcgccatggcacgggcttcaagggcctcttcgcgccgccgggacgccgcttcagcctccgttgctcgctgctctcgggcagcggcggcgtcgaggaccccctgggcggcgtcgagctttttctttagctccgcctcccagctcccgtgttgaaggcggagggagtcctgcgcctcaatcatcgcggtggtggcgacgagggcggcctctcgctcctcctccacctctcgggcgatctccgccagcgccgccttgcgggcttcaagctccgagatgtggcggcggtgggccttacggcccacctccaccatggcgtccaccgagcgccgcccctcctcgacgcgcgcccatgcggcctcgagctccgctcgttccgctcgcaaggcctccacctgggcgctgaatccatctagcaccgcggtgtttgcggcggccaaggcttgcagaaggggctcggcactcagcggggtggcagaagacgaggagaagagccgccttggagaaaatgcgacgcggctcggcccgccagaagacgcactgagctcggggatgtcccccggacccgtttggtcctgggcgtcgcccgagggagcgggcccaggcgatgcgcccgcggccctgtcgcaagccgccccggaggttgtcgcctgagcgtcacccgagggagtgggcccgagcgacgcgccggcggtcttgtcgtaaaccgcctcggaagacgccatcgcctctgcctggcgagcccgggcggtttcctcccgggtggcttcttcagcctgacgagcccgggcggcctcctcccgagcggcttcttcagcttggcgagcccgggcggcctcctcccgagcggtatcctccgcctgccgaacccgagcggcctcccgggcggcctcttcagcttcccgaaggcgatctgcggcctctcgccggtcagattctcgcctccgttcctctgcggccgccggatcttcggcctcggattggccggacttgggatggcgggagggacgcgacgggacatcgctgaagcagaagaaaaaaccagaaggcaaacaagatgggtaaggtaaaacttgcttttgggatagaagaaaagacggtcgcaaagagagcgggacgaacctgcgagggggtcggttaaatgaccaccttggaggggaaattaggtttccctgggatggttctgtctcccccatcttgcgcagccgtttcttcttgcgctccccctcgggctgcgatgttggcgcggccccctccgggcgcctgctgctggcacgcgccgccccgccccctcggggaggagatgggggaggtgttcctcccagtttcctcttcccccgggcgtcggtagggcggttgctccccgagcccccgacgcggggcccagaagcacgaccccctccgggggtagattgatccccccggcggctcccacctgcgccgccatggcccttaggagcctgctcctctgaggccccgaccgccgtcataatggtcaagatggagacgcgatctgggtcgctgcagagggggaggataccgtgggggatgagggacgcctccacggagttgagatttagcacccgttggatcagtatcttgaagtcctcgggggcccaatcccatctgaccccctggtgggtccgcatatagtcttcgggcccgatgtactcccaggcggcccgagcgcgccgctggagcggcgcaatccgacgacggaggtagtcgccgtacaccatggccccggtgagcccctgggatcgcaggcccgcgaggcggtcgaggacggcgtcatagccatcccccagatctaccggcgcccgccagctggaggcctgcaccgggggctggctcggaagtcggagatgcgcttcgtcggcgaggggggtgtagaaccagtcgctcttccagtcatcccactttttgcggaggacgcaggggatgtagcggttcaacaccggcccccgcggcaggaaatagcagccgccgaccaccgacggcggcgacaccgactgcacggtgaagaaccaccggaacagccgaagagatgggcgcaccccaatgaacatctcgcacaggtgcgcgaagatggccaaagtcatcactgcgttgggggtgaggtgcgccatctggagatcgtagaactccagaacatccataaagaaagaagaaaaaggaggaaccaacccggccattgcgaaggggagaaagaagacggaccgccccgggtagtctggcgccgggcgtccctcacccagcattactatctcacggccggtggcggattccggcatgaagcggcgcggcagcccagcctgcctctcgctcacaatgcgggaaggcggtagtacgctaccgtcgagcagagcggagccccgtgccatgtcgtcggagaaagagagggttgagaacgagtgtgtgtggcgaaggtgaggcgcagcaaagagagagttaggggcgcaaacggcgaaggaaaggggaatagtggcgaaaaggaagggagcaagtcctttcctcgatagctttatacccttgccatcgctgagcccggctcctcgtttctcgtgcccactatctcgctccctcgttactcgctatctcgctccctcgtttctcgcgcccacgcttccactaaattccattcgcccgcttacggcgcataaggtagatatgcggttgtggcagtcgagatagatcgtatcgtgtgtgcgttaattacgctcgctgaccgaagcgacgttaccatatctccagacgaaacgaatctacacgcccagattcgagcgctgctcaagtgatgtggcagtcttgaagagaccgcccatgactgacggccaagacaccgttaccgatatgcgtggtttgagaccgttgggtttctgcccaatcacggagaccggtcccacctgtcaccaggctttatgagtggcgtcatgcccgaccgcttcccttgagaaggatgattgccctgacataacgccgggggctactgtcggtgatatgggaccgggagtattgcgcccggaggcttgaggcagatggaatcgcccacgtggcctggcaccttcggggacgtcgggcccgagggtgaggtgtccgtcctcctcctgatttccccgagggggggtcgggttgctcctgccccgaccccgagggccgaggtgccccgaccccctgtggggtttgcactatgtacataggttgggtgaacacggtagggctcacctaaccgcatttattgcggtctggtcaagcgtgtcacgttgcatgcagcgcaatgcagcgcgctcttttatccggtctgtgaccagtcacagaccggtcggatcaacggttaggtggcgactggtggtctgacgcacgcctcgccccgtcccgtcaagacgagagcc

SEQ ID NO: 59847 - DNA, 8585 bp, Oryza sativa
gatgggtgttcttcttaatacgcacacatagaatcatcttggatgtgtagaggaattctaaagcatgaatgtggtgtacggcctcctggaagtaataaagctgctataccagaggatgccactgccaaggctattttccctttgtttctaatgctgcccaacagagcattccatagaaatgtcttccctgttccaccatatccataaataaaaaaaatatttgtccagaattattcaaaactgagcattctatggcattgcaaacacgcatctgattgggatttaattaattgagctgttcattcacctcagttgttccataagcaagttcatccattataagcctactctccaatggtggaaaagcaagatggcttagccgcggtaactgaaagtgatccaagctgtatcctacatctcttagtaatctatccaattcagctagggtggataatctgatatgctcttgaaggatattttgatgtatcctaggtgtctgctggcacacacgatacgcaaaatcctcacccattagttgaacattattgtcaaacaacttggctgggtctgatacttggtaaaatagaagcatcatgacaaataattgtcgaagttgatatggaagcgcccactgtgctgcatcagtgatagcatgagaccattcacgatcatcgccaagtaaccccatttcttcacatgcagattgaaaagttgggtattgaatgccactaacagtgcgtacatcagaaaaggattgagcgcctttgacaacatgcagtaatatacgcaagtaaaactgctcaccttggttaggtccaacattggcaatgcgaccaaccttgcccttatggctctgagagcgttgtttccaatatttaccatcaccatgccatgtccaaaactcaggaaattccacatacatgtgttggcgagcttgtgggtatatcctattagcatcaaaccatgcagtcaatttggtgatggtgctacgtggattttcaatgacctggtccagatggtcatcttcagaaaataccacactattttcgagtgggagatgcacaggtaagcgctccatagatggatcagtgtggtggatgtcaaattgcagtaggcgccatgcagcttcacaaggtgttacacacctacaatcaagatattgttgtatttcattgcctccatcccgtatcccaaccttagcacaatcaggacctttggttgtgtatttgaataggtacttctccattccatcacgattaacaatctcaacattgatgtgtgcttggtacttaaccaagagatcaacattatgggccacaacatacctgttatcgacatctacaccacctttctctgtggtaatattgttttttggccgagcatatataacacgcccgacaacaccatagtttttttctgtaaattctttaggataaaacttactgcattttccatcattcatgcaagtagacgatttgtttgaactgccacaagggccatgtatcataaacttggagacagcttcataaccaatatgatcaacagatgggtccggtagctatgcaggtacaaaggcatcaatccaatcaacatcaagaggtccattattttcaagccatatgattacatggacatgggataatccacgtttttggaactcaattgtctagagaactacaaaaaggaaaaaaaggagaagcaaataagaagcagtgaaggggaaaactgggcaaataaaataaatcttaaaaaactggcatgttaaatgagaaattgtggacaaaattaaggatttatggaaattacttccagatataggactgaaaaactggtattttgttatgtcatccataaatattcttagcttcatttggaaaacacggtcaacaatatcaggtcaatcagaggagtgctgccttggaatgagtgctaaagcttgtgttatttctggccatgaagcgttgcatgtgaaagtggtgaaaagatgtgggcacccaaaccctacgacaaagtgcaacacaatcttggtagttttgataataataacgtgggcttccagtaaatgaagctggcaaaacaattttttgttctgctgctgatccttctgtaatgccaatgctaacagcatgaaccaaataattgtatgggctagctctaaatttcttctgaaatgactcattcctgtaatggctcaagcaaccatcctcgacgcaacaaaaccatcaacaacataggcttgagtcagtatcttgcaccgtaaaggagtattaaagtcatcagctctatcatgtagtctatatgcaatatactctaccttggtgacatttttcctcttaatagcccctgatcattggcattgacggtacttgagatctttgtagaagccatcttccccatacggaaacaacagagggtattgcatagccataaacttgcaatgagattcttttatcctttgtagatgagaaatattattaaatcatggccttcattaaatcattaaccaccaacccaacaaccttagatggaacaggggcactatacacaccaccatgttgattgggcacaacaaatagcttgacataatacttgtcttcagattggttagccaatctatcccgagcagttcggaacactcacaatcgggttgtgattatcaaatatcctcatcaaagatgaaatgacattttcatttggtttaaaaccaccacttatgcatggaaccgacatcctattctggatctcattttcagtatcaaaaatgtatagcggacaatattttggcctagcaccatctcttgagatcaaatccaatgacatagctgcccactaatcttgaaaacataaggtcctcctccatcattaatagaccgtatgatgttcacgtccatagttgtcatagcaaaaatagagttataacgcctaatattatcaaagaagtgggtagaaaatgcagggttttgtccagtcaacaaactaagcaatggttctggaggcggtatatgtatggcgataagtgaacacttcctcccctacagcatttgttgtacacacgtgaagctgcctatccttgaccacacacatgctccttataccaaaagagagcaccacaatacttgcatgtctggttaggtcctccaaggtgtaaaggtgaaaaaatagtgcctgagtggaaaatgcataaataaaaaagtaagatagataaaaatatgtggcaacctaatgaacaatatggtatgttctcatcaccatacataggcgatcattggcatgaatcagctgagccgtggcaattatcattatgacgaaacctctttctcaagcactagagtgatcatagagcaaacatcaagagagaaccgcggagttgaaaagcatgacgtctgtaggtgaatgctggcgagtaaaaccaactatgagtttgaggcaaaatgaggagatatatcccctagacatattagaaacacacatatcatgtatgttcctcatgtgctaaaaaaaataatggatattacaacataaagattgataaaataataaaacttacggtggtgtcgaccgggaaatggttgcctaagatctggtggcaagaaaaagacacccagaagaattgaggaaacagttctatgtcatcggagtggatcacagaaaactgaaaataaatcaattagttaccatcgtcaccttggtgagaagccgatgacagattctgttgtggtagttgtgtatgacattgttgcattggtgtacagcattatcatttgggattatgcgacgccgaacagatcgagatgaaggggagtaaatagcagcatatagctctgcaacaccaacaaaagctgtacaaaatcaacaaaaaggaagttgctataaaagtctgtcaatgtagaataatctatcttactttcttctctcttgcgaatcatatatagttgccttgcgttttttacgtgactcagcagcaacatatggttgtggccatggcaaacctaagaacaatagaatataacatatgtatgtatatctgggagtaacttagagtgtgtgagcataacgcggagcaagggatgagcatgttaattgaattgagcttaatatgaacatatatatctatatctatactaatataaaaaggagaagttgcacccctccaatcctacagaccaaatcatcctaactcatctcattcgtccatttgcctggtcatctcatctcatccgtgcatcccatcccaacgcaatgacccacagtcccacctaagccgcacgatgactccaccgtattcctcctcgcccccgcgcaatgactcccgccgtggcctgcccccgatggagccgactccgccacgcactccacggctccacgcgcgctcctcgctactcctcgctcctcacctccctgccgcgatgccgccgccgaacaccacctcggaggaaaaaagaaaaactttcccaatcctcccacgccgcgaaccctaatgaatcggaggcggaggcggccaccacctggccctgcgccggcacggcggcggcgatgacggagtcctccccttctccacgtggactgccgccacatcctcgctagagccgctgcccacgccgacatcttcttctgccgccgccggagcctgcttcttccccaccgccgcggttggagctgacctcggccccatccgccgctgtcgccgccgatggggctggtcgatctctcctctctctcagcagtgaaggtacaaaatcaatttatcccctttcctgaagtcaatttctgaatgtggagtgcaaataatgtggatctgttttgtccctttttgtttcgtagtttcatcctgatccagaacagaagcaagacatcgagttacgagccgatcaatttacatgcctagtgcctcccagtcaatctattttgaggattactagggacaaaatgatcattaatactccggtccaagagggtgtttgatgcaatgctggttagtcattcttattccccaagaagatttgtctttgcaagtggatttcttatgtgcactcaatttttcttgatgctgaattaccaacatttgttatggggtttagatatttagatgtctaatatttacattgatatatatgctgtgattattctgacactcacttgatagctgtttttgtttcaacgtgtgcatttctgtgattttcccaagcaccctttactacccctttcccacctctattttcttgagcacgatcatcttaattgcaatttaggtcaatcttctgttctctgcatcgcggacgtttttttttcgcgaacgagttctctgcatcctaattcaatggatgacacagggagcttctttggtatagacagggagcatcagtactgtctaatattgcaccactgttgtcattgaagcaacatcagttttatgtgttttagtgcttcaatcgatctaaagcaataccttgaagtacattttgtatattttctaatgcctctccccggacataatgggatgaacttcgtaaacatttgcagtaacaaggtgagcaagcagctaaccatttcattaaaattgcgatctttgttgtttgcatggatatgaactgaagaattgagatctttgttgtttgcatggatatgaattgaggaaggataatattatactcttggagttcccaaaaggtcgacagtccaatggccgatgaatgcatgctttgatgctctgcctactgagttaataagttaataaggtgtagtctcctgcttagtctccctgttcttcgccgagttcgtcgccgtccttcgccggaggagaggagagctggtgccggcggagggaggaggggagccagcgcctgcggacagaagaggggagagagccggcgtgaccgtgagggaggagtagttgggggatttgggtaaagtagtatgggtggagatttatattcttctctcgattttagggtggttactataaaatttggatttctttgtaaattgataaacacgtgagggctgaaatggaaagttacaagggttgaaagaagaagtaagtcactcgtgaggctatttgcactgtgggaataaaaaacttgatccagatcttcatcctgtatgaaatagaatgatggtaagctgcactgtgagaggcctaagtttcctgtatatacattctactgtatcaacgatggctgtactacataccagatcccgtaagaaaagtagcatatactggttcaacaagggattcagtgtactggatatatacttgtaaaaacagtacatactactccctaaccgatcgatttaatatatactgcatacttgaaaattcagtatataatccttaaccgatcgatttaatacacactggatacttgaaaaatcagtacatactctttaaccgatcgatttagtatatactgaaaacttaaaaaatcatgtacgatggattaagtatatacagctagagaaaaagtagtaaatacctgaagaagagcatacaaattaagtagtacatacttctacgagataaagtagtatgtatttctacaagaaagaaaaaaaagtagtatatacttctacaagataaaaaaacatataccattccctagcaaaaaatattatatactccaatggaacatatactattaaaaagacacaaagtcatacccaaaggatattacctcttttcaaaataaacatatattttgaaatgttatcacaaagctatggatctagttaacaagggtccaaaactacatgtttgtattgattcaatcactacggggctgtttagatttatgctatttttagttataccattttttataaaaattatcaaaaaaaattatctacgcttaattttttttttccaaatttagtaaatacataacaaattctactagatatttggcaatattgccaacttgctaaaattttggcattgccagaatttggtaaggtttattttggctataatctggataggccctacgtgtataaactgatttgacacctattttatgaagaaaactacagcttggcatcaccgtcttctccaagcaattcaacgtcttcaaattggcagaagataacaccataaatagtgtagcttggctgataaatgcaactagattacgactcagttgcaaaaatggaaaaaaaccaacgttactataaagcatcttctacgtatatatgggtgaataaaactcacgataaataggcggcgattccgagtcatctactagaagttgagatccatcacccaccttctcaacaataacgacaccacaatagatttggaggatcacctctcccacccacgttgtctttctccgctagcggagcctctaactattgaaaccacaacaggctcgggggaatatatttgttgctatagggaggtgggtggtgatgatatgtatgccgggaataaatgcactttttttttacggaggcttcggagggggccgaatgcaaaattttagttagattggatagtcatgtcgtagttccataccaagtgaaaatagtttcgattataggtgacaagttaaactaatattatgtacctagatacgtggtttatgatattatggatctaaataataacgcgttctaaagtttaagaaccagcagtcatgtattttaccttttaaaactcctcattaggataacgctgcaaattatattacctctaactctttttaccataagtttatagttatatgattgatttataattttctaataattataccaaacatttatcgttttataaaattttctctcgtatatattccgtgtaaaagtgagtcgattttagccactactaggggcctgtttagatcccatggcaaaattttacatcctgtcacatcgaatgtttggatatatgtatgaagtattaaatataaaccaaaaagataactaattacatagattgtatgtaaattacgagacgaatcatttaaacctaattgcgccatgatttgacaatgtagtgctacagtaaacatttgacaaatttgctaataatggattaattaggcttaataaatttgtctcgcagtttacagacggattctgtaatttattttatttttagactacgtttaatactttaaatatgtgtatgtatattcgatgtgacacgctgaaacttcacacccagataaatacagcctactagaccaatagccattagccagtgcgttaaaccctcgcagtccccctctcgccgctccccgtcttatccccgctccgctccacctgcgccccacacgcacagagccacgctactctccccacccagattccaccatttcacgcccccgcctccacttcgccttcgcctcgccgcgccgccgccgtctagcccttccgcgtaggcccaggcggccgggccggcgggaagcggcggcgagctcctcccctctgatggcgccgcagctgcagggctgctacgcggtctcgtcctggccccggctcccgcggctgcccccgtggccctgcgcctcccacgcgcagcggcggcgggtgctgcgcctcctgccgccgcggcgccgctgcgccggtgcggtccgggtggtcgc

SEQ ID NO: 59848 - DNA, 11140 bp, Oryza sativa
accttcttttgtgagaaatgcttgattcaattgttgatgagctgagaacggactagttggaatctgtatattagccgcatgatgtcttaaacgtccttcatggctgagtatctcaggattcactatcgtagaaagaaaactaaataactgcaaggatgaagactcacaatgacactccttttcgaaaaagaaagaaaactaaataactgcaaggacaatgattcacaactgaagaaattatactgggttattgaattcaatttcgtatacagagacgctgcagaggattcgggagagaaccaggattgcgatgcaggatcccaaggtgaagtcatgtaagatttttattgttgttatttagtagtgtcatgcatttactggatagttgacttgccttagaaattgtgcaaagttccatagatctaggagtcctgatgataatattaaaaaagagtctgcctgaacaagactagatttctataagcacatagtattagcatcatatgatcaaatatggggacataattccatccgaaagaaagttaggtctctagctgtaagtttgcatctctcagtgttgttggcagggccaaattttagtgactaatgtagtctaccatgttatttgttagataagcatagcatctctactcttatcatcttatggttgagtttatctcacattgtggtgtaacaagtgttgctgctggacttgtgtatagctattaggcttgtggtgcaaaagcaccactaaatttctgatggcttagtggaatatatcatatctgaaagttataattccatctgttaaaattttcaaatgctttggttttgcattgctattggtgattttatataaatgctgccaaaactgtacatgactaccatacttacacttcaatattatagtagtaacatttcatttcatcatgtttattacaatcaagacgaaggcagtttaaattagactattcatgtccccatctctttccgccatccgttgtcccatgttttacaaccatgctaagcgacttatgttgcataaaattaagatacaatgccacattaagggcatgtggtaattaacatatcagaccaacagtttaagcacaatggttattgtgctgcagttatttttatagttcatgtgaaaagtaggaaatagtctcttatttggtttagttaatcagagcaaagttagttagattatattttattatgaagattgccataccacaatttgcatcatagttttttaatgtaaaaagacaatcatttccaatttcttaagaaagtgtagctagttgagtacccagacagaatatatcgaaatgtgatccacccaattgaggttattataagcaacttcaatcccaaaagtaacttaaatattccaactgcaaaggatcacaccaaactagttcccagtggtgcaatgcatgagtgcaccagcaacagtcctgtgttcagttttgaaccatgcttatctatatgattatttgttgggatcgctgttatcatttttttcatatctattatatttgactatagttcatatgataaactatttaatcaatggtgtagcttgcctaaagtgttttttgtgcaggttaagaaaaagttgatgcatctgggacatgcacagaggtaggatactatttgctcttaagttatatgcgtgcattttaatttgaaaagctatgattacagttgaactgaagaaggtattttatacacatccacgtacaaatgtaaaggattcactattcttctctaagtatgactgcattacttggcacgtgttctacttggtagcaactcccagtggtgaacccagcactaggttttaggtatggctgatttgccagcataaacaaagcaattgttatcaaatcagacgattagtcataaagtcggtttaggtgggcaatgtgttcgcagatagagtgttgggccttgggttaggtcggcagtgaaaacatggatgggcctaggcggctagtccattattgctttacgggaagggatactatagcaactgggaggtaaaccctagcctccacttcccctagccaacatcaagcagagaggagtgcaccaggggtgagaggagcgtcaccaaccaacctcctcctcccctgctctcagcctctcctccaatgctggtgctctgatctcctctgctcttccatctccctggctcccacttcttccaaattgctggtgctgcaagcctggaactagcctttccccaaaacaccaattcaccatgctaattggcctattgtgtttagtactttaggacttatgttattgctggctattccatattccatagtttctatcatatattgggctagcacagttgtaaagactatatagtccatcctctgttttcgcacgaccaaatcatggactagttgtgtacttgtcgactcagtagccaagtcggtgtagggggtacctcgactcaactttacgacttgacaacaatgaaacaaagtgtattacccacaatccaccaccataaaagcatctgaaaatgaacatgtatttgtattacaagcacattaccacatggaactaattgggatgaacaactgtagtctgtatgcaaacatgtgctgaaggcagtatgtagaagaattcctcactattgaagctttcaccacacttcaacagaagttaaacattaattacaattgataatttgatatttccattaccgttatgccttggctacattgtaatcagacataatcaaatttatttgacagttacttatagatcatgaccaacacatttttgagattctttaaaactgtctagcctttgacgactctattggcagcatataacatgcaaagagaaaatagagcacatgtcaaattgcactaatgtgatgcatccagataactcacgttaaatgctaggatctcattggtgtagacaacaatgaggaatatacccatcatggcttcacatgcactcatgtatggatctggcctcctgtctccgctggtcactgccgtaccagtgctagcgccacctgctacattgcttgcttgtgattcattaaccaaaatctgatgtgccatttttacagtctgctgatgagtgtgtgtgtgcgtgtttgggggggggggggtaggttaaaaaccaactaagagcaagtttaataagaaaggaagtttctagttccaattatatctacgtcatctattgatcacatagtagatagctggtgcaatagatgagctctattctacagccacattctttattttattgatcaatttaggcccaccatgaccttgtttcagctatcgattggggaggaggaaggtggggtcgaccaggggcgggcccaggattttcaacttgggtattcgaaattggaagagataattttttccaacacaaagtctaatagttgtataatatataacggtataagcatgacgtcgtaaagtcatagattcatagaattgaccataaattaaatatgttaagcatattttaaagtacagtactaaagtattaattgacaaaacatgtcagatttataaagcatagaaaatggaaaaaatgataagaaatcttacaatttagagagaaacttttcgtttcttgatattttgaaaataagtgacgatgtctttatccttcactttcctcttcatgtttcaaacctacaaaacaacactatggtcttctaatttaagtattaaccatgctaactctgctaaatatgtgcactgactctgctacaaagcttcacaaatcagtgaatcacaagtttcaaagttcaattgttcatccataaaccatgaaccatccctgtatggctggattcaaatcctaaataaaatgaaccatcctggattcaactaggaactataaatccgaaattcctaaatcctattcgaacctaattaccaaaatgttcctaaccagttttaccttcgtctgggtcctgccgtctgggcgtttggcgcggtggagtggtggagacgacagaggaggccggagcacaagcgtggctgcgcgggcacctgggcgccacagtccacaggggcggcggcgcgtgggcgccataggggatgggcggatggcgcccttcgcggcaagcggcagcccgggggcgcaggcgtggccactgggtagccgtgaagctgcagcagcttggcagccagctgggaaccaccgccgtcggggttgggaggcgatgctgcgaccccgatgcgcctccgctagtccgctgtcgctgtgcccgtgcgccgtcaggagtcgggaatcagggtcgggaggccgccagggagaagatcgattgggaaggagaggttagggtttcattattcccttttgctgatatgggctattgggccaatgggccgaccagccgaggagaggacggaggtgggatgggatggtgctaagtcgggcttctctgaagaaacaagtctattttacatatttttttcatatacatatgaaatatatattacatatatgaatttttttgtcaaaaatcttgggtattcaactgaatacccatgaatcatggtgggcccgcccctggggcgcaggcgtggccactgggtagccgtgaagctgcagcagcttggcagccagctgggcaccgccgccgtcggggttgggaggcgatgctgcgaccccgacgcgcctccgctagtccgctgtcgctgtgcccgtgcgccgtcgggagtcgggaatcagggtcgggaggccgccagggagaagatcgattgggaaggagaggttagggtttcattattcccttttgctgatatgggctattgggccaatgggccgaccagccgaggagaggacggaggtgggataggatggtgctaagtcgggcctctctgaagaaacaagtctattttacatatttttttcatatacatatgaaatatatattacatatatgaatttttttgtcaaaaatcttgggtattcaactgaatacccatgaatcatggtgggcccgcccctggggtctaccccttcatcgtagcttagcttgtgctgcagttcatgctaatttagtcacccagtcctattctctttcctctcctctctcttccagctcacgcaaaaatctgatgtggcatttgtatagcttgctgatatagtactattgtacctgctttaacaggtaccttctcccaccgaataactcagttatactcttatcttttattcggcctcctaaacttggtgctgggtcctggaggctgcacctcctgcttcttgtttgtagtgtcgcctctgtgtaattactttggcctgcaactcagctcatattctagagcatagctcaggtggagttctccttcatcttacgcaacagaatcccactctcgaggtccatgctgcatggtggaggccattaatccactatggaggtggttcccgctttcggtgagtaactaccctagcctgccataatgggatgtccacccttggcaatgccttatagtctagttttgatactttagagttccagataaaccttggtggccatagaagctaattttactcttatgcaagctaagggaggaagcctaagtattattgtatgctggacatgcctaggtggttgacagtgttttggcgattggtatggttctttggtgcatattggcatgtattcatccttggtggagaacctacattagcattccaataggttattgaacgtgcacagtgttaagttagaaacatattacatgggaactggattggtctaagatttttcatggtgcataaggtcatgtatagcacgactctttgccgggcgcatggatgaagtttatttttctttttttgccaccatggagattaggggcgattcccaagggtgtgtgtgttgctgcttgagcatgcattggatgcatcaccgtccggccaaatgcatggaaagcaaacctgaggaggcaggcgcctaaagaatagctgcctctgttccagattaaggctcctacggagagatctttctctcattaggcagctacataaatctgtcccattttacatgccctaaggaggtttcgaaaggtacctcgctaatattggcgtaacaggagctaatattgtgttttgttataggaggtaccaggttgcattcaaatagtgttaatgctacctccagtaccttatcaaggactgtaaaatcactcgttctaaaatattaaatgtgtgacctactcaccttatagatgatatgtattcttcgaaatgatccaaaagcagctccacacgtgcatattggtcacaccaaaatcatatcagatgaaccttggcatttaggtactggtcactttgccataaggtacataaaatttaaaggagatatgcatcactatgtgaatattaatcattatcttaatactctaatgggttaccttcaaccacattcagaggtctagagatatccctccgattatatgggagggacaaattttgatctcaactgagcttttagtaaatctgcttgctcattatggtttgattaacccaaaacttgttggtccatttgcgtatgtcaagctgtaaatgtgatagctccagggggtcatagaaccaatcctaatgataggtatttcttcttaatatagcgaagagacaagaataaagatatccatgggagtgaggcgaggatggaacttgcgtttacagaaattaatgatccaggatggttgctttgtggagtggagagacatgatagcagatgctgctaggaagggctttgctggtggaatatccctacaatggaattcatataaaatcttgactgagcagatgcggcaggagtggttggaaaaagtccagaaaagaagatcaatgcctcggccaacaggtaatcgacgagcaccaaaatctccagagcagcggagaaaaattgcagaagccattgctgcgaagtggctagataaggtaaagagaatagcaataccttcctcttacatgtttctcattttcatttgaatattatacccaagctctgaactgatcttacaccattccttgtagctttgttacatggattaaatagtcttaactccaatactccatatagctaggagtatatggatcacacaccagcaatctatatggaaattggcataaaggagaaatatctagttttatgagtgccttatctgttttcttgtaggaataccgtgaacgtgtatgcagtggaattgctagctaccatggaacatcttctggaactaaagtaccacgaaagccaagatctgccagagaacctggttcaaagagagatactgtgaaaaagaaacctattcaatccagatcagctggattggaggatgcatgtggaacgactcccacagttaagagaaagaaaagtgcaactccttacaaagatccaatggctggtgaaaaactagagatgataacaaagattcgagctcaaagggcagccctagaaatagaaaagaaagaagctattaaaagggctaggtatgtctgcttattccatagttcaattgggtgggatcaacatttttccactactggtgattttttggcaacatatttttttttatattgcaaattttctcctcgcgcttacaagttcttctaactggattggattgttcttaataattttgtgaaatgtcagtcaaaaggcatatttccctgaaaattgatgcttactattctcacgtaaaaagttgttcataccaagggtattttcttttgtttgttcatcttgttcgatacattgactattatagttttgcagatgaaaaacagagatgtacacgcataataagtacttatgggaaaaaaaattcaaaagctctaatatgaacacctaaatatcttaaaacatgtaaaactacagatcattatgacttgaatatattttagtgcactatgcacttgatttcctgtttcagttatttggtactgtttgctgagcagaaaaactatacatgctatctgtacatccagggatatgttttttaagaaataatgcctgaagtttgcacttgttgggttgcacttaaaacatttaattctgtcactcaagtggcttctgattatattccttgtcattaggtcactgattgcagaagctgagaaggctgcaaatgctctggagactgttgcttccacaagcccttttgctcaagcatcacttatagaagctagaaagcttgttacagaggctagattatcacttcaacacgttgatgatgaagggcctgcagatagtgcttctgatgatgcatcacaagactcaggtgcgtctgatttgcacaatcacgacatggcaaatcaaaatgacgtgatcaagcaagagaataaaccagtcaatgggatggagcttcctccaagcaatgttaatggcagagatttctattttgacgtgtcgactctcactgaaacagatcaccttagagattatcagagaatagaaaattctatggaaagagcctatctgcttccttccgcttcttcagctattcaagacgtgaacgaaaatcacaggatgaaagattttaacgcacatcaattaatggttaatgatgaatcaataacaattgaccaaattgcatctgaagtagcagaaatttatcctgacgagccacaggaggatgacacgctacctgtgcagaagtctaaaatgaggtgggtacgtgggcgactagttgaagtggaagaataaacagttaccagaattatattggttgactaaactgttcaagatatcattatcttgcattccgcttctgctttgattactgttggtatggaccaaaatgggaaatgattgctgatcttggcacgtattcatggtgcattcaaccatgggaattagtcgggaatacgccatgacagagcctattatattctgaggtgagatgcttgtaattagtagttgccaactttagatattttcctcttcttgaatgtagtcaggttagccaaactgaaatcctaaaatcacggtgtggtggatgcatttatcttgtattagaacattttgtagctgtcagattgaggtcctacggatagccctaacacagatttcattaagtcaaatcatacgaggttgtcttgtaagataagtcaaatcatacgaggtcgtcttgtaagatattctgtagctatcattttttttctaggttatcttgtacctgagttcatttgtgaacttgtatcgagagaactactgtttctggctttctgctttgtgccatcggcaacacatctactcaatgtctgtgctaatttgagcctaacttaggccctgtttaattcagcttagcattattataatctgaattattagaagcaagctgaaataaataaacagatagcttattatgataagattattataatctataagctatattactctaatctggtaatccacgtgcttttttttaaggagctgtttgggaaacagggacttactttaagtctctatcacatcggatgtttgaattagtattaaatatagactaattacaaaacccattccatattcttggactaattcacgagacgaatcttttgagcctaattacgttatgatttgataatgtgatgttgcagtaaacttttgataattatagattaattaggcttaaaaaattcgtctcgcggattagctctcatttatgaaattagtttttttattagtctatgtttaatactccaaattagcatccaaacatccaatgtgatagggactaaacagttttagccccatctaaacaacctcctagattattgagtggctaacagctagcaaataactaatcttaatccaatttattgtaatctgacttaataatctatattataataattttaagctgaaacaaatcgagcccgagttctacagtatcaactcacgtatatgacatgctccttccacaaccaaagaatcaaagcccggcctaaaggaagtagataagcaaaatgtcttgctcttatcgtttccccttcagtttaagcagccgtgaaaatttaaattttaagacttaattttagagttattttggtattgttgtatcatagtttatttctcatcatttgcctttaaatcgtaaggatatgtatacaaattttatttacaaattatttattaatcactcataagccgttcagcttataacaagtataatctaaatgacaaggcggaagtctgtcctgttccactacacatctaccatcacatcacatgggggaggatgtatttggggggctcgttggcaccagaggagctggctcgccagcatcggaagcggcaggctcaccctggcacggtggcatcgacaggttgagaacctagcgtaggctttgtttgataaatgagataagaaaataatatcctacttttcaaagggtaatattgtatcataattatgtatttttcacacctcatttaatcctagctatttatctattttcttttttcaatttcacctctcataacctatttgccaaacacatgcttttccatgcgttgcactaaacgtagattaccattttttttccttgaagagtggactgaattttgaacagatcggtggactgaattttgaacagatcggtggactgtattgagtaactatctggttatctattgatatgggtagcggttattccgaaaccacggtgagaactgacgctactggagaaaccatctttggtcggtcggccaaatttcacaatagtcaaagttctattaaaaaccgggactaaaaaaatatctttagtcctagtttaaaagcttaggggtactttttgatctttagtcccggttgatgttattaactgagactaaagatcatttttaattccaattaaaaaagggtaggcagtgtcagacccctatattttctttagtctcggttggtaacaccaaccgggaaaaaagatcggcatacacggagatcgaggcgtgcgcgcggatcggatcgagattcctcctccctcccggttctatctcctcctcctctcctcactcatgctatctcttcctctccttctccccctccccccttatccccacttctcccacttctctgcacgcggcggcggcacgcggtggcggctagcggcc

SEQ ID NO: 59849 - DNA, 9703 bp, Oryza sativa
ccgggcgcggccggcggaaggcggcggtctgcgcggcggtatggccgcacggtaggtggcggcctcgtgcgtcgggggcgcacggcggagggccgggtgcccggcgcgacggcggctggcggctggcggcctcgcgacggcgaagcggcggccggcgcgacaggtggcggcctcacgcggcggcggctggcgcggcagtgggcggcacggcggctgctggatttgggttaattttttttgagaatttttgattcggatctgatatgtatttgatttgatttgtgtgtgacgtgaatatgtgatgtatttgtgatgaatttcgtagaacttgtgatgtaatttcttttttaagattttgtgatgtatttagagatgatcgatttgaggatttggaggagataatcgatttgggatttcatgattcggggatgggggatgaagtgaaatcaatatattaaaaacaataaaaaaataaaggagcaaccgtggcctaccctggctccatctttggtcgcggtttgtgttaccaatcgggactaaaaaggcttcatctttagtccaaccgggacttaaaatggatttttactcccggttatttcacccgggactaaaaatagcgatctttaatcccggattagtagtcccggttggaaaaccgggactacagggggttaccaaccgggagttaaaacgatttctccaccagtgtgaaggacggtaaaatatgtgttcctaatcactctattgtgagatagctcctgcgcacattcctgaactacttataccgtgtgattttctccactattataaaaattaaagatatttttgccaatcctttcgtacatcgcgctgtgcttgatacatagtattttcttcgctatgtttctgccgaattttttcatccatcacctccgtgatcgattcggtctcatacctaggtcacacgaagagcttcacttgatatgctcacagttctagtttgcccgatctttcggtaagttgatgataactacgatttgagagaaacgttgatgatgcgactacaaccgtacgagacagtgttgtgttgtaccttagcgatcgatacacctctgcataggttattgatctttctggtgcaaattatccttattcctacaagcaaatagaagaaacaagtaaaaataagataaaaacaatatgatattacaaataggaattgactacaaatggtaaattggggttctcgaagacaagtaattacacggtctagccgacacgcgtaagtacgtagcaatgtctaaactttaatctaaacaaaattcgagaaaccctaaaggggtacctaactatttaaggagatgggagaatgacctagggcctttaggatcatgctccactaggatggggcgccagatgaagttacaatcccataagtccattataggtgatgcaacattttgtttatgtgattgcggtcaaccgagatggaatttcgagatgaagttggaaccgttggaaagaagactccgagagctttccattaagtactcatggacccaaaacatatctcgtatgcatatttggtgaccgtttgacgtcagcactgctgctagtggctgaattggatttcataacttgatcttaatgtctcccagttaagttatgatataaacaatggttatatcaatagtagccatggtcacatattgctccttccttaaccggctcggccttcattcagctcatcgccaccaattgggcttgcttctctagctaggccacttactatctcactggtcatgccccatggggccaccttggctggatagccctggcgctctgaagcatgcagtttcctcgtgaaaaagaaaattcacggtgacatctataattttaattcgatctcctctcctctttataattttcttgttgcgatttgtaggactcatgcatatattgacttacatactcatacatcaattctttcatgcaatgcacgtgtgccacgtctctgctctttacatacccaatccttgctgtattgatcaatgttagcttcgaatctctacacaaatagaacaaataaccatagtaagaaaagttttttcgttacaagacctgatgaggacatcccagctacacttgacgtaaacaagggtgatggtttacgtcatacatcacatgaagaaaatgaagatgacgtaaaccaagttgatggatcacatctccgcaagaacgatcaagcatatcatggtccaatcatgcgcagctgtactaggataatacaacaagagttgaactcgctctttgctcaacttaacccaaattttagtgagaattttatactacctaaatgctctatctttgtattaccaaggtttacgcccaaggacatcatcactatgccaagaaggatgagttacgttgaggacgacaagggtaacatcgaggaggaatcaacccatgcccaaccagcagctgtttacgccaacaagaagatggtttatggtgcaaaggctcaaatttcaaggcttgtacgacccagccagtcgagagaccgggtgcatggcatacatggttggaaagagggaaaagtctagtttccaatgcatcaaatatcacctcaatatcattttccaataagaatttatgccatttttactgaagaccgcgcaggagctgaagggctgtgcacgaacccaagaaaactctttgcattctcatttatgttagccttgatgaccagaacgtgtcttcttatgttcacactcagttaggagggatgttcctagtataaatactcctctactccatccattagacaacttttgttcaactgaaaatctcatatataagagattgctgaagattgcataaatgccttacccctttgttcttgtgagttcttttggacttgtaagaaggctcctctggtgccccctagtttgtgctctacggcttccagttcagcttgcaccgtattgtgtggattagtcccggattgcggttctatgattgctcaatttgacaagtcggagtccaagaggcttcggatcgtgctcaccctcaccacttggtcgcatccaaccttggcaggtttaaagctagttatttcggatcgtggttctgtgattgctcagtgtgacgggtcggaatccaggaggcttcagatcgttctcaccctcaccacttggtcgtatccgaccttggcaggtataaagctagttatcttcttgctgctcacagctagttaccctcttgtgtttcggtttacactggcactctctatcttgaacctactgccgtgaagatcaagccacccctcgcgagtgtgttcgcatcaagacccatgttattcaatacaagcgcacacactattgtatgaaagaatctatttcgtaactagtactacagatttggttttcccatgtggccaaaatcaatttttgcttgcggacggatagcctgcatgcatccaaacgtatgttaaagatgatttgtgcatgcggacggcgcaaccgcatgccaatgatctgattttcgcatgtgggcgcttaagccgaccgcatgcggaaacaaaaaaaatcacgaaaaaaataaaattccagaaaaaaagccccaccatggctcgagctcgccgcagccgccaccgatgttcctgtcgtcagtcgaatccatggctgacatatccaccatcccgcaaccttcggccactgggatagaagaagacgagggagagagagtgaggagaggcggtgaggtttgtggggttggaggccgagcccgtcgacaccggatctggacctcccgagggcggcgctacccgatccactgccctcgctgcccgccgtcgctgcctatcgtcaccacaactgcaaccggttccgagggcggcgccaccggatccgccgccagccatcgcggtcgctccctaccgccacccgcctcctcgtcagcgtccactcatgcttggagatgaagagagagagagagtgagaggagagagtgagagaggagactaggggagagaatgagagagagagaggagagaataataagaggagaggaagagagagagaggggatagagaatgagagagagagaggagagaataataagaggagaggaagagagagaggggataggagttgaaaaaaaatttgaattggtgagagggaaaggacagtggaggggagaaaaaaaatctatgtataagaggggtatttttgcatgcggaccacttaagaggcccacttgcgaaaatgctccttaagatgcccggctgcgaaaatagactcatttttgcatacctgcgaaaatagtttttgcttgcgctcctcttaaggaacggtatgggaaaatggatggttgatttttgtagatgcgattagttacggtcatcttgttgatgatggtttgtcttttgcaatatgctgatgataccatcatctttttggagcatgacttgcaacaggcaaagaatctgaaattgactttacctgtatttgaaaagttatctagcttaaaaataaatttttacaagagtaaattattttgttttggtcaggcgaaggaatgttatgatcaatattctaatatctttggctgtctgataggttcttttcctattaaatatctaggaattccaatgcattttaggaagctttctaataaagattggaaagttattgaagaaagaattgagaaaaaaagtttaatagttggaaaggcaagcatatgtctattggtggtagattggttttgattaatgctgtacttttgagtttagccatgtttatgattttttttagataccgaaaggggttcttcgaaaaattgattattatacatcgtggttcttttggcaagggatgatcataagaaaaagtattgactcactaggactaggtgggatattgtttgccaacccaatgacccggggggtcttgggatacataatttggaaatacataataaatgtcttttaagtaaatggttgattaagctaattaatgaggaatgagtttggcaagacttattgaagataaaatatctttataatgagtctataacccaagttggcaagaaacggtaactcccatttttggttggacctatgaatgtaaaaagtactttcttaaatatggattcttggattgtcaacaatgggaaataaattagattttgagaagataaatggttaggcaacttggccttcaaggataaatatccatctttatacgctattgtccgaaggaaatcgttttctattgccactgtcatgggttctgttctgcttaatgcttcttttagaagatctttagttggtcagaatcttgtttattggcatgagtcgtgtgcttctattgtacatatctagttgaatatttcttctgatatctttagatggaattttcatcagaatggtatgttctcggtaaggccaatgtacctagctttaatcaataatggctgtatcgagaggaataggtgcatttggaagcttaagatgccacttaagattaagatattcatgtgttacttgcttaaaggggttgtgttaactaaggataatttggcgaggcggaattggaatggcagcttgaggtgctgttttttaatgaaaaatgagtctattcaacatcttttatagattgttattttgcgtagttcatatagagagcagttcagttctcttttggttttaacctctctactaatatgtcatattttttatgcatggcttttagtaatgaactgaacaacatgtacaaatgatgctaactttccttcacaattctcgactatacacacaaggtctcatagttcagttggtgatggacacatagcgatagtagcttgtgtcaatgacgaattctttcacatttagaccaagattcggtcaaacttttaagttatcaccagtgacctgttgttgtgttttaaagtaagtattccagaaattacagatggatagaatcttaaaaatttgactcagtcatatcgtatataaaatttcaaatatttgtattcacccgttgtaatgcacgggcatttagctagttagaaaaatttctaaagttaagatgctttaagaatcatattaattcagttgcacaagtttaaaataattaatactcaattaattatagctagtggctcatctcgttttaggtatcttctcaatcttctctaatctttttctctcaaacatagccttaggctgagtttgtttctctcctttcacaacttctactccctcgttttttacgcacacgcttcctggactgttaaatggattgttttacggttctgctaaatttgtggcgccacaattttaccttgatttcagtcgattctttgaccgacacgattgacgccgagattcgtgctcttgtacataaccaccagaaatacgataacttcaccgagcagatgtgttacattgggtactgctacatgctcgtacacagttgcacattggtcaaagtaagagaccgtataaatgagaacacgtaacgagagagggataaaatagttagtgttatataattactccctacttacactataattacatactatttacatatgtaattttagaacttacatatgtaattttgagacttacaatgtaaatacattaaaattacatatgtaattttagggacttacaatggaaatacattctgactattttttgatgaaaaatatggcgccatatagatacatagtgccttgtttattgcaaaaattttctatgtgaaggttgtttggaaaaaaatcatattaatatattttcaagatttttttagctaatacttaattagtcacgctttaatgagtcaccatgttctctgtacgaagggagagaagttcccaacacgtactaccgaacacgtctctagttaccccagttttgcattcatcaaagtagtactccattcgtttcatattataagttgactttttttagttaaatatttttaaatttgactaagtttatagaaaaatataacaatattttaatacaaaatagacatattatcaaaatatattaaaatttagttgtaacaaaactaatttggtattttaaatgttgctatttttttaataaacttagttaaacttacaaaaagttgagtaagaaaaagtttaaagctacttataatatgaaacagatggagcagttgctaagtcaattaaattgtcttgtagatgattgaagtaggagaaaataaaggtaccagagagagtttagaaacctagctatgactgtgaaggtcaaaagaagctagagagcaaagcagtagcacgacatgtggagactagagaaggaagatcacgtgaaaataagaagagttaagtaaaggaaagcttttgcatcaatatgtctggatgagctacataataaatacaatgtcgttaatccttttgctgaagaaaagttaatagaggattgatcttccttttgctgccttttggcacgtttcatcgttgatacttgtagtcgtagagcacgaataaaaagcatgatgaaatgtgggcaagcgttggccataaactttctaaacccttgaagttcaaacaagaaaaaaaatgagcttattctctactattattcgtggaaggattttttgaagttccaagatcaaaatttcaactgataattaattaaatgatgactagaatgtatgttgctaaaggacttttgggagcccttcctactacctctatgtacgtactccatatgaaagcactgcatgtgtctctctttccttctcatatattaaccatcttattgtcaaacattaaactatttttttcttaaattattattcgatttacgatcgattactccgttatatttgattatatactgatcacagaaaaaatgtgtttcaaccgttaaaatttaatgtttcatatgtgatagcaaaatatttcagcatatatttcactgtgtttaaaaaaataatgtttcaattgcttttttttaccatgtacgaattaacgtttcacctgtggttaactgaaccagcctttttttttgggaaattatgtgtatttgtagtagcctccggatttttcttgcatactttcagatgattaaggaaattgtactttacatgtacaaccccttttaattggtagtacttgtagagctttgacatccttcttctgctctccctagctactactactgatctatatccctcctgaaatcttgctaatgcttggttgtatattgtgtatctcaactgcttctgagacagttttttaaacctccggttgttttcttctacttcagtcatgtacaaattaaagatgtctatcaaaataaagatttttatatgatatttgcttaaaggggtagtgttaaccaaatataatttaataaaaggaattagaataatagtagtacaaagtgttgcttttgtttgcatgaagagactgtccaatatctattatttgaaagccatgttgctaaatttgtttggagaatcgtctttatttctcttgggttgaaaaagagtaatctctgtgtacccctgaaaactcactcaatttttttcatatccctgaaatttacccgatcccttctatgcccctgaaatttcaacttgatcccttccatgcccctatcgttacatttaccttcatttcactattatattatattatattatgtttggttgcaaatatcttttttgctcttgatgctctaggtttgaatataagcttaaaaaatgattgaaaattttgtttaagtgcacaatatgtgcattttatgaaactaatgagactaattataattagtgcagaaaattttgacataaatttacaaaataaaacaaatgtaataaattaaattttttatttgaaattttaataggacaatggatatttttgattgggagtattcataaaaaaattattgtgagcattggtagtcctatctttgtatgaatgctcatcatttttatgacgtttttaaaaaataaatacattttttatttctttatctaaaaaataattttatgataaataatgcagcgcacaacaaactgataactataataatctcctacgacaaacttttacatttttaataatgcaattcatgaatttctatgttcatccaaagggtaaatggtcatttttatagaaattagacggtcaactaacggtcaacagatgtgatggatatggaagggatcaaaactcaaattttggaggtatacaagaaagtaagcaaaattcaggggcatagaaggtattagcttaaatttcaggggtatagaagtgattttctcttgcaaaaaccacataatttttctcaaatgtttggggattggctgatagtcatgaattttaaagctaagaaatttatttggcaaaatttgctacaggacactcaaaagttatgtaattagctgggggacacccgaaaaacgtgaatttgcctgaggacactctaaaagtgtggtaatttgccacaggacactgggcgcattaaaatataatatccactgaattgatgagagagaaaccgcgtaaaatgacagttttgccccttcttttcttccccttccgcttggcgcttccattgacggcacgcccgccgccgccaccgccaccagcgcaagcaccaacaccacccgcggctccatcctgcgccgcaccgtcgccgtctccgccgccggcgaggcaagccacc

SEQ ID NO: 59850 - DNA, 26144 bp, Oryza sativa
cgggcgtgccgtcgatggaagcgccgagcggaaggggaagaagagaaggggcaaaactgtcattttacgcggtttctctctcatcaattcagtggatattatattttaatgtgcccagtgtcctgtggcaaattaccacacttttagagtgtcctcaggcaaattcacgcctttcgggtgtcccccagccaattacacaatttctaggtgtcccagggcaaattttgccaatatattttgatatattttgatagaagcatctactctatattggatagaaatgatatggtttttgataagactccaaataaatcttatgtacaggtattatttagagcaacttattggctttggttctggggccagctttcactactacaaaatcgatatgcataagtacctctttcgcgtctgtgaaaatcatcctccattttcgtgtgcagcttcttgagaggaccgcatggaaaaatcgatttccgtgcgggccttttaagtggaccgcactccaaaatgagcctattttcgcaggcagagctcttaagtggaccacacgcaaaaatacctctctcttttttccctctcactcgctcgcttcaaatttttcacctcatctctcttcctttccttttattttcgctcccctctctctctttctctcctttcctctcctctcctccgatcgggcaggcgggctggcgcggtggccggtgggcggtggggaggcgtggcggcggcggatccggcgacggtgacgggagagggtagacccggcgacggtgacaggagcgggtagacccggcgacagcgaagacgaggatgacagcgaccactagggcggcagcggcggcttcttgggttagggttttttattttttggatttatttttttccttttttatttttgcgtgcgggcgacataagcacccgcacgtgaaaattagatttttcgcgtgcgggtgtgccaccagcatgaaaaatagcgattttcgcagaccatttggcgcgtgcgggttgccatgccgcacgcgaaaacctcttttggactgcacggcagaatggttttcgtagtagtgtttaaaggtgtaaagagtaaatggaagtcatatgtgccgcatgccagaatttagagtcattagtcatgctagttttcgttaacttatggatgaagatttagtaatagacttgaactttgaataagttgctatttttctttggctggtgtggttgtgtctgcttttcatcttccttttttttatttttgttgtatttgggcttcgtgctaataacttagtaataagtggctgtagcttcaattgaagcaaagcccgggtttaatatctattattaaaaaagcaagattatttaagtgactcgattgttaactatatattagatgaatggaaactgaaactgagataacaactgagtgattagtgtagagtaccatacatacactactggaaaaccgatctttcctcggtcgccccaaaaccacaatagtcgcggttataaaaagaacccggactacagatgatttttagtcccggtttaaaaccccatagccattctacgatctttagtcccagttggtaacaccaaccgggactaaagatcatctttagtcccggttcatcccctgtcagtcccttgtcagaggggcgaggatctttagtcccggttggtgtcacaaaccagactaaagatcaccactttagtcccggttggtattaccaaccgggactaaaatcacgcgtagtagtatataatccctattacctattctctcccccactaccggcctcaatctcctcaacaaccggcctctcctctcgtcagatccatctccctctcctcctccccttcctccccttcctcctcccatcccggccctctctcctccccctcctcccttcccatccgatgcccagcgagggccgcctcctccccctcctcccttcccgcacgcatcaggcagggccgcgcccggcggggccgcacgcaggccgagtagcgaacggcggcaagcggcgctaccgcatccattcttttttttttttttacaatttgtgattcacttagatgtataattttgtgatttattgtatggatctgagatgtataatatgtgatgcatttggtttgtgtgtaatttttttaagatttgtgatgtatttgatttgtgtgtacaggtaatttaagatttgtgatgtgaatgttttggatgttactttgatttggggtttgatttgggaatatgcatcccacttgatttgggagaaaatatagggattaaactctggctaaaaaataatgaaaaaaaaagaaaaggagacctaatgagactgccgctaccctctctttagtcccggttggtgttaccaaccgagactaaagatcatctctagtcccggttatttcatccgggactaaagatagtggtgatctttagtcccggattcgtagttccggttggataaccgggactaaaggggggttacgaaccgggagtataaaggatttctccaccagtgatatttcatggtccttcagttatcaccgtcatctcagaaattaccacaacccggaatcaataaagagtaaatttcacgaaactacagatacttgtgtcaaattattacaaaactacagatttaagaatgtatatcacaaaactacagatttagtgttaaacttttcatggaactatagatttaatgcaccatatcataaaactacagatttagtgattaagttattaaagaactacatattctagagtttagatcatagcactattatttatttaaagttataaaatttgtagttttgtgataaaaaatagtttttaaatgtgtagttttgtaataaaatagttgttaaatcaatagttttgtgatataataccttaaatctgtagttccataataaatttaactctaaatctgtagttttgtagttttgtgaaatacattcttaaatctgtagttttgtgataatttgatcaaagtatctatagttttgtgaaatttactcatcaataaatcaccggaattgtaggtagtccacgcgtatgttcaacatattctgttcaatcttcataaaagaacacgtaaccaacaaagtcccaactcatggaaaccaatccttacgtacgtgagtatgtgagatggctgttctctgccatcctttaagtcacacacgcatgtttttctcatagacacctaataaaaatacggttataaaaagaacacctaacaaaaagagcacacgtctgggcaaagaagaaacaagtctttgcggcacacgtgtgatcaattagatccatatggatacaatattttttccgagcgagaaccgtatcactatacacgcagctgtattttggccacgaatatccgcttgcgtagtcctgcttaagccttactacttcttacttttagatgtgtgcaataatgactcagctaacaaccacctggccagttgtcgagtaggaatcctaattagcgtgctcgtgttagggagagaagtcgtgtgcggttcccggccgcgcggtgataagttagggttaatggtttttgggcagggtcgggggagggtggcaccaggagggggaatgggggatcgggtttaaagggatagcctgagaggtggtggactaacggtgggtggcatacaagggcaagcgacgaggcggcggaggtgtcatcagtgccgtggtgtcggtagcaggcggtgggtctcgtgatggtggcggagtgataacaatccggtccaggtggagttggccgaggcctaacaaattaaagttgtccggactccaacagttcttaggtacacccattcggggaaaggcccaatcggagaccctaacagttcttaggcacacccactagggggcctagctctgataccaaatgatacatccggcctaggtggggttggtcgaggcccaacaaattaaggttgcgttgcccggcacacccactagggggcccagctatggtaccaaatgatacatccggcctaggtggggttggtcgaggcccaacaaattaaggttgcattgcccggaccccaacagttcttaggcacacccactcggggaaaggcccaatctctctaaaagactggtccaataggggaagggtggatctcccttttaaggtggcttcctcctcccaaactaagcaaggtgggattattcagaggcacacatggtccccgcccgtctataactggaccacttggcccttgttgcgtctttcccaacgggtaatagtggaggatgtccttatcacggagacaaagcgatgcaaatgggagagggaggaggtcgcctggcggggctgcgctgacaagttgacacctttctatgctggcgaggttggggcagtggcacgatggagtggaggggaagcgggtgttgcgggtggcggtatggaaagaacttacctattaccagagggaggaggcggggactcgctagagagcctctagccggcgctagtgctctactcgcgtcatcgttgccggagtgaggaggggctcgctagagggaggaggtgcgggctcgttggtgccgtcgtcattatcgccgctttgctcactttgactcgcgtctaggatgagagaaacatataagggagggagagatagagagagagaggagcggtccatgcgtgccacgtggagatagaggacaacaagggtggacgcgcgcaacttcgcctccttgcacgtacacgagatagcagccccaaggtggtgagagcggcgttggattagctgttcaattatagcgagtgtgcgtggcagcattccatatatgtgggatggatgggcggctggcctgctattgatttgggcttaaattgttgactaaacttcccatacggtattctttactggagctagctaactatatttatgagaggattgcgataaaaacaattgattaccttcttggaacctgagagaggcagaaacgtagagaagtaccaattacatacgaaaatttgattaaaacaaagcaaaaatatatgccgccacaaattttagcaaaacaaccctttctttggtttacatacaatagaatctggatcgaatcctgaacaccaaattacaaaaagatggagcatcaaattagaaaaaaatattttatttggttttaatgaaatttgtatctgctacctaattggacttggtgagcaggctaggaggtaagttcttttgggtgaggtgcgtaagagtccaaatagggccacaacacgttttacatgaacatccatataccaatgacgaagaatgaaagaaccacctatatcgtccaaaggggtttttaaagtccttttcttgttttgtgtggatgtgtgcgttgacgtgagggtagtagcaggtactaatctaggggtaaggttggtaagaaccgatgtccgatgcaccgcttcaaaccgtgacagtggagggtatgattaaatgttggaggaggtgggaacgtcgaatgtggtgctagagaaggtggaggtggcagaggtggcatacctaacgccctgggagtcggcgagggtagatgtggatcaagcatcgtaggaagctagaacgactgaggcatcacaaatgttattgagatgggtcggcgcggggcaaaaacctttatgggcagggcacccacaggaataccggatgccttgggtgcggtaggcggctgtgaagacctcacgagcaactcgcttattccatctactctccagctagctcctctactaatgagatcctccatcccctcgccttttggcgtcaaaccaatgaagagagagataggacagggaagagatattttacatgaaaaattacctatttacccttaaagctccataaactgttattcagcacgtgatttataccacgggtataataatttctctcagattatcggtatcgtcaagtaccaaggtacctcaaggatgggaaaatagctatcgtccaaaaggaaagctgccttgcgtgcgtatggtaggaaagggaaagcgtttgcttgcagggcatggtgattgctatgttggcagaagaaataaagattaaagcaaacaagaagtttatatactggagttgcggatttccctatcatgcaagtttttttttttaatttttttgtcaagctagagtcatgcaagttttggatacatgtagtgtaaccaacagagagaaaaacgaaaaaggccactaatgaagagcagaagaagaaatgttgatagtacttttgggtatcgattacgacagaattagcccacgtgacagggcataattaatatatacctaccaaagcagtaacttcagcctctaattgaatatcacaccaaaaatcaagccctgaatcgggtacacctttttaattttttgtgctggaaaaaacacgtgtcttttgatccatcatgtacacgaaaaactaattaatgaaactccttctatccttctaaccatcaaggaaaaacacacacagctcctatatataaggctacaagagatcgtggctgtaggtcgagcaaagccgaaattttattaagtgcacgagtcgacggtgtccgaaagagacagatctagctagttcacaactcttgagcaatctagctagttcatgcacgtaacgttagcaccaccggccggccggatcgatcaggttgtagggattacggcggcgatcgatggacatcgtcggcgcgggcacttcgccggcagcgaggtggaaggcaccggcgtccatggtgttggtgcagctcttcaactcggggatgattctgctatcgaaggtgtccatcaacggtggcatgttcgtgttcgcgctgctctcgtaccgcagcgtattcggtgccatcttcatccttccctttgcactcatcttcgagcggtatgttttagtttttttaattgttcttagctacaaccggttaaatttatgcttaacaacaagctcttatgaaacatatctgaaaatctaatatttggaccacgcaacaataaatggccaaacaatgacgtacggaaaaaaagtggatttgaaaatatgttttgctgggtttaattgtaaattaatttagtaaaaatatttgaataataaaatatcttccaatttatgggtttttagatgaaatgtatgggtatatatttgtgggcatactcttttttacttaaaaaaaagtgtttttttattatcaataaaaaatttaataagctgtaaatcgatggactcattgacaacaccacatgtaaaacttgtgactgaatggatgatcatgtgtcgatcttgtaagaggaaaatgcattgtaaaatcgggtgtcatgatgaaaatataatctgcttttgctaatttggttttgtgtatatctttcaaaaatatttcgttttgggtagaggcaagtggagggacattgattggagcgcaaccggatggattttttttaatgcgttcatcgggtacgtgtttctctgaagcttcaaatgcagtaaagtactgcctacaattaaacttatgattattgcattatagaattttttgattcgatcgacaatacgtacatgaaatttccatatttgtacatgtctctaacctgcatatatttaattaccttcgtatcattttacccaaaaaaagtgcagatgatttcaaacttacaattatactaacagatatttcatcgtgtttaattatggtatatggtatttgtatagcgctagtttttaagctgcagtaaatacattaccctagtagaaaattaagaagaacttcagaaagcttgattttataaattaaaattgttgaaaatataccggcattgtcacaaagtatttatacatcaataaagttcacttcattctaaaaatctcgtattaaaaactggcaattctatacccaaaactaaataatcactgattgatattggccgaacaattgcaatctaaaatccttcctctattctaaaataagttggttattagtatttataatttatcccaaaataagttgattcttaccattgtatccttaaatatctcttttatatacaccaactagtattagttttctattaatgggaggtattttagtctttttcgctcgcgatgtcttggatgcgaggaattcattaattttgagacaatgagtttacattagtgagccaagctttgacaaggacggccaaattaatgatctgattccgagcaaaaaaattcttgatcaaattggtgcaagaggggatatttcatgaaattaatttgatcaaataacacaaaagcatttcgctaaatcatttgatatgccaatttgctttttatactttctgtatctctattacatttgtaaaaaatatttcaccattctgcttagggaatcttttcaggctattagccaaaaaatggcctatttataacaaaatcaaagttttcacttcatttgtatttgcttatactccctccgtcccaaaatataagtatttttagactctgacacggtctccgagatgccactttgacgaacaatatctataaaagtaaggtgttttaaataaaaagtgttgcatattatgataatttgttgaatgataaatctagtaacatcaattttatatgattgatcttttttatatttttgctattaatagtcaaagtttagaatgtttgacttgtcactaaactaaaaatgcttatattttgggatggagggagtaattttttgtgggtcgagtgcatcttagttatgtacggtctagaaactgatttaaagatggttgtatccaattatcttgatttcagtaaaaagctcgccagtcatgtttttctttcattcatagatacaaatgggtgtgtttgcaagagcaagttcccaacactcatctctcgttttccacgcacacgcttttcaaacggctaaatggtgtgttttttgcaaaatgtttcgtgtttaaaaaatcatattgatatatttttgaaaaaaaagtaatacttaattaatcacgcgctaatggaccgtttcgttttccatgcatgggaaatggttcccaacacccacctccgaacacggcggctgtgttcttaccccacgtttcccagcctttctccctcgttttccacgcgcacacttttcaaactataaaatagtgtgtttttagtttctatatgaaagttgcttaaaaaaatcatattgatccattttgaaaatctttttaagctaatacttaattaatcaggcactaatggaccgttccattttccgtgcgcttccggttgggaactccatccagcgaacacagccaacccctctgtacgaaacggctctctcgcgaacgtgcgccaacttttgatctggcgaatgtgtcggcccgcattctttcccttttttatttgtttccctttccttttttgttgcgtgggtcgtttgctctcggaggcttttctatccacttcgctaggcgagaaggcgaatctgtcggagtgaggaggacgaaagacgcacgacgtacggagaaggggagcagggggagcgatattgttctttcctttccaattttcagttttcttcttttacgtgatccattttctttttcttttttttttcactaccgtttttctttttcagatttctatttttgttaattatttttattgtttctttaacagaaacatttttatatgaattatttcatgaaaactttctacatatacatatagattttatgtatgtaaagtttttatatgtagattttatatatgtaaagtttctatatgtagactttatgtatgtaaagtttttatatgtagactttatatatgtaaactttctatatgtagattttatatatataaactttatatataatttatatctctgtaattagaaagtttagtgtatcaattttaatagaaatagaaaaatgctgatcatcaccggatatttttcttttaaaaaaagagtacaatccaaacaaaacaaacgttgtaccaagaaaacataaagcatgcgtatacttcgtattttaaccgaagaaacaaactaccggctcgttagtcattactaatcacgattaagcatgtaatttggcatgtaattagccatgaggaagaagagatgaaacggcagtcggaacattcgtgcgatactactagatgctaatcacgtgcatgcatatatatgcagcggagaagcgataagagtccgttcgcttgtcgcgaacgctcgcgaatcagactcacccgaaaattaatgcattttgtatcatcttgcaagaaaccgataccataatgaaatacattacatattgtttcgtacagtacacactctacgtactcgtccatgtatagaaactaattggactgcgatgagttcccacgataattaaagaagaaaaatatcaattgggatgggactgaaatataatattttggattaaaagtagaagagttcacattgggcacaacttttgtaaaactaattttgaatttaaaactgttaaatcaagaagaaactaataaaattaagacatgaagataaatatctatcggtacttttcatttaagattttcaaaattatttgatagaaaaaaatggttatatgttgagaaaagcaattttactgtactaacaactgaatcaaaaataaatttactgaccaaccaaatatatgccaaattaaactctgagattatatatatcttattttcttttttctatgaaggaggtgggtttctgttgttccgaactaaaaaaaaataaccaccaagatatgttgtagcattaaagaacgtgacgatagcaatagtagtgcaacttgtatttcgcttgcatgtacatacgaaaagtatacgtaacaaaaggctgcgagcctatctctctttgttagaacaaggtttaatattttataatttattttaatttccatcttcaatattttttatatctatctctcctttcctagtctgttggacttgagattgccctttgctatttacttctacgtgcataggtagccttttgcacatccggtacatttttttttaacaaagattaagttttaaaccagattgatggcactcttgatttaatatgctctgataattctctcaaaatagtttgggcaaaacatagaaaatttaactacacatatattaactctaaaatgttctgactatatgtacatcttcttattttcatgttcgtattacttgcaagagagaattcattctatgctactgagtttaatttagttcaacgatttgtaatcgttattgattttgtctcactctataatatgctactaactttgtcaattttttctacaatatgctatttatttggttggatactttttaaaaaatgcctataaaatatccttcaaaacttactagagttgataattgattgatctactggaagtttcaaaaacatatgaaattttttatatagccaccttatataatatagaagtgtgtatatttgaagaatttcattttgcatgcattaactttttatgaaaatataatttatgttatatatcctataggatactcttatgttaatgctctttcatgtaaatcatcattcatgtgctatatagttattttttttatgcggctatctttcatgtatgtgattcctcttttatatgctacacaaaaatagtttttttaaaaaaaccatgaaaaaaacccttgaaatatacaaacaaacatctacattttataagaatgcaatgtaaaaaaaatactttcatattttatttgaaacatctcgtgggtcaatcaattgccaactctggtatgacttgaagggcattttatgtattttttgaaaagtatccatctcaatggtatattgtaggaaaaaatgataaagtcagtagtatattccagagggagacagccgatgacaaatcgtcgaactagagtacatttagtgccatataatagaaagcataacaagttaagttaatgtatatatgtactaaagcaattaatttgttaaaaggatctgttgagcaaagtggcaaactccagttatatatgtccttgaacaacaaaaatgagctgataagtcggtcatgaactatacgctagaaggatctgctgcacaaagttcggtcaaatgcttgaccagaaacaatgaactcgtgataagtccaactactatataactgtaagttagtatttttttttttgcataatgaaaaaatagttccaaactttgctgaaaaaaagttataaatcaattaatacaaagtttgtagtaaaatgactgcaaattaaaaacacaatttgatgaaagaaaagagaactaactggaacatcagcctaaagacagacataacaacctattgagtaaacttccatctctaattggtatagttgtatgtaaaccacatacggttattgcccttctcaaacctttgcatataataagatgtatagtgagtgatgcatattggtttgaaggtaagatgcaagtatacaatcatacaacttgcttgctcatggctaccgtgataaagaaacttagcctccaataagatattaattgctgatggcagtatcaattcggtgaaaacctaattagtaatcaatttcttgatgaacaaatattactaatcatccgaggcatattacattaagcttttctttactgtatgccaaattatgcagatatgccgtaccaatgagcctctactactatggcctcaaggataccacaccatcctactccgtcatctttacaaacataattcccttattcacctttgttctttcacttgtgtttaggtaaatgttccattcacaatatttgttgtgtacaatatatatacatggcaataactatgggttccaacaataattattccatggcatgagaaaaaaaaggccatataggtaaaacttaaattgtgttgcaactatgttccatctcaccgaaacatggatatgtatgaacatgatagactagagacattcaaattaagaagcaaggctggcctactgaagatagtgggtgttctggtctctgttggaggcacaatgcttgtcagcctttacaaggggaagtcactgcatctctggaattccatcttgcagcaccaaaaggaacaacaaacgaagtctgcaaccaatcagctaagagggacaattttcttggcaggcagcagcctcacctttgcttgctggtaccttgttcaggtaatcatatataagcattgtttctaacaagtacatacatatcagagtaaattctttttctttttttaataattataggttgtgtggatcatcttgttgtaattgtttgagatcaataaagcttcatttgtctaaaaaatcagagtatattaactttatctagaccatgtcatcttataactgttgtggcagtcaaaggttctcaaagtgtacccgtataaatattggtcttccatggtgacatgcttggtcggaggatttcagacagcatttgttggaatcatattaaggagagacaagaatgcttggatgctaggatgggatctcaaccttgttactgtagtgtactcggtatgccttcgaactttcttaagcattgaaattaactgaacagaaagctacacaaagaattatctttctacaaaattattgttcctatatttcgtagtatccactgaagcttatattcagaaatatgtttgtaaaaaacattctgttatgtgttttcacgatggtccactgaagcttgaattgtattactcaacaatccaggatttataagatgattttagagcaatgatgacgaattttcaggaagtgtaatgaacctaattaactgctgtgatgaaattgacatgaaactattttggtgcagggggcacttgcaacagctggaaaatatagcctaaattcatgggcagttgctaagcgaggcccagcatatcctccaatgtttaacccactatcagtcatcttcactgttgtttttgactctatccttatgggcgatgatcttacagtaggaaggtcagtagccttctttggtgtctatgatgcatgttcagtgttaccaatcaaaatggattatgccagttcatgtgccaaatgcttccctatgccaaaaactaattgacactcattttttgcacagcaaaaaaaaagaagcaaactttgtaaattgtctattattattgtgcataatcatcaatgaacaacaacaaaaggaggaactgaataagttggtaatgtgatatgtcaacatgagcttgttctttttttattacaaaagataaaagtacaacatggatgacatagaataagagatttgctccggttcaaaaaaagtacctcgaagtatccgtacctcacggtaccaaattatttccggttgttgattttaaaatgcccatcgtgcgcagctagatccaatgatcaaaaacgatttggtatcgtaaggtatcggtacctcgaggtactttttgctagactggagcaaatctccatagaataaatttcagaaataggttacagagaaccacaaaagttttagcacttggcatataagcacaataattatggtactccctctgtcctaaaatataataacttttagtacttaggatttgccccaaaatataacaacttctccaccaacattccctttccaaccaatcataaccctccactattcaccttttccacctacctccacttctcaaccaataacaacccctgcctatttaattctacctactttcttaataaccgtgtccaactctaaaactctctatattctgggacagagggagtactaaagttttacgaagtcaggatcctacaacaatcaagctatatattattagactccgcttggcattgaagtggattacgataatcacgtttgccgcaataactttaggatattttggtgtttgataaattatttttcttatactttgtgtttgcatctgcgaatattgttatggtctaaaactatcaaataattgcgagagacaacgtcggataggatattgtatctaattgtaatatgatatatatgtaaaacaaacaatatcaattattgttccaattttcatagcaacttaaataagcacggtgaaggacaaaacaccacaacaactactagaacccaaataggtactgcctaatatgtgccggttattgtcaacaatacacactgaggcttactccaggagttgatctacaaatggacgtggacattccaggcagggtgccctgacgtaacaatagcttaatattcatatggacactgtgcataaggatggctaaatttgttgatagcgttttatgaaaatgttataccatattgttatggttaagtgccaagtgataaaataccaatggtttcctctaacttaaaccatatggcatgtgtatttgtgaaatttactactgtactttgtgatccttgaatcgttatgaagtgcatttgcgttacagtttaaattttagtcaacaattgtttgaattgttctcttgttttgaatgtgcagtctcataggcacggcaatggtgattgttgggctctacctttttctctcagtgaaagcatgagaaggtccatggatgtaaacatgtagattctacaaaggttctcgaagctatagaatagagttgtatatgcagacagtgaaatgtatgtaattcaataattaaatgtgaaacaatatactcgaggaggtgagcatgcacttacactgtttgtttattaatattttgctcaacaatactacaatatttcattgcaccactaaaacaaaatattggtccatgaatataatgctgcttgttattttaatttgaatggatatcgcgtataagtaataccttggaataaatcaagctaataggaataaatatgaaaaatgcacggacaacgatttccatatgatgaaatttaaaatagatccgtcataaatagagtagttaatataatatgtgtaacttctaacttgttaggatataagcaacgattgaaataaatgaaacaattgactggcatgtatatatcagttatataaggtataaggtgtacatgggtatatgtattgattggggcctccaagtacattgtgccctagtctgctgccccatcgcccaacctcaggaacgtccctgattggtggaaagtcctatgtcctctcattactactttcttaacgcacctaaaagaacatggtggtggacatgaattttcttctatttccttcatcctatatggtccctctggaacgcatgaattgcaaaacacgattaataagctaacaccatcccggtattaagcatatgtgtggttgtcttgtttatattagttgggttattaatcgtctcaaatgaacactttccctataggcacataactatcatcatatgcgcatcgcttatcgctcgagtctagaaaaggttttcatcatttttcctttgcaaaaaaatctacacctgtgtggctcgactgctcaggttgaactaccgaagcactagcttgcttagaaggactttgggtggagacagaatggattcccatgcctataatcttggagacggataatttagatgtcactcaagcagtaacaaaggaagctcagatggagtaatgatcacggaagcaaaaaagttgatgcaatgtctttaaagcgtgcaagtgtaagataaacaaagaagcgaatagggtagctcatactcttgctcaaactgggcatgagttcaaggtcaagtggaaagtagagattgtgtgcacttgcgtgtatcttggacttattgaatcatgaatgtaatccatattttgataactaataaagctctctgtttctgctaaaaagacaaaggttccactcagtccagaaataatagcatagtttctaggcatggctaagtaaggccattatatagatctaaacaataggaatcaatatcaaagcaggatcatgcaaaaagtaggtcgtagataccaataatgcacatttcaaataggagcaattatgttcttacccttactttgggttgaaattatgattttatctctgtttcgttttgactctgtcctcactttttttattgaagttacgggttgcccctaatttgttagtttgtcaattgtaaaaagacatatgtacccttgtatcttattgcaattttgcccctacttttgtaccaatattaattgttttccccatctttgaattatgacataaattttgctcatgtttttaacataattcaaatataacctgaatattgacatatttttatgaagatttgacaaatacaacaacatttccatagaatttaacaatgttggctcttggctccacacatgcgttgttgatgatatgggcttcactagtgctcattgtagacacatcatcgttgttggtatttcttagtgacattactagaaatataattctcagcaatgacgcccaaatattctcgatatatttatggttacagatatgatccgcaagcgcacggatataccattgcattatttcacccggaagtaattcaaggtatcatatttatttaattccaaaggtagatatgataagagaatactatgctaataatttatatattgcctatatacaccaatgtctatgcaggggttaatcaattcaagggtaggataaggttgacacatagaagaaaggactaaggtactcttcactaaaatataatctaggctaagtggagaaagaataagaaaagaatcattcatatacttcttgtatatagttaatatatttaatatattttgcacttgctagtatacaatcatgcaaccaataccccctagctataccctcctggtgtttcgagagaccacccctggttgccgatttccttaggacaacatgtcatggccatccgactggtaatgaatacagagcagtacccataccaggaaagtgtcttagtattatatacgaacgtgaaggaatatccgtactgagctgtcaccatcagcggcccacctcgactgacccgcagtatataaccccaattaatggtacctaataatctaagcaccatgctcacattactaaataatactccacatcgctgcagcagacatagagcaatcatagaaatgaacattaaacccacaccaaagcatatatctggtaagctagttacacaattatatcgagacaagtacgaactaaagttggtacccgaataatatgaatgaagtagaagaccaaagctatataaagaagaatatttcattaatactataagtcttacaaaagaaggaagagctagtagagacatacccaaaatcttctgaagactcgaggactaagagatctactctattcctactccactagcactagaacaaaaaaactaaacttgagagagcttcttgatcttcttcttgagtgtgtgatggagtggagtgatgtgtggtccttaaataagctaccaatgacgattgtggcggttggcattatccgaaataccacacaaccatcattgggtagcaatcatggatgtccacgtggaaggaggccatcaacggtggagctgggggttcggctgaacccagggttcagccgaaccatagactagcctaaacgggccacactttggcaggtgcgtctcctgatgactcctttgtccagtgatatggtggttgggcccatttgatgctatttgactagatttataagcccatccacccataagtctacctctcgacggatttcgattgatggttccgttaattcccatcaattctcctgcaattatgtaaagttctctgcaaacaaataaaattccaagtacatgtggagatagattattcttaaacaaaatatgcatgcaagcatagcttgttctcctttattttggatatattgacggttgaaatgggtcaataacaaccgccaatagtcatacagttgctcaatgctgacaatgcagtacatcgatctctctgtcaatgcctattcttgagcctatcacatggctatcccttgtcctccccatatctggcggctgcttcatcatcggctcatcgtcgagggtagctaatgctagggagaacccatcacttgctcgcccgctcagatgggggaacaatattactagaaagttcttcttccatttcatgaataatttttgcttttatttttccatcttaacctcaccaattgtaccaattctaggcctgccgaacatatgattaaagcaggggcaaatggtacattaagtttaaaataatgaaattaaaatcacaagcctaaatgtgggcccccagttttggaaaccagaaaccccatgtgtttacaataccaataccattccctagatcatcaatggtataaccatgacatagatgtatatcacattgcctccattgtcataaatgtcttaaaatacatataagggttacctgagtgggacccaaatggaccaaacatggtcttttacaaatacaattaccaaaagatgtagataagatagcgaaaccaaagttgcggcggtccacctctactccacatgcaacaactggagaacctaggtttgtactgtgtcttcttcgactcctccttctcactggtataactctgttgctatgggattactagaacacttggcattacctttaagtagtatgcattggtatcatgaaaacaaaacagggaaatcagttcatgtactctgttgccctgatccttgcaattgcagaatgactgcatttgaagctaataacttcaccacatattggtaatttttcttgtggaactgataagggaaattacataaatacaaaaaagaacatcacacagataaaccaattgcagtatgtgttgaacgttcctgttcctaaaaaaaaattcagttatggatgtgggagaatactgaaacccaagaaattgtgaatgcttacaaacatagaaagagttaaggaaggaatgtcagtaatgatgatagaaataaatgaactcactgaatttagtttagaggtttgaccttttcctctctctttttttaattagatcagatacaaagaaagcaatcatgtacgataatcttctcttccacattattcatatagctaattttagaatgagaaacatgggaacataatatatttatatcagggccagtactagtattgtggttagagggccatgcatgaagccactatcgcttgcagttcaacgatggtaatctgaaatcacatacatgatgattggaaatagacaaagtccaaaactgagcaaaatatgacaggaaacataatgcaggaataagatattccaaaagcaaaaagtagagcggtaataaaataataaaatggcataccaagctttccagcaattcctatttactaaatgttcgtctagcaaacattattggcatttgtgcaggtgtaaatatataatcacaatcagggtttgcaggcaagatgaataaataatttagtaatctcctgagaaccctgattcagctgagaattgggttacatataagttgagtggaacatgtccaaatatataaggattttttcttcatttgattacaacaaattgtacgtaggtagtagtaatgtaaacttccaccaaaattattctaaaattaagacctacccaatggcaccgggtttgcatttttatccatttcttaggattttcccttttgcgttagattagaaaggttgatcgttaactcgacgtttgttgaacaggttacgtttgcgaagacaaagccacaatagtcgacgaggagccgttgatcaaggcaagccactacgctcccctccttgtgcatgtgagtacctaaacttgtttgtgagccatccttaaaatttttatctatattccttgctgcctgagtctattatttatgcgtgaccaattattgatactgcttagtattgcttgtgtagacgaatatacactccgtgcttatattatggatgtggttgtggcgatcactcagtgggagtgattgtcggaagacgggtggagacatgagcgccacccgtaactaagaaccttttgcgaaaactaaaaactaaatgatgactaaatattttcgactaggtggcacatatagaatatgggtggctccacaaaatggcaagccgccaaccctggccatttaaggactgagtcaagaagctatatgcacgaaacgaacctagtatgaccgcacttcttgtatgggtaaagacccagcagactaagaaacccaagtggggtggcaccccagtcattgtagttatgcagttgtgacgattgtgacagaagatgtgatggattgactggatcaattgcttgaacaccacggcaaaaacctaaaatgcacctaagtatattattatatatttgtataacccccctagtatctcgggagctccaggactcccctcactaccgtctcgaggtagggttggtgtgccggggtgcaatgggtatccatagtccttggagcgagtgctgccaagcgagggtgaccgaaaaaccgagctgggacaaatctaatgtgttaggtgcatcacagagtgcgggaataaaagcgtacatccattgcagcgtgagtaaatcaatctatttgaatagtcattctcacggttaattaagcgccgggacttgtactactcttacttagaatagggttttgaagtgtgaccttgcccaatgtgcgggaaggtcggaatggtgaagatggtatgaaactaatgtgagggtaaaccagacaaagcgaggcttggggaaggtggatgaacccttgttgataaaggacaacaacaacttaacattgttttcagttaaagctactaagtcataggtttacgaaaagaattgcgaactctagctttatgcaaatgaaccaagccatccttgaacccctatgtgcactaaatgcattctgtattagtggcttgctgagtacggttagtactcacccttgcttaattaaatcttttagaaggagaggttggagctgacacgtacgtgtgcaatgatgataaagaggtgctgaagacggtggattagggacctaggttcaccagtcactgcctgtggaataagatgaactgtcactgcttcgcttccactaccttatctattcctttggacatttggtattgtaagtccaagagccgaacctccgactacaataattcctcatcgtctttgttaggaggcggttctcgcaagttgcgaggatgccgtccatctattactctggattcacttcaggtggtcgaggtatgactacgactggtcctcgaccagcagcgtagcggtcctcgtaccacgacttccaatggacgaggtatgactacgactggtcctcgaccagcagcgtagcggtcctcgtaccacgactttcaatggtcgaggtacgactatgagtggtcctcaaccagcggcgtagcggtcctcgtaccacgactttcaatggtcgaggtaggactatgattggtcctcgaccaccggcgtagcggtcctcgtactacgacttccaatagttgagttacggttacgactggtactcgaccagcaacatagcggtcctcgtacctcaatttcgagtggtcgagtgatgactacaactggcctttgaccaacagtgtagcgatgcccccactatttctgtgatttgttgagtacaactacatacctagtcttcacccagtgtggtggtcgtctcatcatcttatgtatgacaaacttctgtaagtttttatatgtgcaatatttatccattgatcgctttttcttatatcgctttcgtcttgaagttggtcctatcgtccctttacgctaatcagacaaagcctccgagagacctaagggaatttcagcaggggacaccaagagcggataaggatttgttagatgctgagagccagacgaccatgtcagatctggtcatgtaagagtgctcaatggacgcgtattaactaagccatgcaatcgggaattggtttttccaacttcactgctgggggctaggatttgttagcttcagcatggtttgctataagatttaagctgcctttgtggaaaatggcttttccataaaaacggttgggggctaggaagagtaccaaactccatttgctgagggcaattctagcgagcgtactcttttattgtcacacgcaaattcaattcattttcaatttttccatacatattataacatgttaccctttgctgcatctttgtataagtctgattcagtcaaggccatgtgttcaataccccaagaagactcttttgctctacccctatcagatgaggcttattcagaattcttgcaacttcaggggaatctggacaacttaaacttgcaaccagggatgggggatgcttggatttttatctggggcacagataagtacactgctaagaaattctataagctaaattatgctgggatgcaaccccctaggcctatgatatggctatggaaaacaaaatgtgtaatgaagatcaaggtctttgcctggctaatgttctgtgatagacttaatacaagagatatgttggatatgagacattgtgccaaagaagatgattatctcacatgtgttttgtgcaatgctaactgtagagagataaggctgcacctcttctttttatgccctttcagcaccaggtgttggcaatacctgggaattgagtggaatagcaattgtgaatttttccaaatgatctcttttgcaagaatcaagttcgcttagaagggtttcctggaaattttctttttggcagcttggcacatctggaaacaaagaaatggcttcatatttcagaacgtacaacccacttttcaggcatggagatctctcttcgttaaagaagttcttctgcatatgtgcagaatgaatgagcctttaaagcaaattgtttctaattgggtacaaaccttatagtatctttgtgtgaaccacatgtaatttttgtaaccttgtaaatattttcttgctctataaaattacactgctaggcaaagccctggcagttttcctggtcaaaaaaaaaagatgttaccctttgagcattcgcacgggggctatttctatttaatattctgtccggagtattgattttaggaaagttctattcaacgctgttgaggactccatgtctctacggtcttacagtacgacaaatgttgacaagagaaatcgcggatgacaacatgagttcatttaagttgaaggctctatcgtagactctacaccctcttgataaggaacgtggaatgaagcgatggtgtacccaccgagatggaatttattgacttcaatccaaattctcgattacggcaagatgggagacttagtcgcatgttccgtaccttgtcggtcgacatcggagattaacctagacaaacccaatatagtgtttgcggtagtcgataaggggaatctagcgctatctctgatctcaccaagaacggtcaagtgagcacgacaacagtttttcaaagggcttcagtcgagaacatgaactcgttcatttgcattgaagtcgggggctactgtcatgggttatggataccacatacctaatagtagttgactaagctcgacagggcccaccaggtactaagtattatacggaatcatacctcatatatagaaggagttccggataaggaaggacgaatagagttctatatggaaacgataaggactacccgaattgtatccatattggtctccattattatacttggacaaggggacatctatgggtataaatagaagacaacctagggggagaggggaaaacaacaacaataacagatagacacacaatacacaagctaacacacgccgccggatatcgacatcagagataagcctagacaaacccaatatggtgtctgcggaggccaagaagagggatctagcactacctctgatctcaccgagtgcggattcgaggaggaagactacccagttgtcgactacatgttggttatctatgccgccaagttgacgacagctagatgggttatcccaaatattgtacttgtgtgattaagatgaataagagcaacaacggctttggccaacaggagtagggctattatctatcagataaggggccggaacctgtataaaaattcttgtctctatctcttttacttcaatcttgcatatacctgagtaccaacgatccccatactatccaaaatacggtctatttggatctatttgggtcccatcgggaaacccttgtattattaatgtaatgaaaaacctgtgtaacgatgtcagctttgtgacctacaacttaccatgtgtgtatcatctactgatctagggaatgatattgtacacacatggggtttccggtgtacaaaaccacgcggggggcccacaatatcaaatataagtcaaatttatcacaaaatctaaaacctattagagtgtagggtcaaataaacagggacaaaaatgtcattttgaccgtgagttaacaccgtgaggttggtttcgtagaacaaggtgagctcatgaccgtttttgaattagagggtcaatgtaaatctgaaaaaatagggctaaattggtagttagctttcaaaatgagttcaatatgcaatttcctcaacaagttttgtagatgtgtatgtcagattgagggtagaaggcaatgcgcggtttctatatagcacaaggtaatatattaggttgatactagcatgatatttggataactacgtttatctaacttgtgcagattgctcaggcaattgctttatctaaggccttaaagcaagtttaatagtatagccaactgcgggctccaaatcatctatagtcaacttaacagccaattcatacaatagttacctatcaatatatactacataattaatatatggtcccatctgtcctacacacatataccttggagtccgtgctgcagctggctacaaatctatagcccactgtccttctctctcctcttttatctcctcgaaatatgtttatatagcttgctgataacctactatcactagtacatatgtgattatgctggacggcggctcattttggttccaggcgggccataagtggctctgcctggaaccaggcgaatgctggggtagggtagtg

SEQ ID NO: 59851 - DNA, 27893 bp, Oryza sativa
  unsure (1)..(27893): unsure at all n locations
gcccactgtaggcgaccgcttgcgatggtcggggggcatataagcccccagcccgaccgaccgttgctaagaatttctagcggtttctctctcctaaacatccacaaattagtggggaaggttttcgacctcaaatctttgattgggttccatataaaaggtgtagagctcgttctcctccttcatttgcttccatttttttcagttttcatcggtggaatacgaagaaacttgcacttttataaatggagaatagtgtaggcacctttttgtttttttattttttaagcaaatacatattgcaatcttttacatgtttataaaagtaattagcacctaagtttaaacgttgggtttgcctctattaatttattttcattcggatgaaaaaggacgaatatttttattttttagaaatggatagacagtattctattaatgcttaaaattgatgtgcggttgtttaaatagtctgttcaactttaaattactacgtgattagttccctccaatttaaatacgttcgtgtttgaatcggtcatggatgtattaatggcaagctttattataggtcatggatcggacatggatgtacaacacgaaaagagctcatccaacgttcttgaaggaagcagccaaatttgttgagctcgcaaaggcacatgctgcgagcgagaatttgaggagcattttttgcccatgcaaagtttgtaagaacgagatcttgctgcaagatctgaatgaagtattgtcgcacatcgtagaacgaggatttaagaagggatacaagatatggacttttcatggggaagccggtggtcgtaacgaagagttagatgatttctgttttgatgatgcagaaaattttataatcgaagacatgtctcagtgaaacatccgggaatacggtggctcaggtatagagaatgaaggtattgatttcgatctggaagatatgttgcggcacgttgaaccagagatcctaactggtacaagacgagggttggacaattgggaagcgttggaaaaagcagcgaaggagcttttgtatgacgaagccaaaggatgcgacaaggactatttagtactgcgctcggtgcttgaacttcttagattgaaggccagacatggatggtcggacacgagcttcaatgatttgatggatcttttgggagtaatgcttcctaagccgaacctgctactgacgaacacatatcaagcgaagaaattgatatgtccattgtctctaggtgttcagaagatccatgcatgtgaaaatcattgcgtactgtaccgcaaggaattcgcagatttagactcttgcccaacatgtgggacgagtcggtacaagacgggcaacggagcctccgatggagaggtggtcgacaaagatgatgcaccggtggatgagaacaaaaagattcctaggaaggtgatgtggtacctgccagttaaagatcgcctgaagcggctatattacaaccgagacgacgccgagttgatgagatggcaccaagagggtaggaatattgacggtaagatccgacaccccgtcgatgctcgacagtgttaaaactttgatgcactacacccggaatttgcaaaggacccgagaaatgtcaggtttgcattgagcacggacggaatgaacccattcggtgacctaagcagcacacacagcacctggccagttcttctaacgatgtacaacttgcctacatggatttgccagaagcgaaagtacattcttttgtctataattatacaaggtccaagacagcctgggattaacatagatgtgtttctggaaccattgatggaggatatgcaagaactgtgggaggaagggttacgaatgtgggatgagtaccgtagggaacatttcactctgcatgccatcatagtcgtgacgatcaacgacttaccggcaaacttttcattctcgggccagtttaaggggaagttcggatgcctcatatgtatcgacaagacgtcgtacaagtacctcacctcgtcaagcaagggtgtttacatgcatcatcgtcagttcttacctcaaaggcataggtggtgtgcgaaggctagattattcgacaatacagtagagaactttctagctcctaaaacacgtacaggtcgttctgtcttcaagttgacaaagaacattaaggttgtgttcggcaagccaaagaagaagcccgtcaagagttagaaacgtacggatcaggacacaactgatgcacctgtagaggaaagtaaccagtccttcaagaagcactcaatttttttcaggtatcttgattactggaaagacatggaggttcggcatgccatcgacgtaatgcacctggagaagaatgtgtttgatagcaccattggcactttactggacatcccgagtatgacgaaagatgggttcaagtcccggaccgacctcatcaatttggacataaggcatgagcttcacccaaaagagctgccaaatgggaagatcgaaattcctccggcttgctactcactaacacctgacgagaaaaaaatctttatgtacatgcttgcatagtgtgaaagttccgaccggtttctcagcgaacgtcagaaaactcgtatctctaaaagatttgaccatctgtgggtaccatgctcatgattgtcacaagatgttaacagtcttcctacccattgccataagagtggtcaagccagttcacactcggttagtgataacaaagttgtgctactttttcaatcgagtatcacagaaggtttttgatcctaaagagttaggcccccttcaaacttttgcaatcgagacaacatgccagcttgagatgtttttccccctagcatactttaacatgatggagcatcttattgtccacatcgtacctcagattatcgagattggtccactatacctacacgagatgtgggcgtacgagaggtacatgtccgtgctgaaagggtatgtttgtaaccgagctcatccggaaggatcaatgatagaggagtacacaactgaggaggtggtcgaatgctgcatagattacatgaaggacgccgaacccatcggtgtgaccccctgtcacaccctgaagttctttcccaagcctaaattgaatttataatccacccgagaaaatattggtgtaaaagcaagagaaaccctaataaattaatgcaaataataatcggatttggcatgtggaatttttcttgagttctacatgtcgaaatacgctaacaagatttttagtggaattttcagagctctattaataattttaaccaattaaaatggagcacaagcaatattaaatccctagaaaattcattttcctttttctttctttttcctttctctttttcctccgaataggccgaggcccatacgcgccgagccggccacccgcctcctctcccctggggtcgtcgacaggtggggcccacctgtcgggcccgtccccttcctcgcgcccgcgccgccgcgcccgcaaccgccgccgcgcccctctcccgcgcctcccgggccacgtcgccctcgcgcccgcgctccccgcacccacttccctctctctcccgctcgcgcctgcgcccgagatggccgggattcgaattacgaatcccgcctctctctcctcccccactccccacgtcggccagcgattcccgcctctaccggccacgtccgagctccccctcccctattaaagctccaccgccaccccctctctctttttccccatctcgccgagctctctcgtgccctctaacgccctagcgccgtcgccctcctctctgccgcggtcgtcgccgctagccgccgtgccgagccacgccgtcgacaccgtcgtgttcaccgtcgtgcgggccgttccgtccaccccttccccgccgaaattcgccgtcggcctccactccgcgccgtgcgccggtgagcatcgccatggccgccgccttctgccggcgtcctcgccctctccgttttgcctctctccctctaatcctttcctttcgattccttaggtggttccgcagatcgtctcgccgtcgccgccgccctccgttgctcgccgtcgtcggtcgccatcggtgaggcttccccttcgtctctctctctcgcgccgctagtcgccgcgctgccgcctagccgccggtcagtcgctgcctaactgccgcttagccgcccgcgccaccgctctccgccgccggtcggtcgccgccggtcgccgtcccgcaccaccgccgcatgcgcgtcgcgccgccgtgcgccatggtcgccgggccggcttgagccgtgcccgcgcgcgccggccgcgagccacccccgccgtccgatctacccttgggtagatcgggaccgcccgttcggccgcccacgtggctgccgcgtggccgccgcgtcggcgcaacgtcagcgccacgtggtgcgccgtccttccccggtccgtggacccgatccaccatggaccagcgcccgcagccgctgacatgtggggcctgcatgtcggcgccgccctctctctcctcgggatttatttattgcgcaataattcaattaaggatttttctgtttatagtaaaaacacagtgaatcatctaaaattcataactaattcatccgagctccgtttaagcccattcaagtctcagtaaatcaagaaaaatgtgtagaattcattaaaaatggttttgttctctgtttcagtagtcttatagcctgtttgtattgtttgctttgtttgtcgcatagattccggctctcccgacgctccagtttaccttgaaatagtcgtcgaagttcctccagctgcatagcaaggcaagtcatgcttgtcgcttgatcatgttgatcctatattgcaaatgctctattgttttccttcaaattctgcattgttttacaataatcctatgggatgcttacctactgttatagccatgctatttacttgatatccgttcctttgttaacttgggttataacatgactagaggttggattagggattgcttagccatgcttagttcaactagcacacaatgggggaaataatattaatgtatagacttcaggttctagtgttgatgttggattagtatcaccgttctggtgttgcttaattaaaataaaccttatggtgggctgtgggtgcatggttttgctagttgtgtcacgcccggaatttctatccaaaattccaaacgcttacatgtgtgtgaaccctcgtccaggaatcagccgaggcacacaataacaaattgataatagagtacagttattactctaattaataagcgaataaaatgtcattacagaggtagatagttcctctcaatcaataaagatctaagcagcggaaaataaaataaacggcgcagacggctccactccacaggcagcttgaccaaggctacacctaatcctccacaccatcagcctcattgtagaactcttcctctgatgaatgattgcaagttgagtatatgacatactcagcaagccacgcagcaaatatgcaagtgcacaggataacaaaggatggcataatagggttccatttgcaaaagcagcatttagcaaacatttcagaatttaataaaacagttatgtaataattaaacaatattaatccaacactatacaacataccctgttgtataggcccaaccattctgaacaaccaccccggctgcacagttctatctccaaaccaggaatataccattccaaaccaggagctaaacaaattattaccagtttaagcatcttttactataatgagaggtgtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacctcgggaaggagttgtgacaatacccctcatacaacacaatccactgcagcgcaccttcctggttcataatcacccccttataaacaaggcatggactccccagcgacccccgtgggcttatctccgccacttctcagtctggtgccccgcaatgaaccatgctatacaaaagataaagccgttgcccacgctggcttgtggttggcacggttaatgtttcacaaccgaaactcgtgaaccggtccttaattgtcatgagcacgaccatcaaaaccatgtgctcacaacccaccattaccaggttttagttggcacattaattaattaactaatcacgattgtccatcgtgaactatcattaagccatcattaaataatagtgagtcataagttatcccaatagtgtgctaatgtttctaagcagggctaagcaattatttctaatatctagttgaaccaatataaataaagttcaaccagtcaaattattataacccaaggtatcaaggaataaagtaatcaagaacaaaagggctatagcaaacaataggttaattccacccaatgacattcgaaaataaatgcaatagttgaaaagaaataatagctttaaataggatcaacatgctcaaagggttgtttgggatctgtgtgacttgccttgctggccttggaactcttcaaactcttctccggcgaaaacggactctccggaaacgacggaatctaagcagaaaagagcaaaatcaccaaaacagcacataaacaagcatgaacagtacatgtggatatttttaatgtatagatctcaattttagaaaaatttagagacttgaaccaactaaatcggagctaagatgaattagttatgaatttttaaagattaaatcggattaaaacacttatatcggtttaaattgaattatgacgcaataatgaattatttttgaaaaggaaaagaaggtttattgcgtcagcgggctagggtttcggtggaccgggcgcacgggcggcggttcacgcgaacggacggcccagatcgatccaatccaagacggacggccgagatcgaacggtccacgaccggctcacggcggacgaccccgatgacgtcggcaatgacgtcaccgacagcggcggcggctcggcggagcggacggctcgggcggcgcacgctcgccggcgaacggcggcacttcggcacaaacggagggcaccagcacgtagaggacgacgcggcgaactcaccggtgaccaaaacggcggcggaagaacaacggacgatgacggcgacgaggaggaagcggcggcaaccttcgggtcgacggtgacggcgatgctccggcggtcttcggcggtggcgaaggcccacggcggtcggcgacgaggaaggaaagatcgggaagaacgaatccgagacaaactcgaatccaacgctttccaaaacgatttagccaaagattccaaaggagaaaaggtagaggagatcccgaggatcatttcccctctatcaattcggccggaaacggaaagggacggccggattggaaagcggcggcggcggcggcgcgctagggtttcggccggaggaagacgacgggcctgacaggtgggccccacctgtcagcggtagcgagggcgcgcacgcgggcggctgcggactgggccggactgggccgaggagagagagagcggttttgggccgactttcggcccaaagccaaaagaagattttttaaaacctttttcaatttaaattatttcttaaatgcaattccatttattaaaaatactttcttagctcaaataaatcccagaaaaaatctaggaattatagaattaagcaaagtatttaatgaaattttatctggcccctttttatattggaatttattaattaaaattagatcttctcttcaagacttttaaaataaattctaaaaattaaaattaaacaacaatttatatattttgaattttcagggtgtgacaagttgcgcccatggcacttaaggaccagatcgcgggaaaccctagaagaattcctcgtacttaccacaagccagcatgggcaacggctgggcttgtagtgtagctttcctctagctgacgcatccaggcaagggtgagcgtgatggagcggggcgggccctgtgacggcctctgtcgcttccggattcacctaggcacgagaggggactgcccgttgcccgctggggacgggggtgaaacctgaggtgtggtgtgcttggctagaggggttatgcgaagggtcctatcacggcctctttccggtatgtcatggtggcatgtcggcgcacggaaacgtgtcgtggggctgtgtcttgtgggtacagttgtacacctctgatcagagtaaaactattcgaatagccgtgcccacggttatgggcgatcaaccggattcaccgtgattagactcactctagattagtctaatggaattgaataatataggtggatggttgggcctgttgcaacgtggtatagcgttggacagtggatgattaatattgattaattgttacaactgctttattgctttcacttctgtttataaatgctcgctttatgcaaatgaaccattatagctgtcccttgataattccctgcaccatgcccctattccggtatgacttgctgagtacagtgggtagtactcggccttgctctattttccccaaaccccaaagttcgagtatgcgtcagatgacggtttctccgaggagtaggcttcgtccgtgccgtcgagtgtgcctgtggaatggtattcccgctgcagtccaagtccagacttagctccagttatcctttatgttttccgctgcatttatgtaagacttttataatgtttgtaagacatggatctatatgtcaactttgtcgtttgtgtacctcggccggtcctggacggggactttaatgcacattctgcttggaattctagttgggaatttctgggcgtgacaccccccctttacacgagggccagttggctgggacggggatcgtaggcaagaaaaggttctacgatgacgacttcaaagatgtagcggaagcacatagcagtgttttgcaacaactcaccatcttagagccgtacattcaggaacacatgaacgagataagagcccgcaaccctagaagaacggacatttggatttgtaaagaacagaaacggaagtttcctaaatggttgaaggagaaagatctgtcgttgggtgattcgctggaggaaaaaactttgcgcaggctagcaaatggcccaactagccttgtgacctcatggcaagggtacgacatcggcggatatggattttacatgatattcaaggacaggaaaagcacaactcagaacagcggagttcgggtggaggtgtttgacgcattaggtgagaagaagtcttactacgggatcatacacgacatttgggagctggactatggccttaacatactgatcccagtgctatgatgccaatggatcagagaacagaacaggcgtattcatcgatgactacggcctgatggttgtggatcgtagcatgctaggacacaaggatgatccgtgggttcttgctgagcgggttgctcaggttttctatgtcagtgacccttccgacgataagatggccattgctgtactgggaaagcaaaacatcgttggcattgatagcattcaagacgcatcagattacaaccaatacgacgacgtccctttgttcacaggttttcctaaccggatcaaggaagttgagacaagccttgatggagatctgtttttgtctgcgcggaaggatggtgtttccaaaattgtcaaacattagtgagatgtcgatcctgtgtactacctattttgtaaacgattaccggatgaaacttatattgcaaatgagatagggtatccatgtttatccgtactatatgtcgttttgaatttattttatggtccaatattttatttatattaatcatatcgatgaataattagatgcgaagaaaattcatgtctgttttaattctatgttaatctatatttgtattttgaataattcgtggtttaataattatacttattaattaactataatttacatgggactataacaaataattaactatttttcaatgtgttatagtcaatataataattaatacaatcctaggcaaataaagatatttttttaataaattgggctttttttcttcccgtgcgggctcgaatcgattattccgtgcggcggcctaagcctcctccccagcatccaccgccgcctcctccactcatcggcttcctccaccgccgctgcttgcatcctctcccccccagcccaccaccgtccgccgcctccgtcccctcgctcgacatcgccgccaccgctgcctccctctcctccatccccctcactgcctccctcccctccatccccctcgttccacatcaccgacgccgaccacctcatccccgtcgacgtcgacgctgacgccgaccacctcatccccaccgacgccgacgccgaccacctcatccccatcgacgccaccgccgattgcctcctcgaccgacgctgccgacgtcgccgaggccaccgacggcggacctcctccccaagccgacgacgccaccgaccgacgacgccgccgacgccaccgaccacttcctccgcaagccgatggccacctcctccccaagcagcggccacctcgcccccaagcagcggccggccacctcgcccccaagccgccggccgcatcctacctcctccccaagcctcctccaggtacccctctcttcgccgctttcttttttttggatgatgcagtggtaatggatggaatgatgcagtggaatggatgattgaatgatgaagtggatgatgcatgcagtagatgcaatgttggatgaattttttgaatgaatgaatgattttaggttgaatggatgaatgaatgttgatttgtgatgttgagatgatgatgatatttgtgatagatagatggctgtttgtgatagatagatgatatttgagatgatgatgatatttgtgatagataggacttgtgctctttgtgatagatagatgtatgtctatatgggatatatggctgttttatgtcactgtgggtttttttttttctacacatgatgaaatatatgcccctgctgaaatataatactaatttgcaaatgatgctgttatgcccctgctgctgttgtgcatatacatgatgaattatattttgcttctatatgtttatatatatgtgatgtacatatatgctgtttatttttgctgtttatacttgtttatactgtatatgctgttccgcacaggttttatatatgctgttttatacatgtttattttgggtgatatatgtgggctgttttgggtttattttgggtttattttgggctgttttatgcctcactgtggttgatacatgtgggtgattgttgtgggtgatatatgtgggctgatttatatgtgggtgatatgtgggctgttttatacttgtgggtgatatatgtgggctgttttatgttggtgataaatggccaatgatgaatgctcaaagaacagatcatctacacttgtcttctgaatttttttgggggcaatccacttgtttttttctcaagaacagaacaactacacttgtgaaatattttggggggcacatcacttgtttatttttgcttgagaacagacaactacacttgtgaatttttttgggggggcacttcacttgttttttttcccacataagaacagaccatctacacttgtggccatatgctttcatagtgtgcatggtgatgaatatccttaccaatcttgctatcgttacccatcttacgttccttaccgatcttgctttccttaccaatctcctaaaattagatataggaggtgtagttcgtacgttatcatgccgctataatatgaagtgttctggttgccaagttggcttggtcggtttagttcctggacggaaccgactagtacaaattggaaaaacagaacatttcgtcaacatatgacatgcgttggtcattcgtaaaatgtgctggcacgtctgttgaaagatagacctctgactcgtacatgcgtcggcctcgtggatggaccaggagctcgacattccttaaggtcgttctttccgacccatacaaggttccgctgcctgcattgttccaagagtgtcttggacaaaagcaggaagtggaaccttgttaaggtcggaacgaactgccttaaggaagtcgatgctccaggtccgtccacgaggacgacgcagctaggagttagaggtttatatttgaacacacgagctagccatgtgatcaaaacatgtttttactttgctgttaatatgatagtttagtttagtggttatgatagttcagtggatttgaacgaatataaaattgagttttaaattattccattgtaagaacgcgaatcgaagatgtcaggcaagacagctccggcgggcacagaaccgacggtcaataaacctaatgggcaggacagcttcgtcggacacagaaccgacgtcactaacaatccccaacacaaagaagatgccgggaaggtaccggcgtcgagcgaggaattgtggcgcacaccgagcgacccgtttgagctagaactagcgcaattgcagtatgaaagacctgaggatgaccccgattatattcctatcaagcaggcggtaataacttaatcctatcgaaatatatattttgaattgaactttccccgacgtagcggtctaatgacttaaccgtgcagatggcaacccgtcgtcggtcaaaacgaagtgccgtcagggttgaacctgattcggacacagcgacctcgggatcaccgcaaacggacacgacgacgagtggtgaagcttgtccaaagaaaaaacgtggcgagaagggcaggaacctcttgccgaaggagacgtactacattgctgctctcgacgatgacggcaaacccgtcgagccggaacatgtaagggcgaagtttagcaccgcatgtggcgcgctggcaaggcttcatgggcctctcaacgtggacgaatggaagcacgttagcattcacatcaagaacttaatgtgggaaggtctgcaggagcaccttatttatccgcctgggtcggagtcaattggccggaaatttgcactgcaaacaattgcccatcggtggcgacagtggaagtcggacatggacaccaattatattcagaagaataagactccatttgaagaatgtggcaacatttcagcagctgagtgggacaagttcgtggccaagatgacaacgcctcaagctctagaaaggaggaagaagttgttggacctggcgaagaagaaacatatatccacacaggttagggtcaagtggatacgccggtcacgagaagaaatggcgagctatggaggaaaagtttgtggccgaaggcaaacctttgattgtgcagcccataaataagagaactagaaattgggtgtgggcaagaacttcggggcaagtgacagaagagggtgagatgctgttggactgtccggacatccagaacgtgaccacgtctctccagtagatcgtccagaaggagaagaccggtgagttcgtccctcgacggcagcatgatgagctgaccgaagctttgggaactgtagaacactccggtagggtcagaggacagttgtgcaggacgaattggaaggtagggtttccacagtgtcggtgacatgggaccgggagtatcatgactagaggtttgggcaggagcaatcacccacgtggcctgaccccctcgggggggtcgggcccgagggtgatgaggccgcccctctctttgtctccccgagggatcggaccactcccgtttcggccccgagggctgaggcgcccctcaccgggagaccgcgcaggcccccctttgccggttcggccgggggccctgggtgagattctaagctcctagtctgtggaaagttcgcgagaatggaaaaagcacaagacacgggcgatgtatacaggttcgggccgctgagaagcgtaataccctactcctgtgttctggtggatctgtgtatgaagaagctacaaagagctgtagagccagagagctcttactctagaaaccctcttctcccttttttcctctcgtcggatctactctccagatcctctctctctctcctttcgtcgtccctcctttccgtccccccttaagtgggcaaggtccttttacattcgtctacggcgcggaagcggttctcccatccgagctcaccctgaggtcccctcgggccaccatgtactgcgaggctgatcaagatcagcttcgcagagatgacctcgactacttggaggagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggattgagcaagctctcaccaatgtgggagggtccgtatcgagtgatcggcgtcccccggccgggctccgttcggctggccacgggcgacggcacagagctgcctaacccgtggaacatcgaacaccttcgtcgcttctacccctaatggagttcgggtgtcaggtttcgggctcgggccaaccccgcacccccttcaggcgtgcagggttggccgggggctaccacatatgcatattttttcttctatctgtatttcaataaaagcattttcgattttctaaaggttgtatctgtgctgttgtttccttttgaagaatcttgacttgaaataggtcactcgtgctcaatcctgccctcgggggctcgggtcggctaaaatcgccaaaaggggccagaaccgagccgtgccccggggcgtggtgaactccgggggggaatcggcaaaaacccacaatcgggtcacccataaccctcggtcaccacgctcccggcctggccagtctcgacatgtggatctccccaggcaccagccccgacccgagccatttgaggactgggacctgggcacgagcccttgttcaagctaagacacaaaaggaccacggcacagatcatcctcgttctcaaacacacagcaaaatgaaattgacacagaaatttctttattttggttgcagattaagttaatctatacaaaaaggaggcctgaaggcctcggaagaaagaaaagaagaaaaaactatttaaagattggcgggggcctgggggctcactccgatgcacccgggtcgccagcctcgtcgccactgtcgcccactccgccgtcatcgtcctcctcatcggagttgagggcgaacgcgagtcgaggggccgaaccctcgaagctgtggacgatatggttggcggcgtcccggacctgcgcgcgcgcgccgtcctcggtcccgggagggaactcgtccagcgccgtccatggggagaagtcggggtccctggcctggtaactcgccagtacgagctccaccgctcctcgggcgaggtccctcgaggatgacttaatcgtcctctcgagctcctccgggagccgctggagagtcccggccatctccgagaggcgttgggcgaggcccccctggttggcggcgtacttcacagtccgcccgccccagagacccgcctgccgcccggcgcggtctaaacgggacacggcgtcgcgaagcatgctgggccctatctcgcctgccaggcgaagggcctcgacctccccggtggacgaattcagcgcgccctgcagatccgcgatggtgtgttcggcagctgcgaggcgggcggctaagtcgctgtcgcccgtggccgccccgccgctacgcgcccttgcatccagctcccttgcctgcgcctcgagttcagcggcccgctggttcagtgcggccctctcggcgcgggcaccttccagattgcgacgcgcttgttcctctagcgcagcctcacggagggacgcgctctccgccagcctttgcgccgcggcctcagcctcctcgagggctcgctcccgctcgatgagcgcatcttcgcggaggcggagtgcggactcctcttcggcgcaggcggcttcgtgcgccgccagtgtgacctcccgaatagcaacggtggcctcgcggtccgccaggtccctctccacgacgcaggcacgctctaccatcgccatggcacgggcctcaagggcttcttcgcgccgccgggatgccacctcggtctccgccgcccgccgttctcgggcagcggcagcgtcaaggaccccccgggcggcgtcgagcttcttccctagctccgcctcccagctcacgtattgaaggcggaggtcgtcctgcgcctcgttcatcacggtagtggcgatgagggcagccccccgctcctcctccacttccctggcgatctcccccagcaccttccgacgggcttcgagctctgaggcgtgccggcggtgtgccttgcggcccacctccaccatggcctccactgagcgtcgcccctcttcgacacgcgcccatgcggcgtcgagctccgcccgctctgcttgcagggcctccatctgggcacttaacccgtccaacaccgtggtgtttgcgacggccaaggcctgcagaaggggctctgcgctcagtggggcagcggaaggcgtgggggagagccgcctcggtgaggatgccgcgcggctcggcccgccgatggacgtgccggactcggggacgtcccccggacctggcttgtcctgagcgtcgcccgagggagtgggcccaagcgatgcgcccgcggcctcgtcgcgagctgcctcggaagtcgtcgtcgcctcggcctggcgaagtctggcctcctcccgagcggcttcttcagcttggcgagctcggacggccacctgggcagcttcctcggcttcccgaaggcgatccgcggcttcttgccggtcaatttcgcgggttgcctcggaggatgtcgtcgcctcggcctggcggagtctggcctcctcccgagcggcttcctcaacctggcgagcccgggcggcctcccgggcggcctcctcggcttcccgtaggcgatccgcggcttctcgccggtcagattcccgcctccgggcctccgtggtcgccgcattctcggcctcagattggccggacttggattggcaagaaggacgcgacgggatctcgctgaagcagaagaaaagccagaagacaaacaagatgggtgaatgaaaactcgcgttgggagaatgaatatagccacaatgggcgtgggacgaacctgcgaaggggtcggttaaacgaccaccttggaggggaaataaggtttccccgggatggttctgtcccccccatcttgcggagccgtttcttcttccgctccccctcgggctgcggcgtcggcgtggccccctccgggcgcctgctgctgacacgcgccgccccgccccctcggggaggagatggggaggaggtaccctcttgcttcctcttccctcgggcgtcggcagggcggctgccccccgagcccccatcacggggcccggaagcacgaccccctcctggggtagattgatctcccttgcggctcccgctcgcaccgtcatggcccttaggagctcgctcctctgaggccccgaccgccatcatgatggtcaggatgttggcgcgatctggatcgctgcagagggggaggactccttgggggatgagggatgcctccacggagctgagattcagcacccgttggatcattaccttgaagtcttcagggacccagtcccatttgaccccccggtgggtcctcatacagtcctcggacccagtgtactcccaggcgccccgggcgcgccgctggagtggcgcgatccggcgacgaaggtagtcgccgtacaccatcgcccctgtgagcccctgggatcgcaggcccgccaggcggtcgaggacggcgtcgtagccatctcccagatctaccggcgcccgctagctggaggcctgcgccgggggctggctcggaagtcggaggcgcgcttcgtcggcgaggggggtgtagaaccagtcgctcttccagtcatcccacttcttgcggaggacgcagggaatgtagcggttcagcaccggcccccgcggctggaagtagcagccaccaaccaccgacggcggcgacactggctgtacggtgaagaaccaccggaacagccgaagggatgggcgcaccccgatgaacatctcgcacaggtgcgcgaagatggccaatgtcattaccgcgttgggggtgaggtgcgccatctggagatcgtaaaactccagaacatccatgaagaaagaagaaaatggcggaaccagccctgccattgcaaaagggaggaagaagacggaccgccccgggtagcgtggcgccgggtgtccctcgcccagcgtgactatctcccggccggtggcagattccggcatgaagcggcgcggcagcccggcctgcctctcgctcacgatgcgggaaggcggcagcacgctaccatcgagcggagcggagccccgtgccatgacgccggaagaagagatgtttgagagcgagcgcgtgtggcgagggtagggcacaggaaacaaggagttagggcgcaagcaaggggaataatggcgagaggaaggaagcaaatctcttcctcggtgtctttatacccttgccaacgctgtacccggctcctcgcttctcgcgcccactatctctctccctcgtttctcgcgcccacgcttccactaatcccattcgcccgcttgcggcgcacgaggtggatatgcggcagtggcggtcgagatggaacatatcgtgcgcgcgttaattacgctcgccgaccgaagcgccatcaccatatctccaggcaaaacgaaccggctcgtcccgattcgcgtgctactcgagtaatgtggcagtcttgaagagaccgctcattattgacagccgagttaccattgccgatgtgtgtgatttgcgaccgttgggtttctgcccaactgtagagaccagccccacttgtcaccaggcctaagtaagtggcgtcacgcccgaccgcttccctcgaggagggcgatcgccctggcataacgccgggggctactgtcggtgacatgggaccgggagtatcatgactagaggtttgggcaggagcaatcacccacgtggcctgaccccctcggggggggggggggtcgggcccgagggtgatgaggccgcccctctctttgtctccccgagggatcggaccactcccgttccggccccgagggccgaggcgccccgaccccttgtgggttttgcgccgcgtgtataggttaggtgagcacggcggggctcacctaaccgcatttattgcggtttgaacgagcgcgtcacgccgaatgtaacgcagtgcagcgcgctcgtttatccggtctgtgaccagtcacagaccggtcagatcgtgggttaggtggcgacaggcggtctgacgcacgcctcgccccatcccgtcaggatgagagcctccaagcactcgtccctagccggagccggcgtgttagctcctggagatggcacgttggtcccggtcagatatatgccaggcttcatcccaaccgttacaagcaagatattgtatgaagaagggcgaacatgcagattgctagactgacacgtggtggacaagaatgaccgatttgtgaccggtctgacactggtcatgtcgtcggcagacaaccatgttcccacgttgcacctgcttccggcggagtggaggtaggtatgggccatcccatcagaaggtcattcggacagcagccattgcaagtctccgcccatttatgaagagatgacagggtgatccccgaggtcagacgagtgaggacgcgtggccacactaaaaaacaagcagtgtttttagctttctagagaaggcaagccaagtttgagtaaagataggataagtccccaccaaaaagagaggtggtgcatgtggtatccccttgagatataaaaggaggaccttgcccactgagggaggggagaaaaagaaaaaaggagagaggatctggagagtagatcccacgagagaaaaaagggagaagagggtttctagaggaagagctctctggctctccagctctttgtagcttcttcatacacagatccaccagaacacaggagtagggtattacgcttctcagcggcccgaacctgtatacatcgcccgtgtcttgtgctttttccattctcgcgaactttacacagactaggagcttagaatctcacccagggcccccggccgaaccggcaaaggggggcctgcgcggtctcccggtgaggagccccacgctccgtcacacaggaagcccaaagttacaagaagcgcgacgcctacaaggccaagatgcgccaggaaatcacagatcaagtcacacaacaagtcacccaacagttctacagtcttgccgcacaacatcctcaagccttccctgacctggttcctcatggttcgcagtcgacacagatcccaagctctgtcgagtcggttgaaaatacaacctacccggtagatagtataactggtccgacaccgtgcaaccttgtcgttccgatagggagagcgggaaaaacaaaggaggttgcgtctggattggctatatcggggagacagttccataatagctcaattctggtggactatgcaagggttcaggtcgcacgtgttcatggcgaccagatgtcgttggagcttgacatcccaacaccagaggggattgaacttctcggggatgcggttaaccagttcatactctggcatcgtcgtgacatcatcctcactggacagttcacgttgatgacaccagctccattggtgccaattacggctgcacctcctgcaccaccgtcccctccgatctgcactaccccacccggatctccactcccacagatatcaccagttagaggtccctctccacctccacaacaagtagcacctaactccccaactaccctacctcggcagccgtctcctgctcctcagtcctatcttgtcccaccccttgacgaacatgtgccacctccacagccagatacatcaaaggagcagccaaaaacctgtgaagcccgcaagctcatacccgttatagtatccacgtacactaaggagaaaatggcagagtatgagacacggatggttttgcaatctttcaagggtcgagggggtccgctaaagccagttggacctgatcagtattcggacgcacagaagagcgttgtaggtcttgctgacaaaatgcaatcttggacctccgatgaagtgcctaaggagtatgaatatggcaagccgtttttgccgttcaacttgatgtgtgaactcccatggccaatgaggttgatgcatgagtggtacttgagggcaagtgagttaggtctcgggatgattactgtgcatgtcccgggaggcgctttcaaggatggacctaatgcaaacttcgccttcagtttcaaggacctccacgcattccttaagatggataaaatggatatcaatctcgtcggcgcgtggtgcctgtaagcattgcatgtacttcgttattacccaatgtgtgccaatataattgttacttattctaacttccaaatttcctcaggtcacaatgggtagacgctcaaaaaacgggggcctcaatcggttacgtaaatccaacgatggtttgcgagacggcccacactgtgcggatatcggaggatagtgcggtactaaagaataagacacctcaggaggaaaaagattacatcgagcgtctgcataagagaaagatggccgaggtgggaaattacttggccacctcatctctcgcacactccgacaaacaagtcatcatggtcccctaccactttgggtaagcaacttcgacatatttccgttcacatattaataacagcacatgaaaatatgtctaacataatttcataatccgtgttcgcagcgaacactacatactattcttcgtctatccaacagaccaaaccgtcgtagttcttgatccagcggaccatgacaaggacgcgtacatggagttcctatgcttgttgaacttgtaagttcgaaacaattttcgtaaagattccaactttccgtaaagatcattaaagtagatttatcataagtaattaatttatttttgtagagcacacggccgttataagaaacatggcgggtacgtaaagaatccaagtagagagaaattgtacataaggggacactggccggtatgtcagcatttattcggtacgtacatcacgattgtcacttcttatttctgacgtgtccacttatgtatgcaatgttataagcaacctagcttgacaaacctatgcggttattacgtgtgcgagatgctcagggtcaatgggagatacagaactgagtttacatatgtaagtcattaaactctcctattgcaaatagttcattaaacatgactgtaacacaaatcatttgtcttttaatttccgtagctcccgagtatcccttatagtgcaagttggttcgatcagagaacgcttatcaacttgtgcgcggacttgtgccggttcattcgtcgcaacatctgcaatcatctaggagagttccatgatcctcatagcgtacttgctacggaccccaaattcaagaatctaagagagtgggagaggcaacatgctgtggactaaatggatgtatttgtcgcgagggatgcttgtaataaacactatactttctatgtaatatgatttaatttgatgtttcggctaattttccactaattttccatctattgtcccgtgcgggccacctaatttgaccacacgggaaaatagattatcctgtgcggtcagccttactgcaccacacgggataatagaatatcccgtgcggtccgtataaccaatccgcacgggataatcgattatcccgtgcggtcggcacgcccgcacgcgaaaataaagattttcccagacgatgagctgcaggcgggccgggcgaccgcacgggataatctatccaaccgcccggaaaaatgggtattgtagtagtgtattgttcttgctcttacaaaaaaaagccctttcttttcctagaatgttggaccctctctcttggagtcataagcgaagtggcatgataagatgaagcaattatcattccataaatcttgtgccaaaagcaagcacagaaggtctagataaagctagccatacccacaaatgatgatactacccgttatgatggcagaaaaaatgaacatatggagaccgaagaggaaaattaagagacccatagataagagaagggtgaagagccaatacggtccctgaagtttcgcttcgggctcaggatagtcctcgatgtttcaaatcgtccaaataagtcctccaaattaattatttgggtaaatatagtccttggacccacaaaaaatgccgggtgagcatgcggagtcatcatcgcgtgcagcggtatgaatggaatgaaatgaccattctacccttatataccatatggaaaagaaagaaaatacaaacaaaaaaaataacaggctatcccaggccagcattgttgcggatgggtggccgacaaaggaatttacacgatcaatgcttggctgcagcaatcgtaagtgacaattctaaaatgatcatacatgtgtgaatcatttatcttcttcttttctttcttttctatatggtatataagggtagaatggacatttcattcataccactgcattcaaggatgacctgcgatgctcacatggcactttttgtgggtccaaggactatattaacacaaacgattaacttggaggacttgtttggacaatttgaaacctcaaggactaaactgagcccgaagcgaaacttcataaactgtatttgctatttgcccataaaagaaggcgaaatggcagttgaggtgtggtggaagtgatgcatgcacagaggcttacaccatttgtgggtgagaaaaaaggaaactaatgcagagaaagagaagaaagatgagagctgccaacagtcttaccaactagataaaaagaggcttgagttatataaagagaggctaatttacagttgaagagcatattagaagaaaagagatcaaattatgacaatagacattccttctatgcctatcccgcagcagctgttctacatgtaacttttgttagtagtagcaactagctagtttttaaaaattgatcatgcacaatagatataccatggctagctagctagctagctagctatataaaattctctcagatgaccttgcaagcactaatcagggtatccattacccatttgttatgaacattagcctttttgttgttgttgcttactcataaaggtacgaattgattttcttttttctgaaaaatgtcgtgcttctttgttgtgatcaactacttcatcttcagtgacagacccactatgtgtttaggccattgacagagtgcgaatggctatgcacaattttgtggtgtggcaaaagtgaattcatcaacgacgtcggacgatgattcgtcaagtagccgttgaaataaggggcaagaatgacttatcatggagaagattgccaaaccgttaaatatcagatcaaattaagatttttgtttctcatgacatcgtcagatcaaagggacatctgttaacggcatgtactgctaatggatcgcatgggcccttccatttctccacacactggtggcaatgtctaccggtgagtagggatgaaatcagttcgaaaagtttcctgattccggacgtgttttcagaaataggaagtgttagtcggaattttttcagaaactttcgaaaatggacccaaattcagaattcctttcttggaaaaaggaaatgaattcacaaggctactatatgttggaaaccggaatccattgtaatatttccagaaacgaattcggaaactttcctgaaacaaattcaagttttttcttggatagattcggaaataaaaaaaattgtcatgtacaactgattagctttagctttctgtactctaaatgtttagatttataccatatgtattaagatgcttaactaaatagagatattttcatctgacctcgatcgttcgtgcacagaggtcaccgaaaaaaacaccgatcgctacctaccgtaaatgtaagatcattgcagcgaggcaatgaccgttcccacgctagtgcttatatgtccatttaactcattatatctctgttcaaaatgggaaacttttttggttttgctatatttcttgcggcaaatttcttggagaaaaactttcaatttttggaccactagatctgctccaagattcgtggttttgctagatttcttgcgacagatttgctggagaaaaacttttaatttttcgactgctagatctactctgagattcatggtggcaggccgtggaaaaatttcagcaaatattcgataggaggatgatttgagcacagaacctccagcaacttagctttaattgctagccaagttacatacaatttacgatataattacaatatagttattagcatgtagttccatttgaaagattgttttcctaaaaacatatgacagaattttatatacttattttttggaaactaatttttatccctttcttggataagttttaacacggcagtggcatggaaggcgctggtgtcgatggtgctggtgcagattttcatcatggatacgatcccgctattcaaggtgtcgatcgggtgagttcactctccaagctggagctcgacatcgacgagcgccttgaccacctcaacacctcatcttccacttcctatttctcctccctctttattctctaatctgctgacagctggcgaccgagattgccacggttgaaattaatggatgagccttatcccattcgaagatttatttttgagtaaacttcacaaaaccccaggtttccccaggttttgagacaccaacaacatagaaccttaggtattatgatttgtttcgagaaacactagattttggtgcaaacttttttcaagaaaccctatgtttacatcaaatactcataatttcattattatgcatgatatatttagtatatgtgttcacattagtaactcaaaatatatatacctctttgtgtactttatcttcttcctcactcttgcaataataccatttaaaaatcgcaacacaaccccttaataatgatacattaaccagttacttatacacagccataataccaatgctcgctaaaataagtccaacacgtatatcaggaatatctcatattattttttacaattattatgcatacgtatattagtcaaaaacaatgatgtaaggttaaacatggggcttcttgaaacattttccccaaaacctagggttatttgaaaaaaatcttaatgcctggggttttgcattacgggtgccttaaaaccttgggttttgtgaaatttactcttaattaattttttttcttttgtaaaaatcacaaaagctcaccttatgtgatgacatgcatatgatgtttagttccaccttgcctattgtaggagagagaaacctccttataagggacggtactctcctagccacttgatgcatgtgtggtggagagaacaagagaaatactcgcgctcgtctcgcctggcctggctaggcggcgcgcgtacacgacattcgcgtgaatggttcctgccaaaattcgtttctcatccttgcacagatgtttcctttgacatttttgttttgctgcgaaaatcggttttgattttggaaacaccccgaataatncnnnnnnnggggggggccttnagtancatgnnnnncaggnnnnnnncnngngnnnnatctnctnnnnntncncnnnnnnnatntnnnccntgcctcttgatcacgcatgctaatatctctataaaaacgagccctcgcctccttgcaatccacgcggaatcaattaacctcctcctctgcaatgcgctgtctctcgtagtttactctgacccgctctccgcgtgcaccggcgcttgggagagctggtcttcggaaccttcgccttcaacgtcctgcgctgggagaaagcgacattaaggtttttgggcaacgctttgtgagactgcttgttgttcgtccaccacggctcgtcttcctcttcgctcgggtgttgcgcgtcatcatcaacgttcggtaccgcgagttcttcctgctgtgcagccgaacgtccagaacgcttggtacgcattcatcgtgtttcgtatattcgatctgttcatgttttattgtccagtttacatgtgtagatgtatatatgatccgattatgctagtatatatgttcaatgtcgttatttatttataaaataaattaaatctagatgtgcttatattttcaacaaccaccacctcgtcaggctcccttgtcaccactgccactttatcaatttggagctccccttccacctcctccaccaaaagctcaatggaaagtgagctcaagatcgagcaccacatcccgattcatgtcatcaagtttcatgtcatcgtgcaccgccgtgtcgtcagaccttagagagtggcagtcggtgtgtcagcgaagttactcctgaccggctctcccatatgcactcaaaggaagctacagtctcaccggagactacgtggaggacatatctagagggtgccagcgtagaggatggaatagtcaccaacattgcaagcagggaggcacgggatacgctattccacaggttccacctctccaccttagctcctttgtcgccgtggtttttctcccgagcagtgaagcccacgccattccctgctaagatgaggtctctctcttatgggagaaata

SEQ ID NO: 59852 - DNA, 8916 bp, Oryza sativa
cccatatgaacccctctagctctctttggttatatcctgcataataccttctcttccagtatgacttgttgagtatagtgggtagtactcagtcttgcccggtctctcaaccccagagttcgagtatgcgtcagatggtggtactcggaggagtaggcttcgtccgtcgtggaggacatatctagagggtgccagcgtagaggatggaatagtcaccaacattgcaagcagggaggcacgggatacgctattccacaggttccacctctccaccttagctcctttgtcgccgtggtttttctcccgagcagtgaagcccacgccattccctgctaagatgaggtctctctcttatgggagaaataaccaattctcccatcactacttttgtaacatagatagcgcactataggtgccaaaacaactaaaactagaacctttaatttattataggtgccagtttttttaaaaaaacctgatacatgtaaaaatcgagccgagccgactgcatcatccttatccactcgcaacgacgtcgcccgtgcggataagcacgacatgcgcgagcccacctctctcgctctcgtgagcccctctttctctctggcgactctcttccctctctctctttgcccctctcctcccccacccgcgagggccgacggcggcagcccttctcacccgcgagcgtcggcggcgggctctctctcacggctctccctcgcgagcggctgctgttagatccaggccggatccaggcaatggtgacggcggcacgacagcacgacgacgggctccccaaccgaaggcgacgggggcggggcgccctctcctctgctagatctagcgggagggaaggtggcgggctccctaagccgactccactgtcgcgcgcttctcgcctctgccatcctccaccacctcatctccctcggcttcatcaacgtggtcatcctcactcacgccgagctcgacctctcccagcaggccgacgtcaagtccttcttccccgtagagctcccatgctacgtcgtcctcaccaccgccaaggtcggcggcatccacgccaactccaccttcacggtcgacttcatcgctgccaacctccagatagcgatgtaagcggggcaggaaagcgagtttttttagcccgcttatctcagttatagtttaatttttcttccatattttgtactaccatataggacatgaactagtaagcgatttttattcgggtagcgggactacccacttgcattcctacctccagatccagtgaatgtttgagttcatcctttgagtttgagtttgattttgattagaagctctgctaagcttggcttgaatccaagccgagccccgagctattttctttttttttcccttgttcttctgtataggtgcctgttcatgactaaaaccggcagctatatatatattattattggtgttggttctttaattagcaccaatgaatgaagtcatccgtgccgcctgttgggtgacagttgaatcatccagcacctaaggccgattcccaaccggcaccaatatcatttttttaatagtgcatggagtggagacccgtggcaacacgtcgctaacttccttaaagagaagtcaccgcatctccatgcgtagagagaagttgatcgttgctgataggtggttgtggagtcaggagtgagaatagaagaagacgaagattgtaaatggcatgtgggccttatatttttattttattattttcattgattgggtgccaggtcagcgccctcgtagacgaaaaccactatggtttttaactagtatagcaatttgaactgttttataagttgtaaagtgccgtatacccgattttcgtgcgcgaacattcgcccactaaccatctcgcgaatggcgtcgggacgaggaggttaaagacgtgtgatatccgttcttcccgttttatccttttatacgtgatcgttttggtacgtttttttttgttttttttttcactccctggatactggaacgtatatatctttttctgttctttccgtcgaatcttttttttttttcaaattcgtttttcattagtcctttttattttagtttttaacgggaattttatatgaattactttttttgcaaactttgtacatatgcatatatatagactttatataagtaaagtttctatatgtagacttttatgtatgtaaattttttataagtagactttatatatgtaaaatttctatatgtagactttatgaatataaactttacatagaatctatatctacacttaaaaattttaatacgtcaatttataatagaaataaaaaatgctatgagtggactcggtgttctaactgaagaaacaaactcttaacggatcgcgcaggactaccaaagcaaactaccaaagcatgcatgcgggagtcagaaccaattcgcggacttggggaaacgcgaacgttcgcgcattggactcacccgcatctaacagggctatttaaattgtggggtcatactaaagcgcacccagcgatctagtataaagtataagcctatatcgacgccagatcgagttggccgtgcgggcgcaccagatggacatcgacggcgcgggcactaaggcggcagcagcgggatggaaggcgccggcgtcgatggtgctggtgcagctgttcatcacggggatgatcatgctttccaaggtgtccatcggcggcggcatgttcatcttcgctctgctcgcgtatcgcagcctcttcggcgccgtcttcatcctcccctttgccctcatctttgagaggtttcttgtttcctactcttattcgcatgcaggccagaagaacattattgcactaaactagtgatggggggttaatttagggctcatctacggcatttagatggccatatatatagtagtttttaacttaaattggaagtattttagttttcgtgcaaccaaaaacagcgtttttctagtctagttgaaattgtgaatcattggatgctatggataacgccatgcgtaaacttgtggctcaatgatggataggtatcgccagcaggtatcattagcagtctgtaggatatgcatgcactgtaaaaaaacaggtgccgtgatgaaaatatagattctatttttgctaaactttgttttgtgtagagggaagtggagggacatggattggcgcgcattcggatggatcttcttcaatgcctttatcgggtacgcatatatgtttctgaatctgaagcttcaaattactgtcaagtttccattatttatacatcctccgaataaaaatgtactcggttttaacaaaatatactagatcatatactagtattttggagaacctcaatgaccaaggaacgagcggcctgagtttaacaaaaatacccatgatgtattactcatgcatgcatttatcaatatacctaatgttactgtaggcatacgtcgcatatacgtaatccagggctactatttgggattttagaggtaaacatcacataaatataagtgcttcctatactatatgtgtgtccttttaaaagacccttagaactatactccctgttcgacaatacctattattttggacaatgacatgattctcgaaacatagtttgtttgggattttctattgtagtgcacacaataaataaatatttgattttgttaaaatatttttaagactaatctatatattgttctattgccttcaaaatgaatattcaaatgttattgatactcaaaattctatacctcaaaaacaccaaaataacacacaaaaagaaatatctatcggttcttttgaactcagaatatggaaactacactactagacaaaaaattttggtgactgccccacactcttgttatggtcatgctgaatagtcatgaaaaacactctctcgccacacaagtgtgtcacagcatcacaaaatttagttgttcggtgactgaatggattatgtagtcacaaaagtttacatgaaaattatttagttaggtttaaaagtattatttataatattggtgacggttatatttcaaagctgtcaccgttgatcccgtaactgatttaattgtgacaggctgaaaagaaaaaaaagaaaataccagagagaaatagattattagcttatttagaagagttcagctctgtttctctctccacctcctcattcctctcgttcccctcctctgctctctattcttatcctagagaggattcgatctccccttacagcgatgcttgtcactggccgcgtcaaccgttgagccgccgcgtgttctcctcatccgcgtgctattagataaaaaatgaattgattggccaaatatgtatggcaaaccaaagtagctgtatcaaccgctgaattgaaaaatcaagattataacaaaataccaactgaaactatgggttgtcttgttccatactaaaaccaaaaccagagtttgttatagcattaaagaaggtgacgatagcgaatgttttgctagtagtacaacttgtattttgatatgcttgcgcatacaaaaagaattcgtaacgaaaggctgtcagtctgtctatctctctttcttaattatattatagtttaatatataatttgtttttcatttattttaatatttggtagtatgcatgtctcctctcgttatgagtatataagaatatttcgaatgaatgaaaacgaacaaaagcactgcatgataaataacagaaacttagcacatcgcggcccaaacgaaaatgagaaactttatgagcttggcattccgatatagtgccagtgacctcttggtttcatttcagttgtgtcctttctaaagtctgtgatggacacgatactgccctcagtttccatcaattcccattgtatgcattcggcctcttgcacatcttgtcacattcttccagaacaattgtttaaaatgataagcatacattttaatttaaagaaggttaaagatattcttgattcgatatacatgctccgatattcgtttcaaaaaaaaaatcgtttcaaaaaaagatatacatgctccgatatttctttcaaaataggtttggcaaagcatagaactaaatatacattttttaaaaaattaaaatgttcaaacttacacctcttcactttggtgtctgtgtagtctgtaactctgtatgaataataagtcaacttaagattttacggaagcacttaatttgttaggaggattgcttcaacggcaaaaatgaagctactagatccatccaatagctttgctggaagatatcttttgcacaaacctcgttgagatcttcaccagaaattatgaaatcatgatatgttcagttgattaccatataatagtaattaacttaattctatagggatacaaatgggacccggatccattgtctttaggcgctaaaggcagagatgctgtctagcactacaaaagaaaacagtgatttgtatttattcactgtagcaacagcgtagagcaggaaactgaactgtaccatgctactgtttattttgtacatcgatcttgctggttcactccaaagtcatggtactaatacacatctgatttcaccttgcgatatatatatttgtctgttcactgttcagagacgctgcgacaaagaatctttgctctaataagatactcactctgtcccatataaaatcaaaccctagcatctcaatgtaaaattaggagagagggaaaatgaccaaaatacctcttattattaaaaaaatagtaatgatgataggatgataaagggtattggagaaattaaatttctcattttacgtgctgatagtagataggatggtagaagttggtttttcgtgggataaaattcaaactccagaggttgattttttttttttttgggacggagtgaatagaaatttactgatggcaaagccaatttggtgaaagactgttacatatataggagaaccaatttgacagtacgtgatcaataatcactttagtgttgaccagttctaattaattatctgagacatggttttcatctttcttctcacatatcaaactatgcaggtatgcagttccaatgagcctttacttctatgggctcaaggacaccactgcatcctacgcagtcatctttataaacatcattcccctattcgccttcatcctctcactcatgttcaggtaaaggttccatttgcaaggttccattcgccttctttgttgtgtacaatgtatttcaatacttataggttccaacaataattgttaatagattttattacttgagaaagtatctttagttatcaaaaatttaaactaaaagttttggtaccttagggtacagggttcctagtatctcgggcttagatattaagttttacagtagaaaacataatatcaaccagtatcttcttaacaatggtaaaattagctataattatttcatggaatgaaagtaatgcacttgatagtaccatggcaagcagtgtgtgatttcaatcctcatgtcccgtgttcaatctccagcatgcttacaatttctcttaagaaatatttggagggacgtatctccctccaaatctcgtttttaatttcatggaatgaaaaaagatgaccatttttgggtaaactcgaatggtgttgcaaatatatgatctcactgaatcatatggatatgctgtatcaacatatggcagactggagacattcgaaattggaagcatagttggggtactgaagatagtgggtgttctgctctctgtgggtggcacaatgcttgtcagcttatacaaaggcaagtcactgcatctctggaattccattttgcagcaccaaaatgaaccggccacaaaaactgcaaccaatcagctaagagggacaattttattggttgccagcagctttgcctatgcttgctggtaccttgttcaggtaatcacgagcaattttacagttcttaggagataccactttttctattgcaaatttggtacctcttagtacctaaatactatgagatacaaaaatttacactaaatttttggtacctcctcaagaactataaaattgctctaatcacaaacttaccttttaatagaaacatatatactagaataatcttatgctgatatttccatgttgtaactgtatttgcagtcaaaagttctgaaagtgtacccatacaaatattggtcttccatgataacatgcttggttggaggatttcaggtagcatttgtcggaatcatattaaggagacataagagtgcttggaagctaggatgggatctcaaccttgttactgttgtgtactcagtatgtcttcaaaccttcctagttcttgaaattaacttaactagaagctacaatgagaaaagtataatattttgtttcctattcttggggtgtccagtgtagcttgagttgtagtattaactaatagtcctggagttataatatgattttgaaggaataatgaattttcatgaaacacaataggcctaattgttctacggatattgacatcaaaaccactttggtgtagggtgcacttgcaacgggcgggaaatatagccttaattcatgggtagtggctaagcgaggtccagcctatcccccgatgttcaacccactatcagtggtcttcactgttgtgctggactccgtccttatgggggatgatgtgacagtaggaaggtcagttgcaatcatttgtactatctatgatgcatgttcggtatttccaacagaaaatgcatgtcaacccattatcagtggtcttgctaagccgaatttgcatgacacccaattttacatacgccgtgtttagtttcaaaataattcttcaaacttccaactttttcatcacatcaaaactttcctacacacaaacttccaactttttcatcacatcgttccaatttcaaccaaacttccaattttggtgtgaactaaacacagccgtagcctaaaaacacattccaaagtggcatgcatatttctgacagtaatggataattatctacggtgaacaaccaccattacacaaatgggcaacagtgaacggtattgaccaggcactaaccaagcggcatatcattgccaaaagaaaaggctcgaaaaatgatcatattttacctgatatatattgggtttggaagtcttgatgttttatctgatatgttcggcatttgaatctgaatatctctctccacgcatggcttacgtagcatcttacttctatctaagcatagcttttttggcatctaaggaaacacatgttttcttttaactctaatagttcaaaaattcaaatgcatatttgagcctctatataacttcaaacaaaaaattaatcagatgtatagtagatataaacaaattatacagttttgacataaaaattatctccaaccgaaattaaaattttaaaaatggttttgtttttcatagaagatctcaacacttctaacatatatcttggcatgtaaaagatctacaataaaaagatcataaattacaaggttatatatctcagcaaattctacgatttcgatctaaagcttgtcttcatccaacttctccatttttaaaaagaaaattcattatgatgcttccgtacttagtggagaggatggttcagtcattgggcaggacgactgtatgctctattatgtaacagaactagcgatgatatattagtgctggttcataacaagaacctagtagtattacggccagatataaaggaacaggccgtgatgggattgttacaaaggtcatttctgtagtactgaacaacaaaaagaaacaagtgacgaagctggtcatgtgagcagtactttaatattcgaccataacatttgatttagttgctctcttattttgaatgtgcagta

SEQ ID NO: 59853 - DNA, 7216 bp, Oryza sativa
agaaagcatgttgccaatatatggaagatgatataagaataagcgataattcattattcatatttgttttgtctcagtacagttctacagttttatactcttgttatgttatcgtcagcttatcttttaaagttttaattttgaaccagctgtgttctatcaaattgtctctctctatatatttttgtcatagtcaatttgagagtccgtaacaaagttctatcaaattttctctgtatatatatttttgtcgtagtcgatttgatggtccgttacaaagcaaagggagtcggaaacttggctagtaattaaccttcatattgtaaaacacctcattattggtagttagttgtttacttatttcagaagaactgcccccttagtagaggaaaaatataaaataaacttgaaaatataaaataaaggtcttaataaattgatgctgatcggccttggacaagtatgtactgtagctctcttcaatgtgctgaaaaactacactgcactccctccatttcttttttttttttgagaaacacagtacaaacgcaggcgctcacaacgtgcgcactccactccctccatttcaaattaatggaagttacggatttgtatttggtcaaatatttttatctttgatgatcgaattttataaactcataatatttcgtaacataaattcacttaggaaaattttgtatggaaaatttaaaacattttgaattctaaaatttttgtgaacatgcctgtgggacaccccagattaaatattatgtaaactattcgaaacgatagcttagttggatggggtctcaataaaactcaaataaaacagtaatcgtccaacctcatcgctgccctatcaagtcaaatagcaaacatattatgtaacccaaagaatcgcgtagagagcataggaaatattactgggactccacatgctagttaactttagcctgagacatgcccgtcaaaccacacgaaggtgttgactagatgttttacacaactcgggagacttgacaaattgttggagctctacaacatctcaaatgctctaaactcatactcatgtgtaactagttcctacaacaagcactagtttcacattttcatctaagcaatgataagcagaaatagggcataaacacaaattagaactcaaattactaccggatgtaattacctaggctgaccgaacaaatatatatataatgatccgcagaagcttgtatactagttcccacaagcagcccctactaggggtagacacctaacgaatcgagtcctagaagaagtcggaacccgaatcactcaacttaagtcaaatctaatacctgcaaaacaagatcatatactatgccacacatgaccgcgagtatggctagttgaatagttttaacaactttaccaacataatgtgaatcgttctagtttgtcctgtacccgtcggtactagcacactctacacgttgaatgtggtctagaggtcaccacgtagcctttatattatctaatgcctagccttgcaccagaacggcaagtgtgaccgttaggtggtgggcctacgccttgaacataacatcgtggcggcaaacgcatctgttaccccatgaggtactgtactgttatattgcacaaacttagatgcctaaactactattaacagtgaaatttggcaagatagactcgaattggagttggatatcaaagcggaatcgaaggagatagaatcttaccaaaaatggactgcgcattgactgggcagcgtatcggctggaaacagagttggaatttggttgagtcgatatggcaggtagccgatacagctctacttaggctcagtttgggcctcgattgagataaccgtcattgccgtttagagatatagttcatttaaggcagttgtatctattaattagaatatttatgtcggtttgagttagagatatggcaagagtctgccgaatggatttgtttgtattttctctttagaaaagcttgagtcgtgtccacaatgaacaagttttgtactcggggtataaatataaactccagaccattgtaataagagagagaatccaatcaatacaacgttcagcgcattgccaccccttttcttttacttctcgacgagttcttgcttcaagtcggagcatcggccatgaattcttggcaagaagtaacttgtctcgatggctagcgctatcggggctattatatcgttttagatgtattagccctttgatcgtgaccattgttatcatatatcttagttaatctagtcttagtatcggtggggaggtggtacggtggctactactccagatttggtgcaagagataaaaaggaaacatattttttaacaaatccaatatttctttccgaaacaaaccaaaccaatctaatctaatctcctccttccatcctacacatgcgcagtgcaccatcacggatacaaccacgggacatgatacaaccacacgacaaaaacctagatgcaactccaaaactgacgaacaaaacttctaaaaactacaaaaatcgaaccctggcggtgagacgagtccgttttcgtaggtcttgacgacaacaaagacatggcggcggtaacaacaatggtggtactagatgtgaccagaactcgaaactctatacggaactgtcatgcccagaaatttccgaatagaattccaagcagaatgtgcattaaaacccctgtccaggaccggccagggtacacaaacgacaaagttgacatacagatccacgacggaaattaaaaacattccacaggcatataaaaatcttacataaatgcaacggaaattaaaagataaacttgagctagatcttgacttggatagcgggcgacaccattccacgggcatcctcgacggcacggacgaagcctactcctccgagtaccaccatctgacgcatactcgaactctggggttgagagaccgggcaagactgagtactacccactatactcaacaagtcatactggaagagaaggtattatgcaggatataaccaaagagagctagaggggttcatatgcataaagttagcacttaaaagcagtagttgagagcagtaaaatagatgtagtaattaatcaatattaatcatcgctgctctacgctacaccatgttgagatagacccaaaccactacctgaactaaccagatccattaagctatactaatgatgtgactaatcacggtgaatctggttgacccctcataaccgcgggtacgactattcgaatagttttactctgatcagaggtgtacaactgtacccacaagacacagccccacgacacgtttctgtgcgccgacatgccaccatgacataccggaaagaggccgtgacaggacccttcgcataagcccctctaaccaagcacaccacacctcaggttttgcccccactcctcatcaggcagcgagcagccccctctcgtgcctaagcgaatcagcaagtcgcataggccatcgcagggcctatccgaacaccatcacgctcacccttgcctggatgcgtcaactagaggaaagctacactacaagcccagccgttgcccacgctggcttgtggtatgtacggtaagttcttccagggcatccctcaaaccggtccttaattgccatgggcgcgactagcaaaaccatgcacccacaacccaccatttagtgtatcttaattaattaacaccattgcggtggtacaagtccaaagtcatgctaataatcaatgtctaagcattaatgcaattccccctttgtgtactagttgaactaagcagggctaagcaattcctaaaccaacatctaaacatgttacatcccaagttatcaaaggaataaggcataaaaatgataaggctgagaatagtaggtaaatacctcatacagtgacattataaaacaatgcataatttaaaggaaaagtagagcatttgaaatataggagcaatatgttcaagtgacaagcatgacttgccttgctatgctgattggggggggggacctcggcgactatctcaaagtacactggagcgtcggaagagccggattctacacgatatacaaggaaaacaatgcaaataggctataaggctactgaaacagagaacaaaaccatttttaatggattcttttgatttttctgtatatactgagacttcaatggacttaaacggagcacggatgaattttctatgaattttagaaggtacactgtgttttattactataacagaaaaaccttaattgcattattccgcattaaatgaccctggctgatgtcatcggggggaggggggagggtggcgccgacaggcggaccccacctgtcaaaggctcatgggtcaccagtccacgttgaaccgggttcacaagaccggaggggagcggcgcaccatgaggcgccgatgtggcggccacgtggacaaccacgcgggtggaggacagacggccctgatctaatggatggtaggccggacggcggtggtgcggcgcggctggggcacgcacgggcacgactcaagccagcccggcagccatggcacgtggcggcgcggggtcggccactggcggccagcggcaggtgacgcggagagcgacggcaagagagggagaggggaaaggaggggcgtcctcaccgtgaggttcggccggcgcggagggaggcgacggcaaacggcgacggcaacgggactgaccagcaaaacgagatggattagtggggaagagggagtccacggtgagcgaggacgccggccgaaggcggcggcaatggcgaaactgactggcgcatggggaggagtgggctctggtggtggattccgacgactgagggatgaacaaggcggcctttgttagcggtccttaaatcataatatctgaccgtcaatacttgcatataatgcaataaaatatggtatccaacttagtggtaggtattattactaatcatttccactagtgttggtggaatatgtgtatgcaggtaatttgaggagaaaacacatccgtcatgcgaaaaaatgcacctatgcacattcaggacacgtttacacggattggaggccccataagtctatgaaaaccatttagaattgggccaaaacatagtgcaggttattggtggcccattaagcagcctactggccaaaggagaggccgggaggacactttttgggttcggccgaacccaccagttcgaccgaacccgttctggggcctcccgccatctggcttcacgtggacagctcggatctcttcctaaaggcggttggagggtgttttggacaattcccatgcccctaactgtcatttgaaacctatataaggaggtctccatctcacttcaagcacacacaacattgagctgaattacaagaggctctattgtatcttttgtacattagaataaggtagggagtgaggagaagcttttgaggagtgcccggaagtttggcgctcatccgacttctacctcgacgagtgtagttttctaggaggaattctggaggagtaccggagctgtcggtacactctgctccgggttcggagaaccttcttctattaagtaagcattcatgttcctttcttatgttatttaggctgtgtttgctactgaaggttcccaacccatctccctcgttttccgcgcgcacgctttaaaactgctaaacggtgtattttttgtaaaaagtttctgtacgaaagttgtttaaaaaaaatcatatttatccacttttttaaaaaaattagctaatgcttaattaaccatgtgctaatcgattactccgttttccgtgcgcaatgtcacgcccggaatttctatccaaaattccaaacgcttacatgtgtgtgaaccctcgtccaggaatcagccgaggcacacaataacaaattgataatagagtacaattattactctaattaataagcgaataaaatgtcattatagaggtagatagttcctctcaatcaataaagatctaagcagcggaaaataaaataaacggcgcagacggctccactccacaggcagcttgaccaaggctacacctaatcctccacaccatcagcttcactgtagaactcttcatctgatgaatgattgcaaggtgagtatatgacatactcagcaagccacgcagcaaatatgcaagtgcacaggataacaaaggatggcatagtagggtttcttttgcataaacagcctttaataaacatttcagaatttaataaaacagttaagtaataattaaacaatattaatccaacgctatacaacataccctgttgtataggcccaacctttctgaacaaccatacccggctgtatagatctatctccaaaccaggaatataccattccaaaccaggagctaatcagattattaccagttatagtatcttctattatgatgagaggtgtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaaaaccccttgcataacacaatccattacagcgcacctttcctggatcataatcactcccttataaacaaggcatggactccccagcgacccccgtgggcttatctccaccacttctcagtctggtgccccgcaatgaaccatgctgtacaaaagataaagccgttgcccatgctggcttgtggttggcacggttaatgtttcacaaccgaaactcgtgaaccggtccttaattgtcatgagcacgactctcaaaaccatgtgctcacaacccaccattatcaggttttagttggcacattaattaattaaccaatcacgattgaccatcgtgaactatcattaagccatcattaattaattaatagtgaatcataagttatcccaatagtgtgctaatgtttctaagcatggctaagcaatcacacctaatatctagctgaaccaatatatagagctcaactagtcaagttataataacccaaggtatcaaggaataaagtaatcaagatcaaaaagggctataacaaacaataggttaattccacccaatgacattcgaaaataaatgcagtatttgaataga

SEQ ID NO: 59854 - DNA, 8890 bp, Oryza sativa
aacagttgcttcctgtttgtctgagaagacatcattcacataccgcagcacaagagatgttttgcctactctccctgtgccaagagaaaagtaaaagttattgtttgtgttaataaatatgaaatgtattcaatcacatgtcttttcaatgaaattgaaaaaatggagcatataattatgatcaattcatcctaagttaaacttaggtttatcagttttcacattgataggctgggccaacagaggactggttacaagacagcctaaacacctcttccattaaaaatctgaaatcaatgacagaaagttataacaataagcaaaccctaatgacccaacctataagatacatgcccacaagactatcaacaatgcttttatgcatggaaacacatatatatcttcattcaaaaaatgtaaagccaagtactaaggcatggttaaagagtttcagcaattgattatgctggcgctatcacttatcaagtactgtctactgtggtaaaaaattctttcattgtgctcattgcctcagttcaaaactactccaacttttttcttttccaaaattgaaattagccaacttcaaatgaaacgtgattccgctttggcaatgcacaaactgatttccaagcttgcttctaagctataagtaagctgatcctaaatcaaaatgagtcaatgttcaacaatgctaggaaaagcaagtgtaccatgttagatcaatgcccacccgtgcctggtttcaagaaaaattctcttgacattcccatgtatgacttacatgcacttgctaagaagcatgcccaaataaagactgtagtactttcccatcaaaaccccctcctcccaaactacatactgtatcatttttccaaaaaggcacacatcactttctctagaggaacatgggtaagacccatggcatcatacacagatgaccaaaaagctgagtcatactgaattttttttttctaggaccctgccttcaagggttggttaaggtaatgacaagaaaagtaaaaccaccaattaatatagaactagatcagctggacattacaatccaagcttaaaagcggacagagagcacggatcaaaatgaaatattatccacccctattgcataagacgaattccctgccaccagctccatggccacccttcagctgccactttgtgtccacatgaatttgcagcagtccccgctgcagctagcactagacaaatcttctatataagaacgaatatgcttctacttgttagattgtttctatgagtagccctctcggtctaatcatctcctggactccgctaagcctcgaaggcaatcaagtaaaaggtaagcttagctcaaaaccgctcaactccctcgtctaagctatagatttagctacctacacagggtaccagatcaaatgattctgcggctttcccctaaccctagctagggctcagcacgcaccacaagagcagccaaaattcacccagattccgtggctattttcttgcgcacgccaaccccaaactgaaggatcgggaattcggcagaaaagggggttgagaagggggggaggagggttcgcgggatcggaagggagagggagatagccgtaccgtcgccgaggaggacgagcttgaaggagacgctgggctgcggcggcggcggcggcttcgagcccatcggaggcgaggcgaggcgagaggggttccgccggaggctcctacgagcctctagaaggttccagaaccttccggatcgcccgtcccggtgttgcgtgtgtgctgtggtcagagaggagaagtgtgggagacggggaaaacgggaatcgtgcggcacgttacccttgcgcggagcaaggctcgggccgggccggcccgggcttggagataggttgctggcgttattttcataacatggatgctaagcaatattattaatattttttttctaaataaaatgattggcccaattgtcacactcttctcctataagccactaatgggatgtttagattcaggggtgtaaagttttggcgtgtcacatcgggtattatggccctctttgtttaatcttaggtttattagcttagggcccctttgaatcaaaggatttatgtagaaatttcataggattcaaatcctataggaaattttcctatttggccctttgattcaaaggattgaagctttccaaatcctatgaaattcctatggaatgacacattgcatgtagattttggagaaaatttagcaagagctccaacctcttggaaaatttcctttgagtctatctctcatccgattcctgcgtttttcctgcgctccaatcaaacgaccattcctgtgtttttcctgtgttttgcaatcctctgttttacacttcaattcctgtcagaatcctatgtttttcctattcctccgttttttctaccctgcgattcaaaggggcccttaaacttttaattcaacttattggcttatatgatttataaaccggtagatttaatgtcctgaatttagtggtgaagtcatatatctacctcatataagccaaaaaagttccaccaacctagcttttggcttaatagtattagagtggcttatggttttaaaaagccaaacgaaaaaactgtttgtttaagcttagactttccgacttataagttggcttataagcctatacaaagagggcctatatagggtgttgcatgggggtatttgggcattaataaaaaaactaattacaaaatctgtccgtaaatagcgagacgaatttattaagcctaattaatctgtcattagcaaatgtttactgtagcaccatattatcaaatcatggagaaattaggcttaaaagatccgtctcgcaaattagtcgctatctgtgcaattagttattttttaacctatatttaatacttcatgcaggtgtttaaacgttcaatgtgagggtgtaattttttgcggtgagatctaaatggggcctaactattttttctctcttccttcggatggagacggcactatggtccactagtcactagatcatcctctctcatatatcgtcatcattaatatcatatagagagatataaaatcatcggtatcaaatatttattacttgcagtcccaattgaaggagctctctaagggacgagtgtttgtagtctgcaaacacaaaacaagagctcatctcctacgctctatctccgtctctctctacaccttatctttttctctcaaattaaatgcacgtggcatgcagccacgcatccatgatagtgaacacacgaggaaagaagtcacaggcgagccacctcccttggcgatgacgatgacggcaacctttatccggcgagccccttcctccccctccctccaacgagcttcctcatacggagaagagaagacacagtcaagtagctccctccagtgatgacaatgacggcgaaggcctccctaacggtgagccctctccttgtcccctcgacgagcttcctctgacgagatcgattaggtatccatgtcagctccccacccttctcttcgctccggtgccgacccatagccctggcagttgcaacgccgcttcagtatccaccgccggtctgctggccctgaaaccattcctctaaacccgatttccctgacttacccctcgctatcaccaccccctcccccctccccaccctccacctccgaaaccctaactcttaccctaatcagtagcttgtcgtcacgcaacccgaaagagttcgtgcacatgaggagtgcgtgcgtgttacgtaggcctctagtccgcacgtacatgtcagctgcttatgtcgcgcgcgcctccccacctaggcacctagcctccacgggccacggctctctcacaccacgcgctattaacactaatgatcatactgctagtgcttacaattatattttaaaagaaatatatttaaaattagtcaaaagtttgaaattggtagttgaaagattttaaaatttgagttgaattttttcaactttcaattgaaagatgtagatttgagttgaaagttttcaaatgggttgaaagtttcaaattttgacttaaacgttttcaaaaattaaattgaaagttttgaatttgaattgtaataaatcaaattttattgaaaatatcttctaatagaaattttgatgacttttaatatatcccaaatcaattacatgaatataaaaaggagagaatccactcagtgccactgagttcgtcacggttcaacaatatgccactgactttgtcgacttccattatatatcatcacctttcccttaacctctacgatttaccatcgtcgtccacagtccgtcaactatacgccgtttgtactgttatttttttccgtaatgaccaaaataccctttgagtcatctaatgcttcggtgcgcgccgcatggaagaatgtcgtcgattgcctgctcaggctcaagcgcctcaagctgttgccgccgtcagtggtcgaccaggacggcggcaccagtgccgtgagcagcagcacggagcggctgggacacctggccaagtcagagtccggcgtcatcttcccgtcgtcgcaccgtggcgccgggacgagcaagcacatgtctggcgtgatcggccggttctcgcagttcctttctctggacgccggcggcgagtcgctgctgtccgtgggcagcgagttcgagaacaacatcaagatcatccagcaatgccggatcgggagcatcttcacggagagcgtgaagctgccggacgagtcggtgcagaacctaggtcgggcgctcatcttcgccgccactggcaaggggcagaagttcagcacgccggtggaggaggaggagacggtcggcttctgctaggacctcatcgtgctggtgtcgtcggcgaacgtgcaccgcttcaccacgttctggccgcagttgcacgactgcttcgccgccgtgtcccagttgccgctcttctccccgtcccgttcgccgagaaggcgatcgtggcgctgttcaggatcgccgtgaggctgctctccggcgccggcggcggagaccggatgtcggaggagttggtgttcaagtccggctactctgacccgggcaacgcctggagcagctcaagctcaagcttctcctcctcgtcgatggtggcggcggcagcgacgatgatgatgatggaggacgcgtcgcggatgggcaacctggcgacgagcatgttcatcaagctggccgaggcgttgcgcaagacgagcctagtccagcgagaggaggtacggaaccagaggagatacggaaccaggcggtggcggagctgggccgagccattcgtccccacgccgccgtgcgccttggccgccggcgggaggtcgccgggacctcgccgcaccttccccggccgccgccgtgctagtcacgcaccgtcccggctgtgcttggccacacacgcgctgcctctccccggctggaggaagaagacgatgaagagagagagggtcgggcccacctgtcattagctgtagtcgatttctgtaagggcatatttgtcttttcttcaatgcaaattaacagtttgtggccgtgatggtaaatcgtagaggttaagagaaagacgatggtatataatggaagtcgacaaagtcagtgacatattgttgaacgtgatgaactcaatggcactgagtggattctctctataaaaaaaatatgaacgaaaaaaagtcatgccagctaaacacatgcatgcgtgtgtgtgacgttgatgcatgtgcaggtgtgggaccaatgcaggcatgcatatgttgcacagctgggattggtgcacgcatacgggtgcgcgctacttgctaatctagcgcgtatgcatcaattagcattcctggcgtgttgctcccttcgtttctggttataagatgtttttgattttggttaaagttaaactgattaaagtttgatcgaattatagaaaaaaaatagtaatatttcgaatcgaagtttgttccaagttaaattaattaggaactcaacgaatcgaagacaaaatctaaggtgcctttacgtgcatgtccgaattgatgtccaattccgtgtggccgcatgctttcgattgaggtccgaaactctgatgatataatttttcgttctcgtgctttgagaagagatcgagtcctttttctcttactttgccggccggccggtaagagattttcttcgttcttcgttctcttcttccatgttgttatatatataaacgtgaaccaaacctttcatagttataacttaaatttgatcaaactgaccttaaacaagttgctcttgtttagttcccaactttttcttcaaacttttaactttttcatcacatcaaaatttttctacacatacaaactttcaacttttctgtcacattgttccaatttcaatcaaactttcaatcaaacttttgacatggcggcgccagagttgaatagtttgatggacgacgtcgtcgaagagatcctcctgcgcctcccgccggacgatccctcgtgcgccgtccgcgcctccctcgtctgcaaacgctggcgccgcctcctcaccgatgacccgtgcttccaacgccgctaccgcgcgttccaccgccgccgagcgcgcgcgccgcctccgctgctgggcttcatccaccacgtctccgacgaccaacaccccggcgcccccaccgtctcacggttcgtcctgaccaacgcgttccgccccgccgagccagagcgccgcaggggctggtggtggccgatcgactgccgccacggccgcgccctcttccactccgccggcgaaggcctcgccgtctgggaccccatggcgggcgacgtgcggtggcagcaggagccgcgcatcccggcctccgactgcatgtactccaccgccgccgtggcgtgcgcggcgcccggctgcgaccacgaccacgaccacggcgactgcggcggaggccccttcgtcctcgtcttcgtggccgtcgacgagcgccacgagaccgcgtcggcgttctcgtgctcatcggagaccggggagtggagcagcgcgccctccaccgtacacctcgaccgcgagtacctctacagaagcccaacgtcctcgccggcggcgccgtccactttctcaccgactacggcaggaccgtcctccgctacgacctcgccaagctggagctgtcggcgatcgagccgccggaggtgcactccgacgtgctcctcacgacgacggagggcggcgacctggggctggccatcctggacgaccagcgctacctccgcctctgggcgtgggccgcagaccatggcgtcacgcggcggtgggttcgccggagggtggtcgacctcttcgccgagctcccgttcctccagcacgtactcccgctgaatctgaccggcttcgacgagggcaccggcatgatcttcttccaagcgagcgacggcgactacgccatagatgagctcatgtcgtcaccacgtgccaagaagctttgggggagggacaacttttctaatgtcttcccctacagaagcttctacgttcacagtaatagccttcggaggcgtttgacgtaaacggtaatagtaataggtaatacttccgttccaaaattaatacttcctttgtttcataatgtaaaactttctatcattatccacattcatatagatgctaatgaatctaaatatatgtatgtgcctagattcattagcatatatataaatatgggtaatgttagaaagtcttacattatgaaacggagggagtatataaacagtaatatgtaacatatcctagtaatatgagatatgttccatctaatgatgtgttgttatattatgggatgaagggagtagcaacgataatggaatcgtttgaagctgtttatacttacatggttaattatgtttggttgtcaagttcaatactctaccattttagcgtttggacacactggtggagaaaccttttgtagtcctggttcgtaacccccctttagtcccggtttctaaaccgggagtaccaatccgggactaaagatcgctatctttagtcccgggtgaaataaccgggagtaaagatcgatctttagtcccggttggtaacaccaacccggactaaagatcgagctgaccttttttttttttgcatgcccctgttgctgcatggtttatatatatatataaatatatatataaaccatgcatatatatgtttcaatacatatatatgcatacatatatatatatatatatgtatatatatatatatatatattatattatattatatgtatatacatgcataatatatatgtatttatacatatatatgttatgcaaatgcatatgtatatagatatatatatgaacaaaatatatttacattatagaaaatgtgtacacatgcatatagaaacatatgtagtcatgtattaattacaatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaattaaacaagaaatcgctacgtaatgaaattttgaatttatttgtacgtacatcaagctctcttgtggtgatgatttggtctgcaaggcagtggcaatactcgcacacgtaatagccgcacaagttagttccctgcttttgctttgcgcactacaaataaatgacaaacaatgagagatctaattaatataca

SEQ ID NO: 59855 - DNA, 3786 bp, Oryza sativa
ctcctcccctcacgcaaaacaaagctcgtattattgcatgattaattaagtattaactatttttttaaaaaaatgaattaatatgattttttaaaacaactttcaaaagtttttacataaatcacaccgtttagcagtttgaaaagcatgcgtgtgcaaaacgagagagatgggttgagaaaatagggggagagggaacacaacctaagcatatatttagttattttagttattcagtccaagtagtgctcttatgatattctttattatcgaacaagtacattactttgagatttagcgagaaagccaacagtaaaaacgggagataactcgttggagcgtggtgtaatagtataaatgtggggtctaaatgttagtggtagaggtgagatatggacatcagtattactagtatagagggcttgttcggtaggcctaaatatggccgcaatacagctagccgtaacagtattgcacatataatctcatttgctactaaggcagcagctgcagcagcagcacagctgcagcaagaattgcagccgaacaggcccagatttgttggcttgttgaaacggattattcgctccacgcttaaaaatatacacttttagtttttaatatattattggttagatttatttattaacatatttaatttaattttcctctacaataagtagatatctgtagcaacaatctatccagtaatctctttcgagcaagagtctaaaatccattcccctctctcgatctctgctctttccaccttcctatatatctctttgcatcagctagtgaaaaccacgtagctatcccacttgcatccctacacggcagcaggaagatcgagctatgtgaacgaggtcacgctgtcagcatcgtcgatccattcgatctgcaatacatgaatgtattcgattgtagccggctgtgacaattttaagaggatttatggaagcaatcatgccatcgtgtccggcatggagaaaatattggggatcgatcgatcgatgcatatatatcctgtagtgtgttcaaggacagtttgatggaaccacgccgcgctctgctctgtcggttagtactccagctaacacatgctcttcttcatcattcatcaattctctctttttccaaagttcaacatggaaacgcaaccagtcattttagatctaagagcgagtacaatatcgagataaagttagctgtaaccacacgtagagaagagaagagagagaaggaaatcgggctacagacttgtagccagctgcaccacggactctaatagtgtataagaggtgggaccatatattaatgatataatagtatatgattatagataattattgtatgaatgagctattagattggttataaatgaattggagctattagagcaagtttaatagtatagccaactgctgactgcaaatcatctatagtcaagttaatagccaattcatacaatagttatctataaacatatactacacaatcaatatctggtcccatctgtcatacacacatgcgtattggagtccgtactgcagctggctacaaatctatagcccactgctgttatctttcatcttttatctatttaaaatatacttatagctggcttatattctgcaattgtacctgctcttagttgtctattaaacttgctcttgccaccagtcgagctgaaaaggccagggatagcgaaatttcattgacgatgttagacatgaaaattggtcatcgactcatcgtaattcaagcttgttttgtcaatgatccgagtaatgtgtgcttgagaaaaaaaatatataccagtgattcagacgtacggacgaatgcagataattacctcacctgaaccaaaattttttgaaaagacacgaaatatatgaatcaacatatacgcgtattggtactaattgctagtaagtactcgtactatatatattacagtatactttcagcgagcccaatttttctagagtaggtacaatagcaaactagccagttataaacatatatattttaataagataaaagatgagagagaaaagtagcgggctacagatctgtagccaactatagcacggactctaatatgtaatgtgtgtatgataagtgggaccatatattaattgtatagtaagcaacttattatatgaattgattattagatcggctatagatgaattagagctaggaatgggctataatattaaacttgctctttggctgctgctacgtaggactggcgtacgtgtcacccagaatatcaccaccgtttcaatcatattcataatgcacgatgattcttttccgagaaagaaactgctgaattgtttgtataaaaataaccttcattagtccaccattagtttcttcactggatcagttcacgacttcacgtacagacatccattcaatgattgcagccgaaagcatcaacaagtgattaattatgatggttgaaaattaaagctacctaccctcaagtcttaacctttgactcgtgattcgtgaatatccccatcatgcatccgtgctcgtgtgcaacaaacagagtagtacttcctccatctactgagagcaaatacaatagcaggctataaatcaactataaacatattttaaagagataaaagaaataaaataagagcagcgggctacagatctgtagccagctgcaacacggactccaagacgtaaagtgtgtataacaggtgggaccatgcattaatagtatagtaagcaactattgtatgaattgactattacattggctatagatgatttggagctagtagtggcctatactattaaacttggtctatggcattaattatattgccgtgtagaacttttagtttatgtggcactattaattaagagagagagtgaagagaggaagaaattgggtctcatgcaagacacagtttcaacacgagaacctatgcactaaacactatcaagttttacattgggagagaatagtgtcttcataatagatgaagaataaatatgattggtagagaagagagatgatgtatttatcaatgacccactttaagaaatcatgggttgtggagtttagtttctattgtgatgtcttattgacattgcaccatagacactgcttatgtacactatgagttgggactgccctgatagttatattttatcttggcacatagaccaagaataagtaattctatcattcatttaatgttcctagttattcctcgtaaacaaacgattcattaatatttacatttctcgaagtccatgtagccaatcttacgtggaaaaatggagaatcacgcattaaatccgagaaagttattaagatgataggttgttggattgaaatatgcctataaaaataatttttttagatttgaaaatatacctatcgaaaatagatggagggtgtaagaaatactgctgacgagataagataatcttttattttggtgagatgcatggagatgcgataaatatccaaatctagtgtttagtggagattaatgatctgccttttgcttcctaaaaaaaagaaaaaaagaaaaagatctgccttttgctaatgctggacgcttaactgcagattgtggcattctgctaaaggaataatatttatttattgatgggaccaccgtaaatacgtgaagctgaaggggcactatatattactggatttttcacattttggtccttttgaaaaacttatttcgcaaatagacccctgaaaaaacttatcccacaaatggtcctttttggggc

SEQ ID NO: 59856 - DNA, 38904 bp, Oryza sativa
aggtcaccgccctcagccgctgccccagcctaccactgaccgtgagagagagaggaagagagaggaagagtgagagagagagcgtatgacaggtgggtcccacctttttttaatatagaatgctgactagactgccacgtgtacgccacgtggaccaaaaccaccgcggattgggtcgaggtgggtaattcgtccggtttgtatagttgggggtaaagaatgtccggttttgtggttcaaggggtaattcggatgaccgcgatagttcgggaggggtaattcgtactttttccaagatgcaattagattctagatcaaataaatagattacgagaaaaaatattttgaaggttgcaaaaagttcctagaaggcatataggattgtgcaagagagaaagatttagggcccctttgcttcgcaggataggaaaatcacatgaataggataaacgcatgaatcgaagtagtaacaccgaggcagaataccaggttacactaagaaaaatgctttgtagagatatttttctagtattatagaggcacttttcaaatgcctttacaatactatagagacattttaaaaaatgtctaataagtgtcttatggtgaattgtctctacaaacgaagagtcattttataaaatgtctataagatggtagaagcattttataaaatgtctataagatggtagaggcattttctagagacattaaattgtaccacaaacatatgaaaccaggcaaaaaaggagaataaaatagtttccttgcttttatcaagccttgaaacttaagatctcttggacaaaccatttttgtcttcaatgcactagccaactcaactccatgttattacttggttgtttgtgtctttagttacttatatttagtcctttagtacacattatcattctaaaaaatgtctctacatagtttaaaatgtctctacatagtttaaaatgtctcaagaaaatgcctttacatatcaggcgcattttacagtgccaaaagaatgcctttacaagataaaatctaataaactgagctgaaaatgtctctagagtaaaagttttctaggcaatttttaaagtgcctctataaagtgtctctacactataaaacttttgatcttagaaacaatttgcaaaactcctctacaaaagtacctctatatgaggtttttgttgcagtgttacatttggctcgtcagcacaactactacactaagaggataccaagccactatattttttaatgatactttgatggtttaaattatcgcataatctttctatcacgcatgatccctcaatttattttctattgaattagtcacttttaagtaagatttacaatatgtttgatcatatattgtaattttgcaactaatatttatgatgtttgattgtgcattataattctacaactacgtacattatgcataccaatatcacatacaagatgtcatcgatcaaccagtagatcaaatatagtaattacggatagatgggtgataatttggactgtatgaatcatacaaaacaataataatcattttgttgtatatcgccaatataatattgccattgctcgtgggttgccttggccgttcataagcaaattaaaccagagcttgaactggattttctttttcttattgtgaaatcaacactttttagaagtggagatgaagctgatggaggaacaaggctagccaaccaacgtgtggaagctattgatctagttgatatatgcgtttagaagctgaaccacaagcattgtaaacattagttattatcgacattggcctcgtgacctctatcttgccatcgattgagtgcaattctgtattgttggaattaatagatgggctaaggcccattcgaagattaattctttggaaaatcacaaaagcccacctcatgggatggcatgcatgtggagtttagtaccaccttgcttattctaggagagggggacctccttaaaagggagtataccctcctagccacttgaagtatgtgtggtggagagaagagggggaacacgcgctcgctcgcctcgcctggcaaggcaggcggcgcgtgcacggcatacgcgtcgaatggttcggaaaattggctcctcacccttacgcagatgcagtctccttttgcagttttgttttgctgcaggaaaattcggatttgttttgttgttggaaacattccgaaaaatccggtgcatgaaaacggctggagtccggataagttacgcgcgtcttatccggctcggttacgtagagtggagatcgtgcgggcgccctgatcaagcgatccatctctatataaaccgtgccgccgtcttcacgcaacacacgcgaaatccatctagggttttcctcctcctctgtgttgcgccgtcgctcgtagactactccatcccgcttgccagcgtgcaccggtgaaagggagagcaggtctccggaacctatgccttcgatgtcctgcaccgggagaaggcggcaataaggcttttgggaagcgcttcgcgcgactgctccctattcgttcgcgacggctcgccttcctctccgctcgcgtgctgcgcgccttcgtcgacgcttgcaaccgcgagtagttcctgccgagcaaccggtctttccgccacctcggtacatgttcgacatgttgcgcatatttgatctgttcatgttttactgcttagtttacatgtgtagatataatgatgcgttaatgctagtatacatctgtaatgtcatgatttatttatggaatatattaaatcattatatgcctatattctcaacaatccaaaaaccttattataggcgctgtgattttactatggctggttttgccgatgcactgaggccggataaatttaccggtatgcactttaagagatggcagatcagggtcactctgtggctgacagctatgaaatgcttctgggtaagtactggcaagcctatgggcgttcttaatgctgatcagcagaaagaattcgatgaggccactactctctttgtgggatgcattcttagcgtgcttggcgatcgtcttgtcgaggtgtatatgcatatgaccgacgctaaggagttgtgggatgcactgaatactaaattcggtgctactgatgctagcaatgatctgtatatcatggagcagtttcatgactacaagatggctgacaaccattttgtagtcgaataggctcatgagatacaaaccatggctaaggaactcgaactccttaagtgtgtcttacccgacgaatttgtggtcgggtgcattattgcgaaactaccttcatcttggagaggtttctgtactgcactcaaacacaagagacaggaatactccattgaggggttgatagcgtctcttgatgttgaggagaaagctcgggaaaaagatgccgcgtctaagggcgatggtgggcggtccactgccaatgttgtgcacaaggcctagaacaagagcaaggggaaatacaaagctcagcagaccaccaacttcaagaagaagaagaacaataacaatcctaatcaggatgagaggacttgctttgtgtgtggtcaacctggctatctggcaagaaagtgtccacaacacaaggggatgaaggcacctgcagggcagacctctaagtctgccaatgtgaccattggcaacactggagatggaagcgggtatggtaatttacctactgttttttcagttaatcagtctactaattggtgggttgatacaggggccaatatacatgtttgtgctgacatctcattgttttcttcttatcaggccgcacggggttccaccgtcctaatggggaatgggtcacatgattctatcgacaggaatcttgttagtggctcccgtctgactagagacggatttaagttggtttttgagtctaataaagtagtcgtgtctaaacatggatattttattggtaaaggttatgagtgcggaggcctgttctgcttttccctttttgatttctgcaataagtctgtgaaccatatttctggcagtgtggatgatgaggctaatgtatggcactcacgtttatgtcatattacttttggcttgatgtctcggctttccagcatgtgcttaattcctaagttttccattgtcaaaggttctaagtgccatagttgtgtgcaatcaaagcaacctcgcaagcctcacaaggctgctgaggagagaaacttggcacctctagaactcctacactcagatctctgtgaaatgaatgggtgttgacgaagggtggaaaacgatatttcatgacgttgattgatgatgctactagattttgctatgtgtacttgttgaaaacgaaagacgaggctctagactattttaaaatttataaggcagaagttgaaaatcaacttgacagaaagataaaaagactttggtctgatcgtggtggagagtttttctcaaacgagtttgacttattctgtaaggaacatggcattatacatgagaggacgcctccctattctcccgagtctaatgggattgctgaaaggaagaaccgcacactgaccgacttggtgaatgccatgttggacactgcgggactacctaaggcatggtggggggaggcattgttgacctcgaatcatgtgttaaacagagttcctaacagaaataaggacaaaacaccatatgagatatggattgggagaaaaccatcactttcttacttgcgcacatggggttgcttggcgaaaatcaatgtaccaataacgaagaagcgcaaacttggacctaagactatggactgtgtctttctgggatatgctcaccacagcattgcctatagatttttaatagttaaatctgaggtacctgacatgcatgttggtacaattatggagtctcgtgatgctatcttctttgagagctttttcccaatgaaggatacacatagtagttctagccaaccctctgaaataattcccagttcaatcacaccaccagaacaaactgaatatacacatgaatatgtcactaaggatgatgacagtgaagctcctcgaaggagcaaaagacaaaggatggctaagtcttttggtgatgatttcactgtgtacctcgtggatgacactcctaagtcaatttcagaagcatacgcatctcctgatgcagactactggaaggaggctgtccgtagtgaaatggattccattatcgctaacgggacttgggaggtgacagagcgaccctatgggtgtaaacctgtggggtgcaagtgggtgttcaagaagaagctcaggcctgacggtactattgaaagtacaaggctcggcttgttgctaagggctatactcaaaaagaaggcaaaaatttctttgacacttactcacctgttgctagattgaccacaattcgtgtgctactttccctagcagcctcacatggtcttctcgttcatcaaatggacgttaagacaacttttcttaatggagagctggatgaggacatctatatgaatcaacctgatgggtttgtagttgaaggtcaagaaggcaaagtgtgcaaattgttgaagtctttgtatggtctgaaacaagctcctaagcaatggcatgagaaatttgacaaaacattgacatctgcaggctttgcagtcaatgaggtagataaatgtgtgtactatcaccatggtgggggtgagggagttattccgtgcttgtatgttgatgacatactgatatttgggacaaaccttgaggtgataaatgaggttaaatcattcttgtctcaaaattttgatatgaaggatttgggagtagctgatgttatcttaaacatgaagctaattagaagtgagaatgggattacactcttgcagtcccattatgtggagaagatcttgaatcgctttggctacattgataataagccttctccaacaccttatgatcctagtttgttgcttcgcaagaacaagagaattgctaggaatcaactgcaatactcccaaatcattggctcattgatgtacctggctagtgcaactaggcctgatatctcctttgctatgagcaagttgagccggtttacctctaatccaggagatgatcactggcgtgcgcttgagcgagtaatgcgctatctgaaaggtactatggaattggggtttcactattctgggtatcctacggtactggagggatatagtgattctaactggatctctgatatggatgagatcaaagccactagtggatatgtcttcacactgggtggtggtgctgtttcctggaggtcttgcaatcagactattttgacgaggtcaaccatggaagcagaactgacggcactggatactgctactgttgaggcagaatggctgcgtgatctattaatggatctgcctattgttgaaaaaccggtgccggctatccttatgaactgtgacaatcaaacggtaattctcaaagtgaatagttccaaggataatatgaaatcatctagacatgtgaaaagacaagtgaagtctgtcaggaaattgagaaactccggagttataacgttggattacatccaaacagctagaaacctggcagatcccttcacgaagggactatcacgaaatgtgatagataatgcatcgaaggagatgggtttgagacccatgtgagttatactatggtggtaacccagtctatgtgatcggagatcccgtgaattagaacctgggaagaacaaaccattagtaaactagatgagagtaccaatctataccctttctaagtgaagatgcatgtactctcgtgagctgcaaggcaggttggctatgccttaatgagttctgttggctttaattagcgaagatgctgtcctgcagagcattcttgaaagaactcacctttgtaagcttgactgttggtcgcagtctatgaagattttgggtgaatcttctaggaagtttactaaagacctaggagtatgacttatacgctccacccgaggggtagactacagacggtctagtaccagataagactctgagtgaaacttgcttgcacaagactttcaattcaaggcgtagtccattgttcaagttgttagtaagtgtagcttagagttctaggtggatgttcaaccttaatcggtctccatcgaaccactggtatataaatagtatattggaaaaggcaaatctcagtgggattttgagatttggtgggggattgttggaattaatagatgggctaaggcccactcgaagattaattctttggaaaatcccaaaagcccacctcatgggatggcatgcatgtggagtttagtaccaccttgcttattctaggagaggggacctccttaaaagggaggatgccctcctagccacttgaagcatgtgtggtggagagaagaggggggaacacacgcgcgcgcgcgctcgctcgcctcgcctagcaggcggcgcgcgtgcacgacgtacgcgtcgaatggtccgcaaaattggctcctcacccttgcgcagatgcagcctccttttgcagttttgttttgctgcaggaaaatttggatttgttttgttgttggaaacattccgaaaaatccggtgcgtgaaaacagcgtggagtccggataagttacacgcgacttatccggctcggttacgcagagtggagatcgtgcgggcgccctgatcaagcgacctatctctatataaaccgtgccgccgccttcacacaacacacgcgaaatcaatctagggtttgcctcctcctctgtgttgcgccgtcgctcgtagactactccatcctgctcgccagcgtgcaccggcaatcgggagagcaggtctccggaacctttgccttcgacgtcctgcaccgggagaaggcggaaataaggtttttgggaagcgcttcgcgcgactgctccctgttcgtccacgatggctcgccttcctctctgctcgcctgctgcgcgccttcgtcgacgcttgcaaccgcgagtagttcctgccgagcaaccgatctttccgccacctcggtacgtgttcgacatgttgcgcatatttgatctattcatgttttactgcttagtttacatgtgtagatctaatgatgcgttaatgctagtatatatctgtaatgtcatgatttatttatggaatatattaaatcattatatgcctatattctcaacatgtatgtgacatggaaaattcatagggtcatctttgccgaaagggagtatctatagatatgttgacacatttttttagtaaaaaaaatggtccatttgttttagtaaaaaaattggtccattttattcactagaatagctagagatgaatgatcaagctcaaccaaccttaaacttaaaccatttacttgcacaacaattagaagttcttgtttacctattaactacatgcttacccatatgccaactgtcttactttgttaggatgcttttacactacaaacgactacacgccatagtgcttttacataaaaattgcagtgtaattaggatataaacaattatagtgtaactaggatgtaattatattgcatatggataatataatttctatgtttttcgtgaagttagcatagattaattaactagttaggtttctgagagtggaatctgcccactcaagtttaagttctaaacttgatatgtgtgttcgaatttacggcttattattctttcaactaaaggcgatgtatccattaacattgagaggcatgtgatgactttattaatcttatgatataaaaaccaactagattcattacattgagcagttggaactaggggtggtaacagaacaagatccatggttccttccataaatcttatctgggaaaatatatggtagaaacttagaaactgccgttggatcgaaaaatggatttataagattcgtccacgtcatcacgagtaaaaattttactcatagtaaattttttactcatgagtaaatctatgagtgaaaattttgctcgtgatgacatggataaatcttgcacgtctattttttaattcaacggtagttttcaagttttcacaacatatatataaaagtatagttataaagttggacccattatcgcctctagataggaatagaatttcacagcgttggccatgggttgcaagtagctgcccagattagttaatcggtccttatcccacgatgcccctgcaatcctgcatgaatcttgcaaaggatcaagtggcccaaaaaacgtctgcaacctggccagaaatctatagacataattccagcaaatccattgccaaaatgggattttacatcaattctaacggcaattaatactccctaattctaatatgttaaaaactacaagttatagcaacttgtatccaatagcaccaatatacaacctcttcttttttttttagaaacacggtacaaacgcaggcgctcacaacgcgcgtacactcacccctatcccactggtggagaaaccctttgtagtcccggttcgtaacccccctttagtcctggtttccaaaccgggagtaccaatccgggactaaagatcgctatctttagtcccgggtgaaataaccgggagtaaagatcgatctttagtcccggttggtaacaccaaccgggactaaagatcgagctgactttttttttttttgcatgcccctgttgctgcatggtttatatatatatatatatatatataaaccatgcatatatatgtttcaatacatatatatgcatacatatatatatatatgtatttatacatatatatgttatgcaaatgcatatgtatatagatatatatatgaacaaaatatatttacattatagaaaatgtgtacacatgcatatagaaacatatgtagtcatgtattaattacaatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagaggatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgatggtacctgtctataagtttgaaaaccttgtcaaacgtagactcttttttatccattgagtcatatacgttgacggtgcaggcctccaggtcgaagagtaaaagcacccagtggaatctgcaatgtgcgtgggatgcattacatatgaaacacttagcaagttcgtacgggaatgaaatttggtatgtaggaagacagtaaaaataaactaactctgtgttgtatggcaacagtatgaacgtcttgtaatgctgcgccttcaggagatggacgagattgtcctctgtttcttgtggatattggtcgagcattgcgacgtttactttccgagggtcgatgaatccagtatcgaaaaccctccgccgtcgggccctttgaatctccattctacaacgataaaagggagtatattattttctatggtctacttatatacaaggacctaattaattaaaggagacgtatagtaagaaatctaactgaacgatatacttacaaaatccagcaactcataatagatacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccggtgtcagtaataaattgttctatcgtcatttctttaccggtcaccaacggctcgatctcctggtttggttgctctccaagctgagggactggtttggactttccagaagatgctttcttcagcgttcgctcatagtccgatagcttgatggccttcttgacagatgcagacatacccctgaagaagttcctgacactggggtctataggaatcttcttttctggacttcgaggcttgaattgtctcttgacttctaatgcaacgtaagcgtcaagctcctcttgcgtgcaatcgtaccccgggtccttgttcttggcggcgtcaactttcgccttctttgttgcccttgtgtgggcaagcggtggagctgggggggcccttgactttgaaggtgccggaagaggagcttgcgggggagtaggtgtaggagcacgaggaggagtcggtgcaggatcctgaggagtcgatgctggagcctgaggtggagacggtgctagcggagcatgaggaggagacggtgcaggatcctgaggaggagatggcggagccggaggagatggtgcatgagacgccgcttgtcgcccagggaggatgatgtaccgcctgtgccatagaataatggcatggcatgtgtctcgtagatgcgtctcaccgtctcctccagggtaatccagctcgaggtcctcgtacgcgccttcgaccaactcaacttcgaccttggagtatcctgctggaatcggcctgcagtggtaagtacctgaagggtccgttgggatggccatgcccgacgccaccttcatgttgtgagagattatttattagtaatcaacatatataagcagcaactagcggaatggctaaatcttacctttattgataagttcttgaaaggaatatgcagctcacatggtgtccgctgagtgatgtcatcaacgggacaggtcgattcgtcctgtgtttgcatggcgtccatgctctgtgatcctacctgccccgttgaggcgcagctgctacagtttcctgacgggctcaccattgcaggaggaatggtcggctggggatcatgggaccgatgtgcggccatgcgttcatcaaccttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcaagttcgtcctggatgctctggagtctgcagggcgagtgtcagctcgtccctatctctgtctggtcggaacgtgccctgagaggaggcttccactgcatctgttagtcgtcgcgcagcctcttgtatctgatagccgaagaccagtgagccatcagctgggttgagcgttccaccgtgagcatagtaccagaacttcgatcgttccggccaattggctgttgccggttcgatacccctctcaatcaagctagcctccatctgctcccacttcggcatcgcgacgctatagcctcctgaccccaagtggtgatggtacttcttcttggcggcattttctttgtttctttccatcatcgcctgcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccgtactgacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtgccctcttctgtccaacggagggttgactaccactagcctcctcctcctggttcccctccacatccctttccacgtgcccctgctggttcccctccgcatccctctccacgttcccttcctcgttcaagtactggtttggatcctcgttcccctcttcttcattccagtactggctgcttccctccgcgattgtatcgtacaatatctgttcctcatcggggtcagccatctgttgatacatgaaacatctgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaatactaaaatagtcatgtatatgctaagtgtttcgtgcgtatatgctaagtctaattaagactacaatagtcaattgctacttgtcgcaccaattccgtagtcaataattacataccaagtctaattacaaataaagtaatattatattaaaactcaaataatattacatgctaagactaaaatagtaatgtatgctaagtgtttcgtgcgtatatgctaagtctaattaagactacaatagtcaattgctaggagtcgcaccaattccgtagtcaataatgtcatactaagtctaatttgcaataaaataatcttatattaaaactcaaataatattagaacactacacaatcttatatgataagtctaattacaggtctaataatcttaattaattgcattacaaatataacaatcatttatattattacgtcacttgcctgctccaattccttctagggcaagctcttccactcaggcttgacggacgactccgacaacacgtcttttctgcaagatacaaaaaaatgtattaggataaatgcgaagtaacatatatatatatatatatatacatatatatatatatatacatatatatatatatatatatatattgcatttcacgttaacgttcgtcctcgttcgttcgctcgttcacgttccctagctcgttcacgttcgttcgctcgttctcattcacgttcgttcgctcgttctcattcacgttcgttccctcgttctcgcttgtcttcgttcgatcgttctcgttctcgctctcgttcgttcgatcgttctcgttctcgttcacgttgtcgcggcaacgtacgttgacgtgttcgttctcgctctcgttcgttcgatcgttctcgttctcgttcgttaacggcggtgtggcggcatcggggcggcggttggcgcggcggcgtggcgacggcggcggcggcgtggcgttgtggggccgtggcggcggcggcgtggcgtggcggcggtggcgtggcgtggcgtgggcgcggcgtggcggcggcggcattgcgcgcgcggcggcgaaggcggcggcggcgtggcgacggcggcggcggcatggcgttggcatgcggcggcggcgttgcgcggcgtagaaggcggcggcgtggcgcatcgtcgtcgtggcgcggcctctcgtggcgggcggcgcgacggagagagatcgagattggagagatcgagatgcatgaagggagatctggcggcggcggctctcaccccagagatgcggcggcagcggaggagacggaggcggcggcgaggacgacgagctcgagacgacggagagatacggcggccgtcggcgcggggatttgccctaggcagtggcggcgaaggagagaggccgagagagatcgatcggccgaaaacgtttaagtgttggtgaagaagacgagggcgcaccgggaatatatatacccctggatctttacttccggttgttctcaacaaccgggactaaagatatctttagtttcggttgttctcaacaaccgggagtaaatatcttttcccgctatttcgaaattctttttaaacccggttagggttaagaaccgggactaaagattatagcactgcatatgattttcgcttacatatgtgtttataaaatagaagttaatgcattaacattatttaaagtacaaagattaatgacaattacttcgaaaaattatttttggctgtaataaattaagtggataaatcgtaataagcaaatataattaataaaaattccaataatcatatatacttagcatatatatgaatgatattattatattggtaaaaactctaattaagatatgtatgtacatactgcatgatttaaaattaataaaaattgtaatcatcatatgtacttagtgtaggaattatattaaattaaatgctaaaaactctaattaacatatgtaaatgccacatgcatgattttaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaatatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactagcatatacatgatttaaacttgttgaaacctctaataatcgtgcgtaattaatatatgccatacatcaattgatttatatggataatcaatacatccaaaatagtttacatcgtgtacacaataattacggcacgtactttctcctcactattgttccctccttgtgatcgctgcgtgagtaaggggtgtcttcatttgataggaggatgctagggtcaatcgtcaccgtgaaagggggttgcccatccaactgatcgtaatcctcgtcagtcttgtcctcaactccgacgatttttcttttgcctgggagaaccacttgacgcttaggctcatcaggccctctgcccttctttcctttgctagacatgtccttcacgaaaaagacttgcgttacatcattggcaaggacaaaaggttcgtccgagtatccaaccttgttaaggtcaacagttgtcatcccactgtcatcaatcattacgcctccaccagtcaacctaacccattggcaccggaacagaggaaccttgagaggaccatagtcaagttcccatatgtcctcgatagcaccgtaatacgtggcagttgttccatcgtgtcccatggcatcgacacgaacaacgctgttttaggtttgtgaacttcttctccttcgtgcttattattcgcttgatattcgtggagtatccagacggtacctttatgctctccaagcattcaaacatactttccttctctgccttgctaagagtgtagctggctggactcaagtaatggcttcctttctcctttggttccgggtgaaggtcgccgcgttgttccatatgcttcagatcattacgtgcttccagtgtatctttcgactttccgtatacacctaggaagccaagaaggtttacgcaaaggttcttagtgaggtgcatcacgtcgattgcgtggcgtacgtccaagaattcccaatatggtaactcccaaaatatagagttctttttccacatcgccgcgtgaccatcttcgctctctatatgctggcttccaggcccctttccgaacactactttaagatctttaaccatagcaaacactgttttcccgctgcgatgtttaggcttcgtacggtggtcggccttatgttcgaagtgcttgcctttcttccgtaccgggtggtttgctgcaaggaatcgacgatgacccatgtatacaaccttcctacagtgcttaagatacgtactttctgtttcatccatacagtgagtgcaagccttgtaccccttgttggactgtccggataggttgctaagtgcaggccaatcgttgatggttacgaacagcagcgctcgtaggttaaactcctcctgtttgtcctcgtcccacacggggacaccttccttcttccacaactgtttaagatcttcgaccagtggtcttaggtacacgtcaatgtcgttaccaggttgcttggggccttgaataataatcggcatcattatgtacttcctcttcatgcatagccaggggggaggttgtagatacacatcgtaacgggccaagtgctatggccgctgctcatctctccaaaaggattcatgccatccgtactcaaaccaaaccgtatgtttcgtgcgtcctttccaaattctttaaattttctgtcgatgtttcaccactgcgaaccatcggcggggtgtctcagcatcccgtcctgttgacgctcttcagcgtgccatcgcaacattctagcattccccttgttcctgaacaaacgccttagccgtggtattatagggaaataccacatcaccttagcaggaattctcttctttgttagctgcccgtcaacttctcctggatcgtcccgtctaatcttgtatcgtagtgctttgcaaacagggcatgcttctaggttctcacactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcactttcccagtcctccctggcgtcctgcaacatctgaccaagatcatccgcaacgtcgttaccatcagcagctatttcctcctcgcccgtttgatttccttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgccggtcagcgtacatccattgccgatccatctacatgagtcaaaaaaaccgcacacaaataattattcttacaataatgagagtcatacaataattataagatatctttattcatacaaaaatcataaaatattacaccaaataattcttaaaaactatttgtaaagttttaaactaattttaatgtgttttacttcttttaattttcattttagtttgttttctattatttaagattaactttcactagagttttccttctcaactattttataaaaccttgtttagcaaatgaactaaatttctatatattctttcttccccacacacattttctctctcatcaacttacaactaaattttggagacaaaaaaaagtgtgcaaaatataggtgcaaatgtagtatgacaaaaaaaaacattggaggatgaagttgcaaaccttttaggcacctccgatttgtatgtaatcaccaaaataaattcaatagaaattttggcatgacctcccctcttttttgaagtaattttgaagcttgctcgggcagctggaggaggaagaagacatatatataggggtgggactttagtcccggttggtagcaccaaccggggctaaagatcaccgggatcattagtcccggttggtattaagatctttagtcccggttggtaacaccaaccggggctaaagatcaccgggataccaaccgggactaaagatcccgggggggtctgataggtcctgacagcattcgaaccgggactaaagatgatctttagtcccggttggtaacacaaaccgggactaaagatcaaatatgcccgtttcccttttgaaccaggactaaagatcatctttagccctggtttttattgcatccgggactattgtggaaatcggccgaccgacgaaagatggtttctccaccagtgacaggaccttgataatttaggtccagcaatcaccagcaatgtctttcatttaaaatcacttgtcatctttcaaaaactccatgttcaaataccgccgaccagcccacgaaaaaaaaacatatgtaacgctttcgaatcacgtagcaatgtaatcaaatacaaactgatttgtgttgaactaatcagaccttcagaattgagcatgcctcttgctcgattcatcgattgtgattcagtcagggatatagttatgtgtgtctggtggtggctcagtgggtggcggatgttgattgctcggctcggtggcgtgctatgagcaatgttgagcgcaatagcggcaccgagaggggtgggggaggtggtgttaggccagtgtcgatggcgtggaggcggcggatccctgacaaaataggctttgatggcagctcggcggaggtcatgtcttgcagagacaatgccgttgtggcaacgactcttcggcaagataagctatggctgcttggcggttgctgtggtttgcaatgatgacgatgtagtagcggtggtcctccggtgagataagctttggtggctcggtagagcggtgacaacttttggcgatataagctatgacaactcagcataggtggctctctgcagcgatgatggcatggcaatggtggaatctgtgaaggagtaggttgtccaggaggcatgagtttttgcttggcaactacaaggtagttggcggactagttttgctttctttctttactcaatggcggatcaaaggagcttttgtagttgatgcaacaatagtgagagggtgtggcaattgaagggtgggctagcctcgcatctccttaaaattttaagcagggaaaaaagtttggtgctagtattctagtttttctttccagttgttcgtttgtctatgtttcttggttatgagatttagagtgtaagaactcgtgtaacatttgtctatgtatatccacttgtgaatatagaggccgaatttctatccattatcttgaaaaaaagactttcaggaaaaaaagagttcaatgtttaagatgttgggattgaatcactcaatttccctttggaaccattcactaattccactcacggtaatattgctcggtagtaagaatatactctctccgtttcacaatgtaagtcattctagcatttcttatattcatgttgatgttaatgaatctaaatatattatcaatatgaatgtgagaaatactagaatgacttacattctgaaacggaggaagtactatatatactctcccataaaacacattgttaatatattcatttaagttctaaaatgattataactcctctgcatccatttcaggttgtgatagggacaaattgcaatcgccagcaattacaactgtaaactagcagacaatgtatcaaaaattttggaaacagttttgctatttcacttgtgacagatttttgggctcctatttttcactttttcatccatagtatcttgcatcaagattcgtattctagcttgtatatccaacatgcacttatacccagtcatatagcacttatactcaattggaatgcacttatactcatttaaaatgcacttatactcaattacaaactataaagcaccaaaattagattttataatagttcttttctctagatttatggtttttgacatgcttgtctctttttcatttcatttaaaacgtgctatattcattgattgaaaattctgcaagatttaaagctataaatgtaaagcaagatcaatagataattaggtagtcccttttgcaacttagactgtgttcgtttgggatggttgggaaccaaactcctccgcacagaaaacggagcaatccattagcacgtgattaattaagtattagctattttttttcaaaaatggaacagtataatttttttaaacaactttcgtatagaaacttttttgcaaaaaacgcaccaaaataacagtttaaaaagcgtgcgcgtggaaaacgagaaggggagttgggaaggaaacgaactgagtcagtcaggttgagcctctgcttttgttgatatcctcttaatgtcctggttaattatttgaagctaatgatatgcaaaactttggactgaagccgatgcatacatagttgctgcttggttcagttttcaaaaaaaaaaaaagaagaaaggttgagatacatacttgtccttgatccggtagatattgttaagggttcacttgaccaaaagggctctagctaacacatgccaagaatttcaggacccggtcacccagacatgaaaaattgaaaactctaatcacttgcaacgcaaagataaccacggattttcctggcgaataccaatgatatgatattttgacattttctccaagatagttttaattagaatacactccctttgtcttaaaacactattgttttagacgaaaaatttctatactaattaatgttccatcaccaccacccaactaccatacggaacccacaaaactgtgggttgcttatcttttagcctctacatatcatagatcccaatattatgattttttcatctttacaaaatgacaacaaaattatcataatgataatatattagataattaaaaaaataattgcaacgcacaggcattgtgctaatgtcttataaaaaccgtatttttacagtgggttcactaaatctttttaatactactttatcattaccttctctttagctatcgagtaattgtcaacattgccagtcatttaaaaaatagtcagttatctaaagatagagcgtttttttttaatttcaatctatgtaagctaccgttttatcattttaatctaatttggattacttccccttttggtaaaaaggaaaaaactgagcacggatatagttggccaaaagacccatagctcgacgacccggtctacggcacggagatttggtccgatcgaagcacagtatggcccaactgttgtcgggcccataccggcccaacctgattgttgggccatgccggagtctcttccttgacacgatggaccggtctggcacagctcggtccaatagatgtgagaggcaaaatagacttatttcaaccatgtatgatatgaccccaagaaatgaggaaggcaaattagacttgttccaagaaggagcacgatagacttgtcgtgccttggggctggcctgacatggcccaagtcttattgggctatacctgaactgttggtgcagcctgtgggcaggcacaacataacccgacagtatgtcaatcgggccatgcctggttgtgcccaggcagactgggctgtgcggtacatttggccatctataacccccatattcaacaaagacacacaactttccgagtagcggtattttttccaagtcaacttatgctggccattttgcagcgggtccagtcaacttatatgggcactgttatattgtgtcgtctccttcggttttgctagaccagaaagacttgttaatcaaaggcaggctattaattagcactggattcttcagagcttaatgctcattcgatcaggcagaagtggcctaagcaaatgccatttaactaatttcttcaaagatatactagcagtattatattttgactcctaatttgacttccgtatccaagaaaaagtcccaatggctgtggaaggaaaaaaaaaactgtattaatttcttgaccaagttactctttgttgcttccatagatgattgatctctcccatttcgtggctatatgtgatctctagtagtgtcttccatttctctgacatggttttcctttttattaattagattagatagtttgaatgtttgatatctcaaattgcagctgcatcaaatctttcccgccttagccttgtaggttgattccatttcttgtccatggcgagagcggattcagctggcgctggcgctccagaagccattgatggcgagctggtggagctggagctcggggagagaaacaatggcgtccctcccgtcgccgaggaagaaggcggcgagccaagacccggtggccggccgccggcgtcggggcgccgcctcctcaggcgactcagcccggcatccgtggcgcgcgcgtgcgggcggtggctgaggcacccggcgcacctcgccctgctggcgtgggcgctctgcgtcgcggcgtcgggcgccatgctcgcgctcctcctcctcggcgccctcgacggcgcgttcccgcgcaagtcggcccgcaaccggtggatcgaggtgaacaaccaggtgctcaacgcgctcttcaccctcatgagcatctaccagcacccggcgctcttccaccacgccgccatgctcctccggtggcgcccggacgacgtcaaggcgctcaggaaggcgtaccgccgccgccggaaggccgccgccgccggagacggcgcaggggggtgggagcggcttcacatgtccgtggtggtcgcgctcctccacgtcgcctgcttcgcgcagtacgccatgtgcggcctctactggggctactcccgcaaggcccgcccggacgccgccgagacctcgctcgccgtgatcggcgccgcgacgccggcgctcgcgggcctgtacgcgtacttcggcccgctcgggaggaggaagcccgggacggcgacgagcgcgcgccaccaggaggaacccgacgaccttgagctcgccgccgccgccgccgccgacgtcgtggtcgcggagtgggccggcgggctgctcgacgtcggcgacgacccgacggcgtggtggctgtcgtgcctctgcacgttctgcgtgttcgggtggaacatggagcggatgggcctcgggaacaagcacgtgcacgccgtcacgttcgcgctcctctgcttcgcgccgctctgggtgctcaacgtcgccgccatgaacatccgagacgaggccgtcggcgacgcggtcggcgcggtggcggtggcgctctgcgcgctcggcctcctctacggcggctactggcgggcgcggatgcggcggcggttcgggctcctccccgggcggcacggcggcggcggcgcgtgctgcggctcgccgtcctcgctcgccgactacctgcggtggatgttctgctggagctgcgcgctggcgcaggaggtgaggacggcgaacgtcctgctcctcgacgccgacgaggctggcggcgccggagggggaagctcaagctccggcggcggcgggcgaggtgacgccactctgctgcagccgttgccgcgggagaacggggtgaagctggcattccatcatgcagctgcagtgccagtggacacggacgcggcctacgggccgccggtgaacggctcgccacaccgcggcagcggcggcggcggcgatgagtcgccgttgctgcagaggcagcagggtcgcgagtctcaggctgaggaaatgaggccgcctctgcagccattgatgacggaagcagaatgccgacgggttcagtaataatgccaggagcaatgcgtgcgacagagtccagaaatgatacgaatatactagtcgatttttttgccctttttctctctctctttcagcttgttcttcaaattgcatttcaaacattcaatttcgaaactgtcaatatttcttaagattgcatttcaaagatccaacctcgaaattgatgaacagagaggctcaagaacattttgtgttccatgtctctcttctttgctctttcaaacaaaaagatatttgcttggatccaataaaaagtagctgataccttacggtatcaaatcgtttccgatcgttagatctaacagtgtataccttgcccagctaaattcaatgattagaaatgatttagtatcctaaggtactggtacctcgtgatacttttttctggctgtagcaaaatctcgaggaacagtgcaacactatcattagactcatttggtcgttttttttttggtgactcatttggtcgttaattatacaacctttgccaatcacttaatcacatgccgaagcttttaaccacgcagttaattatcactttaatcacgtttccatgagtgatcagatggcgaggacgagggcagggaggttcttgcgagcccggtcaggcagcctgctctgccacaactgctccgactgcgacctcgagcacggcgccgccgcctcggctcccttgccgcctccgccgccgccgagcctggtgacgacgagcgcggtgttgcagtactcgcggacgccggtgacgcggccgccggggccgaccgtccacgcgtgcacccagtacagcttccccgtggcgtccgtcccctccgccagcaccgtctccccgaaggcgtccacgccgcggaccttgaacgggagccccgccgcgccgccgccgccgccggtgaggaggcgcatgagcaccagatgctggtgcgcgcggggcccgtggaaccaccagtccacgtccgggttcagcagccgccgcacggcgtccccgtcgccgcgctccagcgcgcggtacagctcctccaccaccgccttgctgctgctcaccaccacctcctcctcgccgccgccgccggcatcggcggcgtcgccgttcgcgtgtaccttgtcgctagccagctctgctgctgctgctgcgaagcgagcgatcgatcgaattggggggaagggaggaggaggttggcaatggcgaatgtgaggttggcgagtgccctttatataggggagagttttggatttgtgtgtgctagtggtaatttgttgggaacccatgtgagtaggattccaaaagcatggaatttcctttttgtctcagcttaagcaaagaggtaatgcgattcagtttttaaggcattttttgttgcatgatactacttcaaatgttattcatccatccaaccgttgacggaaaaaatatactgaaacatatccggatactattctctgataccttacacatattagttgcacaaaaaccaggcgatcagtattctctccgtttcgtattataaattatttggagtatttctttaagtcaaactttataaaaaaattagcaatatttattacaaaacaaatatactataacagtactattcaatggtcgatttaatgaaattaatacgctaagaacataggataaacaagatgatttataatatgaaacatagggagtaatgttgataacctcttatccatgactgaaaacgagttctcgtgaaatagtaaatttattctatggtcgaaaatacatccttgaagtagtaaattagattaaatgtgaaaacaattaaaattgtattatgcatgaaggcttgctttgtgataaagtcaagagctttatttccatgatcccaatttggtgcatctctccagatattagttgtcaaagctctaaaatattggccacattggtatcattcgtccgacctatattattgagagatggtggacaggactttctctattttaatttatgaactactaattgcaaatacggtgtttgataaaaaaaaaagtggggcacgataagtggctaaggaaaccaatatcagattgctaacatgacattgaattcatagaacaaaacaattgaatgattgttttttatgaacatgaagtgggaggggtgaaattgtacagactgatgctgtggcaatatgttcatttatgaaaccaacacaatttaagcattgctggacaatttgctcatatgttaccaaagtgcaaaactctcataatagtggggaggaaattactttccctgtcaaaacacccattgttcagaagcaaacataggaaaaaccaccaagaatatgccacacccaaccttatatattttccctattgattccaggcacgctcaaagctaataagtctccattttaacctaggccagaaattcgataggaaacggattccactaggaactacctaagatgcattcgacacatattcctttgtctcgcgtttcttaattattcttttgcaatctgatgaagaatatgactccagaataccggcaaattgcagtttctatctacccaagttgctttctttcattttcttttcttttctgcagaattcaagcagtgtatcacccaaggctgcatcgatcggtgaaggctctattcgatgatcagaattaacacggaaattaaaggttaggatttgagtgtcaattagcctgtaacgcactagttagctttcctgaatcctcgcagcattggccagtttctacatgaacagctcatgagtgcgtttcagaggcgtggcaacttgccgaggaaaaaagggggaaaaaatgaaaagaaagaacactcaagagcatacattacgtgcatgacccaattaaactactctcgagaaaagttaatcagaggttattgtctgattgattcgagtgattgatatacctgcatgcaatccaaggctttaattaaacaaacaaagtcaagagatatatactagctgtttttttttaattattgtagttgcaagatgttgttgtggattaaaagtggctttttgttaagagtgacttgtggaaattaacgtaagctttcaatctttcatgcatgcatgaacaagctgttagtgctttccttttgttcaagctgatctcctcgctgaaaatgcgtgtaagtatctgacatcttcatcctccctgaaacgttttgtgtgtggcctgaaaacctgccatggaatgtggtggtaactgaggcttgatgcaggggatcatgatcatcagatgaccatgcattcatggattaaagtggggttggagaacggatgactgaattaattgcatcactagttaaagcaattgctaataattttcagtttatcttataactaccacctctgttctgctctaaatataaacatttcaatgattcaaattttatacacaatatttacattttttagattactacttatcccatcaattatctcctgtttaaatttatccttattttacaccaactagtgtttgcaatttcggtaaaaaaatgatatttatgaacggtggtcatctgaatttcgtgaattttgatggttcttttttttcatgaaatcattaaaaaatttagcagtttttgactgaattttaataaaatctgaccaaattcaaagagtgcaaaaaaatcgaacgcgatatttcctctttgttttttttttggggtggggggtgggattggaaatttcgaaccgaagttgcataacactaaccccaaccacccctcacattatagtcttttcttctcaaaacttaatgtatactagacaacctagaatgtttatactggggaacggaggaaggagctgataacaagatcgtttttgtgagttggcttgaatatatagttctattcctgttaatagctagccactttggtcccatagtcttacgaaagggtaagattgataggtgatgtttcagaaaggccaaggtcatatgcaccatgttagctaggattgtcctaatttcctttgccaatatatctttgatctacctgggctgtcgtagtcgccgaaagttttaccaacatctaatgcatatattaatttgtaatctctcaatctgtctccagtaccacttctgctgacagagatcaacatcttcccctggcagattatctttgccgacagattactgatatccataaatccatttaccatcatgccatgccacatgttaaagtggaccatcatggcaacttttctttactaggattaattatacatgtattgtacgttgaccctttggtcaaacatgtactcccctggtcttgaaatataagggttcctatgtttattcgaagtcaaactatcgccattctaacccaatatatataaagaatattaatattcgtgatgtcaaatgagcatcatttgagccattataaaatatactttcatatatagtgtacgcatgtggcagatgtgttaatacttgctctagtaaatttggtcaaacttagaataatttggcttaagataaacccatggtttacttatgttagaatggagacggagttaattacacttaattaatatggttagtaatttatccagctcattttttctgttaccttgttactttcatgtagagcagggacatctggttatttaaaatttaatagcactatatggacaagtctataccaaatcaaccacacgatttatataaggaacggtaccgatgggaagcattgagcgaaaaacgaagaaacaatctcaccagccgccgggagactgaattaatcctaaccaaatatcctccaacacaaggaaggtacaattcaaaatttttgttactcctctcatatgcatggccagcaatcaagaaaattaactggcctttaccaatcatttttcaagataaaaatctatggatcatacctaatccaaaattaataatttgttctgtggatgtgctcataatattctgaccatgtgatgcatcggacgataagcacccaatatatgcttataagataagggaatcctcaacagaataagcaagagaggatcagaggaatgctggtaaatggctacacagaattatattacagcatcaagaatagttctcctcctcgtctccatattggtggcaaatattgcccataggacaagttagcaatcctaggcgatcagcatctccaagaaaaataaaggggagaaacaaattgaaagagtcctaggtgagtgaaattgtgaaaatgtgaaatggacaacctgaggaagtaacatctgatagatgatgtcaccatcctacataccatctgcagtcagcagagagcgaacatggttggaaatttgtcagccaagcaatggttactggttaggttcttcagagacattcttcatactgccttttggaatatatcttactccatttgtcctaaaataccataactttagcatttcaaatttgtctcaaaatataacaacttctccacctacattctcttcttaactaagcacaacatatcttctcctatttaatttctctacctatttttcttaactaattacaactatccactattcaatttcccacctccatagggtctgttcttttctccggtactccaactataacttcgtcgttttccgttagaaatctttttaaactgttaaatgatatttttttattttcttaaatcaaataaatctttttaagtttatattagttaatacttaattaattgtgttttaattaatgaactttctagtttcacgtgcggctaaaaatctccttaaaaacaaacaaacataaccttaataccgtgtctaagcctaaaattttttatattttagaatgaaaatagtagttatcttttaggacagagttagtagatatatttatagcacttactagtgttgatctgtaccatgtacaaaatctgcaaaaaccctaccagtaatcacgtgttgagagaaatctgcccgcacaaaatcaataacccacaagttaatcagcagtatcgatctgcagccaccatagatgataccaccatatacatttctagaaacaatgttgtttaattttggtaggatatcacaggagaaccgataattacactctctctacacatttggatgcataaatcatcatcagctgtagcttgaccgacctaacctaaccaaaacatcacatcatcaaaatcagtgtgtatcaaacaattagggccaacatctttgcaggcaattaggagtactctatgcacgcacagcagttcacacttctgtgtcacatcagcattgatataggatatcaattataaaaaatcatgtacgtgtgcattattgattatcgttagaatcttcagatgagcggtatcaaggttcagttaagccagtgtttcttctagctggctactttggtggccacaatttttaatagaatgctgagacggagccaggtggcatatatatctttggtactaataatacatttcagtctctgcgcatctgttgattactcatttatatagtggttcacatcatcagtgtttttttttcacttttgaggaaaataatgctgatcattcacagaagagaacgacgaaaagggtatagcatgcatacaacaaatgttgttgagaggaaatatataaccacaaattatgtaaaaatcttcatgaaaaaggtaaaaatatatttaatctcggcttttttaaaaaatccattagctagctcaatctgtgggaggtgtagatttgtacaacaaccatgacccaacattgagaacgttatctttcgctagcatgaatttagtgcaactaaagattaatttgccaaataaaaagccataggtgccgtattttgttgcgttttcaatgtaatgatagtggtgatggtacttacaacacggcgtggggaagaagtcggcgaggacgtcaccgagattggcgatgcaacaagtgccagtgttggagaacaccggccggcgaccttgatgccttgcaacctggaagaataccggtgaatggaatcaccaattcaccatatgggtgaagatccctacaaggagagaatcgcactacggaatcccctccagcgattttctaaggatcgcgtgtcttaggggttttgggagagtggaagtagagagaccgtcatccttccaacagccggactcctgctttttgtatcactggggaactggaggcgattgaaaatagaagataattaagagcgcaatcgatcaatgtgcttaatttgcaattaagaaaattaacagaaatttaattgcattaattgcacgggccaacagatgtaattagctgtgtccatgattctctctgccgaaagattatttcccaacatttagttatcagacacctatcctttcagttggtactttcaccattttcaacttttggacatgatgtttgactgttcatattattaaaaattcagtgtgaacatgcaaaacacaagtcattttaaaatatctttaaccatgcacaagccacaacaaaataaattatatgtaataactatttttaaagataaatggtcaaatgtcatgacaaaaactaacaatgtcattcatttagaaacagtaccacttaggaccaaaattttcacccacaaaacggtaatccaaccgccacctgcatatactatgtacttcctccgtccccaaattgttgtctttataggatttaaaatttatcctatcaatcacttctcatttaattttatccttattcaaccctcaatcacgatcccactatcaaacatacatcatttttctaccctcaatcacgatcccactatcaaacatacatcatttaataaaggacattacaatttttctatcaaagcttaatcaatgctaaacaacctatagtgacaactattttgggacggaagaagtatatctctagctacaactcaaaatgcgcagggccggccctggccctatgcagccgaggcgaccgccgggggcccatgatggtggggggccaactctgaaaatttaaaatccttcgatgaagtagatctttggtcgcactgcaagatttttgcgaaaatatttaaggcccctttgaatcaaaggattcatgtaggaatttcataggattcaaatcctataggaaattatcctatttggccctttgattcaaaggattgaagctctccaaatcctatgaaattcctatagaatggcacattgcatgtggattttggaggaaatttagcaagagctccaacctctttgaaaatttcttttgagtctatctctctcatccgattcctgtgtttttcctgcgctccaatcaaacgaccattcctgtgtttttcatgtgttttgcaatcctctgttttacacttcaattcctaccagaatcctgtgtttttcctattcctctgttttttctaccctgcgattcaaaggggcccttactcatgagaactcatccgatgtttagatcaatgatttttattcagaatcttcgatgtccgcgcctgagattctgaagtctgttatggatacagattgctatccaaatgtttcagttgcttatcgaattctcttaactgtacctatgacggtagcttcagctgaaagaagtttatcaaaattgaggttgttgaagaactatttgagatcaactatgtcgcaagaaaggttaaatggcttggttatgtgctctatcgagaatgatatcttggacactattgatcttaataccgttcttgatgattttgcatcaagaaatatccaaagaagtatcttttcataagaagcaatgaatatgatggggttctatttttcactaaggtaatgatattagttctaaggtattattttggtcgactttatttctcaataattaccagacatgttaaatttaatatatggatatatttattttcgttttgcaagtaaaattagcgtctatatatatcacaaaattttttatatagtttagagggcccatcacgataagtttgcctagggccctcaaaatcataggaccggccctgaaaatgcgtgtgccctttcgtcacatgtgcgttcatgcaccgtctctagtgatacttgcaaattgtaaccatctttttttttgcataggtccgcgtcagtgattcatatgttgtctagcttaatttttcatttggtaggtttccaccgtcatatatattcgttgttctctccctattggacacaatccgaggaggatcacgaatactaacatgggacatgtgccccctcccaaaatttttttttcaagatttctaagtgaccattacattacaaaattgccccctctttctaatatgtcaatgtgccaagtcagcattgcataccaaaaaaatcaaaataaatttgggatctagtatacatatgagtcactaaatctaagatacctttaatttactggagttaattggcaacttgttctatctacttggagttaatctaggaagaatgcattaattggaagatgtgttcttccaattaatgcacacatccagtggcagccacgatgttgtcaatgtagcaatccatgaaaagcacacgggaatgatttttccatggatgccctaggtatgacactaaagcgctaattggaacctcactggccatgagacataccttgggcgtccgggaaagaaccactccgatgtggttttgcataggtacattttagtttctagtgcaaatttctatctattagaatataaagtttgtagcaaattacaatcatctttgcaatgtacaatcattgccagtggttcatctctgtcctagtatattctctccactcctcttggacatgggttgtatatcacagtacagggctacaaagattgaaatggggccatgtggccccccccccggccacacacacatacaaagtttatttttttgcaatatttgaaccaaatatagcatttgtttaattagagctgattaaactttaaaattggcccctatttctaatgtgtgtcaatgtcctttaaatatatataaaaaaatctagcttaagcttggccactagctagcatcacccttgctagtggttcggatctatacaactcattttttctccttgaatggatcagtgtcgtcacggatttgtatcctttgtattaaccctagttacggtttacggtttgctgttctttatcctagccgtctatttctgagaaaatgtagaatttccttggtccttattataacatctatatatgctcctatttcccatctctaaactcataggtaagtttgtagttcagtttctctaccgccaattgcctccccgccgtgctatctctatatcatttctcaactctcatgttgtcatgcaaatagagatcagtgaagaatgcagcaacatgcgcgtgtgctcataatgctattgttggagaaaatgctcaaaatctaacaacaatctttgggtatctgtatataggaccagcattttttttctaacttcgtgcaatttgctgctatttgttcgtattagtttgaaatttatgctagcaattgatctctgtagatgctggtttactcttcaggttgtgctttttgctaaaaattaatactagcattttgttctgagttaattaagaggtgtaatgttcacttgatcattgggtttttggggagtttttccggttatcatcagtacaagttttgttcaatgcaaagaagttgcatcctcaccggcaacatggcaagtaggacagagttagccatggatgacaatgactctcacctttgatatctagagtaccaggtgatggaggccaaatatgaaagaaggaaacctcaccgttgttttcagtggcgtccttgagcctgagcgggctgtacgaccgaatagggcccccaaattttaagggtccataaaatattaagtatgtcctatatataataatattagaggctttaattttgttaatttgcagtctaaatagtagtaaaacaagacccaaaacactgcagaaggtgaaccgatccaacttccatcgtactcccgtccaggcgtccgcgtcgtcgcgtatcgccgaagtcccgacgccgcagccgcttcgtctcctctccccagtcccctacggcctccgcttctacttcatcgctgatgattggctgattgccacgcccgtttttaattttactataaaaaattactaggctactagagccccattttaatattttgcacggggacccgatttggccgggacgcccctggttgttttgaaacacccctaatacattgtatttgcttgctgctagcggtagtgattaattattgtgtctttcttttaattcttattattacatggtaatgaggatatatttttgcttgttacggagttttgtatcatatcttagtataaagttgatgtccactaacttctaaatctcaatatatatgtaaatgtgtcacattattacccagtagcaattattatctatagtactttaaataacataaaaatgtgtaacatcatcactcctagcaattattatctagagtattttaaataacatgcaaatataacatatcatttacaattttgttgacatgcaagcaacgtcaaattaatatctctatattatttttacattatttaaacatatacacatatcatttataacgtataatatgtattcatccacatatcccgtagtaaattaaacgtgagaaatacaactagttattatagttggtactccgacctcggatctttacatagttaagcctgtatatatattgcagcatttcaacatcaaagcagcacatttagatgtctgtcttttttttcaaaaaaaaaaaaagatatagtgcagtatagtactacacgacgtacacgttcgcatgaattcgggggcccactttccagcgagacgccaggtggggccgacccagcgcgccaggaaggattgatgcatgcgtgggcccacgtgtcagatggcgagcacgaggccaggcagcgacctgtcgtcgtcgtcgtcgccgccgccgcgcccacgttggctctgccagcacacggcggcgcgccggcgaactcctcctccgtcgagctgcggccggcagtggccgccgccgccgacgtcccggacggtgacggaggtgttgaagtactcgcggaggcgggtgatgcggccgccctcgacggcccaggcgtggacccagtacgcgcgtggcccctcccacccttccgccaccacccacccgccgccgcgccccaccgccgccacctgccgcggcacgaacacgaaggacgacgccgacgcagcctcggcctccccggtcaggcgccgccgcatgtgctcgcaccgcctcggcccgtggaaccaccagtccacgtcgcccgccagcacggccgacgccgccgccccgtcccccgccgccaccgccgcgtacagcgactccaccagcctctcgttctccctcgccgtcatcatcgcctcctcctccgcttccaactccatggccatccgatcggttagttcttgggagatgatcgatgcgtcgatgtggtcgagcaggtgtggtgcatggaaggatgagctaagctaggcgagagtgagggctatttatagggggtttgatttcttgaggaggtggggcccacagggggtggaaagcttgtgaatgaagtatccgtgcaatcacctaattcggtgcaactatgtaactctcatcctacaccgttggatcgagaaatggacgctcccagtaaattttaacttatgagtgaatctacgagttaaattttaacttataatgatgtggataatggtataggatgagagttgtattattacattgaattaggtgattgcaccggatacttccccgtggataatagggttaggtttgtgagatttggagtgaactagctagctgggtagtggtagagtacgtaattaagtgatgaagatttgctgctgggggtttgaatatcctaatgattgtgaatgcaaatggcgatggaggtgtgtcggggagacatcaacatctataccgactagtgaggtttcgcctgggagcgtccagaactgaaatgactattctgccctttatattccttgtgcaggataacaccgttgttgacttttatcacgacatttgagcgtttgttttatttaaaaataataatataaatatcatttattttgtcatgacttgttatattattaattaaaaaaatttaagcctagcttatattttaccatatttatattaaacttgtttaaacattgttttaaaaatcaacagcagcatccctttagaaatagaggtagtatattgcaaagtgagcgtagctcaactagtttcttgtggtggaaacagcccacccggattctaatcctagatttgacaacgaggtgtatgtggtgacttcgtcaatctcaagatatgccggcccaattatatggaggtgctcatagggataaggtctgcgtgtgtgcgttcataggatcactggtggagaaaccatctttcgtcggtcggccgatttccacaatagtcccggatgcaataaaaaccggggctaaagatgatctttagtcccggttcaaaagggaaacgggtatatttgatctttagtcccagtttgtgttaccaaccgggactaaacatcatctttagtcccggttcgaatgctgtcaggacctgtcaggcccccccgggatctttagtcccggt

SEQ ID NO: 59857 - DNA, 749 bp, Oryza sativa
gaggagagagatgtgcaacttttttatttttattttatttttttgatatttttttcacacttaggaactcacagaaaccaaccatgtaaaaaataaactcaaacggacgaaatatgtggcatatggaattttccaaagctccaccgaaaaacttttctcctcgaaaacacaatcttgcaagcggaatttggaggttttaatatcgccgaacccggcaaagctggggagaatcggatgtaactttttctgtatattttgaatttggatatctggggagaatcggatgtaactttttctgtatatcttgcttgctctttttctgtatattttgaatcttgcaagcggaatttggaggttttaatatgtcattttatgtggttatattttgaattagattaattaatttcatacagtggtagagtgcattatgtttaacatgctgatcaaagggttttactaaaagagttacggtctaattttattgaaggtgcaaagtagactaagtggtatgctagatattttcagacttagctaagtggtagtttgagtttaatttttttttgtggttggttgtatcgtgatcctgagtgtgaaaaaacatccgaaaaaataaaataaaaatgacaccgttgcaactccatatagggaaacaggaatggaggcggcggcgccagccatgctggcgccctcctcctgccacatcggttcgcgtgtgccacggtggcaggaggacggcgccagataggcag

SEQ ID NO: 59858 - DNA, 18238 bp, Oryza sativa
cttgagaggggtatcgaaccgaccaccgctaaatggccggatcgatcgaaattctggtactatgctcacggtggaacgcttaacccagttgatggctccctagtcttcagcgatcagaggctgccagtcgactaacggatgcagtggaagcctcttctcagggcacgttccgacctgacagtgagaaggacgagctatcactcgccctgcagactcccgatcatctaggacgaacacgagggaaaggggtgatccttggaagattggattcaaggaggacatccacacgtacaggagtcggatgaggagcaagagagataccgaggcgaagattgcagatcttgagtacagggtatcgagctacgagctcagcattcaagaggaggtggcaaggaaggtggataaacgcatggccgcacatcggtcccaggatccccagccgtacattcctcctgcaatggtcagcccatcaggcaatcgtagcagctgcgcctcaacggggcaggtaggatcacagagcatggtcgccatgcaaactcaggacgaaaccacctaccccgttgatgagatcactcagcggacaccatgtgagctacatattcccttcaagaacttatcaatcaaggtatgctcgtagttttatgatttttgacttgtctattccgcaagttgctgcttatgttgattactaatagataacctctcaccacgtgaaggtggtgtcgggaatggccatcccaacggacccttcagggacttaccactgcaggccgattcctgcaggatactcgaaggtcaaagttgagttggtggaagccgcgtacgaggacctcgagttggactaccctggaggagacggtgagacgcatctacgagacacaagccacgccattatactatggtgcaagcggtacatcatcctccctgggcgagaagcggcgtctcgtgcaccatctcctccggctccgccatctcctcctcaggctccagcaccgtctccacctcaggctcctgcaccgattcttcctcaggctcctacaccgactccgcatcaggctcctactcaagcttctgcagtgactcctcttcaggctcctgcgccgactcctcctcaagctccttgtccatctccttccaagtcaaggtcccaccaagctccaccgcctgtccgcacaagggcaacaaagaaggtgaaagttgacgccgccgaaaacaaggagccggcgtacaattgcatgcaagaggagcttgacgcttatgtggcagcagaagtcaagaggcaattgaagccttgaagtccagaaaagaagattcctatagactcgagtgctaggaagttcttcaggggtatgtctgcacatgccaaggaggctataaagctatcggactataagcgaacacttaagaaagcatattctggaaagtccaaaccaatccctcagcttggagagcaaccaaaccaggaggttgagccgttggtgacaggtgaagaatttggaataaaagaatttatttctgacaccgggctaactacggatcaattgctacgaggtgcaccaatcccaaagacggaagtgaaatacaagcatgaactcagtaaatcgcttgtcaagcctgagcagctgcagtccctaccgacacagatgtacaaatttcatcaattgtacatggaaatgagcgccaccggtagagagataattggagcgaggattagggacacggacttcttgctaggagaagatattctctggatcaatttcaagagtatctacaaactataccaactggacgccctcgacgtctctattatgagttgttggattttgtaagtatcgttcagttagatttcttattacatttcctttaattaattaggtccttgtatataagtacaccatatataatatatacttccttttatcgttgtagaatggagattcaaagggcccgacggtggggggttttcgatactagattcatcgaccctcggaaagtaaacgtctcaatgatcgacaagtatccggaagcaatagaggacaatctcgtccatctcttaaaggcgcagcattacaagacattcatactatttccgtacaacacacagttagtttttactatcttcctaccaaatttcattcccgtacgtacatgctaagtgttttatatgtcatgcatccgacacacattgcagattccactgggtccttttactcttcgacttggaggcctgcgtagttaatgtaaatgactcaatggataaaaaagagtctacgtttgaccagctttttgaacttatagacaggtaatgtcataagttccaatgttattacgaatcttgatataattaattgctactacgaatcatagctttaaactccatgtagggcttagtatcagttccgtcatttggtccacggcaattggaaagaaagacttaggaggaagtttaaatttcctatgagtacacatgctctacatttatattgaatctccaattcaaatacaagtgtatattaattagatctctcgctgtttgtcaggtatatatagtgcgcaaagtaagaacagggaactaacttgtgcggctattacgtgtgcgagtattgccactgccttgcagaccaaatcatcaccacaagagagcttaatgtacgtacaaataaattcaaaatttcattgcgtacgtatcgatttgttgtttactaattaatttcatacatttataggttattcgtatgaggtataacctcgcacacaaggaatttatcatggcggttcaagaacaactcatgggattcatcaacgaacaagtcattgatccccagggtgaattctactacgacggaaatacaattcataagtcgttagcttctgagataacgactactacatcgaagtcgtagctagcaaggacataatgaattgtaattaatacatgtctatttttctatatgtttacatttactttagtgtaaatatatattttggtcatatatatgcactcattttaagtgctttaatatatatatacatatgcatttgcatacatatatgtataaatacatatatattatgcatgtatatgtattgaaacatatataaatataatatatatatatatatatatatatatataactactatacaacaccttaaggtgctacgtattaaacgaagcgtgatacagacctcacatcccacaccacaccatcctcccccaccacaccaagatgttcagtaattttttaactcgcgaacgaaaatatagagcgctaccttattggataagagccataggaaggtgcgtagtaaaatatttactcacgagccctgtgcagccaccctcttgcatctcgagatgttcaataatatttttacttcattaaagtatgagtatttataccataggaaattctatccaaccattccttccagcatcaatcactccatttttttgggatctatagcacggcaatctcaatcgtgattctagcagaggaaaggacgacgcccccttcaccgcgtgctcgccagcgagggcttgatggcggtggccaccgacgacgatgaagatgttgaagagatgcagggctaccggatcggaaggattggtagtgcctcatgcaaggaagacagactagtccagatgggatctgcagttggaacacggtcttctctggtgcatttgtgttgttctttggtctttagagcaaatctttatttttttttggctgtatttgatctatttttagttcttgaatttttagctctcaattcgtcagcactcctgatgatatttggtttgatagctaggttagtaggttgtgcacttctgcaaacaatgctgcagtgtcccttcctccggggtggggaaggtcacgatcgaccgcgctcggcgggcggcagcgacggactgcaggcccggcgagcctctcaggtcgccgttgatggggatggaggccttcgacacagctgcagcatccccttcgtccatgtatgatggcgctagatgtagctccaatcggttcctaggcgttgagtttcaaatttgtactgatgcagtgatgcttattcctggaattgctggatttcttccgtgtgattcattacgtacgtgtgccaggttcggccggccggcactgttcccgtcctcggggaagctcatggagtcatggtgtcgcaagtcgcaactgcgtgcagtggcccatcgccgtcgaccttgagactaacatttggccttcactgaacttcgcgccgtcgtcgatacctcctgccaggctgcctcatggcagcgacaagcaagacatcggcaggagtcaaaatgctagcagtagctgccgtttagttttttttatgcattatatagatggacctacagctgccctgtaaatttgttactactagtagcacatttatgttgtcataaaaatttactgtaccttttttttactatataccagcagcgatctcgcttgatgcacacattttcgtctacgtcgttgccatgattgcacgtggtgagctccggctaggccatgtcgaacagcacgaataactcactggcaagcgaggattggtactcaccactacgacgctaaaactacgcaaccatcttccctttttctttaaacgacgacgaaaaaaatgttcacccccattttttccggatctgccatcagttcgtgtggatggaataattcctttctttccgtcactttaactgcgattcaattctccctgcgatcacatttttatctgcttcaaaacaaaagtcattttttaactacacatgccgagtatttttataactacaaaatcatctggggttggaaccgctagatctgcacttagttttttcaaataacagtcaaaatttaactatttatttcacacagcacgaaagatgtttacaacccataagttattttttacctattaaatccgacgatcaaaacaattctcatgcaccacgatcaaaacaactctcatgcaccgtacaagttattttttaactatacacgttcaaaaactctatttttattattaaatgaaagtaaaattatcaacctcatgtcgattaaggcccagagtaatattttaacttataacatgaggcagtaattattttactcagccttcacaaggagtggtgtacaggcaaggcaaattagaggagagatgatccagtgattttttctacctgccgtacaatttttttactcattaagcgttcacatgaccagacgagtaatttttttaactcgggacaaatgggatgggaaaagactttgctggcggtggtagcagtaaaagcggtccaagaggatgcggtatatgagaaaagcgaggaatccggaggcgagcgctgagaggcgcgctacttccttcgtagcgctacacacgcgctgtgtagcaccaccccgcgcgtatatatatatatatatatatatatatatatatatatatgcataaaccatgcagcaacagggccatgcaaataaaaaaaatggcacctcgatctttagtcccggttatttcacccaggactaaagatagcgatcttcagtcccggattgtttaaaccgggattaaagggggttaccaactgggactaataagggtttctctaccagtgtttactattatattgttaatttaattaccctagaaacaatagcatagctattgggaccatttggataggctaatccgggacagatgggaacataaaagccaaaaggatacttcgatggagatgcatgcattgcactgcaatttgcagtgatggcaatttgagccacatgtctgtcttatctgattggattagagggaaccgaatccgaattcacttcagtttcataattaacatgtgcctttagcaaagtatatactataggatagcagcaagcaacaagtagcaaaaaggtcagtgtccgggcatgcatgcttgttgcttgtacgtgccgtgtaggccagataagatgataaatggaataattaatggatgattggttatttcctaggatttctccataagatttttttcatgatgtttactcaatcaggttagtttctgttatatgttttatacatacagatgttgtcctgcatgagtgactgaccagtgatcatcaccaccttaacaaaagaagaacaaaagtttgatatttttctttgagaactaaaggagtacattctcttgtaaaacagtctaatagtacagtgactacagtagagaatatatcgtacaaactaaatctaacttaattacgagaaaatcatttttgttggatgggggagaattgctactctactctaataagttatataaatatgtaattagaagaaaaaatggtgtccattacgacttcgtcattctcaagatatgcaggctcatttctcagaggtacacatcggggtataatgtatgtgcgtttatgagcgagtgtatgtatattatgaacgtctacccttatactatgtttataaaaaaaatgtcgagtaaaaaaacgaaggcagtgtggaataatttacccatcgaagacaggatatagtaaacttagggtgtgtttgaggagaaggggattgaggagattgggaagatacgcaaaatgaggtgagccattagctcatgattaattgaatattaactattttaaatttcaaaaatggattaatatgattttttaaaacaacttttctatagaaaatttttgcaaaaaacacaccgtttaatagtttcaaaagcgtgcgcgtggaaaactgagactcaatctcccctatctcccccgaaagaacgatgccttagacagttgaggcatagaccaccgtatgctggggaatttaactatttgccattattagattcggcagttatccaaatacccctcttaggtttgcacatattattttgcccttcttaagaaatgtcttcttaactatttgccacttttacccacgtggcatgctaacatggcaacggagggtagaaaccggtgtgggacccactagtcagcctctcctctctccttctctccctccggtccagcgtggcgccatcatgatggtggaggaggtagagcagcggcgacgaataaggagaagcagcggcagacggggctcctcgcggtagtggtggatgcagagcggcgacgccagcggaggaggaggcgtagcagcggcagacaagctcctcgtggaggcagtgaaggcggagtggcggcgtcgcggaggaggcgtagcacggcactggcggaggaggaggcgtagcggcggcggacgagctcctcgcaacggccgggcaggtaaagcggtggtgccggcagaggaaaaggcatagcggtggcggacaggctcctcacggtggcggcgctggcggaagaggtatagtggcggcggatgggctcctcgcaacggtggaggaggcagagcggcggcaccagaggaggaggcatagcggcagtggtgggcgtggtgcggctgacggtgaccgaactggtgcgctccatcatgacgctgttgctggtccggtcgctggcgaggatgaaccccggcgtcatcgaggagcccgtccgccgttgctcctcctcatccgtcaccgctgctccatcatggtggcgccacgctagaccggagggagagaagaaggagagatgagaggctgattagtgggttccacactggtttctaccctccgttgccatgttggcatgccacgtgggcaaaagtggtaaatagttaagaagacatctcttaagggggtaaaatatgagcatactaagggcccctttgatttggaagaaaaacataggaattttgaaatagttcaatcatataggaaaatttcctatgaagccttttgaaacaaaggattgaatcctatccaatcctttaaaattcctatgaaatgaataatcctatagagattttgtagaaaatttagcaagagcttcaacctcttggtaatttttcattgaatctatctctctcatccaattcctatgtttttcctacgattcaatcaaactattattcctgtgtttttcctacgttttgcaatcatctgttttacacttgtactcctatcaaaatacgtttttcctattactactttttctcaatcctgcgatttaaagggacctaaaagagatatttgataattggacttaatcctgcgatttaaagggacctaaaagaggtatttgataattctcaaatctaaaagcggcaaatagttaaatttaccctgtatgctcgcacccggccgtatatgtcgcgtcctcctctccaaggcagctaccacacccacacgcgaagcttccagtcgcggtcggtcggggtctcaataatatctggccgtgaaagtgacaaattaattagcaagatccaacaagaattcgagatcgagctagctagcagctgtagcacgcgacgacgcgagaccatcaccggcaacttgcgaatccatcgatcttgatcgatcaaatcggtaacctttaccgcctacgatgcacatctgcacgtacgtgtgcactgcgtgcgcggctggcgctcagggtttacattaccgccgcggttaccggtcctaccgaggtacggtaatagaaaaatcacagtaacctccttaaattcaaataaatttaaaaataatttaaacttttgataaatttttacacggtattgtacggtttttcacggttaccgtgcttaccaccagggcacggtaaccctggcccccgacagtttagaaaaccctgacggctctccagcgatcgtaaaaaactcaatcctacgtaaagtacgtgtacatctatcccatggcctcgatcgcccgagctcctttctttctttttcttcatacttatacttatattatagattttatctcaattttatacgaaaacattttatatggaatttattttaaaatattggataaatttacttaatattataataattagaacttaattaatcatgcgttaattttttttatttttttaaactaattttacttttattttcagtagaaccaaaggccattcttacgcagggattatacgtacctactcttcggtcctgtttggataataatcctccggaatcttgttatttaggagtattaatcgtagattactgacaaaacccattctataacctctaggctattttgcgagacgaatctaacgaggtatattaatctatgatttgctacagtgatgctacagtaatcatccactaatcatggattaatatacatcattaaattcgtctcgcaaaatagtttaggggttataaaatcggttttgtcgataatctacgtttaatactactaaataacaagattttggagggctatttgatagcttgagtatccaaacaagaccttctcagtgagcggctgtgccatttgccagcattcaccggtgacctgaccgccatcgatcgccatgcatgccatccgacatgccaaactaatattgaaaaaaaaaacgaaaatatacgtcgattacttctagtacagtatatatgctgctgcctacgtgcagtatccaccttttccaacttggattcagattcagacgcgtgcactgctgtgctatgccgtgcatgcatcccacgactattcttcttgacgtgctcctctagctttcccaataattaatgacgatagtcactgttacctctatctcaaaatatatcaataggatataacctaatactttatcttctttatattacatatgaaataagtcaaacttatttaaatttaattaaatttacagaaaaatattatagtacttctaactgaaaacaagcatattatcaatatatattaaatgttagatttaatgaaaataatttgatattgttaatgttgctatttttctatattacaaaagtttgactatagaaaaatcaaagcgacttataatacgaaacggaggaaggattacgaatctggatatgcggcacatttttagattcgtacgtattactaagctatgccaaatacgatactatttggttatattttaggatagaaatagaactctcataatttatactgttagtatataagtaataatagaagaaattaattaacacaacactacaacagtaatcagcagcaagatagaacacagctagctctagtttaagtgtaactaggcaacaagctattcatttgctacttgcagtagcggactgaacgaatcaattgaatatatcttgtgagcttacttcaaacagttcagcacatgcttataattaataaatccatgcatatataggttgactgcccaagaccaaaacgtgcatcatatctatatatatgcgacttctctacgagagaatattttcaaacatgcatatatagttgaagtccatgcttgcatggaaatgcaccaattaaattgaatcaaacctcgaatatatccatcgatccatgagaccgtgaccacatcttgactagtatatatatatcctcgtatcatcgagctcatgtctcaccgattcgtgacagttttagattcgacatgaaaatgaaatcgaccaatggaatactagtactttaagactttgaagtgagctaggcagtagtttgtttgggctggatggttgaataatggaattcaaagttctacagtgcacatgaaagattaccactcacaactgttttatctatttatttattttttttgtcatcctatccaatgatatatccaatgatagttgaagtggcagcttatcggactagaaagctggggatcaactaaacaacagagaatcacgtgaaagggacttataaattcaatgaaagcaaagtgttaaagtttgttgtgtttatttatcgatctttggtaaagctaatgagatcacgttttacaattttataattaatgacacggtcatatatacattaaccgtaccgatctaggataattcagacatggctcagcttatctgaattctggttattaataagcaaaataaataagcatgcatgtaccagacaacgatttttcttctgttacaggtttgcgagttttacaccataataggatcaatttatcattgacactgtaccaaggtttacatcattatcactatcagttatctgtgattctcagttacgtatacttgcaagacttgacttcatgcatgctgaatcgaagttatcaagttgacctaacctaattgtttgagatcattaattatatagattataactgtaatatagtgagcacatggatggtctgctaggatcaataattggttagctagtagatggttccatggatgtcattgcaaacgtcaatgcatataggtcaagctaacataggaccaacagttatgcttcacttgtcaaaagagatattttcttttcctttcttcttttcttctttttccatgcgtgtgaaagagattttcaaagagaaggggatctatatgtctgtctaaacagaatttacctctttatgagaccggccagctgggttgctttagtaccctacagtttgttaaatgttaatcactatcttttctccctgtttaaattgcatacatgcatggtatatcatataacttttcttgaaagctagcaacttaattgcttgatagattgctagatatgcatgagtcagtcaactactcaaccacatgggtcctgtttctagatgatctagtaacggttgtcatgcatatgcaacaggataatggcactgtcaataacaaatactaacagtacaaagaatgtgatagatgatcggtatgtgcatgcagctgctaatgcaggagaaagtcaaaacggatgatgattagttcatgccatccaaaactagaggaattttgaaggatttaattcctgaggaaaaaaaactcatgttgtcctttggaacaaagaaataactccctcaaagtcttcaaaattcctatgtttacttttccgacagaaaagactcatatatttttcccatgtgccatccaaacgttagttttgaaactttttttgtctttaattcctatcgaatccaacggccatgacactttgttcccatattattattctgttcatgtatttacaatccaaccagagtcgtcttcaagtcctgttgtttttctctctgaacaataactttgtcatagctatgcaaatggcggattcacctcccggacagcactagcggctacccggctttgcgtgttcggccactggattcactgtggtaattaaagtccaccaattcaccgtctttcccggacaaaattagcaggttaaaattaattagatcttggtgtaaacggcgaggattgggcgttagccatcggtaatctgttgtggcttgcttgtttgccttcaaaatggacgtggaccactccaagtctccaaccatcggaatcaatggaatctcctagattaatgacaaaatcgtatatattttttcagcataaactggatcatgacttgatgattagcaaactgagcatatacacataggtttagtggcagtgtggcacggctttaattagacttatccaggttttctgaaagtcacagttgaataacttatgaaaaataacttcgtcatgacgttcttcccaagcatgtttctagattcctttgctctactggtcaaacccaaattaaacttatctgaaaatagttttggtcaagccaaatagtagtagtcagtgagcacatcagcatggggacgacgacagatgagttatgctgatgcacgtgtacaatctggacatttcaatattatctatcttggtgacagtagcataaattagtcaatgcgtttgatcaatcaaacaattaatcaattaaggtcatgggattgacagtgatcctgtgctggaaattagtttaagagcgaggattatatatatttaagctatctacaggctgattatatttgccgtgagcaatcataataagtaattaatttaatggtcaatgaaatgatccacctgaaggctgaactcctctttgcttggaacgtcatgtgtccttgtcggttctaggctgcttctggctgggcgttaattaatttgcttctggaggaaacccaagagttaatcaacaagtcaaagatctctttccgggctttgttctattaatcccaatataaaagcgattggatagaattaagagaggataggtgtggaataacttcatttcaaatctacctcaatcccggtttaactgaacaagacctcaaataaagacatacatacatgatggatgataatgatgtagcagccattcagcccaaatggcaaacatccactacatctggtaagtactctttcatatatagcatttccagcaaaaaaaaaagaacacactataaaaatatatttaattatatatttaataaaactaatttagtgttataaatattgttatatttttctataaacatagtcagataaaaccaaaataatttacaatatgaaacggacggagtagtcggtagtgtaggctgcccttctaggcctttttcagctggcttgtgtgttgctggatgggctttcacgtgggccgtcatgctcagcacgtgggccagcccacacatctgactcacctagtcctttcaagagcaatagttttgcatccacatggttatcaaggaaatgaatgggacactttatgcatacattattttgttgtatgatacgtgaatttatgctccgtccatccttaaatatatttgatgccgttaatttttttaaatatgtttgacctttcgtcttattcaaaaaatttaagtaattattaattcatttcctatcatttgattcattgttaaatatgcttttatgtatacatatagttttacatatttcacaaaagttttttaataatatgaatggtcaaacatgtttaaaaaagtcaacggcatcaaatatttagagacggggggaatacattagtcaaggtgcagttctgaactaaaacatgcatcagtttctcgtggggacaacataaaagtagtttaattaattgctgctaaagaccggtttaattcttgagaaacatgtggagttcattgagcacgtccacatctttgtagataggcacacaaggatgcgtaaaattaaagagaacaccggtaagaggtgatcttactagcaaggagcatgctaaaaagagataaatgggaagaaaatgaggttagtttcatatttattttattgaataaagttgtgctagctaccatgtgttcaaatttcatcccaaagttattttagatacgaacaccatgttcttaaatttgaatctattttgtacacttgaaattgttaatatattacctttgagtaaaatacatggtagccgggcggtccttaaatttggaccagattcatgaatttgtaaaatacaacacatctacatctctagtcttggtttaatgtataccactcaaagtccaaagtgcatatgacatagctcacgcgccgatatggttatccacggttacgagaattatgtccttaggcctacactatagtattccccaaaactgactccaaccacccccaactcaacaaatatatatgtatttctcagcatctagaaaattcatagtatataagtcatgcgctaaaagtatatttgatagttctaagagtcacacgagggacctaaatgtaatgttcttgctacggttgacgaccacgtcaaggattaaaattccagaacgaaatttcggaacacccccccccccctcccataatattttttcagctgatatttttattttttttgtgaattttggcaatattttgttcaaatttttgaaaatttcgaaccaaaattttggtatatcagccccctcacatataaacgtccaaaccaaaagattaaaccctgggcaatatactttgaccacggtagatgtgtatttataagttcatagacctgtaccggccatgtattttacccacgagcttttaaatacttgcatcatctttactattataaaaattaaagttgttttttcagtattttgatacgtcatccatatatgagttggttttaaaatcgttcgcttttgaaaatacatatccgtatttgagtcggggggttttaattttgtccgcttttggaatgacagaaggagtcgtataagaaatccattaaagaaaactcgcatgttaatatgggataatcgaactccctaattatagctcatgattttctagactcacagtgaatttcacctttactaaaccatataacaataataagattaaaatagctttcatccgttgtaacgcacgggtattttttctagtctagtaataatttaacgggaatgctaggggatgagataccgtttcccaacatgatgcccctcctccacaaacgcgattctcacccatgcgacgcgcccgaagccatcagcgcgcgcccgtcccctgcctccgtcgtccccatcccctaccgccgcagcgcccgtcccccgccgccgccatccccatcccccaccgccgccaccgccgcgcccgcacccaccgccaccgccgccgtcgccgtcccttgccgccgcgcccgtcccctgccatcgccgccgcgcccgcacccaccaccgccgccgccgtcgccgtccctcgctgccgccgccgcgcccgtcccctactgtcgccgtcgccgttgccgtcctagtctacaggggacggctgcaggtggccggccgcgcgtcgggatgctcctctcccaacgggatgcacagttatatctactaggaatcatctgatacctggtaagtatcatccgatatctcttaagtatcgcgcgatacatagcagaaatcgtctgatacctgacatgatacttcgcgagtatcacgcgatacgtggtagaaatcgtctgatacctgacaggtatcacatgatacctcgcgagtatcacgcgatacgtggtagaaatcgcatgatacttgataagtatcacatgatactttgcaagtatcacctgaaacgtttgtagaatcgtctgatacctgataagcatcacacctgatacctactcgggatcatctcgttcgaaaacgggattccgttatatagcagcccccataatttaagaggcaaggttttgcgcttaccaaggtcaacgtgctaagagcaggtacaatagcaggctattagccagctataaacatattttaataagataaagatgagagagaaaagtagcgggctacatatctgtagccaactgtagcacggactccaagacgcattgtgtgtatgacaggtgggaccatatattaatagtatagtaagcaattattatatgaattgactattagattggttataaatgatttggagctagcagtgggctatactattaaacttgctctaaactatgctgattagactgaacaaacctaaatttaaccagatgttatggatttcgaccgaagttctttttttttttagataattcgacctaagttcttaaaaaaaaaaccatgtaagcgtcgctgaagaaagtactaatagatgatccttcactttatgaagcttataacttgtttaacatgttgaacctaataaagcgtcatcgaaagtgaaggatgattgttaaacttgcctggaaaacgtggttggatctagacgaaaatctgtccgtaaagcagcccgaaatccttgttagtatccaaatcaaagagagcgcatgtgttgtcatggagaaaaggacacatgccaggatgaaccttcttctagagtatgacattaaattgctgaaaattcagtgattcgggtggactgctcttattcagtcagcttggggacagaggtcagaggggttagtgctttgattgtagcaggtttaattacttactccttcccggttaataatacatactagtgccacatcacttgaccagattgtcacatgtcgtggagttagtgttagttctcaaaacaaaaaataaaaataaaaaaagaaacaagagtgcactgctgttgttagtgtgcagttgcactttgttaattacctggacaatggcttcagctggttctcattgaaacctagtcagagatgtagatacatcaaacatggctgtactttttctccactgattgatcatgtaggtttttttcactgagcatgataaattgagatataaattagtaattggaatccaagaagaaatatgattgtaattcctaccttctggtctcactcactgatcaagtaattgggagctaggtcggcctgccagctactactgtttgttttcagggatgtaaaactgcatgcataccatatgttgtagatctttctccccatgttttgatgtaagcatcatttgttgcactttatatcagaggatggaggaatccacatctgcatatcgtttacaagtcagtaaattgcttgcagcatggggaacctgaagtgatgtgattccctgcctaaactagatgggacgacgagggacttaaagtggacctattcctttattgggtcttacagcgatgggccgggcaggctatccaagacttgttgggcctagtggaatcaacgaccagactttcagctcttccgaacaggagaaatttggaggattttcgtacggaataagttcacattaggtcccttaatttgttctgaaatttatctctgaaccgaatactaggtatagaccgtcccccaactcacagcagtgtcaattttagtccctcggaagtataatgaccggtttcagctgacatggcggttgagtcaagcgtgcgacccacatgtcagaacaacatagtctaaataaaaaataaaaattggtggaccccacctgtaagcgacacataatctccttcctctctcttctctcaaccttttctcgacagcataggccggagcagagcgtcagcgctatgacgcgtgaagccatggggcgtaagcggcggcatgaaggagcacggcggccattggcggagcagttgcatctcctacggccgcgtgcctcattccccttctttcctctctgtccccagaggcaggcggcgattggcgagatgagctgggtggcagcgacgactggctagagagggcgatgggtggcaagagaggagctagcggcggcggcaagagaggagctgggcgcgggagagagcagtcatttggaaagacgttgtcgtcttctccggcgtcgctttcttcaacatcttcttcggctggctactaaaaaacactatcggcgcctgtgcg

SEQ ID NO: 59859 - DNA, 2840 bp, Oryza sativa
caatactcaaatagtaatatgctcatgtcgcacggccgcagggcagtacaggtggcgactaggcgagcactgtccccacccctttcccctcctcccctctaccccgccactgagcggccaccggaggggctcttttcctcctctcatggtcatgtcggcctaaggctctgccactattgaagaaataatctttgctgggtcgactaattttcacaatagtctcggttctaataagaaccgggaataaagattgtttttagtctcggataaaaaatttgtcagaggcttgtcaggggccgagaatctttagtcctggttaataactaccaaccgggactaaagatcaccacttttttcctggttgatagtaccaacccgaagtaaagattatttagatctttaatcccgattggtaacaccaactgggagtaaatatttctctcccatatctgatcggttaagtatcagacaagactttcctcctcaccgagatatttagataagatcggatcattcccctctcctcctacccctcaggtccccttactcctcctcctcctcctccccttcctccccttcatcctcctcccctcccctctcctccccctcctcccctcccatccggcagccgacggggtcgcgcgcggtggcaggcagtggggcaacacccggcggggccgtgcacggggccgcaggcggcaggcgctggccgtggcaagcggtggccgtggcgggtggcaacgcgccagcctttctttttttttgataatttatgattcaccgagatgtataatctctttgtttagaatttgtgatttattgcatggatctgagatgtataatctgtgatgtatttgatttttgtgtaattttttaggatttgtgatgtatttgatttgtgtgtaaaagtaacttaggatttgtgatgtgaattatttaggatgttacaatgatttgaggatttggggtttgatttggggatatacatgacactcgatttgggagaaaatacagggattaactctggcaagtagcaaagaaacaatcaaaaaaaaaagaaaagtggaccaaccggaactgccgctaccctctcgttattcccggttggtaacatcaactgggactaaagatacaactttactcccgattatttcacccggaactaaagatgggcatctttagtcccagattcgtagccccggttggaaaaccgggactacaggggttcccaaccgggattacaaacggtttctccagtggtggctaagaccgaaggaagacctttaagtttcagtcatcggtggctagatttggcatcattggggctagacctagtcccctcactgccagatcgttctggtgccccagccgacaagtttaagcggcggtgaggaggagagtagaaaccagggctgcactgcgataaggggtggcgtggcaacatgaaagacaacatgatggcggtggcgcagcgtgcgagggcgtggcctgggctgcgacgcctatgggtggccagcgcaacaagcaagcaaggagtaggctaatggtgtgcgaggtggaggccggcggtgcgtgatgctagtggcacgcacaccgacggcgcgcgaggccatgactaggaggctacagagtgaggcggtcgctgatgccacgaggagctggacggtggggctagcagggcacaaccgaaggtgccgaaggtggttgaccgacgcaagatagctgacgcagcaagactgcgtgctatcggagaccgcttgggtggctttgtgttaggttgttgatgatatgttgaatagagtgaactgtaggcgaacgccttgcttggagttctctaggctggcagtgtcggcatctagcagcgtttcacccctttggggcgctgtcaagctgacaccctcttcctccttggaagattctccggaagaaaacctagtcctttgacggatgacggtggtgtcttgagcatcatacctcctggacggatgacggtggcgtcttgagcatcatgctccttgaaggcatcgtctttgagatctcatcttcccgccgtcacaggcttctctcaatttggtttttggcgttttgtcagttgtcgtcaccaggttggcgtgagggacaagtgggtgttcttctctcttgtcctctccctccccaagctttctccgtgaggatgaccgggagcccgttgacgatcttctgttttggagctagtgttcgccagggcgtttgcaagactagcggcattcagtcacggatagtggcggctggcttggtgctagttcttttgtctaggggtatgtttggaattgctaacatgtggtggtggtggtatgtttttcccctgattacaacctcttagggaggttgtggctgcggtggcggctggcgcgaatccacgaccacaactgtggactgcggtggcactctaaggtggtcctttggtggctggggagacgatgctcgtgggtggaactttggcagcctcctccgcggatgccatcctctctttcccggtggcggcaagcaacagattggtgagggagagaggagagttccacgagagagagatgaatgataagctttttatttcatatggccaggccttaatcataaggatagctcatccaaaagactcctataaggaccactagcttgtacaatgtataaagactacttgggaggtttaagaccctctgtatttccatattgtggacgccataagagacaaaaaattccatattgtggacgccataagagacaaaaaaaaactagcggtgcatccttgatctcactataaacacacctgtgtgcataatattcgtgggcaccaataaaat

SEQ ID NO: 59860 - DNA, 12265 bp, Oryza sativa
cactgccaccaggcaccagcctttccatgggaccttggccatcgcctccctccattgtgacaggagagagacccctcctgccaccttctcccgcctatgtgccactcgcacccgctcctccgtgtcacatatggtctttcacagtcccacttcctcctccgccagagcagctgccgccaccgcagtgccaaccccaggccctttctcctcacacaactcctctccccctcctcctcatcctcgtgggagctaagcacacccttaggggtggtggagcggtggagaaggtgctagtggcaaacaaggggattgcgtgcagggtgatgcggacgcgcgtggaggcttgggagccccaccgtggcagtccactgtgttgttgatcgctgggcactgcacgtgagtgccaccgacaaggctgtgtggcttggcccgctgcccacaagggaaagctacctcaacatcgtcatcattgttggcgctgcgctctgcatcggcgccacctaatttccgctgcggtggcattggttggctaggacggaagagagatggggaaggaagagaggggagagagggaagagagaaggaagatgttggtttaccgacctgtggggtccacgagatctttattatttgtttttgctattatgccacatagccgaaaccgtcttgggaccttatttgcactgattttagaagttaagagacgcatcatatttggttttacggttcaatgacgagtttaaaactcgacgataaattgagggaaccaaagtaaacttattccttttcgtacaaattgaacctgtaaaaattcctctcttaagagccctcacattgtgatcgtgccagattaccccgatcatcagcccagcccatcaatgatttttctccgttccaaagatcacgttgggatccagtttatttatgtgtatacgccaacactttgaactgaaattatgatcgtgtctgcctgttcagtcatctcgcttagcttaagccaaagtcaatgtggttatttcaagaaaatctagctaaacatgcttacatgtagactacgatggaaacagaattcatatcagttaagaagagagatatctgaattcatgggtgcagaaataattatgacaactcgaagggccaaggaacacaatgatttttatcaatgacataactaccaaagacaacagaaattattgtcattgtggagctactagcattgattcgagctgaattttgcaaaaaataataaatgcaaataatccaacacccagtgaggaaaagaaagaatgttgtaactcggcagacaaccatttagcccataaaccaatacaagactgttcaccatggggaacctgaagcatatgcaagcaagaacccataaaatggactcaaactagctaagtttgaaataatgaacctgtaagcaccaagcaccactaaattgacatttttccctctgtttttggggcaatattgaatacattgtgtgttccaagtatccaaacggttttacaaaatttacttgatagctcacatggcagactccagccgaaagaagccccaatctcacacaaattggtaaaattgacgagggtttgacaaccagatttatcattacctgaaacactcaatcattaaacacgtgtgaaattctgatatacatggtatgtcgacactgtattagggcaaaactgaatacaattgatgctgaaggacatgtagaacaaaccaagtttttcatgatattattctattcaaactgaatattatgcacagccatgttgtacaaaatccaaacaagccaatgcaattgcaattccaacacggaggaagttttaaaattatgtggccctctcataataaaattcctacgtccaactagggataaacataaatatgggacaatctcacaacttagacaaataaagagaaacagcaccaatcaaactttcttaccctgccattcttctatctaaactcacaattgattctttcattgttattgcttctcatcatcattcatttcatcagaatctgagtcactggcattatatcctgaaaaggagaaaaaaaatgatacattagcaaaaatgttcacagcctagaagaagcagtttttatattatatattaaaaaacatactaaacattgtaatacccggacgctttgtgccaactttccagactgaaggcctgtatctagatgccttctcagcccacgctcttcccttgtaaaatgaaaaagaaacaaaataagtgcaaagtataatcaaaacatagtattcaactattatgatgcagttactggacatgtctgtattccacaaaaatacaccacatgcagaaagaggatagggaaaaaaatcgaaatagtatgacgaataaactgtactgtatctatataaaactcatttcacagtatctatataaaaccgtaacctaactcagatgtgaaatgttttccctttaataattcaaccaaatgaatttatcgtctgtgcaagcatgttcattagcactagcaaatatgaaacaacagccatgaatttctttgatctttcttctttcataacctggttattctcctctagggtccagctcctcacaacttgctctaaagagatgtcccttggctgagttatataggcaatattttgatcctgtggtttaagaaagctctaaggttgagagtaacagttacttacaaaaacaactaagcactgaagtacacttccattaagtgccttggaaggatgatgacaaaagctatgggtagtcaagcataaatgcttaggaaagatagtgaaatcaatagggacaaaagacccccaaaaatgcctccaggtcttatatttttcaacaagatggcaaactaaataggccttatcaaatcaacagaggaagtaacataaaatgagttaacaaattcaaacaatcagtgatagctactaccaaatagaacatcaaatcatcaatcaactgccataaaagcagcaacactagtataaaacatttacacaaacaagaaataacacccaaatgtggagaacccatttccatgacataaatcaattgaaacttaacatacccaaggaacagaagtctaactgttcaagaaaaaacttgcaagaaggatggcacagagaataaacacaacataaaaagggctaatctgcatgtgaaccatcttctgtatcaagtttcctcattaagctagcaaagctcaaatatccattgaatccatctcaacacatcaacatttagttagttgccttatcaatggttgaaaagaataaacataaaatcaacaaagcagaaaaaaggaaccccaaacataatccatcatttgtccaaaattgcccaattattcaactgaagcacaaacaatggtgcattatttagatatggaaatcaatgaattaaaaataggaaaggatagcattttcaaaccctttttgtatcacgagaattttcctagttcttacctttttcctacaaaatcttttgatgtcctaaatttcagaaatggccttaaaggttacggataccccaaaggttttgctctccaactaatgaaacatgactaccacatcactcccagataggaaggcaagtcacttgaagctaagcacaaatctagcaatttgtacagtggtgtttcctccatggttggagctggagactgttggacatctcagaataaatatatataaatgggtaccaaagcaaacatagcctcttaggttgtgatgagtcaatagtgttggtatgagatatgtgcatctatctggccaaatgaggtggtggtagaagataaagtttgtgttcttttaattgtcgaatcaaaattatctttcccatactggtgctgaggttttttatataattattatgggggtatgccacgtgtgacctagacaatggtaacctccagtatatgattgcatcagccccatttgtggtcagtaatgggttgggcattcatctccataaccacacctccctatacatttttaaagttgttgggattttctatatagtatatagtattgttcttaggcgtatttcactttgtacatgcaatatttagcattaatacctcctcactccaagaatattacatacagattaaaaactaacaaaggcaaagaaagctatgctatcatcaaaaaggtataaactttagccagccaaatcctccatgataaagcagcaatcaactccaaatataaatgaagccagcaaatagaggacagaaaaaataatgttgcaccttctgtttctaaccaaagaatacactccaaataccaaccaaaacaaaacagtatttctctctgtcgtgaggaaaaaaaagaaaactaacaatggctgagaacagaacagatcctcccataaaagtgtatgcaaggaaccagaaacaaatgagcacccctgcccatattctaattattttcttcctttcaaaattgaccacaattgctaaagaaaggaaaaaaaacacttggttgaattctacaaattgaaccgggccactaccatacatgttgccacttcccaccctgaagttcaaacaccagctaaaaaaaaatattccacggctctgacaaaaataagtcgcaacttctagttaaaactatgctaataataattgtaataatcgatacgttaaaactctacccaaaaggaggaattgctatcaccatattgcatacaatactttacaagaaccagattagaaccacaaaagcttgtgcatcagcacaagaaaacagcacggaagcagttcacgacccgaacccgaccaaagtaactagatagtatcatcgacacacaaaaaaaaaagaaaaaaaaactatgcttgcaactcgcaagaactaacatagacagggttttggtaaaaaaaaggaggcgtcccctacccccatgtcttcctactccagaaacaagttgtaatcagagtcgcacccttatattcaaatctaagaagcaaggcactagagaaatctaataaataatgcagtgataaacggtgcgcacgaaaggaatcacatcgtgtttaagctaacgccttccccggatctcgattcagccgagcaaaataactttgatctagagatggttgagacctataaacggggaggagcaggagcagctcgatcctcctccggtctctagcacgcaggggcacataaccagcggatcaaatcacgcaccaccaccaccaaaggaagaaaaagacaaggtggggggaaccatgggggggggggggggtggggcggggatggatgggcatgggcgcaccttgtgctcgttcttggggatgccgtagccggagtggtacatctgcgcgacgagcacctgcatggcggagtcgccgcggcgggcctccttgagcgcgtcctggaaccagcgctgcacgcagtcgcccaccacctccgacagcggcttcctctcctcctccaccgccccgccgttcaccccctccatgtgccgccgctaccgccctatgccgcttcgccgctcggcgaggcgaggcgcggtcgggtttcttctccggcagtggcgccgccgccgccgccgcaagaggaaggttagttggggaggcggcgcgaggagagagaattttacaaaataaacggcgggaggggaggggttttgtgtaaaattgtcggggattttgcctttttttttttctttttctgcaagttgcgggttttttttctcttttctttacctcgacacgggacggcgcacgcggttttttcaaaggggagggggtttggttgcctgccgtgcggggaaatcgcttcgcccccgattcaaatgccgccgtttatttgtgtaggattcgaattcggatagaacatgtttcagctagaaattgggaaagaaaaacatgtttcaccaagaaattcggacggaaaacgtttatggttctctatgtgggtcggtacctgagtcggatacaagatgttttctatccgagacaaatacggcataatattcataaacataagttttttttgcttttagaaatacataaggagtcgtataagaaattctttcaaaaaaaactcgcatgctaactggtaccgagagtcgaatttctaattgctttagaattcttatcagatcataagaaaacaatatataggatatgatcatatatatttggatatttggatgggaatgtttatatatcagttaatttttggatcatcggatatgctttaagattcgtgcagaggcattaatcctagctctcctcctcttgttcccctcgcatcgcgcattccgccgccaccactcccatcatgcattcctccgcctgatcccccgccgccaccgccccaccgcatcgtcgcccgccttgccggagggtgtcaacggcgccggcgaaaccccccttccccccggccagcctccttctcctccccactccttcctcctcgagccatcggcggcgagatgcccccaccaccaacgccggcccaccgccctcctccagcttcgctgctccggcgcctcgccgcccaccgccgggctgtcgcctcccccggccatccctctagagccggcgaactcctccccttccctctcacaccccaccccgggaccttaatctgtaggtcctctgccggagtctaggatgtcgtcgacgccggagaagaagagaggtcatcggagttggaggaaaagacttggagtacgaatcttgaagctcatccgatggcccaaaatctgtaagatttgaggatgcaatttctatggacggaaggttagcaattccgatccaacgaatagaaaaaaaccataaggtgattggacaaactctcgtaaatatatttacgtaatgagaaattaatcttgtgagtcaaaccataaggtgattggacaaactctcgtaaatatatttacctaatgagaaattaatcttgtgagtcaggcggccgacctgatgcgtaatttaatgctaaaagctaatggtggcatgtcactttcggtacatggatagaagtggctgccacgttggaaattaaaggaagagatttgcacgtacgagcggatagggattggaatttcctttcagcatcgacgacgacgtatgatcattaacgactaggttatctggtcatcgatcctttcctttcgttgtagagtgtagacgagaaaaatacaggcgctacagtatactaagtaaaatactcgtgcttctctacatgtaaaaagaatcgttaaacactaaaagacatagtaaaacatgtcgtatatcaacattggtacaagacatataaatgatttatataggctaagtatcgataaaaaatctctaaagataagtaggacgcatgaaaaccattattgcataaaaaaacattattacatattaatatactcatattctcataatgctcgttctctcttaacacttacgtagcaaagtgtgtgatctcatttctaaattcatgtgcgtatttgtgtagagaccgatcgtggcatgtgtaaaagatagatagcatacacgttctaatttgtcatgtctcatggacgacaataaaaaaaatcttacctacttaaaaatatcgttttttacaattgcaccatgtgctcaatttgttttttccatgccatctgttcatcatccgattttctatgtgatattttttatagcaaaatattggtattggtcatccaatattttcggtgattttttatagcaaaacatccgtatttgtaataggtgaaaataattttatgttagtttccgaagttgaaagatgaagttgtcgataaacactaccatatatcaaatatttattttgttatattcttagcacgatgcatgttcaactcactctgcatatagtgccatagtatattttttcttttaatttcatttgtttttgtcatagaaacaactataaggtttggatttagaaatactttttgaaatggtctattaataaaattaaataaaacataaaaaggtaagaaaaaaaatccatagtaaacggttgaaatcgcgtgggcacggaatcggacagcgcgagcacgtgtgcggacggacgacgatattattttatcaggtgtagagaagtacaggttactcatcctgtattgcaggattagtacagtgtacatgcatatgcttatagcgtatgtgcgtgtatctttcgtataattaaaaaaatcttcttcgtcaccagatataggcacacattcatcatagatacggccgtagttactctctccaccaatcactacaacaaactaaaactattattttattattttaagacgttttacttaagtcgctctgtaagtcgtctctgcttttacaagtaaaattaaaataggaacgatatttgagacgctttattagttgaggacatagtttaagacgttttattagttgaggacatagtttttaagacactttacaggttagcacaacattaaatcgtttagagatgaatattgagacgttttggaacgtgacagatgagttttgagattgtttctaatcgtcatcgtaaaaaccattataataatattataattatttggacaaaaaaatttgaatatttaatatttaatctcgtatctgctagataataaaaaataaataataaccctttcatccaggctcaaacacaccacctgcaggttgtaaagtctagacactaaccaactcattaccatggataattttgaatgtcaatacacagttttttttttatattgtaactctgcaaacatgcgtcatgtggtaatcagaagtgggttggccctgcacagcacttcatttgttgggccgaatggatgactgacagctggccttcatgcctgtgatcgatcgtgtgtatccgcgacagggacctgtgattttcgtcccatacgcgatctcttctgattttctgatcttgccgcgatcacagatcgagccgcgccaccggccaacgcttgacccggcacctggctaccccacgcggccacgccctgacgcccacgctgccacgcacgaccagcaggcaggagcccccacaccggcaagcccacgccgccgccttggccgctgctgcagcctggagcgtgtgccgccgccgcgaggagccgtcgtcgagtcgatcagccgattagccgtccgcaccaacaattttaggttatctatttgtgtacttttttagttactgattttatatgttttaagatgttttattaatatatcatgataaattttttggtgatttggtctattatattatatatacttacattatatatattagaattattagatttactgtgtttaaaaaaaatagatcggaccacccatatcctaaatcctaaatccaccactgatgagcaatggatgctaggagctgaaacaagccgtcgtctccttccttctgtctcctatccagccccaggtccaaaatgttaatctctcatttagtgatttagacatttttattccctatttacgttggttaatcgttaaatgccaagagtactgttcactacaaattggttggcttgatttaatttgttttatgctagcgagagaatacggagatcacaaatgtcagaccttcatatgatttataattcttacgactaacttgaatcaatttaaatgagagaagatataagaaccataaagattaaggtggatcgaaatgatagatataagtaccgcaaagatgaagctaccttttaccagttgtatattgaacttctgctatgaaacttgagtagtattaacataataagtttatgtatccatctttatgcccttctcaaatctcccaatcaacttctcgttgttcttatttaagtcagaattggtcagtggatcaattgctagtgccagcgttaagactttacatagtgtttattcaattaattatgtgaataatagtcagagaaaaaatgatttttgtgacttgggaaatactgttcatactttatgcacattttggacatgtttttgtaaagttgatgaaaataatgttaattaccaggttcatgttttttctcttattacttcagcataccatataactagtgatggatcgagattggatgagtgaacccagaacatctgcttcctataaagatggtgtagcacatttcctatccattgcatttcgtgatgttccagatgatgccaaggtcctttgtccttgtgtgaattgtagaaacagaataacacagaattatgatagagttaaaacacatttgagatgtgctggaattcttcaaagctataccaagtggattcaccatggtgagaaatatgatgcaccgtcattagtattcgctcctgtatctggcaaccctaggaatattcctatttccggtgctcataagagcaatgttgtagaagttggggatggaagatcggataacatggaaggactactaaacactgcatttggcagggaagatagctttgagtctatatcgagtgcttctatcgatgatgatggtatttattttgagtctagctatgcagaacctaatatggttgaggatgagaataatacatttggagattgccataatgggggggaacaagatatgttcacaaggttgttgaaggatgcaaaaacaaaactatatcatgggtgtgataaattttcgaggttatcattcttagtcaatttgtataacctaaaatgcatacatggatggacacaagaatcttttacagcactacttggtttgcaatctgatgcacttcctcaagaggcagatttaccgaagaattgttatgaagcaaaaaaaatcatccgtggtttaggtcttggctatcagaaaatccatgcttgtcataaagattgtgtgctctttcgaggtgacaaagctaaccaagagtcttgcgatgtatgtggttcctcccgctggataactgataaaaatgggtatccagttgaatcaaaaggaaagaagaaaccagctaaagtgttgcgttatttcccattaataccaagaatccaaagactattttcaactgaacaaacttcaggagagatgcgatggcacgaggagggccatacaaaagatggattgctacggcaccctgctgatggtgaggcttggaatgatttaaatactcgttatcctggtttttctgctgatgcccgcaatgtgcggcttggtcttgcaagtgatggattcaaccctttcaggaatatgagttcaaagcatagtacttggccagtgatgcttattccttttaatctcccgccttggatttgcatgaaacaaacatcgttaattttgtccatgatcattcctggaccacattcacctgggaatgatatagatgtatatttggagcccttgttgatgagctcttgcaactatggcaaggtgtggaaacttatgatgcttctgcaaggaagaaattttctcttcgagctgcattattatggacattgaatgactttcctgcattagcttacctatatggttggagcactggagggaaatatgcatgtccatcttgtgctacacttacaaaatcatttcgtcttaaaaaaggtggcaaattttgttacatgggtcatcgtcgatggttgccaccggatcacaaatatcgagaattgggtagtcagtttgatggcactgaagagaaggaaattgcaccaaaaacattgaatggaacttctgttttagaaatgctgcagggcagagtatttgtatttggtaagaaggtaagcatagccaaaatgtcaaaaaggaaaagacaagcaaaaaaaaaacactaatgacaaagggagcaatcggaaactcaacggtaagagaaagacatgtaaggagaaatcaagtgataacccaagtaagtctaaaaagaaacctgaggattggttgaaaaagaggtcaatattctttaagctagaatactgggagtgcaacaaattaaggcacaatctagatgtgatgcatatagagaaaaatgtatgtgataatttaattagaactttgttggatattagttcaaaaacaaaggatgatcttaatgcacgacttgacttggtaaatattggcattcgcccagaacttcaccctacaatagatgataaaggaaagcaaatattgcacctgcaccctttaccatgtcaagagaaaaaaaaagagattctgtgttcagtaattcagaacattaagactcctgatcgttatgcatcaaatatttctaggtgtgtcaacatgaaagattgcactcttaatggtctaaaaagtcgggctgcaggaat

SEQ ID NO: 59861 - DNA, 1730 bp, Oryza sativa
agatataccttgtgcacactggcgcagctagggggtgaaggtgccaacacccccctatccaaacaccaccaccactacatattctgtttttactttatattaaggctaactaagataagtatttatttagtttatttgggtagtttgaaagtattatcagattagttaattagcaagtctaaaaacattagcaacaaacatgatctacaaaattaatttttgatttctcatctttttcaaaggaaaatagataaaacttatttgtgagattattcaatagtttacattgaaagaatttagcaataaagactagttttaaactttcaatgatattattaaagaggtaaaatttaagttttttttaaatgactagtttatgtattgattgttattaacggtaactatttgaccctctttgctatcagtattagttattcggtctcatggcttatcctcacttcacaccccctaattttaaatcctggctctgcccctgcttgtgcatgggtgagatggtccatcagcccgttggaactaatgtgctctaggtcgttttgtgcaggataagttacttaatcctaaacggaaagatggaacaaacggtgatcaaaagtgaaactctgaccaacaacagtggcctaaattgcatttcataattattttagggtgaatagctaaagtggtccttcaaattttatagtttaatccttaatgttttaatctgttcatactagtttttcaagttttggttttagttcaaacttactcttgaacccacttagaaaccatatggctaaatataaccaacaactctcttgataaataacagttatatcccctcattcacatatataagagaaaaatttacgtgtaatgaatttttttaataaataatgcatagtaatttatataaaacgaaaataagttatgtacttgcaagtgtatatcatagctattaggcttaagttttatgtgcacacgttgaaattatgtgaagtatatatgtaatgttgtttattcatcctggttttctcttttctagtgtatagttgtatataaattaagggcaaaaatgacattttctaacataaatgctgactagaaatagtcttatggtatattaaatctgtccaaggatgattttatgtaaaaacaaataattagataatctatatggacaaaataaaatctgaaggaacaaattaagcctttgataaaatttgagagattaaattagctattcacccattattttactttttttaaaaaaatcaaacttcaatattcaaatttacagggtaaaatgtcaaaggaaaccgacatttctttagtttaacggagggtatatccgtggttgttttggttgttgcgcctaaaaatcctgtgggggaacctcgccggcgatccctccaaagcccagaagcgacgccgccgccgccgccgccagccgccacgttatccatgaggcctctcctcgcccgcctcttcgccccgacttacattgccatgggtttctcctcctccgcgtcaccaccgtcccggcggcttgcccacctcacacgccacctcctcctcagctccggcgagctctcctcctcggtgggcgcccccgccgccgccgcccggccggcctaccttgccgcccccaagggctacgccaccgtgctggtctgcctcttcgaggacccccacggcggcgacccccgcgtcatcctcaccaagcgcgccgc

SEQ ID NO: 59862 - DNA, 1875 bp, Oryza sativa
acattgcctgtgtgggatggaagtgaaacaatggtcgatacaaagaggatcggtagttagtcgatctagtgtaaatcatactgaattgcaggaagtggcagtatgctgtgctgccagagcagcagctatatagtgcatgttgcaggtcaaattctgttatagtattgagttgatatgagatatttgtaatattttagcttttgagccccagtcttaatatgctgaatggtttatgtgtactgcatctgcatgcctcagattgttcagagaaacagaaagtgtgaagcattagcgaatgagtcaatcacagaagtcatgtgattttttttaccttgttcttagcatgtgttagatagtgctaataaaagtagaaaccaatatgatgatcgatggattttgattcattcagagacaataattcaataaagagataatgaaaatatgcttgctagttcatttgatctctgtttgccattttatcgcttgtttgtgtattgctgatatgccaatgccatatcacatttctagtcccaaggcgttatataactgacttgtgagaatataagtttacgtgcatggccaactgcgaatgtcttggttttcaactaataacaaccaaaagttcttgcatactttggtgcttcatctggttattgctgttttcttgacaaataatactctaaataactactcaaacacatgtgtccatccaagttcatctaaattaccttttttagtcacctgagcttggtacaacttgtcatctcttccccaagaacaggtgctctttcactctagtaaagtcaggccacttacctgtttcttacactaaattattatggttgctatctgatataagctgtgtgagtttttggaaccctgcctttgtgcatcaaatttccctttgtaatatcaagtaatctataactgtagtcccatgctcagaccccaccgttttctgtccttagaggagagatttccaattaacatctcactcttatattaaaatactgataaaactatttgctctatatggctttaattgagtaattattgatttccaagataacacattctttgacacattcaatagaaatgcaaactatccagaactcatagtacagtcattttgtagaacggactccatgtaactcctgtaatcggcattctttcggataaagctttattcaagcctgtcttgaatgaatctgaagtggcagacatctttgatgcacctctagagatgttcctgaaggtattactgttatttatcgatgttactcttctccttttatattcatcatcaacttcttgttgtcgacaagggcattgttgcatctagctctcatttctaccatacctttaggatgatacccggaaaacacaagaatcgaattggatgggcatgaatattccagtccagtcttttgagtaccagtcagaggacaaaacgtttgtgatttggggcttaacggcacacattctgactcgtgctgcagcagtcgttttaccgagagaaccatcatttgttgaatttcgaccaagatatgtgaactcaccctctggagatacgaatgaaacaaaacgctgatgcaataccataatcatcaatatgtaattctagcatttatcccctccattcagaggcagctgcttgtgcctgtctatagaaaatcagcttactgtactttttgtatgtacacgatagtccatagaatgttgcatcatcagcatgttggaaaatttgtcaatttgatcatcggactcagatagtgaacactcttttgttgcactttccacagaatgttgtaaacttgtaatacttgaaacttgctcgatatttgaatgcactctctgaacaggaaacaaaagtag

SEQ ID NO: 59863 - DNA, 7318 bp, Oryza sativa
  unsure (1)..(7318): unsure at all n locations
atgattgtcgcctaagaaagtaagaaacgtatggctgtcgtataatacacatacggtgttccaagagttcgacattaattaattaatttgtacgaaagtgcatggtaggcaactaggcataaaggacagatggccgtcgagatcatcccacatgcaggaaatgtcactgttgtattcatgatactcgtatgagtaacatcgcccttatatcacatatatatcggctataagttaaccaataaaaacatgctaagtaaagtaccgtcggtcactaaacttattcatttgtatcatttaagtctctaaactgatcactaaatgtattttttttccttgaacttgttaaaatactgtcactccggtcctaaattaccacgatccctctaggaacctacatgacactcacgtgacatgtggcgttgattgatttttttaatgttttttctcctctaattnttctattcttgatcctgttggtgtggaagagagtgagcgaaaaaaaagaaagaagtgcagaagggaagaaaaagaaaatacgggatcggaatgttcatgtggcataccactttagttttcatgtgacatgtcacgtaagcgctacataggatcctgtaggggtcgtggtaatttaggatctaaataatatactttaacaaatttgagaatctgaaaatgtattttgagagttcgagaacctatatgacacaaacaaaaagtctaaggaccaacaatgcattccactcgaaccagcagcaaaaatatgttttcacatgtatgcatcgatcctcagtgtgatttcttgagagagagagagagagatgcttcacgggcgatattattattcagacggcgcaagcaatttgccacatgttacacgtgatatcatattcataagtgacagttattccactgtgcgacgctactgaggttggcatgggcaaaaggaggaatagataacacataattttgacaggcagacaagttcaaaataaagaattagaaaacacatgaacatataagaatagttggttaaataaattagaggagaaccacgggaacacacaaatggtcggatgaagatattggagctcttgttgacttttcttcaatagcaagatcatccatttcatattaatttcaaagataataacataatttaataatctattacaaatgcttttctatttttttcaataggatcaaaatcctttaaaagttttcggaaatgccttatatttgaatatatacgaagtcaagttactccctccattccaaattgatcatcagatacatgggtgcattaagacaaaaaatataataactcacttatactatatttattatggcaacaaactcgatgtatgcatattccccactattttttagccaatagcaaatcaaaacactttgtgcatggatgcatgcatcaatgttcatttacttcaatgtataaataataaataaatttaatgaatgaacacaaatacgatgatcatttgaaatattctcaaaaagattatatgatcaatttgaaatggagggaggaatatagaagatttttattttatagtattattgatagagactgataagaaatgttgtaaaagtacccgtgtatgaaataaaagccagcggacgaagtgaacgatgttaactgggtaggtttcttttgacggaaccagttcactcgatgacacatgtactcacatttacggctaatttttttttactagtacgtacgtgacgtacgcacggttagttctgactttattaatttaaatatatactccatccgtcctaaaataagtgcagttttgcactattcacgttcaacgtttgatcgttcgtcttatttaaaaaatttttatgattagtatttttattgctattagataataaaacatgaatagtactttatgtgtgactaaatttttttatttttttataaatttttcaaataagacgaacggtcaaatgttgaacacggatatccacagctgcacttattttgggacggaggtagtatcaacctactttttcggagatgactcatagtggtcagtgtgtatgtggtacgcgcttactccagtacgcgcttgtactgtgcttcttgaataaaaaaccggcgggcccctctgtggtcgggtggctgatgattagcggccggccatgaatgattccactgattcggtccctttctgcaacaccgcacaccccatttctttacgatatcctcgctgccgcgcgcgccccctggtggctgctgctggtgcactgcagcactggcacgcccagacagccaccgccaccgcgcgcgtcgtccccccctcgccgcgtgtcgcccgctcctcccgccgtggccccgcccgcgcgcccatcccgtacgtacacccgcgccgcgcgcgcgccggaccaccaccaccaccaccacaccgttgccgccgaggccgacgtacgtacgcgacgcggtgggcaaagtttgctgcggctgcacgtcgactcgcgatcgcgcgcggggcaccatgaccaacgtaccgtctcgcggtcagtcccaggtgcgcgctcggttggccgggggcccccgcggtgaccgcgtcgcgtggtgcgtgggtggggtgattggattgcgaggctttccgttcccggggggacgcgtgggggggaagggaccgacacgtgcggagctgcatgcatatgcgtatgctgcgcgggtgcccgggcgggggctccagcggcagccgcgcgtccagctagcgcaccacccagcgacgcgatgggatgggtgtttctgattctgtgtgcgcactgacgtaactccagtacgggtggtcgggcagggctgggtcgtactactagtgctgcggtttgacacaccgccgtcagatctgtatagagatgcacggctgagatcatcgtattaggatctgttagttggcttatagatctgttgagagatgcacggctgaattagagcaagtttaatagtgtagccaactactagctttaattcatctataactaatttaatagcttattcatataatagttagttataaatatatactacactattaatatatagttctatatttcatacacacacaatgtattgaagtctgtgctgcagctggttataaatttgtagcgtgtttgttttctcactcttctcttctcttctccacatatgcttatagcttatttatagcttcctactgtactcgctcttatttgtctccggcagccaccgcacctcgtgctgatcttttttctctttgaggttaagataagtgttgtgcttgtttcatgtggctcggcaggcaatggatgctttcatggacagattcaaagatgaataatatgatctcgatacgaccctgtcgttttgaacacatgtggttgaggcaatatctccataaaaaaagtgtgctaagtcacataacatataatgcagaaaaggagaaaaacatacgaacaacggcaatgggcgagaaatatcaaatcaatgtaatttaagaggggtatttacaatgaattatttggggaaatatcaaactcaagatgatatttgggatggtttttatgattttcccttatgtcatcttcttcttttgtgagactgatgctctatacatgtgccgagttgtctataccacaaattatctagtgctaaattttgatttcgtcaaatttgatttgaaaattcatggagaaagtccgtaattcctttctcatttgtagctatggacgaaaacggctcagaagtagacggagaccaattctatcctttttgtttttataactttttttttagaattggaattgaaatcgaaaaacttagatatgaaaaggaaatcaaatattattaaatacagatacgaagcgaatgcaaatcggcgtgaatatggtaatgaatattcatcagaatatgaaaacaaatctaactacactcaaatcatcgaagagatgtagctcattatttttctaaaacaataaatagacactttaattgtttatctactttaattttcaggagaactacaattagcaagagctacaatcatttaactctaattcgtcggcaaattttactacaaaacaccaagacctgtgtaatttgtttatacacatcgaaaaagcgtgtcatgtctaaaagacatcctagaaaacctggtaatttgctagacgacactttcgactcaattggatagttagatttttaagaaatacaagatgcccctgtgaccacgagtttcaaacatgacattagagtaaaaatttagaaattatacaactctaaatttgcaatcaccccaagtacattattagcatacatcatattccttcttcactctagcctcagatcaaaaacttttgaccctagggatacttttttataagaatttatctttccaattgaaccgaaagtattctccagcaaattaccagtatttttagtgtcttttagtcgtgacactttttattatgtctatcaataaattacatgaactttgagagtgttgtagtaattttttcctaattcgtatggcatggcctaataaaaaaagctcattaagcacataaagctcaacatgcaagcatatagtatttatatctataatttatttcattctaaaaccaaacatacacatgctaaataatcattctcaaatcattttcataatatttcgatccaaatcatttcatcgtttctccaatatataacaaatatcccacaacaaagtgtggggcatcatcttttgtgagacatagcagaccatacatggctttggtctggacaactgtcggtgaacaactttgaagagctgcaatgccgaccaatggaccaaagagaggccacaccgacacatagtagtgtacaacgagggatttgcatactttgtcgctccacgaaatagattttgattatttatcatacttatccacatctttgacgcgcttcaacatggggccactgctacaaaatcctaatgggtgtcagttggaaacccacataagtgtcgaattcttcaaccagcatctcgcaagcagcactgatgatgaggaaccaaatgtgtggtttaaaaacgacacctttatggttccactaataaaaaaccaactcgatacgtcggctcaattagctcctcatcacccctgagatccatcaacaaccaagaacacagaatcaacattcaagaacaaaatcaatgtccacatatcaacaataaaaatccaagaacatagagaggaggctatctaaggagagaaggccactgtcgccgctgctcaccatgggctaagtccgatgttgagcgtcccgtgaggagagggcatcatcgcttgtcgagggacccacctccgtcatctagcaggtcaccctcgatccgtcgtgccaaggttagttggcaagctagatggcggtagctcgccatcgcgccagctacatcggagataagaagcgatagggacagtggagaccagggatggctgctgctgaggaggtgaggagtgatggagaggaggaaggaggacgagtacagcggagttgaggggtggtggcagcagcagagatgaggggccgcgatggtgagcaagagagggagcgcggagaagctgatagaggtgagcaagagagataggctggactttagacgcgaggtcatccatatataaaaattaaccgggccggctcgatcgattgtcaactgactaactgaagagagtgtcggtttttttgtagaactgacatctattaccctctcataagtgctagtttattaaaaagaatagcacatattattgtggtgtcaatatttttaataaaccaacacatataaggggttatatatgttggtttttatttgtagacccatatcagatgttggaaaggtgagaaaaatcttatatatgcccattttttatgtacatatgagggcgtcagtttcggtcttccaacacctctatgtgcttttctcgccatatgaggcttgctcattcacgtcttactctttcattcgcggatagtggggaaccgatctggtagtgtctctcatcttgtctcacagcaacagtggacgtgttcgtccgacggctagcgtgttcatccgatgcatgctaggtgtttcccgctaggttgccgttggttgttccttgcgttctgcggctatatttgggcgagtgactgatttacaattcagtttttctcttgcgctttgagaagcggctacatttggacgagtgactgatttacaattcagtttttctcttgcgctttgagaaacgtctaggggtttttcggctagcttcataacatggtgagctagccggcttgagtttaaggtttcacccctttaatttatttgttatcaggtctcccctagtgttcgcgttttgcattcgcgaaaaagcgttctctgacgctttcttccgttttggctcaaagtcagttgccaacggttatgtgcgtaagttttgattagcaaaaagatcgtccattagtttcggggagtctgtttttggtttgaggacaaagactacatgcaacatgtaggcagctgctcaaaatcaatggttatgcagatttttttgccaaacatgaataagatatagtctcgatctaaagttctaaactcctactaattaccattacctttactaatattagcatcaattcccttatataaactcccaatcattttttcctcaagttaccaaacaaaccatatggatttccattaatacggtcacatttgccaagctcctaaatattatattttttttaaaaaaaattctcttaacatgctataagaactttttaatccacttaataactctctaatatttaatttgggggtttgtcttaaatactccctccgtttcacaatataagactttctagcattacctatattcatatagatgctaatgaatctagacattattatatatatagattcattagcatctatatgaatgtggacaatgctaaaaagttttacattgtgaaacagaggaaataattactatattttcatccatcatctattgaaaatgcagagtgacacatcgattatttttggtaccacatatcccctccacagctgtacccagagcccaaagacgctttcaacgcctctgcttttgtccagatgtaggacgcattagggcatttacaatgggtcaccacattttgccgttgttcccatgccacatagactaggaacagtgtaagccatatgctccacaatgcaagttacagctacacaatacaagctacacgtagtagtgggtgccagcactctatatctcccttttactt

SEQ ID NO: 59864 - DNA, 30560 bp, Oryza sativa
gaagatttcagatacatacctgcggaggcggattgaatgcgttatatggcacaactggcagctggtgtgagtagctgacgacaatagcattcgagaatatcttgtacatcctctccttcatgatcttaaaatccagagaatctgggtcttcacggtttggatcgtgcttgccgtcaaattcaaaagctgtgcgggatctttctttgatgggagccaatcggcacttaatgaaatgccgagtgatttgctctccctgcaagccttgttctttgagttttagcatgcgttccatcaactccaaggcttgggccgcttcatctccaatcggaagagagttccaggtatcctggtacaccggaggaagacaggagtactcgggaagagcaggctcaggattctgaacataaaaccagttcgcatgccaccccttgtttgaggtcttgaagggcatagagaaatacttctggctcagagttccccttagctgaaatcctgcccctccgactacgcatggcttgctcttgttcggttggggcttgagaaagaagatccggcgaaacagagcgaagtggggtctgattcccaaaaaggcttcacaaacatggatgaaattggcgatatggactatggaatttgggtttaggtgatgcaagctgattccataaaagtttaaaatcccgcggaaaaatttcgaggtcggaagagcgaagccgccatagaagaaatgcgagaagactacgatctcatgtgtatcgggggtcggaaaagcctcaccgcacgctggccgccacccgatgatctccttggctgggagaacgccgtgcgccaccatctccttcaggttctcttccgttacgtcggacgccgcccattggccttcgaagctttccttctcttccgccatcgattttacccgaatgcgctgatttgattcgagggatggctggggagaagtgagggattgaggcggtggatcacgggaagggttttgatgcacttttcgaaggtggatttgagtggagtggtgaaccctagttcgccggcgcagttctgcactgtagcaaggagtggggaaaatggcgagagttccggcggggaagacgaagcgtcgcttggatctcgggatttcttgttaagggtatcggaggtgcaaatgggcctaggcctgaacagtacttcagcccaatacttttaacagcgtggcccattgtgttccttagggacttaggcatattttgctttggcaatattatgcgcacaatagtgttcagcccaatgctgataaaatcctttttatgcggtcatataattctttggaattattgcaatgcaaattaaaaggtgcccgacagaaaggtgttatactgctttttgttagctttattaggctacaaaagctgtctgggttaatttggaatgacttgtttttatcatagtcacttccttggtatgttatatacctattttcattatggtaaatagtcatagcctaggctgttagacttattcattaccataatttttataatacctggtgggtaatctttagagtttttattcggatgcctgtcaagtgtgttcattcgtgaaccttttagagtgttaaccactcggatttcttttgttgtggctaaaaagcagtcggctagaatgcctctttaggcgccgcatatgcttttgtcatatgatgcatggttgtgctattattttgttctcaactatatgtttagtttgttaactaatcacatagttgggggctacacctaattaggtgcatctattcgatgcaccatattctttaccttttcgccctttacagtcttcgtcttcgctactcggcgggccttggcatgaaaagtttgaagcactcggattatttttgagatggctacgatggatgactgcaaaggtctcgggggctactgtggagattatggatatcccatatctacacggcgacggtatttggactaggtacaggatacctaatgtagatagaatatcttatttgtatctcgggtttgtttcttaacttgtgtatcaaggaaacaccctgagacttagtcggttacgactatatttcatctgtatttgcatattccgttagggatatagattatcttttgtaaaacggactcttccccatatataaggggggtccgggtgcctctagtggcagaggttggattttctccaaatcatacaatcaataatacactcgtcggattcatccccggacaggagtagggtattacttcttttataagaaggcctgaacctgtataaatcctttgtcttcaaacccatacactttcctagcttgatagccaccccctttcattattgccgaaatctagtttcgacaaggtgtatttcagggcgctctcacgatcgtaggacgtgtcccagagtcacagcccaaacaaattcggacatgaattgggcctgcgatacctgggccgggcgacgcaaatccgactcggtctcacggtttcgcgccgagaaaggccgaagcacactagcgtcttttggcgatcttaattaaggcgccaagctagccggccggtaacgcgcgtagtctgcaaattctgcatctccgcgacgagaaaggaagaaacaaatacgccggcgaggcgacgacaatgacaagccagccgcacgccggcgaggatggcggcgaccgcctgagcgcgctacccgactgcctcctccacgcaatcatgtcgttgctcccggcgcgacacgccgtgcagacatgcgcgctgtcgcggcggtggcgcgacctgtggcgctccatgccatgcctcgacatcgtcggcgacgagttcacgtcgtcgaccaccggcagcgtgaggtgggacaagttcgagagcttcgcaaccaacctgctcctcaaccacgacgccccgttcctcgacaggttccggcttcgtctacccagctcatggcacgtcaggggaggtgtacagcaacgcgacatcaaatcacactcacagcccgacgtgcgacagatcgagcgatggatcaaccgcggcgtccggttctaccgacccgtcgagctcgagatcaccatcggcgttggttatgacctcaagcttccaatcctcggcgccgtcgtcttctcccaccgactgaaatcattgcgtctctctcgccttgttctggaccgcggcttcggctacaccatccgttcgtggtgcccggtcttggaagccatggagctcaactcctgcatcttcgagttcgacgagatcactggcaatgcgctcaggagtttggccattgatggctgctcccgacgtggtctgcaggtgcctgatgatgcattgtgtgtcacggcgccaaagcttacctcccttcggctcaagttttcgatacatgatttcagcgtgtttttggttgatcgaatgggtttcctcgttgatgcgtcgatctgtaaaatgttttcgtccacgaccaactttggaaacaatgtatgcaacttgtagaagtcgaattagaatccatgtccagtttgcttgggagtctactcaacgtgacaaagcttaatttgtcctgcattcagctatcggtatgcgtaacccctcttgatgcttgaataatattacttgttcgcttcaagatttagatggaaatgtactactcctaattaattactaatctctgaattgacatatgcacccaagtttccttctgtgtattaaattcctttcggctgcgcttcaatttgtctggagcctcactgttactccctccatttcaagttgattaagtttgtagataaatatagtaatatttatgacactaaattagttccattaaatctataattgaatatattttcataatatatttgtcttgagttaaaaatattactattttttctattaacttgaatcaattttgactttgatcaaagtttttttttctgaggagaacaacggcaggagatctgccggaatttaattagaaggaagaaaaaacagtacaaaaccagttcagtccagaaaattaaaagaaaacggtacaacaatacacagcacgaaacaaaagaaactatggaagcctaaaagccgagcaacggagatcaagatcttgttttactatatatgccactgctctctctaagattgaaatgttgttgaaaattctcctgtttctttctaaccaaacattccactaagtggtaagcagagctcctctcatcgccttcttttgctccttcgatcccacgcaatcgatttgggcccaccaatcagaggttccaacagagaggccaacattgtttgtaggtaaatgttgccaggaagtaactagagacgaaacttccttgaagaaggggcattcgctaaacagatgattagtgtcttcaaaggcgcttgtgcataaactacaaatccaattgcacggccagtgtcttctcaacaagttttgagccataagagttttctggtggaggactagccagccaaaaaatttaagtttcggctcagccggcgccttccagagcgaagagaaatctaaggaaacaaaagatccttgatattggaaaagataagcactcttacttgtgtaaactttggattcattccagttccaagagatgtcatcaagacgcggggtaagcaggactccctgaagcatgctcccaaagtgaacaagttcgtggatttcttctactgatgttatttgcctgaaagagatcagccagttattgttatggagctcttgatggacgcttttttgctttctttttgccaacttgaaacacagtggtgcaatgtcttttgggctgctgttttgtagccaattgtcatgccaaaagcttgtttttgcgccattacctagctcaattgtcgttgctgcctgaaacaaccttttatctgtatcatcacagggaacgctcatgccagcccatggtttgttttcatccttccaaccgagccaaagccaacgaagacgaaaggctcgcgaaaacctctctaaatccaggatgcccaaaccacccaaaacttttggcttacacaccgtctgccaattaactaaactgctgcctgggttggttttgtcagggtcttctcctttccaaagaaaagatctcctaaagcgatcaattctttttatcacccatttgggcacttgcaatgcggtgaagtgatgaattggcatagagcttaggaccgattggaccagcgttttccttccggctgaagtaaagaacctccctttccagccaggaattcgcaagccaattttttcgattagcggtaggaagtcgattttccttagctttcggatatggagtggcaggccaaggtagcgacaagggaattgctttaccattccagggaaatttgcaagaagagatacgaggttgatgttttcacatctgatcgggtagatctctgtcttactgatgtttgtgtgaaggccagaggtttgcgcaaagaaagttaggagtctcataagcaccgataagtctgaagcgtgaggcttcacaaaaactgccacgtcgtctgcatacagggagcacctgaatctgtcaaaactcccacccattggagagagaagtgatgcattttcagccgccttaagaattcgatgaaaaggttccattgctaggatgaacaacatcggcgagagcggatccccttgtctaaggcctcggacatggtttattgattgccccggagatccattgagaagcacttgggaggaagaggttgcaagtaaattggaaatccagtttagccaacgagttccaaatccaaactgatgaagcacatcaagaaggtagggccaacaaaccgtgtcaaaagctttggcgatgtcaattttgataaacagactcgttttcttcgttctatgtaaatattgtaccatgttttttacgaagacgaaattatcatggatagccctttttcgaacgaaggcactctggttgggggagacaagctcacacagtcttggcgctagcctgtttgccaaaattttggaaattatcttagagaaactatggattaggcttatcggtcgatactgttcagctcccaaagcatcttcttttttgggaaggagacaaatgaaggctgagtttagttcctttagccgcaaagtgttaagatcaaaaaacgatcttactgccgataacaaatcttctttaatgatctcccacgctgatttgaaaaaagcaccaatgaacccatccggccccggagccttctcgggtggcattgagaaaacagttttcttcagttcttcttctgtgatgtcttattctaaatcgccaaggtccagggagagcaaatccatcatgttccagttaatccctgacgttctttgaaaacgagttccaattctttccttgaagaaacgcagcagttcctcttctttgtcttgtgctgaaattgcaatcccagatggcgtgtgcaaggattgaataaaattttttcttcttctggaattggccttgatgtgaaaaaattttgaattaacatctccctctttgatccaggtctgcctagagcgttgtctgatctggattttgtttagaactgataaagccagaatcctatttttgaggttagacaccaggaggcgctcatcgtctgacaaggtcctagtttcctgagctacgtccagctgaaagaccacttcagatgcaaccgcaagttgtaacttaatgtcacccacttggctccgactccatccctttaaatctcgagcgagacgtcgaagtttgatgcggaaaatagctaggcaattagtggcaaggatcggccgttgccatgagtcttgcactgcttccaagaacccaggaattttgagccaaaaagattcaaatctgaagcttgggaatttcgatcatttctcatttcctaccagaaggagaggcgcatgatctgaacatgctgaagacaaaggatacaaattggaaccctcaaacattaaatcccagtcagttgtgacaaaagcacggtcgatcttggtttaagttgggtttgcaccttcccctgcccaagtaaaacgacgaccagggagttgaagctccttaacctgaattttgtctagcagaccacgaaagcgctgcatcattcgtctatttaggcgatcgttgtttttgtcagaggctttatagatgagattaaaatcaccgatgatcagccattcagatttcatggagggctgcaggctctctatctctgagagaaaaaccactttgtcagcttctagttgaggcccatacacaactgtgattgaccactgtagcccctcttctcgcatggtcacagttgcagacagagagtattgtccaaggataacatcagaaggagaaaagaaattttcattgcaagctagcaacagaccacccttggtgccgtccgccggaagggccacacattgccgcacaaaattttggcccaaactgctgagaacaacacgatcatttaaagaggcaatcttagtttcttggagacaaacaatagtagcaccatattattgcaaaataattttcacggcgtcttgcttcgcctttgaattcaggcccctaacattccaattaaacaggtagacattgtcttgtgacattgaaacatgagctgctgcaactacatctttggttgatgaggaaaggaacaaagcttttgccgaaacacaaccagccaaactggaagaaacacaggcaaaaggtgacgctacaactctgctttaacacagcaagcaacaggcagaagtaggtcaagcacaaaaggctcttcatgggtgttgtgcagcccatcttcatcctgaggcgttctgctcacaggggcgcgaccgccaccttcttctttgcagccttcagacggatggtcttgcatccccccttctccacgagctcagcgattgtcttcaaggaggatggagagagaggcttcctgtagcgctgcaaataaatctttttgatgttatcatcaaaggaagcatgatcatccaaaatgcaaaacttatttgacaggatttcttgagcaagagtttcaagttttgctcccgcccgcttcttgcgaaggaggcgcttactgtggcgttgcgccgaggagatggcaggaattgtcaccttagcatagcttggacaacgagcattgacgtcgggagcaggtagcagcggctgctgaagaggagtcgagagagcagagatgaactcttccaccctgttgccctgcctcgccaccagcccggcttgagtctgcacatccgtcgccaccccattggtatgcggagtcccctgttctgcaaaagaagaaagtacaaaaacaggagaagccacacggggaggagcattgtctggtgagtagatggaatgctgcacggacgcctcatgcaacattgggtcaagatgactctccagaacggaaaggacatctccctgcccctcacttggctccctagaccgaccgcttctgctacgaggacccgagcgttcccggttgcgcgggcgccccctgtcttcattgccctgacgccggccgtcatctctctctggctctctgctgcagcttgaggatcggcgcccaagccgatcccacagggagcgactcctgtgatgggacctacttggcttgtctctgtctttgtcgtcgtcatcatcagtcggccctcttgaaggatcaggctcagctctacaaggcagaggatactctctatatcgagtaccgtcatcttggacatcatactcccacttataggcatgggctttgcgagtgaggaggtcttcaagagtatccacatgaacgaggacattgtaggtccaccccttctttgtgtctgacggcggcgggttgcgaagcggctccaagtccggcagaggaatgtccgtggacagaccttcctcatcagcagaagtgatggcgaaagtgccaccacgagggattgccctgggctcatcagtccaaatccaaagatcataggtgcagctgtagttgcgccggcgggagtattcttcaacatattgaaccgagcacttgcgcccgattatcttggtcgcggcttcttcagtgcggccattgggatgccctcaatgcagatgcgagcgcggtagcaaaaccgtgcctcggtaccatgcaggctctcgtcccagggacgaaagaggtacactctgccagaggcagtagagagcctgggctaacgaagaattgcatcgtggtcactctgatttgaacaagtgatgaagaagtcttccgggtgaaacttggtgaactgaatgtcagcgcacctgatgcgaaaagctgagcggacatcgtctgcaaaagtgttgagctcaacctttccttcattcgcccccacttgccaagccacaagagaacgggctgagaagcgctctctgttcctctcaatttcaccagtggcagacatcacaacggaatcaagaagaggacgagcggttagatcatccatggcgagaggattggagggagtggggatggagcggggagggaagcgaagtggagccaaaggggggaaagctgcagtggatagcccatggggaaccgaaggggatttatagtcagctttcttgctacagctggaagctcgatgaccgaaattcaaacatcgccaacagcgaagaggatctctacaatcaaacacttgatgctctgtgctcagacaccagaagcatttaccttccatatgctgcaggaagcgcgccctccttgactgcagatactctttgttgttgggaggattgaatgcagaggattttctccaccagtgcttccctctgacctctttccaagaatctgaattcacttgaatgcctcctgtaccttgcctggaagctgaaagattttgagaagacaactcaactcttcgcccactcttgaggatcttgaaatcctttacagctgcagcaggcgagcttgtaggcttcataggggaggatggtggctgcaacgaagttaagagggaggtactagcagctggaggacgaagaggagcggagagcacctcagagtaaaggcgcttaaatccctgagcacctgctttcggcgaaccatgaccttgaagggacagagcgagcgcagcagcagcgccggacccgggattgagcagatctgcattgagaaccttgcctgtgctgacctcaaccaaatcttgaaccgaatcccctggagaggagacagcccaaggtgcagtcgccggcctagggagcactggagacgtggtctgacccggggggaaaagctctagggttggggaagctaaggacgctggtggatctgagggagaggagaaaaacagggagggcgacagggacagggatgagcgatgacgacgatggcgggggtgagtgtctggacttaaaggatctggtcatgatgtggatgtgggggagaaaggggagaaggagagagagagggagctcaccggaggtggccgccggaaccgaagaggccgccggcgcgggtgcgtctagtcgcctaacctgtcgcgagagcatcctaactcgtctttcctttcaagagtagaagtatgacctgtaaacttgatcaaagtttaaacgatttataaactgaaacggagagagtagctctatctatcatatcactaagcttccagcttttgttttctcttgtgtagttttttatattgccattatattttttttcttatgtcccaaaatatatttattttttcatatttcttggataatatccttttactgatatactatactttttgagacctacttcataatgtcatactcaattgttctccaattttattacaggagaagcattctgacaactctacaaatgttccgacgtttcacaaactgactaccttgtgcttcgatgcatgtgatctggacaaaaatctagatatattgttgagttttctggagaatgctcctcatatggagaaagcaatattgcagaactgcaaggtactagttttctcttatttctgtttgtcttgttactctccattttgttggctacttggtttatcttctcacggtgttcgtgtgtgatgctctcacagattccaaataattcgagaaagaggaaaataatggcaagggcaaataggaccctgatttctcccgagcacgaaaacgtgacagttttggcgtttcagtacttttaagcttatcaagatcgcatataaaaacgacaatatcaaagatgtgattgaacttttactgtgcaattcgacagaacttgagaacagcacaatcatcctcacaagacattaaattgtttgagttgtattcgcgtgcagcttgttggtatgtcacttttgaattgttttttaccaattgtatgcccaaatgtatacaaatatatagcaaaattgtttgtttatccgacatgaagtgtcctgggtggttacattatcatccattgtgggttggataaacgagagtgatgacatcggaattcctgttccgccccactgcatttggtccggtccattagttagattcagccataagtaggcccaattttctaggaataaagttcacctgtcgtccctcaactttaccccaggtttgtttgacatcccccatccatcatcacacttaaaattagggatccggatagacctccaggggtccggtcagatcaattttgcatttgaatttgtcaatatcagtagtaccaaatttgatcgtaaacagaaatctcaatccttacatcgaacatatcgtgtttgagttacatttaggccatccttgattttgtttttatggcatggctttgatataagctaggttcgattgttcacaaaacttagtagcatgtcctacgttgtaacgggctataagtagcaatgactataagaagattagggataaaatatttggtagttacctataaatgctacgtgtaggagcgcgttgcctgccgtggagaaggggaggaaagtaagacaactttacttttaacagtactacaaattgttaaacataaaattgcttcatacatactaccttcgtctcaaaataaaacaacctagtacaacataagacacattctaatactataaatctgttgttataccatagtagggaaggagtataacattagaaatttaattgtccataaacaaaaatttttagctgtgataatgatgtcataagtgggacaccgggttatttttgctctggatttgcattgactcagttctccataccgtgcaaaaactgcggaggccaagaacagcccgtttggttggagagagttttcaagagggattgaggctactaagtgttttgtttggttgggagacatggaaattttggtgggatgaggatagagaattgaggaaggaactccctccttttcaatacctgggtaggggcagttaattgggagggaattcctcctttactttgtctaagcaaatctcacccatccgtttttattactgatctagtctccaactaaactccctatcaatttccatcgcctctgccaaacaagatattatgattaaaaatcaaattcccatcttaattttatcatcaatttcctcgtgtaaactcccaatccccttccctcgagttcccgagcaagccggaaactctcatctgatcggccaccgtgcgttccacgggtccaaagtccaaaccctaccgtcttcttccgcgatctagcggtggcaacgcgcgcgcgcctgcatctctggaaagaaagaaagaaacaaacagagaggagaatacgaccccaacgaacgaacgccggcgatgaagcagccgtacgccgacgacgacggcgaccgcctgagcgcgctgccggactgcctcctccacacggtcatgtccttcctctcggcgcggcaggccgtgcggacgtgcgtgctgtcgcggcggtggcgcgggctgtggctgtccatgccgtgcctcaacatcgacggcgacgagtaccggccggccacggccggcggcggcggcggcgccaccatcaccgagaggtgggagaggctggagaacttcaccaccagcctgctcttcgcccacaacgcgccgttcctggacaggttccgcctccatctcccaaacttccagcgcatcacggctactcagcagcatcacgggcggcagatggagagatggatcctccgcggcttccggtaccggcccgccgcgctggagatcgccgtcggagtcgccgccgtcgcgttcaagctgcctctcctcggcacctcctcggctagccgcctcaagagattgcatctttccggcgtggttttggacggcggcttcggcgagtgcatccgctcatggtgccccgtcttggaagccatggagctcaaggcttgcatcttcgaggatctgaaggagatcgtctccagcacgatcaagagtttggccattgttgactgcagaagtgggcaccatactgatgcattggtttgtcgaatggattccctcgttgaagcatcgattagtggaacacgtttcggatccgactttgacaagacgacatccactttaataggcagtctaatcaacgtgagggaacttaatgtgtcgtggtttcagccagtggtatgtagtataacccatcttgacacatgaacattacttattcgcttcgacattcagattacttttacagaaattgtaggagaaccactttttccaagctagtttctatctactgcactcctttcaatcctagataacttgatctaccacaaaagcacctttttatgctatactttgttgaacctgtctgctttttcatattgctattataaatttcttctatctaacaataatcattacactatatataatgccttaccaactgtgtatggtcctattatgaggatcctatatatgatcatgtgatactcaattcagctccaatttatttcaggagttgaaatatggtgaatctgcgaactttcaaacatttcacgagctcactacattgaacatatatgaatgtgatctgggtcaaaatttacatatattgctgagttttctgcagaacactcctaacctcaagaaagttatattgcagaactgcgaggtactacttatactttctttcagtttgttttgttactctgctttcttgatttatcatcctagagtgatcctgtgtgatgccccaatagatttcaggtcattcgagaaagaggaaaagaacacccagggcaaacaggaaccagattcattccaagcgcagaagtctgataacttccaagtctgagatctcgaagataatgaagatgacatatgaagatgacggtgtcagtgaccttattgaacttttgttgcgcaattggagaaaacttgaggaccatactatcataatcaccaagatttgagtcttttgcatatggtgttatcatatgcctgattcttatgtcattttgtactatactgtgtgtatttttacaaatagtaactaaaaccatatatatgactaatgccagactggtgtgattaagggcattacctccaatgtatgctagtattaactgattccagtgagattcgtaaaatcactcttttatagtttcaagttgagaaatttaagtaaaacagccatttgattatttgatgatgctcctccctattgatcaattgacagttgacactgttaccatactacaggtgcaaggattagcttcattttctgttctgtcattccaatctattgattcctttcaaaatgataagtgccaatttgtcaagtttttatcctagaaatgcaaataaacatcttcatgatgctcttggaataatctgttgtgaggataatgttttgtgacactgcttgtgttgaaagtcatttattataaattggggaagacaaagtaattgattttcttgtccaaatatcgttgagcaaactataataggagaactaaactttctccctccattattgtaataacataggagaactaaactttctccctccattattgtaatcataaccagagatctaaataaaataccttggtagctggatgaaaactattccataggagaactaaactttctccctccattattgtaatcataaccagagatctaaataaaataccttggtagctggatgaaaactattccatgtcaatatgaagcgtacttcgaggcaaactcagcaatattcttattcgagctccctcctttcttcatggcttccttagctttcttcatccacctattagcatttttcctgtactctgccttcctctcactctctagaacctctctgatgcatctctccacctcttcttttctcaccatgccttccttgtcccgatgtacgcgtacaccatttccccatgcactttcaatgtacttcgctgtagttggttggtctgtccactgaggcatcgctaacagtggaacgccagtaacaattgcttctgttgttgagttccatccacagtgagttaagaaacagcctgttgattaatgaagaataatcagtttctacctgcagcttaattatttgaaactgtttactgcagatacttccgatagaattgacatgatacacacatcttatcgcccaagagttggattgacaagataggttacccattggataatttggttgaaggcagtaacttgagctaggtttgtgggatccaaaatacagatcttatgaaaatgactcagtatgccatgtgtaaataattagggacagtatgtccttgtagaattctatagctgccattagattttgtaggatcgaacagcaagaactaagccaaccagagggggggggggtgaatggttgtaggggtttacagatttaagtgaagaaacactccaatcaaactgatcagtatctatgcatcagttacaactagtgtattcgtgcttctgtctttctctgacaactacttttaactgtctctgcagcttatgtaattttgagagatatatggttcatatttattccaatatctagaactttcagtcttctattctcaccatatatctgtaatcgtagccttctgacattaattctgtctcatgaaatacttgaactagtagtttagtgaatgaactgaaattaacagcattattaccgatttgactcaaaatctgagttgaatatattacatttccacatttgaataaaaaataaatggggccacgagtaacatttaaccagattaaagatagttgctaacagttgcgtatttttgtgaataaaacatgactttttgtcccatacctgtggctttgtgagataagacctcaagctggggacaccaagaaacgattaggcccctctccttgcacttgtcacggagttcttctgatagcttgtgttcatcacaggacctcacgacccaaaggaacggtttaccggaattgcaaaatccattgcccagctcatctaactgagttgggtcaagatcagcaacagtcccataggaagcatagacaacagagcaagggggctgattatctagccacgccaagcaaggtgaagtgctgtcagaaatgttgaacccatagttcttgtttggttgtaagcgatcgtcatccaagtagaaggatggtacggtcggaccaatcgtcttaaaacgccatgctgatgccaagtaatctgcctcctgattaagtaacaacattgcagctatcaaatcttctaccttctccaattctctctggggcaaaacaacaaacagacgaggggcatgagcaggttgactcaccttcggctccaattcttggaaagaattgacgagcacgtcgtcggcgtcctccagcccgtcgaactggcccagcaccgcctccaggaacggcgggtacgactccggcgccttcacgaacgacggcacgtcctccggcccgagctccacgctcagcaacccccggagcgcgcccccgtccacgacgggcaacccaacgcgccccgcccagacctccccgtagatgacgtccacggcgcacggctgcgagaagaacgcggcggctggcaccccagcgccgcgcgccacgcgccccgcccacgggaggtgcgggtcgtacaccagcacgcggggcggcctccccgcggcggcctcggagcggaggaggacacccagggtctccgagcccacatccgccagccgccgggtgtactccctggcgtccccgcaggccgccatgccgccggagtcgaagccgtcggagatggcggcgacgcggaagggggcgagagggggcgggacggtggagagaacgtggcgggtggtgacgagcgtggggaggaagccgtggtgcgccgcgaggtggcggccgaactgcaggatcgggttgacgtggccttgcgcctcggggaaagcgaggaggaagacatggccgccggcgccgccgccgccgtcttgggtggaggaggtggtggtggccggtgcgttctccatctcggctgtttcgttttttcttctctgtgtcgcccgggaggccgggacatggaggagcatagtccaagactagtccatcctaccatttttggttttttcttctagcaaattattttacaaaattatggctatgattagttctcttcaaacttccaacttttccgtcacatcaaatatttgatatttgcatgaagtattaaatgtgaaaaaaaacaattgcacagtttgtatgtaaattatgagacgaatcttttgagcctaattacgtcatgatttgacaatgtggtgctgcagtaaacatttattaatgacggattaattaggcttaatagatttacctcgcagtttacaagcggaatctataatttattttgttatcggtgtacatttaatacttcaaatgtgtgtccgtatacttaaaaataaattttgaaatagaactaaacacggcatgtgttttcttttctgtgttagaaaagacaattttttaaaataattcttaacattttttaaattataccatctccaaaatatatatttgactatatttttcttattataatatataataaataaataaatttttattttttatagtatttcctaaaacaaatatatatatatttttatttagcatagattcttttaaatgtttagagaataaaattagctcgaagtctagataaaagaaaatctagatttatttttgattcataatgaaaaaaattgttgcaaaatttacatttagatgtcaaactaaatttacataattattatttgtgccatcttctctagtgtggttcattatttttccttgaccctctaatctttcccttaatttctattggtgtgctatgttatgagtttttaattttaaattaaaataaaagctctacgtattattatgaaaatcatcttagaatttagccttttcttttttcatgcacagttttttacatacaagtgtgctaacctatagaattaattgttgtaaccaatgctaatttaggttgcgttcaatctctttgttttgatatttttgacgcatgcaaaacgagaaatcacattagcacatgattaattaagtatcaataattataaacttgaaaattaggtttatttgattttttttaaataacttctatatataaattttttgcaaaaaaatatcatttaacagtttgaaaagcttgctaacggacaacgaggaagttgaagtttgaagttgagaaatagaactatgccttaatcatagggacttaaaaagtacaatgcatactttttttttgactaattttcagattataccaaaattaggtagtggttttgccttttgttttctgaattttgtaaatctttctacagtcatatgcagagtgggactgtagattgcttggaaagccttttatattttcatagttctattgctagttctattccctatgtatttttttttattttctttgctctcacacatgtgaggcaggcactggaaagttccagaaaaaatccagctttactatttttcattgatccaatcctacggcttcctgcttttttttctccatcagacggttcagctttcgttgctgacgtggatcaattgagtgctatttttggattcacagttcacctatagagatttcttctgaaaaatatacctataggctcggacattctctgtatacaattccgtattttcaatagcccaggatttagagaactcggattaatatctgtagcattactgctattaattagcattgctctgtttgtgtgcttggtgatgctctgttcgtgtattggtgttgccaaaggaagcggagaggaaatgggctccatgacggacagaaggctgcagagaaggggaaagagcaaggaagcagagaaggggctctgactttctcgcctgcaaacaacacactgccgctgcctcgaggctggttgattttcactaatactccaatcgttagggccgatgtgatacctctgcgtaattatgtgcctccgtaccaccaaaaaatccattccattctaagatggatttagtggcgataaaaaataactaaaatattcttaattaaaaaatagtaaaaattatatgtaggtaaaaaatattgaagggataaaacttctcgttttacgtgatgagggtaggtaggataatagaagttggttttagtgggataaaattcaaattatagaagttgagtttttttgggagtagaaattaatccctatatcatttgtttatcatcacgttgccacactttgtccccctgtttagttcccaaaatgttttccctaaaaacatcacatctaatctttggacacatgtacaaagcactaaatgtagatgaaaaaaaaactaattgcatagttaggggggaaatcgcgagatgaatcttttgagcctaattagtccatgattagtcataagtgctacagtaacccacatgtgcaaatagcggattaattaggctcaaaagattcgtctcgtggtttccaggcgagttatgaagttagttttttcattcgtgtccaaaaaccccttccgacatccggtcaaacgtccgatgtgacacccaaaaaattttatttcgcgaactaaacatgcccaaggctgagttcttatcccagttttcccaactcacctctctcattttccacgcgcacgtttttcaaactgctaaacggtgtgtttttttttaaaaaaaaattatatacgaaagtttgttttaaaaaatcatattaatctatttttttaaaaaagttaatacataattaattgtgcaataatacgtgctccgttttacgtaccggggaggaggggttcccaacacctcctcccgaaaacagcctaagccgatttactggcgccctcttactttaggctataagtttttttttgagaggctttaggctataagttgaaaaatcaaaaccaacagatatttttttttgtttggcttttataaagctgtcactcctaggctgtctttggtattaagggatggaaactaatcccttccgtatgaaaaaaatcccttccatataaaaaacggagtgatctattaacgtgtgattaattaagtattacctaccgtactttttttttaaaaaaaggatcaatataattttttaagcaactttcgtatataattttttttcaaaaaacacaccgtttaacaatttgaaaaacgtataagcgaaaaataaggagagtgggtttccaactctaggtgccaaacgcaaccttacactgttgagcaaaaagttgggttgaactagttttttttttcttatgtgaaatggagataagattttaccattaaacttaagccttaaaatcctttaacttattaacaaaaaacaaaaagtcgtcttaaaagcctaaccccaaataaagaggatcggttctttaagctaacctttttagcttttatatagttctattttgcttttattttatgtagtagttaataagcttgtgcccttttttaaggaaattctgtggctttcaagtctcgagggtaaggtgaagtcctatccgtaattcacaaaattgaaaggactactcgaacctggattaaattttggcttagtatagctaaaagaaaagtacgacgaacaaactgactatttgttggggcttaaactttttcgtttagctcatgagccccaaaaaaggcccatctgcgattcacatatgaaaagctactcaaatatggctgttgattttaatagtgcaggagtggtttatagctttaaatataacgaaccaaaatgttgatacaacacgtgcaacattaccctttacttgcaaatcaagtccaattcatgtttcatgccacgttcgccgtgccgattcccgacacggcgacaccccctgaaacagtgtacaccgcaaatttggaccatggagagagcaatcttggccgtcactccactgcactcctatttatccattaacaatccttgtgatgcaaaacacacacaccagccgccgcatggcagtaccagaaaccaacacaaaacaagatcatggggagcatgagcacaccggcggcgagcgccaacggcgggcaagtgctcctgttgccgttcccggcggcgcagggccacaccaacccgatgctccagttcgggcgccgcctcgcgtaccacggcctccgccccaccctcgtcaccacgcggtacgtgctctccaccacgccgccgccgggggaccccttccgcgtcgccgccatctccgacggcttcgacgacgccagcggcatggccgcgctcccggaccccggggagtacctccgcaccctggaggctcacggtgcacgcacgctggcggagctcctcctctccgaggcgcgcgcggggcggccggcgcgcgtgctggtgtacgacccgcacctgccgtgggcgcgccgcgtggcgcgcgccgccggcgtggccaccgctgcgttcctgtcgcagccgtgcgccgtcgacctcatctacggggaggtgtgcgcgcggcggctggcgctgccggtgacgccgacggacgcgagaggtctgtacgcgcggggtgtgcttggcgtcgagctggggcccgacgacgtgccgccgttcgttgcggcgccagagttgacaccagccttctgtgagcagtcgatcgagcagttcgccggactggaggacgacgacgacgtgctcgtcaactcattctctgacctcgagccaaaggtatagctgcgttcctttcactggcttgggaactcatttcctctgcacgaaaaacggaatgatccattagcacacgattaattaagtagtagctaatattttttcacaaatggattaatatggttcttttaagcacgttcgtatagaaactttctaaaaaaacattttaaaaagcgtgcgtgtggaacacgagagataggggttgggaacaaagagcaacgaatagtttagttcgtttctaggtgttcccaactctcccctctcgttttccgcgcgcacgctttttagacggttaaatggtatgtttttgcaaaaagtttcgatacgaaagttgcttaaaaatcatcttaatccatttttgaaaaaaacaattaactaatactcccttcgtttcacaatgtaagactttctaatattgtctacattcatatatatatatatatatatatatatatatatatatatatatatatatatatatatatatatatatatatatatatgttactgaatctagacaaataacacatatatttgtctagattcattaacatctatatgaatatgggcaaatgctagaaattcttacattatgaaacggatgaagtacttaattagtcacgtgctaatggatcgctccgttttccgtgcgggagggatcagttcccatcctcctaaaatgaagaagtgtgcttccatccaaacatactccattagtttcatattataaatcgtttgacttttttctagtcaaactttgttaaatttgatatagctcgtacaaaaattatcaacatataaaatatcaaaatagtttcattaactctaacattaaatatattttgataatatgtttgttttgtgttgaaattacttttatatttttctataaactcgaacaaacttaaataaatctgactagaataaagttaaacaacttataatatgaaacggagcgattaccatagatgatcattgtattgcaaaattgttacacatttttcttgggaaattaaaatgagcaggaggcagcatacatggagtcgacatggcgcgcgaagacgatcggcccgtcattgccttcgttctacctcgacgacggccggctgcggtcgaacacagcatacgggttcaatctcttcaggagcaccgtgccatgcatggaatggctggacaagcaacctcctcgctctgtcgtccttgtgtcgtacgggacagtctccaccttcgacgtagccaagctggaggagctcggcaatggcctttgcaactccggcaagccattcctttgggttgtcaggtccaatgaggagcacaagttatctgtccaactccgaaaaaagtgtgagaagagaggactaattgttcccttttgcccccagctggaggtgcttgctcacaaggccacaggtattggaactaaccaagaactcaaattatattaatcttgataacaaaaagtatacaaaagactagtgaataagtagtagacaacaatagctaaatgcaagtttttttttacctggcaccaaatatttatatgtaggttgtttcttgtcgcactgtggatggaactcgacattggaggcaattgttaatggcgtaccgcttgtggcaatgccacattgggctgaccaaccaaccatttcaaagtatgtggagagcttgtggggcatgggcgtgcgagtgcagctggacaagagcggcatcttacaaagggaagaggtagagagatgcatccgggaggtgatggatggtgacaggaaggaggactacaggaggaatgctacaaggttgatgaagaaagctaaggagtcaatgcaggaaggagggagctctgacaagaatattgctgaatttgctgcgaagtattcaaattgacaaaaattattgctgaaatctcaagcacctagctatcagagatattctagttctgacttctgaatacaattggtttttcttcctagagaagttcatggaggtcaaggtgctgatgttttccacgagtcagcagaagtaaattaagtttacagtgtgtgtaaaatggtaatttatactacttacaatttttattttataattgaagtgtcgttaacttatgtcctcgtcgagggcaacaagctaccttagagatatcacgataacaaatgaattatgtaagctttacatactttgagagtaccgggcatagcttgcttaccaaattacagaacatatatatgtgcatgcatcaatttcctctgataccggaaaaactgttatttatcctctcctctcaattctttctactaaaattcggcattacaacaatatatctctcttattaattacaagtttctatagtatataaagcaaaaaaaaaaataaagcgcaatgaaaaactcaagtaaataatatggttaaaaaggatgagacttcaatcctccatatcttccctatcgcacaaaaccatcaaccagagcactaccagtttatttaaaactgttactgaaattaatatcattctcagtttaatataacaatactaatatactattccaggtggtttattatatggtttagttaagatgaaattcactgtgggagttcacttagatatatatatttttagaaaatcatgagctgcagttaggagtccgattgtctcaagttagcatgcgattttttttaaacaaatttcttatatgattccttctatattaccaaaagtgaacggtcttaaaaaccgactcaaatacggatatgtattttcaaaagcaaacgaacttaaaaactgactcttacacggatgacgtaaaaaaaaccgataaaaatattttcaatttttataatagagatagtgattgtccactggtcggcccaagcacacctctaagagcaattgttttgtttgacagaaggacttcaagggcaggaatcccggtgagcaacttctcttcgaccacgcgaacacctatccattctgtgaggctgtgatagtcatagtccctggacaaagcgagtctccatttcgcctacaaacttgtcgtcgtcaagcgcgccagcacaaccaaaattaacttgcgcgccactctgcctctcaacccttcaaacacctagtataaagctcatcgtcgccgcgagcgagcttgctacctccaagtcaaatcaccaagtgattcgaacccatggcgagcatgaatgatcaacacggcggcgccaccgcccacgtcctgctcgtgccgttgccggcgcagggccacatgaacccgatgctccagttcggccgccgcctcgcctaccacggcctccgccccaccctcgtcgccacccgctacgtgctctccacgagccctcctcccggcgaccccttccgcgtcgccgccttctccgacggcttcgacgccggcggcatggcctcctgccccgaccccgtcgagtactgccgccgcctcgaggccgtcgggtcggagacgctggcgcgggtcatcgacgccgaggcgcgcgtggggagggccgcgaccgtgctcgtctacgacccccacatggcgtgggtgccgcgcgtggcgcgcgccgccggcgtccccacggccgcgttcctgtcgcagccgtgcgccgtggacgcgatctacggcgaggtgtgggccggccgcgttccgctgccgatggacgacgggggcgacctccggcggcgcggggtgctcagcgtcgacctcgcgacggcggacttgccgccattcgtggcggcgccggagctgtacccgaaatacctcgacgtctcgatccggcaattcgaggacctgctcgacgccgacgacgtgttcgtcaactcgttcaacgacctcgagccgatggaggccgagcacatggagtcgacatggcgagccaagaccgtcggcccgacgttgccgtccttcttcctcgacgacggccggctgccggcgaacaagaaccacggcatcgacatcttcaccggtgatgcgccgtgcatggaatggctggataagcaggcaccctgctcggttgttcttgcctcctatggcacggtctactctctcgacggcgccgagctcgaggagctcggcaatggcctctgcaattccggcaagccattcctctgggtggtgaggtcgagcgaggggcacaagttatctgaagagcttcgtggaaagtgcaaggagaaggggttaattgtgtcctggtgtccccagcttgaggtcctgaaacataaggcaacaggtatgaattgctaattaaaatgtcaattacaaagataaaaatgtttttttaatgatgtacttcctccgtttcatattataaaactttctaacattatccacactcatatatatgtgtttagattcattaatatctatataaatgtcgacaatgctagaaagtcttataatatgaaacggagggagtaataagtaaaggtaccacaccttgcagtgttaattggtaccctacgacaaatcatgagttagaaatagggtcgagttaatactttctctattttgaatatacagacactggtaaaagtactccatccgtccataaatatttgacgtatttgacttttttaaatatgtttgaccgctcgtgttattcaaaaacttttatgaaatatataaaactatatgtatacataaaagtatatttaacaataaatcaaacgatagaaaaagagttaataattatttaattttttaataagacgaatggtcaaacatatttaaaaaagtcaacggcattaaatatttatggacgaagggagtattatttattttattatgacttatcctctaatggtaacttacatttttttatatttatgcaatatttctaaataagataaatcattaaacttatatcgaaaagttgataggatcatatatttaaaaatagttgtattatgtttgcaatatttgattaaacctctgccacacaaattttttctgtgcaggttgtttcttgacgcattgtggatggaactcgacgatggaagcaattgctacggcggtgccaatggttgcgatgcctcagtcagcggaccaaccgactatagcgaagtacgtggaaaccgcatgggagattggtgtgagggcacaactagatgagaaaggctctgtcacgaaggaggaggtggagatatccatcaagaaagtgatggatgggaagagggcagtggagtacaagaggaatgcagctaagtggatgcaaaaagccaaggaagcagcacaagtaggcgggagctcagacaagaacattgctgaatttgtagcaaaatatttatcaaattagtatagctttgtatacatctggtttcttcatgtaaggatcttgtaacaccagcatgtaaaaaaaaattaaatagcagacgacaagatggagttagttttaatgtgtctacaaagattttggtagtataaaactaaatgagtggaaatttggtggtatgagacaaattttcccttcccaaagaccactaaaaatataaaaatataaagtaattaaacgagaaatcatcagtctacagatggtttgcgagttctacggaaaattaaaactcaatcggagatggattttcatctgtctaggagatattagctcgtttcttgcatgtcagcatgtcacttaaatagtttaaattttttaaaaagtaataaggtaggttaatataaaatatatcatttcataaagcatgttatgtaaaattcgacttccacaagttataaaaaataacaaattaaacagaaacttgttttcgtaccttcatagttatgtttgttatattttttttatctaaattcgtatttgtatagtgatatatcacatattaatctatatttattaatgttttgataacttaggtaataagtaattcaagaaacagggaattttccctcgacggaagaaaatcgttcccactacaatcttctgaaacatatacctacaggctcgaacattttctgtacgcaattccgtgcgttccatagcacaaaatttgtattgtttagattaacatgtgtagcattaccgctgtcaattagcattgttctgtctctgtgctctgttcttgcatgtatcggtgttgccaaaggaagcagagtggaagggggtcgccgtgagcccgtgactggaggggaaagggaaagagaaattttctttcacacccctaattttttagtcgatgctttctatgtccctaaattttcttcattccctttatgtttctcaattttgatttgcatcttttccataacattgccgaattggccattagttcgtttaataggtgtggagaagtctgttttaccattcaatatgtgagtaatatatagaaatttatcgactatattgatttggatcgatgttgaagtattgttgcactttgtctatattattcatcgaactttatcatatcattaatcatcatataatggtgttatgtggagtgtgatgatgtaagaatgaagttatagagttatattcatgcatagttaaatgtgtaattatgccacacacggttgtttttcatatgaagttccgatcaatattagtagattccatttcaatagtcccgtttccgatttaccgacgttaccgatatcgttaccgttttcgggtctacagttccgattccgttttcgagaaaaaaaatatgaaaataaaaatgccaaatggttttaatttccaaccttttccgaccgttttcatcctagatacgtgtctacatccacgggttttgtagagagccaaaaacaaacgtgtgatacaacacgtgcaacatgtcctttacttgcaaatcaagtccaattcctgtttcatgccaggttcgctgtcccgggccgacacatccctgaaacagtccaccgcaaattctgacccatacagaaagcaatcttgggcgccactcctacttatccgtctcgatcaaacacactcacatcagccagccagcagtaggcccagcacacacccacagtcctctatcacatcatggggagcatgagcacaccgccaccggcggcggtcacggtggcgaacgtccaacgtcggcgacgataaccatggcggcgggcgggtgctcctgttgccgttcccggcggcgcagggccacaccaacccgatgctccagttcgggcgccgcctcgcgtaccacggcctccgccccaccctcgtcaccacgcggtacgtgctctccaccacgccgccaccgggggaccccttccgcgtggccgccatctccgacggcttcgacgacgacgccggctgcatggccgcgcccccggactacggggagtaccaccgcagccttgaggctcacggtgcacggacgctggcggagctgctcgtctccgaggcccgtgcggggcggccggcgcgcgtgctggtgtacgacccgcacctgccgtgggcgcgccgcgtggcgcgcgacgacggcgtgggcgccgccgcgttcatgccgcagccctgcgccgtcgacctcatctacggggaggtgtgcgccgggcgcctcgcgctgccggtgacgccggcggacgtgagcggcctgtacacgcggggcgcgctcggcgtcgagctcgggcacgacgacctgccaccgttcgtcgcgacgccagagctgacaccggcgttctgtgagcagtcggtggcgcagttcgccgggctggaggacgccgacgacgtgctcgtcaactccttctccgacctcgagccaaaggtaatctagtgtatccagcttacattgcaacaaacaagatcatttcgtcccaaaattgttacacattttggctgtgaaatgagcaggaggcagcatacatggaggcgacatggcgcgcgaagacggtcggcccgttgttgccgtcgttctatatcggcgacggcccgctgccgtcgaacacggcgtacgggttcaacctcttcacgagcaccgtgccgtgcatggaatggctggacaagcagcctcctcgctctgtcgtgtttgtgtcgtatgggactttctccagctacgacgcagccaagctcgaggaggtcggcaatggcctttgcaattcaggcaagccattcctttgggttgtgaggtccaatgaggagcacaagttatctcgagaacttcgagagaagtgtgggaagagaggactaattgttcccttttgtccccagctggaggtgcttgctcacaaggccacaggtatgggaaccaacaaaaactcaaattaattattttgacaacaaaataattttcttccaggttgaaaataattgtcatttttataagacagatgtgaaactttaaaaatttgactataaataacatgtaaaatgttttttagaaatatgcaaaccatatgtataattaatctaaaaagtacttcaattcaataaaatcatatatttattggtgtttatatatatatgggaaatagaaaatattggtcaaagttatttttttttagcctggagggagtgtatag

SEQ ID NO: 59865 - DNA, 4306 bp, Oryza sativa
cacctaatcctccacaccatcagcatcattgtagaactcttcctctgatgaatgattgcaaggcgagtatatgacatactcagcaagccacacagcaaatatgcaagtgcacaggataacaaaggatggcataatagggttccatttgcacaaacagcctttaataaacatttcagaatttaataaaacagttaagtaataattaatcaatattaatccaacgctatacaacataccctgttgcataggcccaaccattctgaacaaccatcccggctgcacagttctatctccaaaccaggaatatatcattccaaaccaggagctaatcaaattattaccaattaaagcaccttttattatgatgagaagtgtgagactaatcacgaaagacattgttagacccgcccataaccgcgggcacggctattcgaatagttttactctgatcagaggtgtaccactgtacccacaagacacagccccacatcatgtcaccatgtgcctcaataccaccatggtacctcggaaaggagctgtgacattacctctcgcacaacacaatccactacagcgcacctttcctggatcataatcacccccttataaacaaggcatggactccccagcgacccctgtgggcttatctccgccacttctcagtctggtgctccgcaatgaaccatgctatacaaaagataaagccgttgcccacgctggcttgtggttggcacggttaatgtttcacaactgaaactcgtgaaccggtccttaattgtcatgagcacgactctcaaaaccatgtgctcacaacccaccattatcaggttttagttggcatgtaattaattaaccaatcacgattgaccatcgtgaactatcattaagccatcattaaataatagtgagtcaaaagttatcccaatagtgtgctaatgtttctaagcatggctaagcagtcatatctaatatctagctaaaccaatatatatagcccaactagtcaagttataataacccaaggtatcaaggaataaagtaatcaagaacaaaagggctataacaaacaataggttaattccacccaatgacattcgaaaatagatgcaatagttgaatagaaacaatagctttaaataggatcaacatgctcaaagggttgtttgggatctgtgtgacttgccttgctggccttggaactcttcaaattcttctcctgcaaaaacggactctccggaaacgtcggaatctaaacagaaaagagcaaaaacaccaaaacagcacataaacaagcatgaacagtacatgtggatatttttaacatgtagatctcaattttagaaaaaattagagacttgaaccaactaaatccgagttaagatgaattagttatgaatttttgaagatttaatcggattaaaacacttatattgattttaattgaattatgacgcaataatgaattgtttttgaaaaggaaaaagggatttattgcgtcagcggctagggtttgcggtggaccgggtgcactgcggcggttcactggaacggacggccgagatcgatccatccaaaatggacggccgagatcgaacggtccacgaccggctcacggcaaacggccacgatgacgtcagcggtgacgtcaccaccggcggcggctcgggcggcgcaagctcgccggcgaacgacggcgcgacgacgagaacagagggcaccaggacgtagagcgcgacgcggcgaactcaccggtgaccaaaggagcggcggaagaccaacggacgacgacggcggcgaggaggaaacggcggagaagatcgggtcgatggcggcgacggtgcttcggcggtcttcggcgacggcgaaagggcggacgaggacggcaacgcgacggcgaccacgacggcggtctttccgagcgatggcgacagctggaacagcggcggcgcacggctggagcgacggcggcgacggcggctcgagggcacacggcgctagggcactacggacgacgagaggcgaaggcgaaggtggcgacgggtagagaagagctccggggtccttttaaaggggctaagaggcgacggtgaaggcccacggcggccggcgacgagaaggaaacttcggggttagaaggaaagaggccgatccgaatcgaactcgattccacgaacttccaaaacgaattagccgatgtttccaaaggagaaaaggtagaggagatcccaaagattgtttcccctcaatcaatttcaccggaaacggaaaggaacggccggatttggaagggaacggcgtcggcgcgaaactagggtttcgggcggcggcggccggaggttgacgacgaccctgacaggtgggccccacctgtcagcgggcgaacgcgcgcgcgcacggcgacagactgggccggctaggccgaagagagagagaagggttttgggccgactttcggcccaaagccaaaagagactttttaaaacctttttcaatttaaattatttcttaaatgcaattccatttattaaaaatacttccttagctcaaataaatcccagaaaaatctaggaattataaaattaagcaaagtatttaatgaaattttatctggccccattttatattggaatttattaattaacattagatcttctcttcaaggcttttaaaaatcatttctaaaaattccaattaaacaacaatttatatattttgaatttttagggtgtgacatctttgatcgtaacatgtgggttttctaaaattagaattatcatccactctagaagataagcttgaaatcccatgcccctgtttggcaacgcttcctggtcaccgatactcttataaaaaccgatgcaactggagggaggctagtgtgtgtgtgagtgcgagctaagcaagcacgcatgcagctcatggatcatttaactctctaccttatcctctcctactccaaccatccacacccttgcgcagccctttgccctttctaacctaactcgatgacacttgttttcctcgccggtaacaccatccactcttgactgcgataggaagcaccactactatcgcccgtctcactttcaccatcaccactactaagtgccacctactattggtgggcctattatctggcaatcgctctaagcctagacctctttgggacatccctctccctcccaccatccctacccctaccttgaaaccttaatccacgagggcttagacaataatgacggtatcggagcgctactgcgtgccccgacaaaccgatttgttcgaacccatgcgcgggtaacgaacgctcgcgaattagcattcctacactgtgtaggaccctgttcagtaacctgcctcatctgccgctgatttctccatgtccatcaacgaagaaagcgatgggaaacgcctcccactcgcacgcgctggcacggcaccatgtgattgactacatatgtaggtcaataattaggccacaaccacaacaaccgccacaaaatacaatgcaaaacctggcattcataattcatacaaaaattattaaaacaagatcgatcgatcgatcgatcaagagttgcatcccaaaataaataatccaccgcaaaagctacaggcgccagcctccaggtagcttcgctatagcccatcaaacaagcaagaaagggggagagaagggaaggagaggtcgtcgtcgccgtcgacgacgattcaccggccatgtgctgctgctgcggcggcggcggcgacggcgacggcgacggctgcaagtgccggccgctggggtggctgctgggtctgcctttcgcgctgctcgccgtcctcgtctccatcgtcggcgccatcatctggatcatcgggtatgtactttgtactcctcactcttgtgagaaatcaagttgcaagaagccaagaactcgattcatcttcttgtgagaaatcacaattcacagcgattgattgatggatttcgtgtgtgtaggctgccgatctcgtgcatctgcccgtgctgcctgtgcgtgacgctggtgctggaggcggcggtggagctcatcaaggcgccgctccatgtcatgacctggttcacctccaagataccatgctagctatagcttcttgatttgttctaccatttgatcagatataaacagaatgatcagtaactgatcagtaagtataccgattatttattatttatttatgcatatgtactctggcttggagatatgattaatttgtcattccaatcgagattcattcggtgaaaaaatatactctgtggtgctggttcatctttgatcccctt

SEQ ID NO: 59866 - DNA, 1788 bp, Oryza sativa
tagtgcaccacattcaacacgatgcaatgcaaggattcgatttccatccatcgattaattaccagctattataattataaatatcttaagtgcgggccctgtatgcatgcatccaaaaatcaattagatttggccaggttgttgttggagctggagtactgtttctgggttataaacaagatggacctaggtcaacccggaaattaaaaacaatcgatcgttcactcaatctggttagccatatatattgattaattgatatatacgttgccccaacactatcatacatgagtctgtaaaatccccacagctggataaaacgcatgcacgtacgtccccacccagggacgaaggtacaatcaattaccggggtcagtagaccccgatgattttattttaacctctcgtatcctctttattttaccagctatgaccccggtgaaaacaaatattagaccccggtgacattaatattgattggtgtgtaaaattccaattgacaactagaaacgatactagcaacagccaatagaaaattacctagcatttatgattatacgtgagccgaatatgcatatactttgagtttttgagatttgagaccatgcataaggccaacggctcgtaacttttcaaattccctagaaaaataatttctataggaaattgttttaaaaaccatattaatctattgtctttcaagttttttataagctaataatgcttaattaatcatatggtaatctcactctattttgcgtgctgggagggaagggttcagatcccgtagctaggtctgaacacacccagattgtatcagggttcaccaattcgatttaaaattagattccaaatatagcaatatggcttttttttaccaaaatttgatgtttttttattaatttggtttaattttacaatttcaaatttgaattcttgaaaaactattctaaatttcactcaaaatctacttttgtcccaagttggaacatcgaaattgcgttgttttcaatccgttttggttgaaaacatagaccctggttagtaatgaccccgacaatcatttatcctggattcgcccctgtccacacctatctttgcaaatttaaaatttttcggggaggggctaaaatattgatctgaaatttcggtgattttgaaccaccccttaaaagaaattattttggcttttcacaattaatattgaacctttggctatgaattggtcgatctatgaagaaacaaacaatgatgaatatacatatatacgacgtgggtgcacgcccatgctgctctatcggtttgcagcgaaactgcatgcatcccgggcctgcggaagtgcagagcatgcagagaaaaaggaagaaatcgaatcgatcgagcaacctgcagctgcatagctgcatcatatcgatcgcgcagggacagggacagggcagcggccacactcgcacaacaggcagctaaccctaacatatactgtagtggggtagcacaaacaccatgcgcacaaggatttgttccaatcgtagcaagcactacttgcgcacaaggggcggcgcggtaattaattagggtatgtttggttcttgcctgatattaccccaactcaatttgtcattagggtggcatatgccacgtaaagttgttggccacagatatgataatgtttagcttaaaaaaaataagtgtatgacatgtagacccatcaagtaagaaagtgtgacttgctacaattgaaataaacaaataattaataaattgcggcggccctcctcaccccccacc

SEQ ID NO: 59867 - DNA, 1046 bp, Oryza sativa
cctctttagattctaactttttttctttaaacttttaactttttcgtcatatcaaactttcctacacacataaacttttctacacacgtaaatttttaatttttccatcacatcgttccaattttttaaaacttttaattttaacgtgaaactaaacacagccatagtgcaatgaatcatgctcattaattcggtgggcaagatatcactacagtgcagtgtatcctacgcagacaggtaactgtcacgagtagaacccagagcccagagcccgtcgccccgtcccactcactaaatcatgcacatacctatttaaaaattgaactctttaaatatctaactaataaataatttattataaactaaattttaattgataaaaataatatcatcggttgttatttacattcagttttactcctatatgattattttgtttgtcaaaaatattatactatgtgagaaatttaaactcgaatattaattttaaaataatactaagtttataacaagttacagtacgttttactgaatacctcttatgttccaaaatagacaaatctcgtccgaagaaggagcgaggatacacatcatcaacgtatcatcatcgtcatcctcatacacccccatgcctatatatgccgacgccaccccgttcgtctacctccccacctcacctcctccattcttcacttccttcgattcctctgcttttaatcggcgctctcctctgctttctacctagctagctactagcattctagttgtcgctcactcatggtggttttggcgaagggggagttggagcagatcgccctgccggcggcggtgcagaaggcggcgccgccgctggccgacgtgccggaggtggacctgggctgcggcgcctgcagggcggacgcggcgcgcgcggtggtggcggcgtgcgagggacacgggttcttcaaggcgacgggccacggcgtgccggcggggctcctggcgcgcgtggaggccgcggcggcggcgttcttctcgatggcgcagccggagaaggaggcggcggc

SEQ ID NO: 59868 - DNA, 4761 bp, Oryza sativa
gtctgtcatttgtaccggtcactgccagtgggccccgttgaagcagtggctttttaaaatatttctggaattaaaatcgaccggaaatggtgtgcttatgttgtttttttttggtagcaaattgtgtgcttttcttttcgtttacctgtatatttttttaaaaaaaaccttaaaaaattctgtgaaagaaacgtgtgcaaaaccataggagcggcaggttgatcagcacacggttttataaagtttccaatagctgagtaggaaaaagcgatcaacttttagctaaataattttattttatttttcattatagagaattcttcaatgttaatttctgaagattaattcaagtaatgaaactaccaacctattttttcattcgacaatctttattcatggttgtatatgtggtggtggtcggactctaatttggtaatgacattttagtcatgcaagttttacaatcttatcttatctcatatagtgaaagcaacaaacctttttttacgaggatgtgccacattatcaaaaatatattagtcatcggataaatagttcggataataatagtcattagatcaaaagagtgtatgtattaaaaaaatatattgtcctagccaagtatggatactttgtgaacaaattaacttatatcaaaaccttattaagagctaaagtaaactaataggccatatataaaagttcttaaacagtataaaaagttgtgcagagtgcgactaacggaaaaaaactaagatcaattttgtttagccatgtgatgcatatgcgtaagtaatattcgtggttagatcagatgaggccataaccatgggttacagtgggcagaaaagatgagatacaaatagcacgtgatgaattttgaagcaagagtagagaatctatgaaatttcgctaaactcaccccaccacatggacccttctaccatttttcccatctctctacagatatactagattctgccctagattattgccatctttctctttctttctttctttctttctttctttctttctttctttctttcttttcttctttttttttttgaggttagtttgcctatctgtttctcactattgatgaaactgagcccatgtatgagtagatttcagcttttgaaagcactgatataatgcattttgattctctcatgcaagcatgcatgcccctcatcacatgaccacacatcagcaggttccctctgcttcctgcagcaaccctacgtgtcacctggcatcacttttgcacaatgcttgcttagtcactgttttctgaaaagagcaagttctgatactgaggagacacttactatcaataattattgaaagagaagaaaaatagtgagaaaacctgggttgcttagtcactgttctcaccccattcctcaatttctcttttagatctatttgagaagcttaaagattttaacaagcacttataagtagatagctagcgaaaatttagaaaagcttgttttcttagcttatactatatactcttggaatataaatgagaatctagaccgtttaggggagcgacaatttgagcctcctttttattggaaaaagaacttataaaaacatttttaacataaaagtttgagctggccgaccagtttgcttactcatgttttcagagctcaaaattgtgtcatgtgtggtttgtgcccataaaagagtaattttttagttggtgcacgtgtggttaccgctgtggtaatatggcctacttcaagctggcctcaattaatgccttcccttttcctttgtgatgtcttcgtcgcatcaagtccctttccagaaactctcctgctcagcatgccagcatggcaaataaaattggacccacagtgacatctcatgccactggtttgatttcatcacccccccaattattgtgagcccaaaaaagtgatgcataaagtaatatatcgattttcatagtattatgattttgaaaccatattactattatttttcataaatgttatatttgagtactcccaacgtcaagaaagagtataattttaggagtatataacgttgttcggtaaattgagacaataatatctatatataccatgaagcaactttgatgtttaaatgttaaaaatcattttttttgcccattgtgtgcattgcagcgatatcttaaatgagtacgttgtggcggtgagagcgatgatgtgggaggtgctaaagttaatggcggaagggctaggcctgaaggagaaagatgcgttggttaggctggtctcacacgaggagagtgactccgtgctgagggtgaaccactacccaccacaccctgagttgaagcagcaaggccatggtaggttaaccgggtttggagagcacaccgaccctcagatcatctcggtgctccgatccaacgacacctctggccttgagatctctttgcgtgatggtagctgggcttctgtgcctccggatcgaaagtcgttcttcgttaatgttggagatgtcttacaggtagttactgctccctctgttttaaatacatgatttttagacattaattttgagcattcgtcttatctaaaatttttgtataatatgtttgaaaatataagttatgcttaaagtatatttaatcatggatcaagttaaaaataaatattatataacctttttaataagaggaatggttaaatgtcacgtcgaaaaattaatagcttcatatatattgcggaaattaaattaacacgctgaacttaacaaggcctagcacctattaattagttttttttcactgaaaataagttcactcgtatatcaaacttttccttttccttttcttttttctgaaaatggtttaggctaattagctgtaaggctcaggagacggcgatgttgaatctgacgtgtgatcataaaaacgaaagaagaaaaatcgtgtggatgtcaaagtccatcccaatcagccaaccttttggggaaccaagctgccagtcggtgtgttgtcaaacaggcaaaaccatcagtcattattcagaatcatttcataataaaagtccaatgtaaagcacacggctatatatacagtgatctgaaaacacggtagtacaatgatcaattgatcatggcaaccgtgcaatgcggtcccttagattagattcaatggttaggtccacgctttgccgacttcctctgtagccaggtggtagaattaaattagaggaactgcaaggttttcttcatgccgtgtcgctccgctccagggcaacacgggaggcgacccgaagccgccccgccgccggccttctctccctcgcctcccccacctcgccgccgcctgagcagccgccggcaaagccggacggcggcaaggacggcggcggcggggccttctaccccctccaacaccctgcggttggggccccgacgggaaacaggcggaggggcggcgacgcgtcgaggcggctccggcgacgccgacggccagaggcagcagagccagcgtcgctgttagcggatctggccccctcgcagccagatcgggacgaagtggcgccggccgcgctgcatcaggacgaggcgctggctggggcagtcgtggcgccggcggagaaggccgctggatggggcagtcgcggcgcgggcggaggcgacgtcgctgccggcggggacgaggcagcgagcctgggcgccgctggatctggctctcccaggccggatccaacgcccgcagctgggccacgaaggaggccggctccggggcggcggcggcggcgatgacgacgagacggcggaggcggcgctgacggcgggagaggcatgggcctggctacgcacagcgcctccggctatggctccccctatttcgacaccggctcccccagtccggatttggcctctctggcgagggaggccggatcccctccggtggctcctcagctgtggacgacgcgacaagggcagcggtcagagggcagcaggaggcgtgggtgtccgcggcaggagggcgagtgctgcggctggtctggcgatctgccagagctgtgggtgatggcctaggactgattgctaaagggacgatgcagccgaccggcgacgatcattcttgcgcgaattgggtgtgtgggtttggacgggaaatcgctggcgaaagcctcgccgtgccattggccggctgacgacggcggcgcctttggcgtcgttcccctccttggaggcgtcgttctggcgttgatccctctcctttccctaccgttctccgagtgaaaacctggctccggcttccggacgagcggtgacggagatccacgtcgtgtcctccttggaggcaccgctttggagaaacattttcgtgcaaggatgtagttaatggtctatgcattggcttcgaagcttttcagtacttggttttgatgaggccttcgctgtctagtcccactttttgttttgcggcgggcaatcttcgctccttgcttgtgtttgctaggtgaagtcggagctgcttcgtagggtgacgaagctgggcaacgatgacacgttgcattctctttctaggggttttgtttgttggccgtgaataggatgtggcgtttagacggctttggctgaagttcttcgtgggaagttgaagccacttgaccattgacagcgagttaggtatggatgatgcaaccgatttgaagtcggagctgctgtgtcgctaggcggcaagctcggcaacaatgacacggttgcaaggtcggaacccctttgccgtcttgg

SEQ ID NO: 59869 - DNA, 649 bp, Oryza sativa
gaaaggggtgaaaaaatcgaatatctcaatcgatcagttggtgagtagggccgggcgccgttgctgacttgccgtgatacagaaatattcctgctttacttttttccgaagggaaagaaagccaagaatcaaatggccaaatgaaccagcttgctataacaccctatatctcgtttgaagcctataattgttatggtgttggcccatatatataatgcagttgtcatgcaatggtggtgatttagtacaacattggaaatttaagaggatgatcagggtctctgcttataaatcaaaggatgattatatgataatctaaagcgttaagtcaccattcaaaaatgattatatgaccactactagaaaaacgatttttcatggcgttggtctatgattttcgctggcagaaaaatgccaaaaccacaagcaaggtcgtaatgagggaggtggggggcaccgaccgccagcgaaaatagatcttcgctggcagccacgttataccagccgccagcaaagatatgttcattttcactggcggtcacttaggtgcgccaccaactaaaatagatcatttttgctggcgcttgggttatatagtcccgtagggaagatacaattatttttggtgacggcccacttaagtaaccgc

SEQ ID NO: 59870 - DNA, 4233 bp, Oryza sativa
ggtgtaccgctagtggcaatgccatattgggctgaccaaccaaccatatcaaagtatatggagagcttgtggggcatgggtgtcagagtgtggcaggaaaagagtggcggcatacaaagggaagaagttgagaggtgcattcgggaggtgatggatggggataggaaggaggactataggaggagtgctgcaaggttttttttttttgagataatgcagcttctcatagattaattaagatcagacagcagtacctcccgaagagtctccgggattacagtacggtaggtattacaaactgtttgctcagaacattgagctaaaaggtgagccgcagcattagttacacgattaacatgaatgaaagagcagtccaaaaaaccagccgccaggaagtttatgtcagagacaagagcgccaaccattgaccggtcgcgtgttccagactgaatcttttggatgatagctaggcagtctaaagccaaaacaattttctggtgaccctcctccatcgccgtgcgcaacgcacagcgaatagccaaagcttctgccatttcaggttggatacaccccgagtgtcgctcattagcagcgaacaagcacagcccgctgtgatccagaaatagaaaccccaacccaaacgaattgactgactggaagacagcagcatctgtattaataagaatcgtaccttcaggcggaggcctccatctgggcactggccgaagagcatcacccctaaccgcttgcacagcacggcaacagtgttgttcaatcatctcgacataagccaagattttctggatgacctgtcttggatttgctaaggtaggattattcctggaatgatttctagcctcccatatatgctacaacgtgatagccagtgccgtcttttggatgcctgaacttctccccaggaaatcaaaaacccactgcttcatatttgacagctcagtcatgcatagcttcaaatcaaaatgttgcttagtgccatcccaaacacatacagcaaaagggcaaaggagaaagatgtgttcgattctgtcatccctttcgcaaaagcaacagccatcagtagcagggatatgccgccttctcagctggaaacctgaaggcaagcagtcatgcacaattttccaaagattgattaacattttccctggggcattgattctccaaagttccttccatctgtttgcactctcttgtaaacccgacgacattcccctgccattttcactttgcgcagccataaagatttctgatcttgcaaggttgtaagctgaacgcaccgagaaaacccctcttttgtcgtgtggctaggaaatgaaatcctctcctccatgtgcactaacaggaatttgtaggatctgttgggcagtagtttcgtcaaagaaagagaacaccttatcctcatcccactccccaatcgcatcattgactaagaagtccaccgtgacatcctcaggcaaagggaggagaggtctcaccatcgaaggtttgattcctggtatccaatgatccttgaggatttttaccgaagagccattcccaatgccccacctcacacctttcctaagcaaatcccttccaaagagaatactgggccaggtgaaggaagtggcagtgggtttgggagcattccagagatcagagttcgggaagtaccttcctttgagaaccctagcacagagcgaaacaagatcagtcacgattctccaaccctgtctagcaagcatagcttggttgaaaaggcccaggtctctgaaacccatcccccccagagatttcggcgtcgtcatccactcccaggaacgccaatgcattttcttcttcccgtcctcgaagccccaccaatggtcaaggatgcaggatttcattttctcacaagttgacacaggcagcttgaagcagctcataacataggtgggaatcgcctgcgcaacagctttgagcatcgtctccttcctggccctggacatcggcctatcgttccaaccattcactcttctccacactctttccgggaggaaatgaaaagagccagtggacgctcttccaatttcagttggcatgcctagatacgtgtcttggaggatctcaaccgaaacttggagtgtctccttcaccgagttctttatatcctcaagacagttctggccaaagaagatggaagatttctgaagattaattttctgtcctgaggccttgcagtatgcttggagtgcatctttcagtccttgaacactgtgcagatcgctcctagcaaagaagatgctgtcgtctgcaaagagcaggtgtgagattggtgggccaagacgaccgttcctaatgccctgaatcacccccattgattccttcttttgaaggatgctggatagcccttcagtgcagagcagaaagagataagggctgattggatccccttgtctcaaacccctcgacggagtaaccgggttcgttagctctccattgatcctaactgcataccttacagaggtgacacatcgcatgacagtttgaatccaaggatcagcgaagcccagcttcaaaagacatccatgcaggaaagaccactcaacacgatcataggctttcatcatatccacttttagagcaaagaaaggcttcttgcagtgttgcttcttaatggagtgaaggcactcatatgccactagggcgctatctattatcagtcgtcccagtacaaaagcactctggaactcagaaacccgagtgctgcaaggttgatgaagaaagctaaagaggcaatgcaggaaggaggaaggtctgacaagaatattgctgaatttgctgcgaagtattcgaaatgacaaaaatccagtgagaatggctattagcctagagatgttctagcttatgaataatttttttcctagaaaagttcatggaggtcgaggagctgatgttttccataattcagcagaagtaaattaagtttacggactgtgtaaaatggtactttatattacttacaatttttatttcataatgaaggtcatgtctagcataactccagaccccaaatcccttctgaatttgaagtttctatatcaaattatactgttttaaaatttcttatttcatctaaaataggaacaaatgattaatctaaatattatttacgtaatcaccgatccatagatttgcaggtacgaccatatttaagaaatctcgtatctagagctacgccaaacttgacctgaagtgtaattagcttatgtcttcgtcgaggacaacaagctagcatagacatatcgggataaaaaaaataattctttaaggtttccatactttgggagcacatggggttatgtctttctaaattacagaatacatgtgcattttattttcctccaccggacaaactgttatttatgttctccacttaatccatcctttctattagaactcgccattacaaaaatatctctctcctactaattactacctccatattttaatgtatgacgccgttgactttttatccaacgtttgaccattcgtcttattcaaagaatttatgcaattgtcatttattttattgtgactagattcatcatcaaatgttctttaagcatgatataaatattgtcatatttgcacgaaaattttgaataaaactaatggtcaaacgttagtcgaaaagtcaacggcgttatacattaaaatacggagggagtacaagtttccatactatacaaagctaaaaaatagcacaaggaaaaactcatgtaaataatatggttaaaaatgttgagacttcaatcttgcgtaactaccctatcgcacagaaccatcaaccggagcctcattgtcattgccggattatttaatgttgtttctggaaattatatcattctcagttttattaatgatactattcaggccggtttattaatgaattcattgtgatataaaaatactcctatttgttcatgataaaaaatagacagtggtgcttgttttcttaattaaccgatggtaaaaacagtcaaggcaggtcacaacgcgtgcatacataagtctaagcttggctcttgcgcagaagctatatatctctacatttcctctcacacgttgacacaacaatcctttcgctctccacagccattgatgtgaccgtttgcccaccgatatgcctccccctcctcacctccccaattctaccgcgtgcatgttattctgctctttcaaacatcgctgcat

SEQ ID NO: 59871 - DNA, 6097 bp, Oryza sativa
cgctgcgagcttgaggcacgagaccttgctacctcacaagttagattatctcatattctctttttttcttattgttgtgttttctctttgcacagtttttcgtctgctgcttttcttagcttgattgctataaacaaattgtggcaatgtggatttttgaaagcgtatgatttgttgaatgttgaattataacattagtatttatgtacttttgtttccaaagctagtatcactactacagaaaagggaattagtgccggttgggaaacccccttcggtgccggttttctcaaccggcacaagggaggcggcactgatttgaaataaaaaggtgccggttcattagaaccttttaggttcgacgaataaaaaaaagccggctcgatgcgttagctcgatcgagccaacgcatcgagccgagcagtccctcgtcccacatccagaagaatagaaagaacaagaaaattttttttggcaacattcatcccacaacatgcaaagatggaatcatccacatatcaaattttggcaacattcatcccacgacacaaattttggcactcaaatcaaatttatgcaataaaaaaaatcacacctcttcagtcgtcaccgtcgcacggtcagccgttgcgccacctcccatcgcgccgtctcccttcggcgagcccgccgcttgccgccaccaacctccccgcgagcccgccacccctaccgccgcctcccctcccgctagatctagtggaggggagggctcctccccgccggcgagccctccgccacctccccttcttgagccaccccacccgccgccaacgccagatccggccacccccgcctgtcgctgacgcctcccctcctgccggatctggcggaggggagggcgcagttgccgctaccgcctccgctggctgcgggagagaagggaggggagagagagagagaagagagcgagagagaagggagggagagaagagataaatattattcaagtggtgaataatcaatatttctctttttaatttttactcaaataagtgggctcgtcacggattggaggtgattgccaacggtgtgcccctttggcaatgcacaatgggctgatcaaccaaccattgcatactatatggagaccttgtggggcataggtgcgcggaggtgcaatgggacaagaatggtgccttatggagggaagaggtgcatcagcgaggtgacgatggatggggatcggaaagagaaatacaggcgaaatgctgggagcttgttgaataaagctaagaaagcaatgcaggagttcaggagggagctctagtaaaaatattactgaattcgctgcaaaatatttgaaatgaatagaattctttgaatgcattcttaattaatgagaatatccagtccagatgttatggaaattacaatttttttttcacttgaaaattatatagggagagcaaactgctagattactcaggattcagcagacataaattaactttacatagcaggtctaaaatgagttctttttcttataactggtatatatcataatagggataagacattttacgaagaattttccaccttttaagttatttacatagaacgataattaatattataaaaaaacggtgacatgtttccaaaatgttagctttgtaataccatgcatcagtagtaattttaatggtacataagtacaccaagacattatctaacaaaatacaccaagaagcataaaaatataaattattataattataaattataacactacaacagaaaccttaataggaaacggctcatagtcataggtgccaaactgccaattcatttaaaaccggcatctattgaccattttccactttcatgggataaaaaaaaattaaaaaccggcatctttaagaacatacaggtgccgattctagaaaaaaatcgatacctatactgatattatatgtgcatgttctttaaaagaccgcctataattaaaaaaaccggccaaccgagccgactggcgttatcctctgccgcctcctccttctccccgctactgcccttcttcctcctcctcctcatcgtactgccacccctccttcctcttcctcctcctcctccttagccaccaccaccactcctccttcctcctcttcttctccatccaaccaacgccactgtcaacacagggactgatccaccgccacgaccacggggttggcccggtcgtcgatgtgatggtgtcattctttgtctgtttgtgatgatggtgatctcagtgatgattgtgattgtgtttgatgtgaatgatggtgatctcagtgatgacggagagttggtcgaggcatcaagccagttttttttcattcctaggacctcaaaggtgttgctttgctgggtgccgttcgaaaatatggcacctatggtcatctcccaaccagcacaaatttccttttctatactccctccgtttcatattataagacattctagtattgcccacattcatatagatattaatgaatatgtacatatatgtctagatttataatatgaaacagagaaagtagtagtgtatgtgattactagtgatttcaacaatttgaattataaattatgacagtacatgttatttgttctacttataaccttaccagccatcttaattaattgtagcaaaggctcacttgctcatggacaatatatacttgacctattttatcagatccaacacatgttatccatgcatctcgtagataagtgcattataaattatatcttttgaacaaacaaagtatgaaccacagcaacacattattcatcaatccctatacatcatccacatcacacttgagctttccctatgcagtagggtaggaaggctccatggcgaggccacacatgccccttttgtcagaaatgtccttctccatcctcaagaaaccattctcaccccaagtcgtgccccaggagttcttcagcaaccaatacttggtaccatcactagccttgccatagccaatggccacaataccatggtccaagtcagtgccacatgagccggtcatcacaccacctttgtagaactggaatgtcatgtcgcctccatcgacagccacagacacaggttggttagccaccgccttcataagggcagcctcattgttggctggcacatcctcatagcccttgatcgatgcgacgctgttggatacactcttgcacttgtcgtctgctgctgcgtatgggtagttagactcggtggtgaggccgccattcttgatgatgaatttgaaggcgtcatccatgagcccaccttcgcagccctggtcctcaccatggacatcacatcaacaagctcttgttcagagagtgagataagtttgcccgtgctcagcttgacaataccttccatggctgccacggccgaaaacgcccaacaacaacctgcaataatcattcatgttcaatgcattggacacaatagatgtcatcacaaaacgctatcataaaagatactgaagaatgtcatctgagtagcctgaattttcttaccacattggccttgatccttgatgggagtgaccgcgcccttggttctccagtccacggtcgccggcagcgcatcaatgttaacattctcatacctgaatccagtaggaaccctagtcgtgctaggaatgaatcccttgttggtcttcatccacctgaactcgtcattggtgaggtcggcgaactggttcacaccaagccagaaattgtggttaccagcattgaacgactcgatgaaggcgacattggccttgaacacctcgaaccggcgggccttctcggcatcgtccctgtacacgcgcccgtactgcgccatccacctctcgtgcctcgccgccatggccgcgtcatcgctcagctcacgagctgctagaacagcgctgcagaggcagaggcagccgaggatggcgaagagcagagccttggccatggccatggtcgatcaggctttgtgacctgtgatccagctgctgttggttgctgctctgctgctgcttctgtgaactctgcttttggtttggtgaattggaactaggatgcattggtatatatagtcagtggtacgaacttatgtaagcacatacggtgcgtgtacgatgttgtgtttctgtgtaaacggcagtctgcgtagccgtgaagtatatacgcgtataaataaattattgtgcataggacgtacgtttcctgcagaacacagacgcctacattttaaattatgctgtgggggtttgttgaatgggaatatgaatacaaaattggaatttgagtgctccaaatttgccttggtgaatgtgtggctaaatgagacgtggttcacacggaatgaatgtgtttatcataggtaatggaggattagagtgatgtgtttatcctatggagagttttgcacattggggcaatcgaatttaggataacataactgaaaatagttgtattgcatataatagatagaacatggagtacaatatattttgagtactcgtatttacggctaattatttttttcaattctaggcgacgtacttattaacaacgaggtgctagagataactttatcactctcaagatatacaagttcagtcttttcgaggtgctaataaaggttgggtgtatatgtgcgtttatatgggtgtatgtgtattgtgagtatctacgtttgtaatgttgtttctcaaattaaaaaaaatgtatttttggagtttttttacagagagaaaatacagtattttggttgctcttaatcgaaattaaccagattaacgttactcccaaccaaattactagagtacttttaactctacatgagtccaccaaatcgatgtaatcaaagagaatttctccttgccgtaataaaattaatgtagattttgttctctcgctgttggatatttgggccagcagcaggtggagggcatagagagcacatctgtcagtctctggtctatctatactaatataaaaagtataagttgtgtctagcaatcctacaggtgaaatcacctcctcccatctcatccgtccatctaccatctcatctcatctaattcgtttcgctatcctcctcgctccaccgattccaacgattatagcgaccttatcctctccaccgtccacgcgcgattactccgcatgcgccatctctgccgcgcacctcgcctccgccgcattcaatccgtcgcgcatcatcgccacaacgacaaatcctcatatccgacgctctctcccaagcgtcgtcgctgctacctccactccgcctcggtcctcctcgcctcctcgctcctccctgcgtggcgccgctccgccgtcgtccccttgcttcgctccccctctcctcctcctcgcctcctcactcctcctcgcgtggcgcacgccgccgtcgtccccttccgccgccgcccagacgccgccgtcgtacccttccaccgctgcccggacgccgccgcccatacgttgccatcgtccccttccacagccggagccgcggtcttccccatcggccacacaaatcgcgccatggcaactcacaaaattccccacgcgtggaccaccaaggctccatcgcgctaatcccgcggtggctcccctaatcatgataacgccgtcgccgcgcctttgaacgctgctgcaccatccgtcatcatccgcacttccgccgccgtcgtcaccgcaatcagtatcctggtggtccagggtttccaccagtgccgctaccccgtctcgccctggttgtgcatactcccaccagcgtcgcagctccgtcgtcgccctgcaatcggtgcctcagtggtccagggctccgctggcgatgccaccccgtcgagccacggtggtcaagccttccgccgacactgagcctccatctttgtcgctgctctgtgagtcctctagtgttgccgccattggaaggggatagactcagcagctaggcctcccagccgtgtgcctccctctcttatgttggtgatacctgattcaactcaaatcgactcttttcaatccccatttttcctctttgtgaattttccccattagttctctagctgaattttcttat

SEQ ID NO: 59872 - DNA, 2535 bp, Oryza sativa
aggtgactatgattggcaaatttcctcatgacattagagactaatattgcacgatgataatagtaataaatatcatgctatgatgatatcaaatgaagaaaatattagttgatcggttgatgcgctgtctttgttgttttgtggaataaatttcctgcagattgtcatgcaatcagacatgctcattcttgaatattgaagctacttagtttctatttccgtttgtcgtgctccagatttatgaataaaatatgccgaatgccgtattgttactcgtgatttggaagaaattatctgattctgtttatgaagccatctttgtccaaacatctttttttctgtcgcgggaacagtgaaactagccttagagcataagcaatgggtgtcttggagccgttcccctagctcacggcgtcgccgtaccgtttgcttttcggcctgagccgtccccccgcgtaggcgcgcgtttgctcgcggggggatgcgttcctcagtcgcttttggctgagccacggcgccaggctacgcgttggacgcgcggtggctagacgtgtgtctcgtggacacagctccgcaccacaaatttcctcttccaccctcaacagcgacgacgacaaccctgcgacggagacgaccccgcgacgacggcgaccatggccgacagcggcggatctcgctccgccgcgtcctcctcgctccgcgcgccgtcgatgccgccaccgctgttgtgtttgccgtcgtcgcccttgccgtgcgttgtggaggtcgcgatgacctcgagcactccagatctggcctcgagctcgactgggcggcgtcctcgatgcggccaccgccggcgctgccaccttctcctcctcgatgcggcatgggaggagggacgccaccgtgcgccactcgggggcgcagccgtcctcagcgtcggtgtgggagacggcgacggcccggagctcctactcccccgcggtggccgcgttgacgacgaggaactcgaggttgacgccagcggaggagacgggaagaggagaggaagagacggcggcttgaggcggtggccggggatgacgaggaggaggaggagcagctctgctcgacggcatggaggctgggcgtgccgtgcgcgtcctccccggatgtagcggcatggcgaggaggaggagcagctctgctcgggcatgaacggcattgtttatctcaaggtgaaaagagagagagcgagcaagctagctctatttctctgtgtgtgtgagagagagagctactagactagtacgatgaataaattccccctgtactagtttgtgtgagctactagtggttcttttgagaagagttattggttttggtttctagggccaaaccaaagaataaatgcccccaaactaaaagctacacaaacacaatgaaaatatggagcctcttgaataaaacttcatgtcaacgagggcgtcggtggtgggctagggagggaatttgtcacctgggactacttgagaccgggatacccattgtgaactggagtatcctcaccgagtagctttggattttgaagaacccacctacctgtggcctctattgcgagatgagttttcctagaagtgccctcgcttagtgagggcactctaggagtggcttacattgctgatgcccttacatttcttacatgctttcaaatcatgaccgaccatcatgtattctgtcggtgcttctaaattatttaatttgtctccatggaaaattgtaaacttctctttgacttcgaaatgaactgcctttggaggtatttctatttccagtttttagtgccacccagggcttcccaggctaccatgcttttgcattaccacctaaggtggtccaagactcccaacacgcagcaagctggatccaggtgatgcaggatgggcgaccaacaatgtggctgggctgattatgcctacatttcgtgctgcaagatttttgttgtgctttttttccctcatactagtaatttactacttcctccatttcacaataagtcattctatcatttttcatattcatattgatgctaatgaatctagataaatatatgtctagataaatatatatgtctagattcattagcatcaatatgaatgtgaaaaatgctagaattacttacattattcaactttggctacgcgttcttcgtctcagcgggcccacaggtgggacccacaccgccgctagatgagagaggggagaggggagagggacgaggcagccgagcggcaggggaggatggcgctgaccgacgccgacgcctgccgacgcgcagccactcctcgccggatcctgccgcctaccaaggtcgcgccgatttccttgagcgcgcgaaggctgaaggaggaagggggcggcgcggaggccggacgccgcttgccgcttgggaggatgccgtgccgaccgagctcccgcgccgccgccggctctccgtgccctcgatgctcatcgtcggctgggagatgaggggccccggagagggacgggaaggggagcgccggcgtggatttg

SEQ ID NO: 59873 - DNA, 13942 bp, Oryza sativa
cataacataaagtttgctccgccttgaaatccgctcggcttcatctttgtcttgagggagttcttgagaagtcaaaaatcgtatgaggggttctcgccagtcggtttcaaccacagcgacgtcatgagtgcccgcaacttgagtggtatctttgtgaggtactgtcggcgtataaaggtgttcaacgaaaacatcagagggcgccacctcgcgcttggatccaaagttggcaagtctatcggcggcttcattattatgtcgaagaacatgactgagctcgagtccatcgaacttatcttccaatttgcgtacctcttgtcgatatgccatcatgttgtcgtcaaggcaggaccactctttcatgacttggttgacaaccagctgtgaatcacctcgaactattagacgctttatccctagggaaattgcaatccgcagtccatgaaggagggcctcatactcggcgacgttgtgggacgccgaaaaatgtatccaaagcacatagcttaatctttctccagttggggaaatcaaaaccactcctgctccagtgcccgaaagtcgttttgatccgtcaaaatgcatggtccagtgctccatgttctccgcgggggtatcctcctggcactcggtccattcggcgacaaaatcagctaacgcttgggacttgattgaaattcggggcttgaatgatatgtccaaagacatcaactccaaagcccacttagcaatacgtccgtttgcttcgcggttgtgcagtatatcaccgagtggaaatgatgtgaccaccgttaccgagtgaccttaaaagtagtgagatagcttcctggcagtaattaggataccatataacagcttctgaacctgagggtacctcgttttggagtcggctaggacctcgctgacaaaataaatcggtcgctggactttctggacatggccttcttcctcgcgctcgacggccaagactgtgctcacaacctgggaggtggctgatacgtacagcaacaacggctcctgcgggtgtggtgaggctaagactggtggctcggtgagaagtttcttgaaatcttcgaaggccttctgtgcttcgggtccccactggaagttatctgttttcttcagcagcttaaagaagggcatcccccgctcgccaagtcgcgaaacaaatcggctgagcgccgccatgcatccagtcagcttctgaacatctttctgggtacttggcggtttcatgttgaggatagcagtaactttctccgggttggcttggatgcccctatgagacaccataaagccaagcagcttccctgacggtactccgaaggtgcatttttcagggttcaatttcatcctgaaagcacggatgctcacgaaggtttcttctagatccgagatcaaatcatccttttgcttggtcttgacgactacatcatccacataggcttcaacgttgcggccgatctgcgttgagaagcatctttggatcatacgttgataagttgctcctgcgttttttagtccgaacggcatggtgacgtagcagtatgccccaaaaggcgtgatgaatgaagtcttcaaacagtcggattccttcagtcggatctgatgataccccgagtagcaatccaaaaaactgagaagctcacagccggcggtcgagtcgactacctggtcaatgcgaggcaacccaaaaggatctttagggcaggatttgttgaggtcagtataatcaacacacatgcgccattgccctgttttcttccgaactagaactgggtttgccagccagtcgggatgaaggacttctttgatgaagcctgctgctaacagcttggtcaattcctccttgatcgcgtctttcctgtcttgtgcaaatcggcggagtcgttgtttgataggcttggcgtcttctttgacatgtaaggagtgctcaatcacctctctaggaataccgggcatatcagatggtttccacgcaaagatatctttattgttctgaagaaaggtgatgagcgcgctttcctatttacaatctaactcagcgcctattacagcagttttagtaggatcagagggatctaggggaatcttcttagtcttggcttcgctttctccactttttgaagtcttggtaactggtatttctccttcgctcgccgtggctgcagccagtcggatatcctctcgggcagacgccatctcgtgagtgtgagccatgtcgcaactctccttgtcgcatgtgacggcttgcttgatgtcactccgtagggataggactcctcggggaccaggcatcttcatcatcatgtaagtgtagtgcgggacggccatgaacttggctaacgccgggcgtccgagtatggcatggtatgctgtctcgaaatcggcgacttcgaagctgatattctctgtgcgaaagttttcccgagtaccaaaagtgaccgggagggtgatctggccgagtggagttgcggataatcctggaatcactccgtgaaaaggcgcattgcttggttttaactcggagcgagggatctgcatatcatccagggtcttggcgaagaggatattgagtgcactgccaccatcaatgagggttctgcgaagcttgacattacggaccactgggtctagtaccagggggtaccgccccgggtggaccactcggtcaggatgatccgagcggtcaaacttgattgcaatctctgaccatcgaagatactggggcgtgtcgggctgaacagcattgatctcccgttcagtcaacttctgcttccgtttagactcataagccagggggccgccgaagatatggttgagctccttgcggtgatcttgaaatcctgccggggcgtcgccatcgtccttcttccttgacgtgctttgttcttcgtcagagttcttccgtgcagtcttggtgtattgatccgcgaattgcttgtagacgaaacaatctttggccacgtggttggagttaggatggtgcgggcattgggagttcatgatcttgtcgaacgtgttgacgcgcgaacgctgtcgagaagagtgactggcggttgcaacaagttccgcaggcttacgcttgcggtccttatgattgttacttccacctcctcccgtagccggcgtacccttgttttgcttccaactgggacccgactgctttgatgcggtgacggcgtcttcagctttggcgtactcgttggctttttcaaacatgagcttgactgtcctgggaggcttacgcccaaacttgccaactagttcttcgtggcgaatccctttggtgaacgcggcgatgataacgtcgtcggtgatgtcggagatcttgttacgttgttcagaaaatcgccggatgtaatctcgaagggattctccggacttctgaatgacgttgtagagatcatattgtgtgccgggacgctcgaaggtgccttggaagttggcgatgaagtggtcgcgtagttcggcccaagatccaattgtaccacggggcaatccatggagccaagatcgggcggaatccgctaaagccactggtaaatagttcgccatggccttgttgtcacctcctgctgcgcggattgcgagaccgtagacggtaagccacgatccagggttagtggtgccgtcatacttctctattccagtcggtttgaagccggctggccaatccactcgacgcagatcgtcggtgaaggctgctacttcgtcaaggtcgtcgtcgtggcggttcggcgaatgatgatagcctcgagctgctcggcgctgtatgattgtgtcgcgaagatcgacggggcggcgacgaggtggtgagcgaggccgttccactcggcgctccttatgaaggtcgggaggtgagtgaacagaccgctcgtcgtgtcccctgctcctgcggttggatcctgcgccggtgatgctgaggcttggatgacggtagtcatgagatcggaagtgggggactcggctgccagtcggcgtgtggacgctttcggagttaactgggaccgaagccgcaatcatggtcttcgtctggttcaagatgttgacgacgtggtcggattgattgagctcgttttggttgaggagggtgtcgagaagggtgatcgcggcaacggcattctgttgaggggtgcggaaaaccggtgtcccttcgacatcctgttggccgatgagatcacgcgctcggcgcccagcttccaaagctcgctgacgtcgatcctcagcctccttcgcggtccgctcacggtcctgctgctcacgccgtagccgttcttgttcttgtggttgatgctcttcctccagtcggtgacgttcttcggtctcccgggcttggcgttgctcctccgtctcattattggccatgaaaacgccaaagtagagaggggtgtagttgtcatctaggcttccgtcgaagtcgtcgaagtcgtcgaagtcgttgtagcgagaactaaattcgtcgtactccacgatgtcagtaggacgtgagtcgacggtgggagagctgttgtagtcatccagctgatccgtcgaaaccgtgccgagtggttggaggatgacgccgacttccctgaagctaggcgaaatcggcgttgaagccgacttccgcctaggcctacgggatgaagacgctgtcgtggtgaagacggccgctaaatcgtcggggagcttcatcaggactggtgggtaagccccatcatcttgatctggtgtcgttgaagaagatgcgatctcggccgagtggtttgaagccgactcggttaagatggtcttgaagtagctttcagccgcgttcgggaatccaaacgggaccgaaatccggttctctcccgaccggtctgattccgagtcgaggagagaaatcttgccgaagttgttggtgatgaagtcgaggctgtcgaaccgaaacgtctgcccgggagggaaaacgaggtcgtcgatgccggagatggaacccattgcactgatcggcgaaaagcttgacgctacccctacccggcgcgccaactgtcgaaactagatttcggcaataatgaaagggggtggctatcaagctaggaaagtgtatgggtttgaagacaaaggatttatacaggttcaggccttcttataaaagaagtaataccctactcctgtccggggatgaatccgccgagtgtattattgattgtatgatttggagaaaatccaacctctgccactagaggcacccggaccccccttatatatggggaagagtccgttttacaaaagataatctatatccctaacggaatatgcaaatacagatgaaatatagtcgtaaccgactaagtctcagggtgtttccttgatacacaagttaagaaacaaacccgagatacaaataagatattctatctacattaggtatcctgtacctagtccaaataccgtcgccgtatagatatgggatatccataatctccacacacctcctcgtcagtcccccgccgtgagcgtcgcgactcgaaaccctaccgtctttcgcgatctcgcggcagcgacacgcatctgactaccgcgccgacgccgccggtggcgatgggcgaggatcgcggcgacgactacctgggcacgctgccggactacctcctccacaaggtcatgtcgttcctcccggcgcggcaggccgtgcagacgtgcgtgctgtcgcggcggtggcgcgacctgtggcgctccatgccgtgcatcgacatcgacggcgacgagttcggcggcggcatggccaaggtcaggtgggagaagctgatggacttcgccaacaatctactcgagttcggcgacgtgcacgtgatcgacttcaaccccccgtttcttgagaggtttcgtcttcatctcgcccactcttggaccgcaccatacatacgcgcatggaagggctctcggctgatcgagtgttgcatcctcggcggattccggcaccgacccgccgccgccgagatcgccgtcggcgtcggcgtgccgttgttcaggctgccctggctaccatctgtgtctacttcccgactaaaaagattgcatctctctggcctagttttggacggttgcttcgatgagtgcatctgttcatcctgcccaatcttggaagccatggagctcaaatcttgctcatgcgaattcaacaagatcgaatctgccacgctgaagagtttggccatccatggatgcagaagttgcctcctggagtgtactacattggctatcaagacgccaaggctcacctcccttctcctgagaattacagtttattatgaacttagagtacgcttggtcgatccaatggattccttgatcgaagcatcgatccgtgagaagtcctacgagccgattaactttgacaacgatctatgcttgtcacttggtgccctagccagcgtcagaaatctcaagttatcgtggtctcgatcaatggtatttatattatcctcttattatagtccttgaatatatatcctcgtgcttgaatatatatcctcttggtgcattcgtttattcatgcaaaagtatgtcatttgtttaatccatgtaagaaacgacctctagggcttaaaatccattcaagtaataatgagtaaattgtattggtggtagacaaacttgttaggtgggtgcaaattagtacataaacttataaaacactcgttttagtacatgaacttgtctacttcgtgtgaacaaggaccaaaataacttgtcaatgttaattttacgaagttgacgttgattagaatgtgacgtgcatacgtgtagtaagcatgcataagacatgtaatatttataaatttggtctctactttatccttcattatggaaatgatgaatttcatatatttctaacctttatatcattgctcgctttttaaaatttttctactatcactatatcctattctatttttttattaaagaggtgtatatctaatagcaaccttcttagatatatatttacacagtatcctaatcagccaataaatcaataagattagctatgtagtaattttgccttcctccgcacgcaccagataagttaatacaccaaaacgagcattttatatgttcgtgcactagattgcacccacctgacaagtttgtgtataggcgatgcaattatatttactcaataataatctacttctacttgttatattaaactctggaccgaaatatgcacccatatttttctacattcgacgacagttttttagaaaccgttggagatccatgtgtcattgtattaagaaggataagagaaacagctctatattctcagccattcgcacagagaaaccaagcaggaaaaaaaagaaaagaaaaacgtttaaccgaataacttattttcgaataacttatttttctccactgcccaaccaccctgcagattatatatctatatatcctatacagttggaaccaaacactgaacatgcattaagccacatcactatacaaatcttgaccattggatcatccgttagagggcaagtatcataggtgatgtgaaactaaaaagttaaatgacatttaattctgttatgaacaaaacactaaatatgcactaaaccacatcgctttagaaatctagatcattggatcatccgatccgttagagggtttaggatcctaggtcatatgaaactaaagagcaatacatttaattttattatattcacatgtatttcatcatttcaattacgatacatccatttagcttttaccttttacgaaaagactatattgatcttcccagatatgaagtgttcatcaattcgtttattttgtttccttctttttccttagcttgcacatttgttaaaatccatttatcattacatagtcattccgcagaaacacacggggggtattatctcatatctaacaatgtatgccaccttcaccagttaaccaaccttacaaaactcttaatttatatttggtgtacttttgtacactattattataaatttcatccacatataattttataaatttgtatatgtcaacaaaattaatgtaagatgtttatatgtaggagatcttgtctaaattcgtagtattatgatgtgtcacatctgatcaatctcttgtattttgagatggatagaggatatgatattgccatatttacttatttttgctccaatttgcttcaggattcacaccatggagaatttccaaattttccaacgtttcaaaagctaactaccctgcacctatataaatgtaatatgtgcctaaatttgaatatactgttgagttttctccagaaagctcctagcttggagagagttatattgcagaactgcaaggtatactacttgtatctttttcctattttccttcacttgttacactgccgtgttaatctgtcttctaattatactgatctctgtgatgcctgaatagtttccagtagctcccagaaagaggaaaagatcaacaaaggtggatagacacaagattcctcccgagtgcaaaggtctgataacttcggaatctcgcgccttgaaacgtatcgagatcacttatcaagatgatgatttctgcaatcttattaaacttttctcgtgcaattggagaaaactagaggaatatactatcacactgaccaaggtttgagtcgttttcattccatatatgtttttctagcaactttaaatttagagcatatatagcttaagtcttaagagctagtagtaccaaatattttaatttaattagttcattgtctccggtagacatccgcttgtttgctagtactgtctaattagaacttaaaatagttggagtgtagtaccttattatcttcacgattgctctcagcctctcagttatttcttcgagtcttctcacttatatactattgcgttttttttctcatgtatcgccaattcgccatgcattcggtttggacactatttggttaattggttttgccaaaaacaaatatatatgctacatagaatgcctctaacacaattgcatgcgcggctgttccaaacacccttttcattttcatcaaattcggcacaagcatcggtggtgatgtgtctgaaatatatgcacatcacgtgtagaattaatctagtatttcataaatatatcatgacatgaaacatgtaaactagcaaaaccactgctgttgatctagaaatgtatgctagacagctacacataagtaaatctatggaacataacggagacgccgatggttttggttctgcaatggaagaggatccgctaatgcggagcaacactcaccacacgaacaacgcacagtaccgggtgttgacgacgacgcgtaatgcccgagagtagagcaagacgagtcacggtggatgaacaactagcgagcgagtacacgaagcgcttcccaaaaacttttttagcgccttctcctagtgcaggatatcgaagccgaaggtttcggagacctaccctctcaattgctggtgcacaccagcagacgggatggagtagactacgagtgatgttgctttacagaggaggcaaatccttgactgttttcgtgtgtttcgtggagccaacagcttagtttataaagagataactagatgtgtcgttaagatgctcgtacaatcttgtcagctcctcgcaagggaggtggaaagtgtgtctcttgttgccattggtcgacgagtgctgtcagtgttgaacataggcattggcctctgagccatggtgatgaacgctagcaactttgcatctagtagacgagggatgtaccggttgtcaaacggcatcacgcctcccgtgtgcccttgaatccacaacgtcctcataacttgtataaagaacaacgttacaaaaagttaaatgcattgacaactctacaatatattcaataaataataagcaaagagtatgttacccctccctccatgatcctgtgagctcagtgcatctccttgtagtgcaggtgtagaactagggtctccaccatcgtacatattagaatcacaaattagagacgtgtacatatgagtgaatcaaagaaaaatataagtaaattgcgcattctaataacctgtctactagaaacgttgaccaccctacaagtatgccaatgtttttttggccgatccaaagatttgtcgtgcttagggcatgttgttttattatgactaccttcgtggcatatggaacacctgttaggtatcatatgctcggaataaccatcattcgacttctatgaccgaccaattcttatccatgtcattgatgaacctcttagttcttccgccaggagtatcgatcatcttcgacaagtcgggtatgaactcctcaccgtcatcacttggccattgagtgggatcttggcttggctcgaacctaggggagtacgagcattgcacagcttccttggtagcttcgaaacacatccgagggggcacttcctcatccatacatcgtagtctacaaaactgatcattgggagcatggcatgtgatgcaatgccagatattgacatgtacaagtgttagttgtcacaaccatgcaatagtgtcggccacccccattgtgctgcagctgatgtaactccaccctgcttagtcacctcgtactttgctgtagaaaagtagaaacaagtcgtatgttgtcccatagtacgtactttttgtatttcaaactccttaattcttttcggccacctctcacacttttgtattgcagccatcgtggccttgtacctatcagcgaaccacttattgcagttgttgaacgtgtatgccacgatggatgttactggtagcctatgaatgcctttgagcatattgttgaaactctctgccatattgctagtcatgaagccgaatctacgagctccaacatcacagggccgtgcccacttatgcctctatcacataatgtatagtagccacttctttagttgagactcaaggaaatcaatgagatgcttcacttccttctcaaactctatctactcatttatttaacaaatacactctagatccttcatccggcgttcggttgccccgcacggtagaagttagcacagaagtgtcgcgtgcaccatctatgatgtacattacggtgacctgagagatgacattgttgattttgtgtagaatgtctttgtgcctatgtgagattatgcacacttttctattgagtctaatcaagcgtctccaaaccatactaatgaaccagtcaagaaggtacctcaattgctatcatcggacacaaagtggttgaaagcctctacacactgcccaaagaaccatgcgtcatgcccaaatacatgccttgttaccccatccactgttctcgacctttcttggtgaggctcaacaacataacgcactgtggggttattagccttaataacatttagaatcgtcggtagccgaacatatctctcatcccaatctccccatatgttcttcatagccacctactttgcacgccaagctttaccataagattgatggtggtgccatatggcctccacgacctcaactatagcagcaggagtcaaggtcagatcagcttggacaaatggttgcaacctgttaccgatgaacttcgaagttagtttcaagtgcttgttcaatgccactacaacacgtgtgctctacacctacactggtaaccctccacctcccatccttagtcttccttgcacaaacctcccacattgttaatgatttaccaatgcatgccaccatgtacttcttagaagcgtttgggtgcttcacatggaacgggcgatgcacactgatcgagtaactctgcagtcatatttgtgtgtgtgagagagagagagaggcgctactgaggcgaggagagaaagagaccgccgtgtggggctaagtccactacctgtgggccccgccgatgcgggtggcgttgtctttcgttgcgtcggcatgtcggccccgccaaccattcgatggcatgtcgtggccatcacgacctcagtgccaatgcgtttggtgttgaggactgaaagctcagcgccgtcagcccttgtgctaaacccggggttcaatttttgtgatagttttagcaaggacctattttgaaataagttccaaaaaatggccaaattgtgaaattttcgggtggtgggtgcccgcggtctcgtgccccgttctggtgaggtggttgtcccggtctggtgaggtggttgttgattctcacctcatttacgtgaactggtgggcttgcgatctcctaaagtgggcggtgattttacacctctcttatgcaaagtgatggcctcaacacacctattttgttccctctcttttcttcctctcctagtcattttgtgtttgctattggacactgtatctccctctctcttcctttatatctgtcacctcctcgctggaacattttgtgtccgccacgcgacactctatctccctctctttccctatatatttgtcaccaagagggctctctctatgtgtcttctacattctttagttggtaaagtaaaatgacttaggaaaaaaaaggtgcatgtctatttagatgagatgacattgaaggagtggtcgtattaccttgcataatccataaactgcataaagcccagatcccttatcagcctgtttcaatggttttaatgcttgatgtgtccaaaatgccaccctaggctctccccatggcacattacatccaggtgcatctacataatctaaatacaatagttgcaattttaggggaaaaaagcagtgagatgttacaatactaaaaacaaggtataaaggagagattaagcatgtagataattaccccgagaaaatatgtggatgctgaaatccaatcaatatattcttcttaatcttgtcctacacctatagtgctgcatttcttatagttgaaagcatgtgctcagcccaattgtactttgcaatgttgttaacatccaagcaaatagtgacatattgcatactaggttggtttgatgttgttggggcaatgatcttgtacaaagtaatcaacataaaagttgtgatgaacttgttatctgacggagcttggggctcctcaccgggagaccgcgcaggcccccctttgccggttcggccgggggcgctaagtgaggttcttcgccctcgatctgaggaatgttcgcgagagagaatcgcacaagacacgggcgatgtagacaggttcgggccgctgagaagcgtaataccctactcctgtgttctggtggatctatgtgtgaaggaaattacagagagttgaagagctagagagttcaggctctccaaatcgaattgccagcctccttttcttcggtgggcaaggtcctccttttatatctcaaggggataccacatgcaccacttctacctactcttcttttgggtggggacccaccctatcttgaccaaaacttggctcgtgccttgagcctggaaactaaatcacagcctgtgcttgagtgaggctcagtgccgtcactcgcctgacaccggagatcaccctgtcattccttcattaataggcggagatttgcaatggccaccgtccgtatgaccctccgatgggatgggtcatacctacctccactccgccggacgcagacgcaatgtgggagcacggttgtctgccgatgacgcgaccggcgtcagaccagtcacaaaccggtcattcttgtccaccacgcgttagtttagcatgccacacgtcggcccttcttcatacaatgacttccttgcaatggttgcgatgaagcctggaatgtatctggccgggactgacgtacctactccaagagttagcacgccggctccggctaggaacgagcgcctggaggctctcatcataccgacgggacggggcgaggcgtgtgtcaggccgcctgttgccacctaacccgcgatctgaccggtctgtgaccggtcacacactgcga

SEQ ID NO: 59874 - DNA, 4325 bp, Oryza sativa
tttttctctcctgttaacggaggggtttccacgttaaatctcgtgtcttctgtgattgatctattgttctttatcgcttgttcgcttatcgtttcctaacaactagaaggagaaacaaacctggcaatccatgaatatgacatcatagggcaatggcacattatgctctcctgaaacacttactctctcaatagcatctttgaatatatccacagccttagctccatcccctgccaattcaattgttgctcctagttggttcaacacttttctctgaatagtgtgcgctccgcctggcggagtgcgcacttctgcttgacgaggttggcgtcgagcgccgcctcccacgccaccgccagccgcagcgcccgcgtcagccaccgccagcgtcccagccgccgccgctgccgccgccaccgtggagcacaccaagatgattgtggtgacgccgcctgcctctcgccggagcacgtccgccatggcgctcttgtgaaaaccggcgggaatttatggtgtcaactccaccagctagctggtccaattcacggccgtcggccgctgccggtgacggcggcgatatagaggagcgtatactgtttgaaacttagaaggtaacatggtggagtggagagagggggaatgaattacagagtgattgatgggcttagcttaacaagtaaaatgggaaggaaaaggtatactttgactcgctcaagtatcgcccgagtaagattcatatcctccaaccacaaaaccgggttcatcgactcctccaactatcaaaactggtgcaaacaatgtccctcgatggttttggaggtggttttggctgaggtggcagtcttgaccaagtctttgtcctacgtggcgcttacgtgtcaatagaatgaaaacaaaaataaaaaaatatgtgagacccatatgttattcacacaaaaaaaagtattgtgggaaagtatactttttcccaaaccctactcggtcggggaagccaccaatgaccagcccaccactcgccttggcgcaccgtcgcctccgcagcagcagccagagatggagatggaggacatcgaggatgtgctggggccatctaggctcaccggcggcggggcgcctccgggactccgtctcccactcaccgttgtcgccatgaagcccaagcatctgagatcatctagggtcacgcagacccggccgcagcccgaggcctggatcctcaggatgcaggtgaaaccgccgccatagctcgagctccgatgagggcagcgcaggagaggaggcggacgaggaggcagttggcgcggagggagtggggggtcgatgacgacagcgacgagaaggcgacccagtagaagaaggtggctcacgttcctggcgacgagctccaaggaggaggccgtggcgaggccaaagaggtttccgccaccgccaccgctgctatcgccgccgcgccgcgcaagcacgcagccgctccccgctgccgccaccgccgctccccaccgccgtcgccgcgccgcgcgagcacacggccgctccccgtcgctgccaccgccactccccaccggagcacgctccacctcaacccctttgtcgccgatttgtgagctaccctgttgtcgcccccatcactgccatgttgcctctcctcaacctccgcgcaccggccaccctgctgcatccctgccatcaccctactgccaataagaggagttatgttggagagaaaggaaggagagggtatgatacatgggccccactctatttctatgattaatagattgtcacgtcaaatatcacctagtcattttgtgtcggtttcaatagttagaggaatcattataccttgttttatgattgaattgaaggatacgaataagatccaacctaatgttttgaaggagtcaaagtgaactttctcctccattctgtttccatgactcttttagcatgggctatttcctagcccatgccagaaatggactaccagtaataatttattagttaacttagccttctccataacgttaaattttagaccgaactagttatatgcccgtaggttgtaatgggattgggtgataaaaatattgttttagtttatttctatgccggtttttttacggttgtttggttctatgcggttttcttagagaaagatgggaggcagtggctttgttaggaggaaggagggatttactatagattcaggaaattttgaaaaagaaaactaacaatagtgttatagtggctcctttcgaccaaattctttttagcatttctggctctactactacaaaagggttacaaaatttggcccgtaaagttccgactagaggggccggaattgcagttgcaaggccacgcaaacgaaagcccctcaggacctcattgagagccagcccataacaacttgtgaaactaaaatggaaaagcccttgtttgagcttcattattcacttggatcagtttgattcgatccccaactaaatacatcatcaggcttaaaatcaccctctccaaatcacaaccaaactctaattaagtaaaccccatgaacaaatattaattaacccacacacaaatacaaacacacacttcggcctaattaagcaaacagtgcacaattaattgggtcacatctcatctctctgcagatattatacatgtaggattaataaatcagtggaggatgggagggttgcagtaggggcccttgagccagccatcggcgatggagcggtaggcggcctcggtaaggtggatgccgtcccagatgaggtagttggccgggtcggcgcaggcgctggacccggacatgccgcaccgcgctttgttgttgtagttgtacgtcccctgccctcccgccccgcagcacaccttcagcccgtatttcagccctgccatattatattaacaaggtgagcaaccaatatcactctccaaataaatatattgatcggtggataccggagatgtaaacaatttttcacttatcttagaaattgatgtcatatatacgtgtttcggatgtttcactagaaatagttttacaatggcagaaatatgtagtgtcagatttttgcattatttatttggctgtgtatatctagtttagatgtagaggctcggttttaaatctatctttgataaaataatatttctatgtttcaaatagtgccgttgttttttttttttgtcgttttttcggtttgctttgtaatgtgtgctctgttcttttgcagtggtgcaagcagagcaaggctgagagggtttgaactttcaagatcatgcaaagatatgaacatgttcctttgttttgttttaatttgtggccatgagcttttggccaaagggtatctttgttttcaattggacgatgtcgcatgcaaagaagagctagctagctgtgatacatgcatgcatgctttagcactagtattacataaatcatgccagttgttattatttcataatactccctccatttcaaaatatttgacaccgttgactttttaatacgtgtttaaccattcgtcttatttaaataattatttattcttttcatatcatttgattcattgttaaatatactttcatgtacacatatagttttacatatttcacaaatttttttaataagacgaacggtcaaacacgtgctaaaaagtcaacggtgtcaaacattttaaaacggagggagtatttgatatagtatgatagatgccattccaattggattacaaggtatcaattcctaaattatactgtactagctagtatatggacagaggtcatgaatggtccacacagggaaggcacaaatcatttgccacactaacaggacaagtgagctaagaatccaacaagtaattggactatttggagatgtaaagcttgttgttatgcacgtacagtgtattaatttatacttatctctaacaacctttggatatatcctttacctagatctgacgtgtgggccatgtacccctagctaacctacactaaacatgccgtgaccactgaaaacttcaactctgtcacggcaactggattctgggacgcttttgatttttagcacataaaagggtgatgtgtgctaccggacaacgatggtgccttgcagctctgggcagtaatgttcagggctgatctgtaactactatacaaaatacaatttataggctgatctaaatattatgcttcctagttgctacgaaatacctcgtaaaattttataaaacgggtatctcctatcaaccataacaaggctggattaaattccattttgccaaaaaaaaaaaaatcaagcctaacagaaaaaa

SEQ ID NO: 59875 - DNA, 1655 bp, Oryza sativa
gtgagttgatcaggtggagagcgtgaaatgatcaggttagttggttagttacctcgaggccacggatgatcttgctgacgacctgtggcacgtagtccctgacctccgtcatggcgcggccggcgaagagcggcgcgttgtagtcgttgccgccgaactcgcccaccacgaacagcgacttggacaggtagctcctgcaatctacacacacccgtgatccgatcgatccatcaattcgtccgttaattaattaattaattaattactccacatgcacatatatactggtagttgttggtgagacgactaatcaatgaattggatcattaattacagtggtagttactgtggtaaataataagatgttgaataattagttagttaccgttgccgcagacgaaggggaggagctgacggaaccactggatctgggtgtcgagggggccattgttccaaatcttgtcgctgaggccgatggacttgaagaaggcggcgtccatggaggtggcgccgatgatcgccatgttcgcccccttcttgaagtcgccgccgcccttcgacgccggcggcagcggcagcccaaagtgctcagctgcatatatgcatgaaattcacatgtcattttctccactactagctcgatcgatcgatcgatcaggacgtcgtcctaccgaggaagtcgacgacgacgcggccgtcggagcagcggccggtggggcggccgaagaaggtcttgccgtaggggggctggccggtggtgagccacgacgggcagccgccgacgcagaggttgccggtgtcggagatggagtcgccgaagctgtagatagcattgtaccgctgcgccgccgccgcgtgcgcgaacaccaccaccaccatcgccgccgccagcagcagcagcgccgccattatcacgaacgtgtaaagctagcgtcgtcgcgaagaccgggagagggagactacgtgagatagctaggacgatggataggtagctcgtgtgggttgatgcgattttataggcttagcgctagttcgtctcgtctcggcagccgtcggttggtgggtcgctgtcgcggcgggctactgcgtttccatattcttctttgcttcactgatcaccactgcaaccacgacgtcgtcctctgcacactcacgtaagcgtgattctttatcgtcataaagctacggcagtaacatacagctttttctgttgagttttcggtgtttgtttattttctgttccttttgttttggatgtgatggatactgttattgttgttttcttttctgttccttttgttttcgatatgatgcatgggtgctgctgctttgcaaattacaatgcattcatcattgctaaaaacctatatatagactctagctatattttcactccagacttcgctcctagagtaaatttaagagttagaaccctatcccatacatgtccgtagtcacagatgttagtgatatgccctagaggcaatcatagagatgattatatcacacactatgtttacatatttatccgactttgctccttaaaatagataaactaattattggttaatgaatgtgtgattcttttataagactctttatgttatgtgttgctatttctaaaggatccctgatcaaatatcatatgtgcaaca

SEQ ID NO: 59876 - DNA, 5973 bp, Oryza sativa
tcaataactatcacttggttatcctcccgcatgtcgcgaatgtcaagggaggaggagtgaagcagtactaggtgggggagaggggagggatggagggatagttgaatggcatttgcgggtaatttctctacaagtcaatgggtacttctgaaattgggacagagttggagttgtggagcgaccaaaataccgctccacatagctagttcactttgtaggagcgatctggtttactccgctccacttttttttttttggagctggaccgtttggttgggctccagctagatcagaggtgaatctaggagctgtagctgcaccaagcaggccctagaagaacatcgtaggagaaaatctcatttactatcccacaaattgacaaaaattctaatcccttatataaggaatttatgaactacataaataactaatcaagcatgtaaataagcatatgataacttacagatgcactaggttgactttgaccagacgatctagtctcctcttcaaccctcaactatgccaacactcttccctctgtctccttccggtgaaccgtttaaaccctataacaagatcgaagcaaagggaagagtaatggagatgcgatctggtacaaatcggattgatcactactgaaataacggataccagtgatttacttttttttttctcatggcatactgatctgcacaacaatatactgacagatggatgtttgtattcaattcatgtatagtgcccatgttttacaagttaattactccactgccatcatgttacaataattttgttccatacattgctcctctcctgattaaccgtacacgttgttccacctacaaatacctctaggtacctcgtaaacacagtaaaagatctcatgctttttcttactgttggtaaaagcaagtcatagtacaatggaaaatgacatgagaatgcaaatacaatacgcaaaggactcaatgttttgtgagtattgttgtgttgttctcaagttttctgcgactgtacagcaaaagttcaatactgtcactgatatcgtcatctttatacgtgatcatgataagcttcaagtcctgggactcgaacattatcacactttcacgcttggaaggaccgtgcaagattagccttgccattattttactctttcttgaattatctggaatctattggaacaccacacatgatggtagtgagaggatagaccaaaagcagagtaacaagatgaacataaaaaaaaatagaagtaccttgcagtttgccaatataactttctccagattaggagcattctataaaaatctcgacaatatataaaaattttggcccagatcacatgcacagaagcgcaaggttgtcagcttttgaaatgtcagaatatttatagatttgctacaatgcttctcctgtaataattggaaggagaattgagtttgacatgatcaacattataaattagtttggaagtcattatagatgcgatagaagaagtaatagtacaaatataaatagatgcacctgacaaaacaaaaggtcaataatgtaatgagtgccaggcccaaagtataatataatagatagaagctagctgtgagctgggacaaactatagtgcaaaagaaatgtactccctctgtcgttaggaaaaattaagtatttgcaactcttagatgtggtaattaaaaatgatttgtcacgtagacccacacatcattgacacatgatggtccacatgtcatgatatatgggttgcaaatagttgaatgccaaatttaagagcggcaaatagttaaatctccccgtaaaatataacatctcgtaaagtttaaatttgtacctaacgcgcctcaagaaagaaaacatgtttgtttgacccctcctttcaataaccatgctaaaagataaaacttgctaggacgaaaggaatacattataaaatgaacttggtcttatatatatttcagtccaaagattaataactattacattctggcatcgatattaaagcgaataagtaaggcttgtcgatttatcaattgacagagtttttcatattaataatcatttttttcagcactagaacaatatctaatgactgatagtatgttttttcttcttgttatgaaacaaagactctcaccttaaacttgtaaaaaatgtttttgttatttatcatcatcgacatggatgttttttatccatacaagcataatgaaacatttagattcgtttcgtcagttcgatgcttcgacaagggaatccatctcatccactaaaaatacaacgagaccaataactgaataccataggcgaaaggaggtgagctttggcgccgtgacagccaaagcatctcttccagagcagtcatgaatggccaaactcttgagtgtgccacaaacaatctgactgaactcgaaccgtacagttcttgagctccatggattccaggacggggcaccgagaacggatacactcacggaatctgccgtccaaaaccatgctggaaagcagggtttgaaatttcggtaattttgccccccaccagcaagctcacatctcacccaaattttttggtttttttttttgcgaattttttgaatttgatcaaattttgttcaaattcattcaaaacagtcacaatttcaaataatttcggccaaaaaaaaaacgaaatttctgaaatttcggttcccctgactgaaaaaccaagttcgaaattgaaaaccctgctggaaagatgcaaagttttcaggcggcaagcagagatggcgccgaggagaggcagcccgaaccggtgaatggcgacggtttcgccaatggttaatctcgagcaccacgggccggcaccggaagccactgatgatccatcttctcttgtgtcgaggcatatatatgtcgggttgtcctacgatgtcacggtagtttgggagatgcagctggaatctgtcgaggcagtacggggcgttgtgggcgatgagcaggttggtggtgaaatcctccagctaatttgtccagctcaaccagctcgccgtggagtttgcaatcgtggacctcaactcgtggccatcgatgacgacgcacggcatggagcgccacaggtcacgccaccgccgggacagcgcgtacgtctgcacggcctgccgcgccgggaggaaggacacatgatcgtgtggacgaggcagtccggcaacgcgctcaggcggtcgccatcctcgtcggccttcggctggtcgagctcatcgccggtgttggtgttgtcgtcgcaagatcgatcgcaaaagatggtagagcttggatgcccaggtcgcagggacgctaccggcatgcagtcgtatgccattcgatcgaattgtatgtaacagatgggcttggttgaggcccaatgcattgggaggcttgtgcagtagttcccctaaattcaaaatatcatgtgattccgaaaccatgtttcttttccagtctcaaatatggttgaaaacatggaatacttgtagccagagctggagtttgaaactccaccatcggttccggtgttgaatttgatcagaagggttcgcattgcaacagccgcaaacgcatacctgtgttactgttggcttggagcactattctccctcgtaatacaggacattttgacttttttttctagtccaatatctttaggtttgatcaagtttaatcaagtttatatgaaaaattaacatcatctaaatcaccaaattagttttattcaatctaacattaaacatattttgacactctctccatttcatattataagtcgctttgatttttcttatagttagatgatttaaatttgaccaaatttatagaaaaatattaaaatattttcaatataaaacaaatatgttaaccaaatatattaaatgttatttttaataaaacgaatatgatgttgtagatgttgctaaacttttttataaatttcatcaaacttctttaagttaaacaaagaaaaaaatttaaacgactaataatgtgaagtggagggagtactatattttttttagggaggagggagtaatatatttgtttcatgttgaaaattttatgttttcttataattttggtcaagcatacataagtgtgactagaaaaagaatgaaaaaaaagtaccaattttgccatttatttttggcaagagcaaatggttaccaaatactcccttcttttcatattataagtcgtttgtctttttttaatcaaatttctttatgtttgactaaatttatagaaaaatttagtaaattggggtgttgttaagaaggaaattggaaaattttgtaaagcttattctcgagatagaagcacctgaagtagtggatactatgatgatatgatcatggaaaaggctcatattatttttaagtcggaaaataatgaaaaaaacctttcacattggtgtatatgtggagagaactgaaagatcaaccaaaatggcgaaggttcttagaagaagataaaaagaataagagtactaagatatctaaatcaggtgcatacacatcataatccaatcaagcatacatatcatcatccaatcaagacacagaggaggagaccatccgcaaagagaagcgccatgagggatagaaaaatggcaaagccaagctaaaagggagaggtaaaaatgtcgcaccttctcctttgagggaccagccgtctcaggactttgttccttgcaatgaagctataaaaataaaagcagaagcaatgtatgggaatagagaggatgcctttatttaaacaatagttttataagcatccatgccttactgtttggatgcattaatttgaacagcgagattctcaacagacatgccttgctatgccttgctgtttggatgtattccatcaactatattttaagtagccatgtcttgcatttcatatatttaaacaatagttttataaacatccatgtcttcctttttatatatttaaacaactgttttataaacatccatgtcttattttacaactgttttaagctatcataactgcaagattataaataattgtgctaattattgccgctagcccgctacatatgtattttgcaggctgttgttatgatgaaatgctaagaaattattggctaacaaattcagataattaagactgtgggctacatattatcagtacataacctcttctgcaggtaaaaagatacatttatcattcactgaattcacaatagaacatttagttagcttacaaacttatcactgagttcacaagtctaataattgccgagtccaaatcctagaagccaattgaccatagaccacatagtggcacactaaatactagggatacaacatcacttggttatcatttattcatcaacagcttcatgtcccttcagttttgcatcactaaaatttgaagtgtctttgtccaacaattttaagtgtgtgtgatacttctccattcttgtttgctccttctttgtttcagctgatttcgatcttgcttctgcaaatttcacaatcgcttttgcttttactcttatagcttcatagtaagaaacaaagtcttgacatggctggtcccccaacggagaaggtgtaacatttttacatctcccttttaacttggctctgcctttttttctatccctcatggtgcttctctttgcggctggtctccacttccgtgtcttgattggatgatgatgtgtatgcacctgattcagagatattagttctcttattcttgttatcttcttctaagacccttcgccattttggttgatctttctgttctctccacatgtactcctatgtgaaaggttttttattatttgtcttaaaaataatatgaaccttttctatccgagtatccactactccaggtgcttctagctcgagaataagctccaaaaaatattccaatttccttcttaacagcaccccaatgtgtcttgcattgcatgactgtt

SEQ ID NO: 59877 - DNA, 558 bp, Oryza sativa
agctcaatagcagactattgacatacaaaatgcacgtacatactactgacgtacaaaatcatccgcactagctaccttggttattgggccaagaggctaagaatggacgggtaagcgtagacgccgttgagccagccgccggcgacgtacttgtatgcggcctcggtgagatggatgccgtcccagttgacgtaagccgacgggtcgccgcaggttgacgcgcccggtgagccgcatgccgctccagggttgtagttgtacggcccgcccccgccgcagcaagctttcagtggttgctgcgtgaaacctgcaagggcaagtcagataagttacctttttcttttttctaagataatgggatttttttttcaaaaaaaaaaaaataatacaagagcacttaagactagtattattagatatgaagtgtaatgacatattacattgttacgttgctatacatatggagtgtattgacatgggacgagagatatgtaaattttatatcgtcggacaaaaaaattttggcaagtatgtttgaaacaagttagtccctccgat

SEQ ID NO: 59878 - DNA, 1494 bp, Oryza sativa
ggttcattagtggacataattagtaccaccttgtaagtagtaaaccatgtgccctactatataacaatcccctaagcagcactgcttttagttgtcccctcctcatttgcttcttcttcttcttcctcctctttgtttcacacttgtggtttgtggttgccaactttgtgagcgaccatggagatgaggagggtggcggtgctggggttggtgtggctggcggcggcggcgacggtggccatggcggatccgctgccgtcgtactacaacgcgatattcagcttcggcgactccttctccgacacgggcaacttcgtcatcatcaactccggcaagctccccaacatgcccaagttccctccgccgtacgcccgctgctccaacggccgcctcgtcatcgacttcctcggtacgtcgccggtttaccggccatgatcatcatcatcatcatcatctcctcgatcgaatgcgagtggtttgattcggttggatttgcagctgaggcgttcgggctgccgctgctgccgccgtcggcgaacaagggcaccaacttcagccagggcgccaacttcgccgtcatgggcgccaccgccctcgacctcaaatacttcaaggacaacaatgtctggagcatacctcctttcaacacctccatgaacgtccagctccagtggttcgacgaggtcaagcaaaccatttgttcctcccctaaaggtccgtccatttcaaattttccgaatggcattggcatcggcgccggcgatctaattgaattcaagaacatgtaaataaatacagagagcagggagttcttctccaaggcgctgttcgtgttcggcgagttcggaggcaacgactacagcttcgcgtggaaggcggagtggagcctggagaaggtgaagacgatggtgcccagcgtggtggcctccatggcggggggcatcgagcgggtgctcgacgagggcgcgcgccacgtcgtcgtgccggggaacctccccgccggctgcatcccgatcacgctcaccatgtacgccaccgaggaccgcagcgagtacgacccccgcaccggctgcctcaagaagtacaacagcgtcgcgctctaccacaacgccatgctccgcatcgccctcgaccagctccagcgccgccaccccgactcccgcatcgtctatgccgactactacaccccctacatccagtttgcccgcacccctcacctctacggtaagtctatcttaacttctggctatgtatctggacatatctacgttcttttttttttcttttgccgtgcaactctgctttcctctgcaatgcgatgttcaagacagaaatggtagtttgagggttggtcagtatggggccgggggaccatgccaggcagcattgcaatacagcaagagctagcactggatgatggttgggggtactgtgtgtgcagggcggccagccactgacactaacctgacggttacatctcacaaaaccgtaccc

SEQ ID NO: 59879 - DNA, 9081 bp, Oryza sativa
gagagagagagagagagagagagagctaacgtgcattccatttgttgttggtgtatattggcataagtaaatcgattagatttttaaatttcttttttgttttattttgttttttaaaaaattgggcggttttggtgccatgtaatactgcctactacttggtcataaattaatggtggatggatgaactgtttggtgtaaagcttggcagattggagtagtttattgtcagaaaagggaaaaaaaacagaattgcttgtgatgatcatgatcatgttttataccttacgtttgagtgggagtagcatccaaactccaaaagagaagaaatcatcaccgatcagctcgaaaggcactacacgcatcacatatttggcttgtttataactgaacataggtaggacggtgagggccggagagataggaaaataataaacatggaaactcaggttacccgctttattgattacacttgacactttcctctcatgagcttagtgacaaagcacacacacatgctttggtagtttgattgcaattacctcaactaaagatcatatgcaattatgtattgcacaattttcttttttgccacaaattgacgagcaaaagcaataagcaaacccatatgtggttagaggagaggaccagagtgctgtagttgcagaaaaccaacaagctggctggcagaggccgcaaaagcacttttggcgaaaggcctaatgacttcttccactgcaagctacccagcatcattgtcgccttttggcatcgaatgcgatgaatcgtgcataagaaaaccgatcgatccccaacgggatccatcctccatgactcgtttctcttccaagcggtacatcttccctgttgtcaccaatgagggcttttgttttgcgccctgttttccaaagtttttttttctaacttccaacttttccatcacatcaaaactttcctacacacaatcttccaacttttccatcacatcgttccaatttcaaccaaacttccaattttaggtgaaataaacacagccttggtcaaaccaaaccaaaaaaaaaaaatcctactcatggccggtttcgatgtgttgattgatgatagctaaaattgaatttatggcagttgttaatgggcataaacgaataaattgaccatttgaaaattgaacaaaaatgttaacaaaagttatttccagaaaatgttgataaaataagattatgtagaaatcacatcatttgaaagattgaaaatcatgtccatgataatctatcatcttaagtactccctccgtttcaggttataagacgttttgactttggtcaaactgatttaagtttgaccacgtttatagacaaaagtaataacatttttaacccaagacaagtttattatgaaaatatattcaattattaatttatctagtaaggtagcccgcgcatacgcgcgggcatgttgtttaatcttgtgtgaacttttattacaaatgtttatgtgtgcatgatatttttgaaatattttttgactctattttaaacgtatgctcgttaatacctggtttcggcgtattacttgaaattgtatatcttcaaatttattagaaaaaaatatgtcaccataacgaagttagttcatatctatttgtattatgtgtgattcttttttaaaaatttttggagtttccaaactttatataacattttttattttatacgccatagactactttaagtagcattttaattttattatatattactgaaatatattgtctattaaaaatatagctagtgatactacttcatctaattaaagatgacttatattacttatattccctctgtcacataaatcgaaggagttgaattttatcccaaaacaatagaaaaatttatatgtaaccgggacaaagtgattttttttaaaataacaccacattaatctccaaagtaacgtatcatattttggcaaatatctataatatctatagtgtagtgcatgttagttcagtgtccagattggcttcaacacctattgtttctaatcatatgagacgccattggtaatttggagaatacatatgtacatttaaatcagcgttgtgtattcctcaagtgttctttacacctaaaatatgatgtgaaattattatcataacattaattattacatgtcggctccatatttgtgatgtattttgggctatagatatttagtagtttatttatttaaaggaatacaaccggatcacaaattggatatataattttaaaataatttaaaagataaaacgcttaaaagcattgattgggtatttcatatttacatttgcgtaaatttgaagattataatattttatccttaaattgtagaaaattcttttttaaggactgccattttttggctttatcataagtatattttctgttcttccagcaaatgatatgtaagcaatattgttcttttcaatcatatctatatacggagtactttttctggtcaacagttacatatttctcatgtatccgtatataggagaaatgtattattttttaaacaataaatctaatctaatggtgtaaaatgaaacaactaaattgtgttgttttcatttatgcaaatgtagatttaaattagcgttgtgtattcgtcgagacactctagaatatgatgtaaaataaaaaattatcatagcattaaatattatatatatcagcctcgtatgttaagatagaacgaataaaaatcattgatgggatatttcatatttataatataaatttagtttaactacgtatatttatgcaaatttgtagagtaatatatttatctttaaatagtagataatactattcataagaccatcgatcctttccgaatgatacacatttttttgttttattgtttgtataggaaggattttgaaaatagtatttcaatagaccaccgtgcatagatttttctttgttccgatggacagtaggtaagcttcatttctttttttcaagtcgtatgtacgtacggactacttatgtattttttagcttaacagttatataggtctcccgtatacctacatggggtattagtttttaaaataaaatacatctaatataatggtctaaaatattagattcaccaatttaaatgaaaatcgatggtgacatttacttaaatttatattgaggaatagattttatctttaaatagtagaaaggataatcaattttttaatggtcctacgtatgttttgttcgctttattgttttttatagtactaagtctgtgcgtaatttttttctttcgataaacagtaggtaagattcattgttttttagtcttacgaatgaacatacttgtgtttttgttttctttttccggtgaacaataagataaacggtaataagattcattgttttttaagtctcacgtacgtacatacctacggagtacttgtgtgtttttttttctttttccggtgaacaggaaggtattagtttcctcttaaataaaatacatctaatctaatctaatgggctaaattatcaggtccaccgatttaagtgaaaattgacggtgagattaggtattgccacgtggcggtatatgagcgtttgcagaagtgtcatgtggtggcttgagagcgtttataggaagtttaatagacttttagtatataatagatagatagatgacactaatttagtattataaatattaatatttttatctataaatttagtcaaacttaaaacagtttgactttgatcaaaatcaaaacaccgtctcaatccatatttatggatacataggccccattctttttttattaatttacagatttcacctcggtttctgtttacacgttttccaaacaaccgttgaatggtatatttcgttcgaaaactgctgatacagaagatgttttaaaatatcagataaattcatttttaggtttgaagtaattaaaacttttgatacagaggtggctaatagcttttcctattttgtgtgtacgtactaaatctttgtgtcatcggcaggtccaaacggggccatattcttgcttacgaaagcaagcaagcagcgtgcggttttccggccgagcggcaaggggatagccatgaaaaagaagaggagattgagttgagttggagctaggcgcccgagcttttagctatctgcctagctttgtttgtgctttgcttgattgccgcgcgcaggaggaggtagaggtagtagaagccgccagcgcgcgcgcgcgcgggggcgcatgtgcgcgcgtcgcgtcgcgtcgcgcgtcgctcggggacaaatcacgtggacggggtggggcgggcggctgcgacgtcgtgcgcggcgcggcgtggcgtggcgcggaggcttcgcgccgttcgttcgcggtctctgagttaaatgtgcgggtcgcggcacatcagatgctgcctgctctgctcgccgccgcccacacacaccggccgtcacggtgttgtccctcccagctcccagatgtggcctgaaatctgaacgtttgaatgtcttaatcgctcgaaacgagtaaataataaatgcgtgaacattcaattgtgggattttctaagggtagagattttctaagggagtatggcatggtttagttcccaactttttcttcaaactttcaactttttcatcacatcgaaactttcctgcatacaaatttctaacttttctgttatatcgtttcaatttcaatcaaactttcaattttgacatgaaattaaacacaccctatgtgtgtcctatgtgtggagaggtgtgtgtatttgtctttccatccaatcgtaacaaagaaacaaaacaatagggtcttttttttttgtctaagtaaaaagactagtgcaaacaaaacaaccacggatcaaaatgtacatttgtggcgtaaggttcattcttctatgctttttcaaagtagtgtgttgttgaaacttttcttttgcagtagtgttactttcagtgctttattttcttctctctcttaggatgaaaacaatcggaaacggtatttatttttctattattacagaaacggtactgatacggtcggagctctctatttttacaactttaatacgacacaaacaaaaattagaaaaaccaaattttactatcatagacacttagaaagaatatttttcattatcttttatgaaaacggtatatatacggtgagaaaatttatgtaccgttttttcatcccttctctctctccttttgcacagataataaaaagtaaattcctggcaaccactggttgtttgggctaatcggtgctttgttggtcaatgtaagatcaccattgctcttgctccaatttcgtcctgtagtgggctttttcaacgagcccaacccatagaacccggcctggatcacgaaagaatctaggcccatctaagcactagcaaactgcaaacagctgccagcgatcactcgagagcgctcatggcaggttgacgttcgctgcatcggcgacaaattaagcagctacccgacatgccgacacgaactaatctgcaattggaattttggaagaatactggcaccactgatggactcaaccaatgtagtttgtaaatcttcaattcttttttcgtaatttttagaaagatttacaatggattaagaagacaaacctagtgctcaagccctaattacctagactcgtctctgccctgactaccaccgcgtaaactaatcacaaagaatcagagctcgaaaagatgcagagaattgaagtccatgcaagagatgaaaggagaggacaccttctctattctcacgatatgaattcacattatttcccaatcatattcatgtacatcgcatacagattaggcactcttatgaaatttggagtacaactcagaacaaaagaatcgaccaaaacacagctaaaaacacaagagcaattgctactgaaaggctactgatcacagtgtctcttccatgacccaaaaacatactgaaaggcgctactgatcgcctcatctcatggcctcaaaactagggagtaatatattgctccagctctctccctctccagcttcgtcagcagccgcagcgacttgccggcgacggtcggtctcgggccgccgtcgttgctcttcgacttggtgggatgcggcggcggcggcggcgcggcagcgtttgtgacggcggcggtgggcgtgatcaccttaacttggtccctggatacgcgcacggggcggaagggatcgtggggcgggaacccgacgttgtagacgacgtcgaggaagccgtcgtcctcgtcggcgtcggacacgacgacggcgccgagccggagcacgaggtggcggttgagccccgcgccgatcttgccgacccgggtgcgcacgctcaccggcgtgcccttcttgatgatcggctcgtcgacgccggcggcgccggccaggaatggtgaggatgcccgtgaaaacttcttggcgacacgcccagtgatcggcgcgaggtgatccggcggcgtcctcctgctctcgatgtcgcggagaagcctcttcatgccggccgattgcaccgtcatggatggcatggtgctggaattgtttgatcgagcgagagaaaatcaggtgagatgggatgagagtcgagacgagaaggcggcaaaattatataggcggttgttgaatatgaaacggagtctacacgcgcagtcggagtcggagatcgacgcgttcacaggcgcagtcggagtcggagatcgacgtgttttcatttcccgccatctttcaaaattttgtattcgtaatgttggacgtgtgtggcggaaattgggctgggcgggttgaggagaagaggcccaggctgacatttgtacagcagggtaactgggcttggtttgaaagaggaataagttcatccgaggtcccttaacttatcaacgaaccgattttcgtccttcaaccgaaaaaccagatacaacgggtccctcagctgtcaaaactaatgcacatgaggtccctcggcagttttggctgatgtggcacctatgttattaatttgacttagtcttcatctgatatggcatggacgtgacgcttatgtggcaatgtgacccgaaaaaataaaacctcatgggacccacatgttagtttcacacataaactaatcaaaaatggtggggcccacatggccccacatgtcattctcagccccctcttcctcctttatcccgatctccctctcttttctcttcactctctctgccctctcatctcccaatgcttgatgcctcactgtcgtcgccgtccatatgctcccgcaggccgtagctcattggcgtccggcccaaagagatgagagagcaaaatagacttatttctaaccatataagacatggcccaaagagttgagggactcaaaataaacttattccaaggacgagcacgatgcaatgatcgtgccttcggatcgacacggcatgacccgagtcttattgagtcatgtctgggccgtaggcgcagtggctgcacaaagcaccatatggcatgtcgactgggcgtgccttgatgtaatgccccgctttcagcgagacgttaaaaactagtttaataaaatcctaattgcgaaaattccgttctttgagtgagagtctaagtcgtgccatggatctcaattcatatcccttgttccctctcgtcgacatcaaaatcctccaccccaagatttcaattccgattcaacttccgaagtcaaataccgaattcaatcgcatcctttgaatcctcaccaaatacttgtccctgttttcgcaaatatcaaattctcattttgaatctctctcttgacatctccttgactccaccttgtgttcctagaccaaatatcaaagttaaatccaattccaaacttcttttccttccaaaccagttctcacagcagaagttcaaaatccgtccctctacttttgtgggccgaattccctccctcggcccatctcctctctcagcccgtttccccctccccttcccacgtgcgccgcacgtgagccgctcgggagagctccctccctccctctctctctttgttctctctccctctctttgatcttccggctgccgcgattcgattttcgccgccgcccgtggtatcccgcgcgctcccctgccgtggccgaccggaaggacatcggtgtcactccctctggtcatcgcctgcgccgacgaccgtcctgtccccgctccactccacactgcccaccgtcgtcaccatggggttgctggcgtcacctcggcttccatgtcccgggctgcccgcgtgcgtccaaggccgaaagcccgagagaatgcgcctctctcacgcgctctcccttctccctctgctcgcccaaatcggcaaggagcaaagctcctttccttccccttttcgcttttcccctgaccacagccgccaccatcacctgccacccctttggccgctagcgccggaaccagccaccgctccttgaccgccctcgatgtcggttccctctcccaaaccgcctctcctcgtgcctataaagctcgagccatccttctctatctctcccattttcgctccccaccgccaccgcgccattgccacctcagcgtcaagtttgccgccgggtgccgccgctcgacaaacgcactccgtctccttgtcctccgtcgaccgaacaacggtcgtcgccgcctcatcgcgaccctgtccgtgccgccccggtgccgtgatcatgacccacgcccccgtgcgccaccgactcccactcaccaccggatcaccggagcgaaattcgtggccgttggtgaaccctcgtccccttccccttatcgcgttaaacgttgtcaccaccctcgctttctctcttctccatcgtcctaccaccctcgatgctgcgtgtaccatgcgtcgtcatcggcctttctctctctaaccaactcgtcgtaaccctcccggagttccttgcgccatctctttgcttccccaacagtgccatctcggtgctgtgccggcccgccgtcgcgactgccatgaccacaactccatccccatcgacgccgttcc

SEQ ID NO: 59880 - DNA, 1935 bp, Oryza sativa
agaatgcagaaaaaatgactgagttgtgcttgtatttgtagaggatgaagttgtagcgttgcggcagcaagtttgcaatgtctgcaaatgtaacggctataactgctactctattattttagtgcatgtgcctgaaatcactatacatatattgtattttatttctttcctgctggcagtagcactactgtattttatttctttcctgctggcagtagcactactgcttggttattgttgttatctatccccacaatggtttctactagattggatgagtgcatttattgcttattgactactttattagtacattgtggatgcccttaggacacacgaactttgtactaaagtggtgaccagatcacgtcaactaacaaaagtttcattgtttgttactctatctgtctcaaaatataaaatatgtcccatccaaccaaattcgcttatattttaggatgaagggagtatccaagtatgtcacattttatttggcacctatcacagtcacacctcactccacacagttcgtatgatttttttaactcatatccatgatgaaatgtggcaaacatggttcgaacccaagacctctatctttattcaaaaccttctttccatcttattggtatttcttaacggctttactagaaatataattcccagcaatggcacacaaatacttctggtatattatggttgcagagtttatccgcaagcacacggatataccattgtagcatttcacccgagagtattccaagggtatcgtatttattttatcccgtgggaagatcaagtagagagaactcgactaataatttatatattacttgtgataattatattctaagcaggggttaagataatccaagggtagagtgacacacaagcattaactactcattctcataatatattatctaagctaagtggaaagaaaagagaaagaaaatctattcctatacttctaatatacatagtatacatacattctagttaactgatatattcgctaataccctctatccgatgccctcctggtacttcgagaagccacccctgattgccgagttccttacgacagcccgtcatgagcatacaaccggggctaaatacggaggaataccctccccagggaattaacttaggattatataccggcgcggaggaatacccgtactgagctgtcaccatcagcggccgacctctcatccgcaatatataaccccaaataatgtaatcccgtaatctagacaccacgtctaaactaccagatactactctaatatcatcgtcatgacatagagtaattgcataagcaaacactacacccgcagcaaagcatctcaaagataagctagccgtatattcagtataacatgaacataatgtaaagtaggtactcatatactcggaaagtatttcaataccataaatgtataaagaagagtattctaataaaagtacaaagctgacaaaataaaagagaaaagctaatagagccatacccgaactcttccgaagacttccgaactcctgatttctactctattcctattccaccagctagatactacaaaactaaacttgagagaaatgagagagctattgcttgaggtgtgtgagtgaagtgaggatgagagctcctttttatagcctcccaatgacggttgtgacggttggaatggtcggtaataccctccaaccgtcattagggagccatctcagccgtccaggagaaccctggatcaaacgaagctgcggggcattcggccgaacccaattgttcggccgaaccatgggctgggccgacctggcacaatttcggcaggcagcctcctcttttgctctcatacgcagacttctgaattttggcccaattcatcgtgccaattctaagttcttggcccattcatacataagtctgattgt

SEQ ID NO: 59881 - DNA, 28390 bp, Oryza sativa
acagtgtttgttgatcaggagctgctactatgctatatatctctgcaaggtatatgtactctctctcagattaaataatctttggcacggtggcttacccttaccctgattcccacgaaacactgcttttccttgccttgagcgttttgaaagatagaacagtaattagagcaccagtcacccaatctttattcaactcttattccagaagttttcaaatgattttgcaaaagaaagctaagttcctcaaatgattcactcagtctctctaagtgtatcaaaatgaattcctcaccaattgttgcctttctgatgcctactctaaggttttaatatgtagagctcggtagggatcaaacatggcatacttgcattcacatttattactaagtcaaaaacttagactaaatatactcaagatcaagatcgtgcaatgtgtgtgtggtatatggtggaaatggtatatagaggaaaataaagaaaaagcttctcctttgtgcttactttcttctcccaaaaaaatccttcttttattgattaggagagggcatgattacatttcttttttttcaacataatgctcatgcttgatggagcataactttattttatttatttattatttttttttcataaccatgcctttccctcctttttttaaaaggatatttctttctttaggagaagaaaacacatgaaagcatggagaatttattttggtggtaatatggaaatggaatggaatattgcttagctcccagtgtaggagtttggcatgtgcatatatgtggatgtatgatcttgatcatagagcatgagaagtatctacacaagtcacaagagtttgacaaagttcagtggaatggcaagtaaccaaaatgtatatggtttaatcatgataacataattttggctctggtaggaatttatatcaaatgaggaactttcaattttatcattttgaaaaacaaaacatccgaaattcaagtcaaactagtatcaggatcatagcaactcatatttactatctcatatctcgcaacaacttagacttagatcaacaagcgcatctcatttacatcaggttcccggataattttttgctacttatatttgacctttgagagagcacctaccaagaacccatatatcagagatataaaacagagcaactatttattatttcaacaaagagaactagcttgtcttacctagcatgactcaaacctatcatatctttttggtattctctattttgcaaattttttatgctgttttcaagttttataagatacaattggaaagcaaatatgcaattggaaagggaaatatgcaatgtgatacaagttacctcagtggggggagagatatctccccccaagcttggcgtttgctcagggtccttgataaggattgaacccctgaaaacggaagtatgcttgaaggtcatcatgctattgctgcatcatgttgttgaagttggcgaactgagcatcagcagattgttgccattcttgcgtttgagctatgtgttccgtgaggttgtactggatctctctcgtctgcatatcaagggtgtccattctcctagtgatttcacccaagtcccaacgagaggaacttgagcgacattcacttggagatggaggcacaccacttgatctgggaggttgattgtccccccattggatgtcatgaggcgcatgccacaggtccacactggcacttacccaggttgagactctgatactgtgacgtggagcttgggtccatctgggtgcgtccccagttggctcccaacctacctcatacatctgcacggctgttgaggattatgaactttctcgttcgttccttgtcatgttgcacgtctccctgtatgctccacctgcatgagattcttttatgttctgcaggggaatggttagttcatggcagttgtacaaatgataccccgtatttggcaacgggatttcatttgtacaatcggggaataagtaaatcaaagatttatttactccatgtttcagaatgtgcccttgcactaaataagcctcatcaatacacggacaagcggctgagataaaagcaatttggtcgctaacgacccctagcccttttgctatccgagtaatcagagaagtgcactcaacaggagcagagaactttatactttctaaccattgccttatcatacatttcacaggagcaattttgatctttctaaccatggcaaatatgataatcaattcatctcccctaatgggcctcagatcacctctaggaaacaaggtcatagcaatccatttgtgcatgagcctaagtgtaggattatggatatcattcgttctagctttcttgcaaattggagcaccagaaatgtcttcccaaaacttatttttctcgaacccataaattcctttctggagatcgattttacaggaatcgtgaaaaccaagaagtgtacttaagcttttccatgtaagtgtgtactttttatggaaaaagcgaaaggaaattccatcttctatttctttcaaagtgcacagaaattgcaaagtaagcagacgagaaccaggctcatctaccacagcaaatctctgccaaccaacaactttccaaacagtacgaaattcaacatccatacctatctttttagcagctccggtgagtattcttgcgtgtgagcatactcccggtcgctcagcatgtagtaggcttgtctctcccgatcactgacaaagtcgaggtcggtgtcgtttaggagtcgttgcggagcttcagtgtcttccatcgagacatctgctgatgaacgagtactagactcgtcataacgacttgatgaagaaccggaccccttgaacagacgagacagtcgcctcctcattctgcacaacggagcaagaatggactaactcggcgggggttaggaatgacaagaatttcacccgccggttagtttcaccaaagcaacttgtatatatgcaactaagtgtttgaatttgagggaaactatcaaagcttgaatgaacttgagagcaaactttggagagggaatgaaaatgtgtcgaaatggggtggaattccctctctcggccggttggcttaagtagtgcacccaaaaaccgacctatggggcccactagcagttgcctcaaagaaggaggcagtcgaccgttggcctggctagttcggccgaacaagtgggttcggccgaacccacagtgggcccaagcggccccactttcggtcgttgggttccaacggtcagtgtggtcgtggcacagcgaattttcattgaaaattttattttggtttgctctgaaaaattcatttaaagaatttcctccaaattcaaaaatcctaaatgcaactttgaaattcaaacatgtgattatgcaaaaattcaaattgttgaaagcaaatatgcggatacataccaaattacctgttggcgaagatcacgtcatttaaagtccggcgtacaagactgtacctccatctagttcagttagtggattttccacccgtatcaggaggtgatggagcgggtgtctttggcttctccctccacaccttctttggttttggtgcagacggtggcttcttctaagccggcttctcttgcttcttagtcggtatgggtggttttaccggcgtcttccaataacggttcctgggcattgttgtgtccttctccaggaaattctgcatgaatttcaccaggctgtccgttttgggtggctccacttcgacctcttgaatattctgtcggttcggcccgtactttattctgaccatggagcattgttccgtcctcggttgaaactcaaaatatatggtgcaaacatcgtaacaaggtttacagtacatatttttcctcatgtgtcttggttcatctaacccatcgtgtgggtctaaaactaaaaaccgacacatataacaacttataagtgccgatctattaaaaaccgacactattagaaaaaccagaacttatatactagataaagtgtcgagccgaaccacatgcaaccgagctctcacccttatcctcttgtccccctcgcctgtctcctatcatcgctgtcacccctctctcgccatctctgtctccttggcacggcaagcggcagagctgcctcccttcacctaagccagcgaggggtagcctagaacccccaccagcctccaccagattcggttgttgcggatacttttctcgctagttgcgttgcctccacctcctcttaaccaagctagagagtgttggcctagatatccctgttagccttcgccagatccaatcaccatcgatggtggggaacgggacgctccaagcatcggctttagtttgaactgatgcatcgaactgagctaggtttatttctttcattcgtggaacctcaaaggtgtgccaattcctaaaccaacaccgaccttcttcccatcagtcctgctaatagggtcctggttgtgaaattcggcacctaagtaggattcccaaccagcagccatcgggtgagttacactgcaactacaatgtaattacattgtaactaacaatataagtacattataactatattgtaacctctatagaacttatttatgaagttacataaaattctttaatacttgtatatatacaggttatataaaagttataatgcaattacagtatagttacagtataattatattaccattataatataatagcatttgaaacatttccactaaaagacttgtggttgtttttttagatagtctcttcaaattattcgtggtaatctattgacaccaaatttaacttcaatatatggaaaaatttgctacaggacattgttcttcctatctttattcccattcttcttccttgcagcagagcagaggcgcgacggcgggtggcctgagccgggacggctcggccacggcggggcggaggcgggggcggccacggcggggcggcggcgggaagatgacgaagctggccgctgccgccgtcgagctcccgccgctcgccgatgtctccgccttctctacgacgacgtcggtggctcgcctcgccttgcgtgacaccacgcaaaccaccacgaccatggacaccagcagcgcggcggcgacggagagcatcacggcgagcaccagcctcggccagctttgtcatctacccaccgttgccccaccgccgccccaccgtggccgagccgtccaggctcgggccagccgccggcctcgatatggagcaaggacatgacgttctcctttggcaacatcctggcggcgatagagcacttcaacgacgcgtactgcatcggcaaggggagcttcgggactgtgtaccgcgccgacctcgacggcgggcgcgtcgtcgccgtgaagcggctcgacgcgtcggagaccggcgacgcgtgctgcggcagttgatgccggtgagcgtcatgacgtagaacgtcggcaccgaggggatgcggcgcatcagtgtgaacgagaagccggccgccgtgttgctgctgttgggcgcaccgagggccatgaaaagcgtcgcgttgctgtcgaacaagaagaacagagaaagagaggaagaagaatagagaaagagagattgacaagtgggcccatgggcaaacttgtctttaaccaaagtttctctctccgttttcatcaaaaataataaaatattgggaggagtgtccagcagctaattaccacttttttacagtgtccacgagcaaatacacgatcttcgagtgtctcacagtaaagaccacaatctttgagtgtcctgtagcaaattttgcctcaatatattcatggtagtatgtcacacctggagttttcccctttcccatagttccaattcaccaataaatcgtctaaagaaattactttggttaacaaggagaaaatcaaaattaacaatgtatttaacaacctgaattgtcagggagaattttttttgaattctctttgctttaaaatcactaacaggacttaaagaggaagttaaagagcatcggagttaatgtggttaattaaaaatttgtcaagttttgaagtaataatagtttttccccgcctttggtcgtgaatcgtgcccgattcactcccctctctgtccacggtttcgttttgcatggttcgccatgtccgttatcgttcgcgggaccgttttcgttcttttcctaaaacgacaccgcatttgttttcctttttgggaaagtcctaatcctattctccttctccaatttttttcctcccctccccctctcccactcggccgccgcccctccacctcggccgcgcgtgcctcccctctgccataccgagtcggtctcctctccctctcccctgccgactcccctcctctcccctccggccccacctattttatctccacccctatataagccaccataccccttcgtttttccctgttcttcattttgttggagtcctagctctagccgccagccacctcctgtagccgccgcctccccattgtcgccgtcgtcgcccttgcatcactggtaatccgtttcaccatctccgtgtcatggctatcgccattacctatccatttcttatttgttttcgtcctaggttttgatccaacgtcgttgtcgccttcgcgtgttgccgttggaccatcgtcgtcgtttccttctcgccgatcgcctcagtttggtgaggaacctatccgtaattctctgttttaggtgttgtttctttttagcgtcattgtggaaaccgtagttgtttagcccgagccgccgctgccgtccgtgccctggcgctgtcgtcgccttgccgccgctgccgcgccacctcctgttgccacgccgccgccttagccgccgccgtcgctgccgctagccgatcccaagccgagccgagccgccgccgccgttgttctaggcgccgccgccactctcccgcgtcgccgtcgtagtttgccgttgtgtcgtagctcggtagccgaatagcaaagccttaggtgcagccctaaactcataccggcctatcgtttgccgtaccgagtctctaccgtaaactgtgtctagttttttgttgtcattccaagccgccgattccgttcgccggttcggttgaccgttgggatggccccatggcacgataagttgactcgttgagtcactaattcttgaggctttcttaccggaggtataattccattgatctatttatctatgggcaataatgtgtaataattgactaaggttttttcggttattagtaataacgcagctcatcttttaaaattcagaacttaataatccgagctccgttttaatccattcaaattgcagtgaatccgttaaaaagtatagaatccattaaaatttgtttattttgctatttcagtagacttattgcttgtatcacctgtgtgctttgtttgtcgtttagattccgtcagttccggtgatccagtttatttcgaagtggttgccgaggttcagtcagctcaagagcaaggcaagtcatacatacatcattgattatattgagcctattttacaaaatcccctgctttctattaaaattgcattgttttagaatgtcatgtggtatggatgccttttattctcagcctgatgaatatcttgtgcctttgataacttgggttatatttgatttattataatttagtccttaattactttatgtacaccaccatggttatggtttaattaaattaaaatttgctttaatggtgggtcgtgggtacatgcatgattttctggaagtcgtgcccatgacaattaaggaccggtttctcgggaatccctagaagatatactcgtactcaccacaggccagatgagctccaggctaaatctagagtataacttaaactagataacataccatggcaagggtagaggcgatggtgcagttcagacctggattttggtctctactatagccagatttacctaggcacgagaggggactgcccgacttcgaataaggagggggtgaaacctgaggtgcatatgttcggttagggagggttatatgacgggttttgtcacgatttccccctttgcagtatctcggtggtacttcggggcatggtaacatgtatggaatcgtgtctagtgggtaaagttgtgcacctctgatcagagtaaaactattcgaatagccgtgcccgcggttattgggcggtcaaccagctcaccgtgattagtcccactataacaatttgacttatagaactggtgtagtttaggtggttttggttggccctgttgcgacgtgatttagcgttggacagtgatgatgttaatactccttaattacttatattgtttttacttctttcaaatcatgctttataaatgctgattttactgcaaactatcctatgagccattcatttgaatatccttgcatcataccttccccttggtatggcttgttgagtacagtggttggtacttagtcttgctttttttcccccaccccaggagcagaagttggttcagatggtgagttctctgaggattgagcttgttctggacatcgaggattgtatggagaaagcttcgctttggtcgtgaagattaagtttatttctttagttctttagattaaataaaaaaatgagggttataaatttattttgttattttttaagtcgtggaactgtatcaaattgtcgtttgtgtaccctgactggtcttggatagggatttaatacacatcctgcttgagattcgggttgtcgaatttctgggcgtgacatagcataaactgatatatgcaattatgcattgaacatgcatgatacatataattatttactacgtacatacatatgtggcattagaatacacatattgaaattacgcagttgggtatgaaggctccatggcaagcccacacatgcccctcttgtcggaaatgtctttctccattctcaggaagccattctcaccccatgttgtgccccaggagttcttcagcaaccaatattgtgtgccatcaccgtccttgccatagccaatggctacaatcccatggtctaagtcagtgccgcatgagccggtcatcacgccaccagagtagaactggaatgtcatgtcgcctccatccacggcaacagaaacaggttggtttgccacggccttcatgagtgcggcctcattgttagctggcacatcctcgtagcccttgattgttgcggcgctgttggatccaccattgcacttgccgtctgccgctgtgtatgggtacttagactcagtggtgaggccaccattcttgatgatgaatttgaaggcatcatccatgagccctccctcgcagccctgatcctcgccatgaacatcgcagtcaacaagctcttgctcagagagggagataagcttgcccgtgctcaacttgacaataccctccatggctgccacggccgaaaatgcccagcaacaacctacaataattattcatgtttacactttcgattcaatacattttacagatgatttgtaaaatgttgcagtggcaaagtggcttgaattttcttaccacactggccttggtccttgatgggtgtgacagcgcccttggttctccagtccacggttgctggaagcgtgtcaatgctaacattctcatacctgaatgtggtaggaaccctaaccgtgctaggaatgaatcccttgttggtcttcgtcgcccggaactcatagttggtgaggtcagcgaactggttaacgccgagccaaaacttgtggttgcctgcattgaacgactcgatgaatgcgacgttggctttgaatatctcaaatcgacgtgccttctcagtagcatccttgtacacccgcccatactgttccatccacctctcgtgcctcgccaccatggctgcgtggtcgctctgctcgcgagctgctagaacagcgctgcagaggcagaggcagctgaggatggcaaagagcagagccttggggatggccatggttgatcagactttgtcagtggttgctcactactgcttctgatctgtactcgtttggttgatggctttgggttgtgaagtggatatagcatggcatgggttaatatactagcttaggagagcttagattaagtaattaatttgtacatcccgtgcttgtgtgatgttgtagacagggatgtctgcgtagcagagaagttactctgtatgtaagctcgtcagtgaacgtacgctagcttcgtagtaagataatgtacgctttgctcaccatgttcacacttactaattactgatgatctcgtcgagcaaatgctaatacaatgaaattctgaacatagatacagtaatgttagagctgtttcccttattttatatctgtactagatcctcatgcatgtgacttatttattttataacagttacagtattggtatgaaaccggattgcatatctgaaatgttgtgaaaagatttcatcttcatcatgattcgtaaaacaagagttcctcatgtctcatggtagtgtcttttgcaatttacatgttaatctttattcccattacttggagttaacattatttttagtacggatatttaattacctagtttatgttatttcctatttgggttctacagcttgaatttacaaaattttagagacaagtttcacttgatttggactttatttgaattacctatgagttttcaaattttaattcatatttctcttcacagaaataatctctcaagtcattttaaactaattttccgaaattacccttctgggagacgttagaatcactgacagcaggggtctacgggttaatattcctatttgaaattattttctctaaggaaaagggcatgtggtattgacatgtggggccggggttatagttgaccatgccatggtggccatagagaccacacgtcagtgacaccatatcttaaacaagattttaatcagtttcttccacgggtatgggcccacatgtcatcgactgattagagagggattcgaggagggcttattgttgtggattagggaaggtgggaccggggtagcgctactggagaaaccatctttggtcggttggccaaatttcacaatagtccgggttgtattaaacaccgggactaaagagcatttttagtcccggttcaaaagagggcaggtagtggacccctatattttctttagtttcggttgtccaaccgggactaaatatctatttgggttgtttcttttttttttgaaaatttgttattcggatctgagatgtatttgatttgtgtgtgatgtgaatacgtgatatatttgtgatgaattttgtagaacatgtgatgtaatttttttaagattttgtgatgtatttggagatgatcgatttgaggatttggaggtgataattgatttgagattttacgattcggggatgattgatttgggattcggggatggggtgaaatcaatatattaaaaacaatgaagaaaagaaaaaaaataaaggagcaaccagatctagcccggctccatctttaatcccggttggtggtaccaaccgggactaaaagggctccatctttagtcccggttggtgttaaaaatgaatttttactcctggttatttcaccctggactaaagatagcaatctttagtcccggattcatagtctcggttggaaaaccggaactacagggggttaccaaccgggagtaaaaaccacttctccatcagtgtaggcccacatgtcggtccaaggaaacgcaaaattttatcccctttctcttctttcattccagcgggcgatcgcgatggcaaagcgacctatagtagtgatgattctccagcggattggaggaggtgaggtggccggcgctgggagtgctcaccatgcagcggccgcatagcggaggaaccgggctcggggaagaagtggtagcatctggctccagcgtcaggcggcgccttctcctccaagaagagaaaaaccaagtagctagatttgtttgcaaaaattgtatttaatttgcgtttatgcatgaattatggaagtattatgtaagctactctatgtgtaatgtgtttgaatagttatgatatgaactttattgatgtgcggaatatatcatgtgcacacaagatttacacattgtgcataccaactaacaaatgtcacaataaaacttagaaaataatattgtactatgtacttacaataatattacacttatgtgtaatgttttcacccccaaattcattatattttacccataacgaaaaagaaaaaattctgacagttttgaagtacaaatatgtcataatttgatattttttgtctctccctatacaattaatttaaagatgatactttacacggaattgtgtaaattgcacccacgatacaacaacttggcaggtgggtgcgatatagtgcaagaacttgagaattgaacgtccgagtgcaacaacttgataagtatgtgtgttctagtataagaacttgacaatttagtattttggtgcatcaacttggctaagcatatgctatgtgagtttttttcacgatgtaaatatgccattacacagtattcctacagatattaccttataatattgaatttaatctttaagaattatactgcacacacaatttacatccaattacctttaagatttttttattttcttcaccttctcaaatatcaaccgaaatataataatttctacatccagtttaattgactttaagttattagtaattaggataaaaaaatataaatatgcttatacaaatccgcgctagtatattgtcaaaataagtacttaaaaaattgaatttatataaaaaaatgctccaaataattaagttgtcatgtactttcttaatttattgtatcaaaatcgtacctaccttacaggttgttgcatttatactaaattgcaccttcctgccaagttgttgtactagaacgctcatttctcaatttattgtaccaaattgcacccacctgctaagttgttgcaccgtgggtgcaatttactcttgtaataatattaatagaaaaattttaaatattttttggttggtatgtgcagtgtgtacacaaaaagacttgtgtgtgttagtatgtggatgtggatgttgtatgtggaatttttgtgatggtatgatttgtatgggaaattggtaggtcctgtaatttttttttcttgccagcatcttggtgcaggtttttattttttcaaaggaaggtgcgggttttaattacaaaccggcacgtatattctttgccacgtgtgtaggtcagtcaacaacctgcacctatatgctatttatgtacaggtgccggttgttttaaagaaccggcatctatatggatagcaacgtggcacgttagtttagaaccgacacctataatgccatatatgtgttagttcttacctaaaatccaacacctatatgtcttataggtgcctgttctacatccatattctaaactatagctggttcccaaccaaagtcatcagtgtgctaggtactggttgagaaatctggctcctatgactagttcccaagcaacacctaacatgttttctctagtattgtggtttgatttgattgactaatgttataattgcttgctatttaatcagtcactgaacctaatcagcaacagaaaaatcttcattcggctaattgctcaattaataaccgagttaaaccaactagccagtcgctcgtgcggtgcgactggatcaagtatacgactttgggttatttgccgtagctcaactccattaacttggaagaaaacggggagaaaataaaaccacttttaaggataatggttggggcatgtactgcaattttagggtcaacataccccactaccaatgttttctatcattacatagtgagagttaagattgtattcaaggtggcacaacggtctagtaatgtatttttgaagaatatggctaatgcaatgttagagaaatttgataaatattgggacagcacaaacaatatcatggttattgctacagtccttgatcaaaatgagatacattaaattgttcttcggaaaaaattatgactgcataagagctagcatacagcttgatgccatcactggtgagttggataagctatgaaagacattcgagaagatctatcgccagaaagtaggtgacaataacccacacgatgctcattcagcctcatcttggaaggatgcatgcaactctttggcttctattgttccaagtggattccagtcctctttgcaatctaatgctactgaatcttcaaagtatgaataactcatctatgttgatgaagcaactgtgcccatagataataatgcattcaacttacttggttattggaaggtaaatgctcataggtctcctgttttgtcgagtatggcaacgaatttcttttttttggctattcaagctagcagtgttttatcacagttcacttttagcactggacgtagagttatcgatgactatatgagttcaggcattggtttgtgctcaagttggataagagaccctcaaaatgagaatagttatccaaatacttgtggtttgtgtcgacgggtgatacccgtagaccggatatagagggtattggggtacgctggtacaaggatctacgtagtacgacatcgagcaatcaaaagacaagaattttactggttcaggccccttgataggtaatagccctaatccagttgacatgggattatatggtggaaaacacaggttacaaaggaaaagatggaactcggggggtttggcgagattgtagtcgagttgattcgactagctctcgtcgacttggctcctcgcaggctccggcttcgtaggctgtgtgggttgtgttggctctgagattcgatgatccatggcctccccggggggttccttttatatcgcaggtctgatgctctccgagtaggactcgaatatactagacctggcacgacacgtaggtaacccaattcttgtccgagaaggactctcctcatcaatcgatttcacgaaaggtttcctttaatcacaaaggaaatatccacgtacgcatagatatgccatgtcgttacgtgacgtacaccgaagggtagagggtatgcctgacccgtaaccctgacagtagcccccgacttctgctcaacaatgaactcgtacgaccattcgcgacttcaggtgtcgagaacgttgtcattccaggtgcgagaaccacggagatgatgtgtagtcgagcataccatttgaacccaacggtcacgagtgaattttgaactgaagtcaaaaaactgccacacgtaacggacctagaaatttccagcggggatttctctccgttccttggaattcgcaccatcgggagtgcggttatttaaagggattttgggtgcgcgttttgaagtccgcccactttgtcaagcacacactgctcattaacgctcctcgccttcttcgctgtcgcaaaaaaccctagcttcgtcagttttcgttcatctccggcgatcttccagcgacgatggatcttggcaagtcggcttccaccagcgcaaccctgaagaagctccaagaggatggcgcccttcctggccgtgaaaaggcagagagggaagcaggaggtactaatccacagcccctcttaggtcgcatggttgcgatcgaagactatgttgtctgcgggtttcttcctcccccctctgaattccttctgctagtctttaatttctatgggctttcacttctgcacttgaaccccaactccattgctttccttagtgtctttgtgcatctttatgaggcctacattggggtagagccctttcttgacctgttccgcttctactacgagttgcgctggatggaatccaatagggtgtctggatgcgtcgggttccgacttcgtgacggaatgaagtcgcggtatgtccccttccagtgtccctcttctcgcagtaaatggcggaacaggtggttttatcttgaggtcaaggattcggatccagtccttgttgttcccgaggagcaaccggacaaaattccggtttggaccgccaagccccctttgaccccctctctcgaatcgtttatcgacatcatcgatgatctccgagaacggggcttatcgggatatgaagtcgttgcagacttcgtcgggaggcgaatccagccgctccaggctcgggcccacccggcttataactattccggggcagatgacgcgacccgggtttctcctcggggtatccttctcgcattcattttgatatgcttgtactcacattccttttcgacttatcaaaaattgattctttcttgacaggtctgagcggcgaagtcgtgggacggcgcgtgagtcaagtaatgatcagcggcccgacaacagcgagcgacatccccgcgcccctttgtgaaagggaagcagcggagcgcgacgaggcaatcaatgtgagttcatttgataagcgtccgcctcccttgcacaaaatcggcttatgacatgatttagcgtaggcccttcctttgactgatgtcatcggtccgctcgcggatcatcaggtggcggcgtctctgaaggagaaggtcatccaggaggcgtccgatgctgccaccactagtggtggcaaagctccgactaagacgaggaaattctcatctgtactcggaaatcgccgcaaggcagaaactcccttggtaatttcctccttgtcattaggttgtgtagcgaggaaagtttgttctcactctttatcggttgtcttgtaggcttccgacgtgtctcctccgcccgcgcgacgtcagcgtattgtgacgatccgcgagaagtaagtgaagaatttttagactctcatatcttctgtttgagcggagttttgattcatggcggttaacagggaggcgcggtcgaaagctgctcggggcaagtctggggaaacgtccggcgcgtcccctgtcacggcgtcaacagatgttgtgcccgtggtcgggagtcgggaggcgacaccgaacggccccgtgggagatcccgtcgagggctgcggtctgtcagaggccgtcctcacctgggaggagcgccacgtcgagatgaggcgccttctcaaagccggtgcttgcggcgtggggcgcgaggtctcggaggcgagggcggagacggcggcggccaatgcgcgtgcggagctcttggtgcgggaactggctgaagcccgcgaggacctcacgaagatgagggagctggtggccggcaacgagcgccagcgcaaagggctcgaggaccgcatgtcggaactcggggataacctctccgagatccgtggttcgctgcgggtcacctacaccggtctccaccaacttgctgaggagtgcggcgtcaagtcctcgatcccggcgaaccccgacgagttctcgttgacctcttctcttgcggagctggcgacggcgatgggggaaatcccctccaggcacgtggccaggatcgcggaggagacgtccaacggtatctataccggggcgtgtcacgtcctcgcatgcgtgaagttgtcgtgtcctgaactcgatctgcgcgagatcttggatcagggagcggcaagcgacgcgcgcaaggaggtgatggaggaagtcggtgacctgggggagtatgtcctccccctttttgaagagtaggatctcttgtatattttttttctgacttgtaaatcttaaactctggttgccttcgtgcgcatgattaccatctttgttcaccgttgatctcggaaatctctcttatcgactgtagagatgctgatgacgaggatgtccggcaacgtgggcagcctgagtcactggcgataattccggtactcgagtttgaactgcacgcctcacatgacgtcgaggaccaaactcctgatgcggaggttgaagtgacgacaactgcctcaagtgagtagcctatcaaccttatcgttgttttgggggtttccgggttgtcttagtggtcgttacgtttagcagatctcgaggatgcccttgcgacccaaaatcgtcgtatccaatactggaagacgaaatttgaagtggcggaactcgagagagcaatgctagccgtaaagaatgagaaagctgtggaaacgctccgaggccgcgaggtgtggttctcgtcttacttgcagagttgctgcaccacgatggctagggtgtgccgggagttcgggtagtccgcggtgatcctaaggaatcggcggccgggtacatctcgtggctcaacggggcctgtgcccaactcaatggcattggcaagcgaatcgacgaggccttgaagcaagagtgtcgtcgagcgagccgatatgccggaggacacatgctggcttgcctgcgagatcaccgcccgcgcttggatctcgaatttttacgtgaaggttttttacattctcggaggaacccggcggagatagatcaccttgcgaggtcgatgtcgccgttggccgagaagattttccaatcaatggactggcgttggccgtcttggtaatgtttgtatcctgcgaccaaatattttaggggaagatgtaatgcagcgaaatatctatgtataaactgtaaggaatgttttgtgaataaagaaattaatctttaacaaatgttttcttactctggatgttgtgcataagagtgtgttctcagttaacgactttggttagccgtttgagtcgtacactctccctagcccccagccttgtcgtcggagggatttcctcaggtggcaaggctcttagacccttggcatgtcttggttgaataagctctgatcctagcccccagtcgtgaaggtggaaagctcggttttcgattacacggcttggttaatacgcacggcgagaactcttacacgaccagatctgacatggtcttttgtctctgaaggatctgataaggccttatcggctctgggcgtccctagccgaagatcccttaggttcctcggaggccttgtcgagacggcgtaaagggacataaggacaggtttcaacgctaggtgtcgtcagagtaaggggtcattgggtgaaaacactttggtcgtcatatgagaccaaggaataggctttattgatactgtaagggtgcttacaggtatagcggtattgactcatacatagaatttacgtagttggtcaatgttccacgaatttgctagttcgcgaccgtcgccgtcggcgattttgaatgcgcctggccgcaagacttgtgtgatcgtgttgggtccttcccattttggtgagagtttgtttcgccccgcttgagtttgaactcgcctgaggacatagtcgccgatcgaaagtatgcgtgctcggatgcgcttctcatgataacggcggagggcttgttgatagctagctgctcggacggcaactcgctcacgatgctcctcgagaaggtttacatcgatatctcgctgattctcctggttctcgtcggaatgcttctgtactcgtgtgctttgatgccgtaactcgtcggggagcatggcttcagaaccgtacacgaggaagaagggtgtttccttattggacgttgtcggtgtagtgcgcacggcccatagtactgatgggagttcttcaacccattttttgtcgtgtgacatgagtctgtcgtagacgcgggttttaatcccttgtagtactatgccgttcgccctttcggcttgtccattgctttgagggtgagagaccgaggcgaaacatattttgactcccaagccgatgcagtaatcctggaaatcggcgctgatgaattgagagccgttgtcggttatgatgcggtgcggtagtccgtatctgcaaaatatccctctgacgaacttgatggcgttatcggccttgatttccccggtgggtactgcttcgatccacttggtgaacttgttgatcgccacaaataggaatctgtagccgccctgtcctcgtgggaatggaccaagtatgtctagcccccagcatgagaacggccaagtcagagggatagtctggagcgcttgtgcaggcagctttttgtgcttgctgtggaattgacaggcttcacatcgctggaccatgtcgcatgcatctttaagggctgttggccagaagaacccttgtcgaaaggctttgccgaccaatgttcgaccggcggcatgtgacccgcatatgccttcatgtatgtcgaggaggagttgtttgccgtcgtcggtagagacgcatttgagaaatatcccatttggcgctttttttgtataaatcgttgccgatcatacagtaaatctttgctttgcgggttattttctcagcctctgtatcgtcttcgggtaactcctcgctgccgatgaatttgattaatgggctgcgccagtcgtctgtagtttcgatgtcagcaacttcgcattctgcctcagtgacctctgagctgatgtcgggggtgctcgggccaacttcgccgctaacttctttcaccgatggctttgtcagaacgtcgagaaaagtgccgggctcgagcggctctcgtctggatgcgcgtcgtgctaggtcatctggctcgacgttgtccttgcggtagacgtgccgaacctcgatcccatcgaacctcctctctagctttctgacttctgagagatacttggataactcggggttggagcatttgtagtctttgtgcacctggtttgcgactagctcagagtcccctttgatgattagtcgcttggccccaagtgcggctgcagctcgtatcccggcgagtagtccttcgtattctgcagtgttattggttgccctgaagttgaggtggatcgcgtgtttgaattgatctccagaaggagatgttaagataaatcctgcccctgctccttggctgttgagtgcgccatcgaacgccattgtccatgtctcattttcgccttggctgtctgacttgttatctggtatggtccaatcggccacgaagtcggcaagcacatgagatttgatggctgtttgcggcacaaagtggatatcaaattggcttagctcgactacccattttgcgatgcggccgacaacgtctttgtttctcacaacttcgccgagtgggaaggaggagacaactgtgactctgtgggcttgaaagtagtggcgtagcttccttgatgtcatgattactgcgtagagcagtttttgaatctatggatatcttgtctttgcgtcatggagagcttcgctgacgtaataaactggtcgctgcactttctctctctcaacgacaatgacggtgctaacggaatatggcgtagcggcaatataaaggaataattcttcattaggttggggagcaacgagtacagggggttttgataggtagcgcttgagtgcaataaatgcctcctcagcttcctgtgtccatacgaatttgtcttgtttcttcagcaaggcgaagaaaggctgtcctcgttctcccatcctggcgacgaatctgcttaatgctgccatacatccggttagcttctgtacctccttaagtcttgtgggcgacttcatgttctcaattgctttgatcttctcgggattcgcctctattcctctgccagaaacgaggaatccgagtaacttgcccgacggtactccgaacgtgcacttctctgggttgagcatgaggcgatatcgtcgggggttgtcgaacgtttcccgcaggtcatcgatcaatgagtcgcttgtcttggttttgacaacgatatcgtcgacataagcctcgacattgttgccaagctggttgctaagtgcgccctggaccgtgcgctggaaggtattcccggcggttatcagtccgaaaggcatcttaacgtaacaaaataccccgaatggcgtgatgaacactgttttctcctcgtcctctttcaccatactgatttggtggtaaccggagtaagcgtcgaggaagcttaaaagctcgcatccggctgttgaatccaccaactggtctattcaagggagaggaaagtgatccttggggcaggccttgttgaggtctgtgaagtcgacacacattctccattttccgttggccttccgcaccatgactgggttggctagccactctggatgaagtacttctctgatgaagccggctttgagaagtttgtcgagctcttctcgtatggcttgttttcaatctggtgcaaatctccgcagtctttgctttactggcttggcatcaggtcgcaccattagtttgtgctcaatcacctccctggggacccccggcatgtcggacggctgccaagcgaacacatcggcattatcgcggaggaaggtgatgagcgcgagttcctatttctcatctagtgtaaccccgattttgacagtcttgtcggggttagcaataaagagtggaacgatcttgatggcgcggtctggcttcggcgtcttgtttagcttgctcactttcttgggtggctcaaacgtggcgggtggggtgggcatttgctcgaccatgtcgaggctccgcttgtcgcactgcaccgccagttttgcgttcccttgaatagtgattgttcccttcggtcccggtatcttgagcacttgatatgcgtagtgggatgcggccatgaacttcgcaagtgcagttctcccgatgatggcgctgtaagctgtatcgaattcagcgacatcgaaggtgatctactctgttcagaagttgttggcttggccgaaggtcacaggcaacgtaatcttgcccaaaggtctggacgatgattgcggagtaattccatggaagggctgagtggttggtgtcaactcactctgcggaactcccattgcatccagagtgctggcaaagaggaggttgatcgagctgcctccgttgatgagaacccttgctaccttgacgttccgaatggtgggtttgaccacgatcggataccgtcctgggataacagaggtctttgggtggtcttctgccgagaactctattctctgctcagaccacttcatcttgggtgcagccccctgccaagtcgaacagacttcgcgttccactttcttgtattctcacttggaggaatacgttgtggagccaccgaagatgtgtgagacatggaggtcggagtctgggtacgcagaatctgattcgtgaggaggtgactcctcgttcttctcgacaacacgtacccgcttgcctttttcaaacgccatgtgcttctcgagcgactttttaaaaacaaggcaatcctccagagaatgtctgtccgttttgtgtatagggcaccatgatttttttgtatcgctgccttgtgggtctgggcgcttgggagggttcgcgtactctgctgcgaggacttccgcttgagcttttctcttcccgtttttgtgatttttcttcttgcttgactcagatgcgtctgcggttggtttcttctctcccccggtcttcggcttgtcgttcttgcgtcttagcgcgtcatccacgtgggcgcaccgctcaacgatctcgaataacctttgagtagttgtgatgcgtcttgttgccaacacctgggtagtgtagtgatctctgacaccggacttgaaggcgcaaattacagaagcatcggtaatctcgggaattgtgtttctgcactcgttgaagcgtcgaacgtatcccctcaatgattcccccgagttatgtgttaacgcgtgtaagtcgtcttcgatcgcgtggcgcttgtttgttccttggaaattggcgacgaactgttgccataggtctgaccacgaagagattgagtaggaggggagatgcatcagccacgaacgtgcagaacccttccacgcggttggtaaatagttcgccaacgcattgtcatctgctccggcagcataaagcactgtcgagtagacttgaaggaattcttctgggtcggtgctcccatcatacttttcaatagctccgggtcggaatctctcaggccatcggacatcacgtagggaacgacttaaagccctacacccagcactgggagcggtgggttgtcggtggtcgcgtgaccttctggatgtctgtctgacgatgaagaggacgcggatgatgatgatgatgacgatgggtcgcttggttccggcgtacgattacgaggatgacgacctggatctcgggaatcctgtcgtcgtctctcgctgttgtcttgtcacatcttgatttttgtttcaggatttataaattatttaataaattaataatataatttatattaaatgttctttaatttacaagtgaagttaaatgtgggaaataaaatttcttaaatctaaagcatggatggatttaatttttattaaattctccatgattaagtcaactctctgaaatattctcggatttttcggagctcaattcctaaatgatacaaagaacagttcagtaattatttgatcattaatgatctaatgatatttgttaagagcttttcttgtttaaaatccttaaattataaattgttgtttaaaaggaataattagaaaagatcttaaaagcctaaaagagaagatctaattttaatttgctaaatctcaacataaaattgggctagataaaatttcattaaatactttgcttaattctataattcctagatttttctgggatttatttgagctaaggaagtatttttaataaatggaattgcatttcatgaataatttaaattgaaaaaggtttttaaaagtcttcttttggctttgggccgaaagtcggcccaaaaccgctccctctctctcctcggcccagtccggcccagtccgctgagccgccgctcttctctctcggtgtcgctgacaggcgggacccacctgtcagggtcgtcgtcctcctcgcgccgccgccgccgcccgaaaccctagcgcaagccgccgccgtctccttccaaattcggccgatcctttccttctccggccgaatcttttgaggggaaatgatctcctcgatctcctcttccttttctcttatagaaactccggtcaatttcgtttggaaatcgacggacttgagttcgattcggatcgatctctctcctccgaacccttgctttcctccgccgtcgctgaagaccgccggagcaccgtcgccgccgtcgacccgatcttctccggcgctttttcctcgtcgccggcgccgtccgttgcttctccgccgcttctttggtcaccggtgagttcgccgcgtcgcgctctacgtcctggtgctcttcgtttgcgccgccgcgccgtcgttcaccggcgagcatgcgttgccgagccaccgccggtgctgacgtcatcgctgacgtcgttgctgacgtcatcgtcgccgtctgccgtgagccggtcgtggaccaatcgatctcggccgtccgttttggatagggtcgatctcggccgttcgtttccgtgagccgccgccgtgcgcccagttcaccgtgaacccgacccgctgacgcaataatcctcttttccttttcaaaaataattcattattgcgtcataattccattaaaatccatataagtgttttaatccgatttaatctttgaaaattcataactaattcactgtaactcagtttaatgtggttcaagttgcaaaaaattatataaaataaagatctacatattaaaattgtccataaattgaattaaatttatttaattctttttaaatgggctttaattagatttaatcttgtaaaattcgtaataaattcatatgaagtcagaatgaggccgttcaagtctcataattcatctaaaattatgatctacatgtttgtttacttttcatgtattgtttatttggtttttattagtctttttcttcgttttgcgtgttagcttgtcgtttccgtcgttgcgaaggttcgcgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcactgggtggtgtgaacctattcctttgttatggcctgtttacattgattactttattccttgataccttgggtgattataacttgactagttgagctatatatattggttcagctagatattagatatgattgcttagccatgcttagaaacattagcacactattgggataacttatgactcattatttaaggatggtttaatggtagctcatgatggtcaatcgtgattggttaattaattacttgccaactaaaacttgataatggtgggttgtgagcacatggttttgagagtcgtgctcatgacaattaaggaccggttcgcgagctactgttgtgaaacattaaccgtgccaaccacaagccagcgtgggcaacggctttaccttttgtataacatggttcattgcggagcaccagactgagaagtggcggagataagcccacgggggtcgctggggagtccatgcctctggtttttgagggggtgattatgatccaggaatggtgcgctgcggtggattgtgttatgcaaggggtactgtcacagcccctttccgaggtaccgtggtggtactgaggcacatggtgacatgatgtggggctgtgtcttgtgggtacagtggtacacctctggccagagtaaaactattcgaatagccgtgcccgcggttatgggcgagttgagcaatgtttttcgtgattagtcccacacctctcacaataattatagatgttatacctggtaataatttgcttagctcctggtttggagattagatctgtacagccaggtatggttgcttcagaatggttgggcctgagcagcatgggcgtgttgttcagtgttgattaaaatttctgattaattactccactgttttacttctcttaaatgttttgctaaatgctgcttttgcaaatgagcctatattatgccatcctttggtatccttgtgcacttgcatatttgctgtgtggcttgctgagtatgtcatatgctcaccttgcaataatcaatcaacctcagttgaagaataaagatcccgaaggagaagacgtttggcttataccccagttgagctgcctgtgggagtggagccggagcttcgctagattttattttccgctgcagttttcttcttggtgaggactaagtgcctcataagtaagtatttatcattttagttaatttgatgaatctgcatactaaattgtcagtttgtgtacctcggctgattcctggacgaggattatatgcacaaataagttcggaaattactagtgaatttctgggcgtgacatgtctcgacgccgatctccttcatcgtcgtcgttgcggcgacggccatgaccagtgttgtctggcccccgccggtcgcgatcgtcgtagtctcggtcctcgtttggacgatttcctcgatcatggcgtcgtgaggagacatgacgccgggaacggtttgcgtcatcccgtgtgcgtcgtgcttctcggcgaccgttgatttgatctcgaagatcgccagtgccacgaggtggaggggtagcttgttggggtgattccctccgttccggattttcaccattggcgtcgccgactggcgatcgattttgttgtgctgcggtggcggcttcttcgaacgcattgctaaggtcagtcaccgatgcccgtaatcgttccgtccaacgctcgaggtcgttgttcagaacgggatcgtaaggtgtttccctcagtatggcttgaacaaccctgatgtgctgggctggagtagtcgattgattcgccgtctccgcattggcttgtgctgacgtgccaacttcatcgatagccaataccttccgcgccgcgcctgacgtcgatgacccatagtcttcgaggagatgtaagacagatggttcgtggggatcgagatcgattaccccaacgaatcgatctgaggccggagtcgctccttgttccttgccgttatccctgacggggacgtatgacttaggagacggagttttcatggcgccgaggagaactttgcagcttgagaggtcgtgattctttgtcttatggataggacaatagtcgtcccgagttggagaagtacgctgaattccacgttctttgcaggcgcgaatttcagcacggacattgatgaatacccagcaatcttgaaaggtatgtttcttggttttgtggataggacaccaagacctggtagcttcggaagttatccttatcggcccgcgattcatgtcagaaggacaaagcttggccacatcagaatccttcacgagtttggacgtagtcggcaatccgttctccgtttcaacgggtggatttttcgacatggaggcgtcttggttcg

SEQ ID NO: 59882 - DNA, 5333 bp, Oryza sativa
  unsure (1)..(5333): unsure at all n locations
ccgccagtcgcccctcttgctcccgcgccgtgccgccctttctgcccccgcgggagcatccccgaagaccattgggccccgtgccacttttaatcgcgtcgcaatcgtgtaatggttcgtctaagcccgatcccgcactctcttttccctccttgcgctcggccacatcacccatttggcgagcctcgccgtcgtcgccggccgccgtcacacctctcctctcaaatccaagccgtggaatgagttccccttgacctcctctagctgccggtgatagacgcccttcccggctcgccgccgttcgccggcgcccttcggttgccgtgcgccgtccgatctgggcaagcccgggctccctctctcttgcgcttgcatggcagtccacatgggctcgaccaagtcggcgcatgccccgtcagcttctttctctccctccctcgcccgtgggctcggcccaccagccggcctcctcctcggcctatcaatacaatcaaagtccaattttactccctcctccaagtccagtgaccccaatcatgagctaaagtccataattgttccctccaaattgctcctccctcaccctttgattggccccacatgtcaatgagcgataaaagaatattcttttccatagaattcaataaatcatttctcctattccagaaattccatttaagcttccaaaattcatatctattgatccgtagctccgattgactccgttccacttccaataattccgtaaatttgagatctatataatggcactattaattagtctaaatagggtctttcttttggtcttgagcaaggcaagtcaccctttgaccaattgctcccttaattccaaaataattattattttgtttgcaacctgcattattagaaatacttaactcgcttggcctcggtctgcgtgccaaaccgatggacctacccagtagtcgcactaattcctgtaggccgttctaccctgattccttgtcgctccacctttgtggtacttcggtatccgtgctctctgagcgcgtataccaactattccacatacaccgttgtttgtcgataattgaggaaatgggttcgagaagccttgaaaacccgacatgtggtgtcagtgtgtttgaaaataaaataaattgtgaaaactcgcgatacaggggttgtgcctgtgtggcgttgtcccgtatttgcatataaggaccaattcatgtgggaaattcatccgagcatataacaagtgcgaccacacgggtagaatgagacgctcttggttgagtaaatagcaaaccagggaagccttgatgccaagagacaagtggattcaccggggtggtgtcgaggagaaccactgggcttcctggcacggtatggtctaggacctaacctgttgttggtttgggacccctctcgttggcatatggcgactctgtatcggttttcgaaatgccttgtcatgaaagccttaaggtctcccgacgtggctgatctccacgggctgggtgatccgagttagtaatgttgtgtgggtaaagtgtaccccatctgcagaggttaactaactgttcgagcagccgtgcccacggtcatgtgctgatttgaggtgtttcccgttgcgtagttttgtttgcatgtgctttctgaaaagttgttgtggatgggaatcgttaccagaatcaacctatgtggcagatggatgacctgaatggtcagaaacggatctatatgattcagatgtctacgggcattatagactaggcttcccgagtggaagcagattgttgtgctgctgggcaacatgactctgggagtccgagaaaatgaaaaggctctaggagccgattaataagagaaatggctctgggagccaagaagtaatgatacgacccgggaggtcagtacattaccatttgagttgttgaaaagcatctcttaagtcgaatcgagacgcaagtctcttttcgacccaaacctgaaaagaaataaatcacctaatgatttcaaataaaaaatttgcataacaaccttgcctctcttccaagctgaagttgaagaagaagtaaagtgaagattagggttacgtcttggttcccagccatcgcctgtggtgttgggtgttagtccattggttccactgctgctactgttgttggtgtttgcctcgtatgtcgtcggttctattctcgggctgtcctgagctataatctaagttaaggaaaataagtcctctatttattttaagaattacaattattcatatttgtcaccgtgggtaccagcgctattgtcgtgggattgctattgagatcgcggtttcgtaggaagcggttcgcgccgtttttcctacggcatgctcctgttaggtgccgttgtacggcggtgccggatcgggatgtgacacttgattgtacccggacggggtccatttggtcatctatacctcaatgttcagaccgcaagcaaattacccactcccattttgcttcagttacctcatgaatccgctgctgacggccgccgccgccgtcgtcttgtgcttcctcctccatggcgcggccgcctccggcgacccgttccctccacggttcaactccatcttcagcttcgggagctcctactccgacaccggcaacttcgtcctccagtccgccggcctcccgtccatccccttcaaccactccccctacggcgacaccttcttccgccgccccaccggccgcccctccgacggccgccttcccatcgacttcatcggtacgtgttctacgcagttgccgtcgccgtcgccgccgttgttgattaatttctcgttgctgtgtgattgatgctgttttggcaatggcgcgcggcagcggaggcgctagggctcccactcgtgccgccgttcctggcgaaggaggcgaacgacttcggcggcggcggcggcgccaacttcgccatcgtcggcggcacggcgctggacgtcgggttcttcatccggcgcaacaacgcgagcgtgccgccgttccagagctccctccgcgtgcagatcgggtggctccggagcctcctgaggcgcgccggcaacgccaccgcgacggagcgcctcgcgacggcgctgttcgtcgtcggcgagttcggaggcagcgactacaggtacctcctctccggcggcaagagcctcgagcaggccaagtccttcgtgccggaggtcgtgcgagccatctgccgaggcgtcgaggtaactaaaacagtaaaaacacaaacaccattgcccaatgtccattgcatttgctcgcatttgtcgccgccggcgccgactaagactacgagtgtgtctgtgtgtgtgcagaggctagtggaggaaggagcgaggtacgtggtggtgacagggacgccgccggcggggtgcatgccngatggagctgaccaagtacgcggcagccaacgcgtcgtcggcggcggcggcgtatgatcgtcggacggggtgcctccggcggctcaacgggctggctcagtaccacaactggctgctccgggaggctgtggagcgcatgcgcggcaagtatccgacgacaaagctcgtctacgccgacttctacaagccggtggcgagcctcgtccggcgaccggcaaagttcggtaagtcgccgcgccgagattttttttcctgctttaattacccagtttcatattgtaagtcgtttgactttttttctagtcaaacttctttaaatttgatcaaatttatagaaaaatatactaacatttttaatacaaaacaaacatattatcaaaatatattcaatattaaatttattaaacctaatttaatgttgtaaatattgctattttttctataaacttggtaaaatctaaataattttcactaagaaaaaagtcaaacaacttatagtatgaaacggatggagtattttctactagaaggaaaaacaaaaaggaaaattgtaattatttgtttcgagtacaaatcggatgcactgacatggttacacccacacacatggacatatcctagctagcacaaatctaaagagactgaaggcctaacataaagacgcgaatattagagaatgaccttatattagataattagaaggggtgagacttcgaatccaggtcgtctagtctaccatcttgtggaagtggccgaaagacccctgtacgtttctcattgaaggcctaacatcgtgtagcgggtacatactttgtcaagcccaaaataatttgaacctttaacaaaatttgaacaaatttgaccaaatcagaaaaaaaatatataatacttccctcgaaataatttcaaaattttcggtcaggaattttaaaccatggtcagccgtaccacctgaaacttgaattgggtcgttagattgcaccacaggtaatctgattagctgagctcggaaaacaaatcctaataggctcaaattttgatgaattgtaatttgatttatcttttatagatcgacatcgatcagccatcgtcgtagctatagctcataaatgcgagtgtgcgacagtagccatgtacacacgtaaagagatataagagcaggtacaatagcaggctataaactagctgcaaacatattttaaggagataaataaggagagagaagagtagcgggctacaaatttatagccagctgtagcacggactccaagacacagtgtgtatatgacaagtgggaccatatattaatggtgtagtatgtaactattgtatgaataagctattagattggctatagataaattggagctagtagttggctatactattaaacttgctctaatgcctgattagtgaagtcaaattggttgatgaaacctaaagcgatagaacaattaactgcgctagcttgagtacttgagcacttccaagagctttgcaacttacgaaattttagaatctttaggtacgttaagccatgaactatgtcgggaaggcaaagccgaagaagttacaagattattgtggcttgtggatcgagaaactagctataaagtctacaatcacagtatctttttatgaaaacaatctggcatgcagctgtaattttgttgggtgtcacacaaaataatctaccagccagcttgggtcaactctgctagcatataaaattacaaaacacttgtagaaacccaatgaaccctgttaggtttgttgacataagggctggtttggttttaggcctaaattagacttatcaatatttggcaaatttaatagtgtttagtatctatttggtttgaagccaaattttgacatgcctaagaaaataggccatttcaatagtgaacttaggctattttagcttcaatcc

SEQ ID NO: 59883 - DNA, 694 bp, Oryza sativa
tcaatctactatctcatctccctttctctgcttttcccatcttctctgctcgtcgccaccacggggcgacggccgacttggcagccgcgtcctcgccctcccacgttccactcgtatcccattagatcacttcccggagctcgtgacaacttggtatcagagactatggttcaaggcgactcttccgccgtcgccaaactccaggacaccatgtctgatgttctatccgggctctcgctcttggcttccaaaagcgatctcgtggacctacgtcgctcggtggccgtcgtcacttcacgcctaacatccctggaacaacaccatggattgtcagctccaccgaacaattcatcggcgccacgcctcggtggcaccggcatcctgccgaacccatctcagttgccgtccggcgctgacaccgcgacagaacacagctccgacagtggcaacaatggtggtggcgttccacgctactacaagctggagttcccaaagttcgacagcaaggaagatcctctgaattggctcaatcactgtgagcaattctttcatggccaacgcacggatgctggcgatcgcgtgtggctcgcgacataccacctcaccggcaatgcgcaagaatggtacttccaccatgaacaacacaaggggccaccagattgggacaccttcaatgatctctgctacgcccagt

SEQ ID NO: 59884 - DNA, 1583 bp, Oryza sativa
ggaggaggtcgccgggtgagcgttggtcgaggaagcggcgaggagcgccatggcggtgccggctggccggtggccttttgtgagctcgtcgaggaggagctgtgcatgggccttggcgaaaggtggggaacgggacttgcagcggcaggagggagggaaggttgtcgaacttgtcgttgaggctgccaatgagcatgaggacgagggagcggtccttgatggactcgccgacgtcggcaaggttgtcagtgaggaccttgagccggcggcagtagtcacctatggagagatcaccttgctggagatgatggacctcagcggtgaggttgacagcgcgccgctcgccattgtcgaggaagtgcagctcgagatcacgccaaactgagcgggtggtcgtggtgggagagatgacttcctgcatgagagtggcagagattgaaccgtaaagccatccgagaacgacgcaatccatctgcgtccagtcggcttggttgaggcgaggaacatcggagaagacatgctcggtgagagcaaacttgccgagcgccacaacgaagagaccacgcctatgggagcagttgtcggtgtcgaggttgagggtgacggggacgagcgccttcacgttgaggacggcgatggcttgattgtgaagcgtggcgatggcgtcggtgtcgatagtcagcggtggcacgacggcgtcctatgacggggcggccagcgtgatgttgaaggcaaggcgagcaagggccgccagaacttcagggggaaggagcgccacgggcgtcgtcgggggcgcgaacgtcagcggaggcgcggtcctcgtcggcggaggtgcggttgtcactggagccagcggaggaaccgtggaggagacggcgtcgttggtggctggggtgtcgtaggctcttcggaccttccattataattgagagatgaaatgaataattcaagtcattaaacaagcataatgaaatatcctacgcctcgagagaggaatattggagacattactggtcctttagcctgccagtcaacttcagcctgagatgtgcccgtcaaaccactcgaaggcggtgaccagatgtgttacacattcaggagacttgacaaaaatggctaaagatctacaacatctcaaatattcttaactcatactcatgtgaatctagttcccaggatgtgcactagattcacactttcatctcaagcatgattatacatagcaaacacaataagatgaaagcgattataaactacatctactttagttacattggccgaccggccaaataaataatagaacagcggaagcttgtctacccaatccacaagcacaccgactaggggtttacaccattaagttcaagtcctacaagaagcagtcgattacctgcatcactcaaagactaagtctaaatcctgcaagcaaaagttaattcaacagcaagagtcagtatattattagaaataatgtactggcaagcaccaagacaagcctaacaccctacttgcaaggcatataatcaaggaaggcatagtatggttctttttagcataagcaagttttatttgcataaacacat

SEQ ID NO: 59885 - DNA, 826 bp, Oryza sativa
aagatggcaacccaaggttagtgtgcagataggcttacagactggatcaagaagaattcacacaaagaccttgtaattgtgtcgtgctctaagctcaaggggtggacgccctaaggctaaccctaggttgtcgttaatcatatttattcagtagccatcattgtttagagtcaggtttttcttagattatttccaacattacaatttcatcgctagttaggtttgtagaacccaacttcgagtgcataatcattcatctgcaactgagttgcaatctctcttagttttgtttgtgttattcggtttacatgtagggattagccttctcaatgaggtaaattggattttagcatgtttgattaccataagagatgtggtgctgcgattgtagagtttggattgtgttgatcagaaaccggatcatgcgcgtcaagttttcgtcaaatagagagttatcagtacctattagaagatcaggacctatttcctcatcagagtcagtctcaaggactacatatgccattaggaatagcaaattatgacaattaattgcaacaactgctgccaactaagctatgattattttgacgaaaggaaaagctatgtcaactttgtgtcgatggttgaaacacttcaagctacagttgatgaaatagttcatcgtaccttgttcgatcaatctggagttttgacggatatattgcaaaattcgatcaaaaggatagttgatgagttaattgtccaaagacgccagctcgggtggcagattgaagaacaacaacaatatcggctcggggggaaaacatatcagtatcagcatgatgag

SEQ ID NO: 59886 - DNA, 8643 bp, Oryza sativa
taagcagacagcacatgggtcaatacatacaggtgattggtttaagtacctccagccaaatccctgcaaaataaattgcaatggaactatcagatgttaccaacaaaagcactgcactatggttaaattttaaaaaatggaggataatacttatcaatgctgcacaattagagtaaacgaattggtctaagcatgtcatagcaaactaataactaagcaagtcaatgattacaaacatgaccagtactttagtactactactcatatatgtaacggaaaaggaagtaaagatattttagcagcaaccttacctggcaatgctcatgatactcataagcgggaggcacaaatatggagaaggaacagtgcgtattcgactctctggttctttgctaagaatttcctcaagagagttcctatgccatgagcgagctaccatcaacggggtccagctgcataagggaaatgaaacatatgcttttaactactaggttttaaaattaacagaaacagtgatagttctttcactatgccccgtgaaaaaagatagctctttaaccatgtatcaaaacttcagaatcatacccgctagcattctgtgcagaaaggctagctcctcgagcaataagaagctgcatcaaacagcttctggttagatatgttgataaaactagacaaacatttaaattatgaaaaagccttcagactggcagaacatacttgacaacagacagcattcccaccacatgcagcataatgaagcggggtgctaccagctcctggcagatggaagcaacaaaatattacatctagatatatgagaatataaacagagtagaaagctggaagaatcaagaactgtagatagtatggacaacttggtgatacattcaaacatgttaagcgctacatgccctaagagtgtgctccaacattatcaaattgaaaaacaccaagcacagaaaggaaagttaaagttgcaaaaaaatacctattaagtcaatagttgttccatcttcaatagtggcctcaataacagatgctcccaagtccagtaacaattgcacacactctacatgcccatttaacgctgccatatgaagcggagtcagtcctccatccgccttctgatttaccatcttgaacaaaccactgctaacacagacatactatttgaatgattcatggtcggtttaacaaccaataaaccaatgggaaacaatcaaggggctctaacatactcttcatcaagatcagcagatggaccttcttcagataggctgtccttcatcgagttccagaagtttggcatgctgggaacataatccgcaagcacaagacgaaggcaccgggcatgaccatgtagtgcagcaaaatggagagcactaccgccattcaaataatctgtcctatgaacctaaaatacgttccaatgcctcaggattagatatccaagcgactagaaatttctcagtgaacagcaagcaaaatactcacatttgcattgaaaagcatcagtgtctgaacaacctcccagtggccatattgacaggcttgcattaaagcagtctacatacaatgaaaatttatagcatattgccatagcatttcgcaagtgaaacttaaacgagtaaatgtaccagaaatcttggtttacctggcccctgtaattcctgaggttgatctcgacgccggattcgagcaacagagaaacaatctgaacatgcaagcaacagacaatgtgaatgcagttcttttacccatctatacagaagcactgatacttcagctacatttttggcagacaaatggcatcacctcatggtgaccctgcgcggcggcgtagtgcagcggcgagttgcggccgccgaaagtggagtaccgggcgagccgcgggttgtactcgagcagcgcgcgcgcctcctgcaggtcgccgtcgcgggccgccgagacgagccgctcgccggaagccgagcacccaaatgagttgcccacaaggctgaggaaccccatggatgctcgaagctgaggatctcctctcttagcgtgcacgggaaggcctcgaatcgaagacttcaccctgaaatttcccaatccacgaggccgcccaaaccgcattcgattcaagaatgatcaccagacaggatcaagctcccgactttaggcatgccgacgatctttaaccccaaggttcagaaagcccaaaattttcctgcaaaatcgtcaaattcatcacgggaagcggcaaattgacgggaaatttcagcttgacgcctaccaattgcagcgagactaccaacaattcgacccaaaaaagccaactttccgcgctacaccaagaaatcagagtggaactcactcctcctcgggaatcgcccagggtcgtcggtcccgagctggaagaaatgcaaaaccgagaccgaccgacaacgccctctaaatcaggcccccaatcctcgcaagaaaacaagggacctcgaactcgaagggggaatcctcggaggcgacctgccgcctcgaatcctcagaacccaccccacacccacgattccagcgaggggggggactggatggatggattggggaatcgcggggtgcaaacaacgccgatgcgattcacaagaaaatgcactcgttgttgcaatccggcgacaagggacaggaaggagaaaggaataatgatctgatggagacggcgacgtggagatgcaggtagtggccaaagatgatgtttttctttcttttggcccaaaatcttctagtgctacaggaacaggaagtaattaaaacaagagccaatagataatcagttgtataaactacctcctacatcccaaaataataactactccctccatcccaaaatatagagagttttagagttggatacagttattaataaagtacttcctccgattcacaatgtaaatcattctagcattttccatatttatattgatgttaatgaatctagacatatatatatttatattgatgttttagaagtaaatagaaagagaaaaactaaaccacggtatcccgtggggacgggatagcgctcatccacccgagccccatctgtttgtcgctctctcttcagataatttccatgcctcgtcaactcagctccctaccgacatggccagcggcggcgacgacgactccgcctccgcgctccgacaacgccccgcacgagctgttcatcttctccacgtctcgcaggcggacgatgacttcgcctccgcgctccgacgaagcctcgccggtggagccggagcgggaggcggcgggcgaggtcgaggagcataagcggctcggcaagcgatgcgcgcagcgcgtccaccagcggcgccgccgccacgagcgggaggtgcgccgacacgagctttctcgaaggtgtggtccaggtgtcgcgctaccgtcgtcttgcctccatgctccaccacgcggctgccttatcctctctctcctcctcctcctcctccaggctaccaggtaccaggtaccacgggtaccaggtatcgtgggtgtcgacgtttgatgtcgcgattccggtatttgcatagtatggggatcgttggtactaggatatacgcgagactgaggtaaaagagacgaagacgaggatttttatacaggttcaggcccctgaattgtcaggtaataaccctacatcctgttggccgaagccggtcattgctcttattcaccataatcacaccagtacaatatttggggtagtctatctaactgttgtcgacatggcggtttgaaggtctgactcgtagtcgacaacagggtagtcttcctcctcgagttcgtgcccggtgagatcagagatagcgctttcgtctctcctgacagtatccggagacaccgtaagggactagccgtgcttatccctgaagtcgatatccggtgtcttgtcttggcgtatgttggcttgtatgttgatcttgtgtcttgatctatgttccgtgtcgtctatggtgggtgtgtcccctctcctcctagggggtcctgtatttatacccataggtgtccccttgtccaagtagaactagggaaaccaatatggatacaatccgagtagtccttgtcgtttccatgtagaactctggttgtctttccttatccggaactcctcctatatccgcaggctgtttccgtataggacatggtatgtggtgggtcctgccaagatttagtcgactactattaggtatgtggtatccataaccatgacaacgggtaccaggtaccacctggtacctagtacccggtacccgtgatacctggtactctaggtaccatacttggtacatgtgagtattaggcttgatacctttcatcatcgagatggccggcggtagcggcggcaaggtacgtagtgtggttgtacatgacggcagtgtattgcagtagggaagggaacatggacaaactcgatgtgggcgacgtcctcgacgagcagctcgaagtggcggccgacgcacgtcaggaagagtcgcgtggcttcacagctttgttggaagcttgcatgtgggggtgaggtgcgcgacttcggggatatatgcggcgttatgctgtcgccccgagtgatgcgaagggcatcccgttcccacgggatcccgtgaggtagcagccctcaaatagaaaggagttgtgattggttgagaagtcgagataggtgggaaatgtgaatattggagggttacgattagttaggaagtgaatattggtggagaagttatattttgagacaattcataagtgctaaaagctgttatattttgggacgaagggagtagaactaaatgagacattttctaatactagcaatttggtccattcgattctaaattattatattttgagatggagtgagtgtcgacgtttgatgtcgcaattctggtatttgcatggtatggggatagtcggtgctaggatatacgcaagactgaggtaaaagagatggagacagggatttttatacaggttcgggcccctgagttgtcaggtaataaccctacatcctgttggccgaagccggtattgctcttattcaccataatcacacgagtacaatatttggggtagccaatctaactgttgtcgacatggcggtctgacgatctgactcatagttgacaacagggtagccttcctcctcgaatccgtacctggcgagatcagagatagcgctttcgtttctcctgatagtatgcggagacaccgtagggtattagccatgcttatccctgaagtcgatatccggcagcgtgtcttggtgtatgtaggcttctatgttgattgtgttgggtgttgatcctgtcgggtgttgatcccgttgggtgttgattgtcttatcccccctctcctcctaggaggtcctgtatttatacccataggtgtccccttgtccaagtagaactaggaaaaccaatatagatacaatccgagtagtccttgtcgtatccatgtagaactctggttgtctttcctaacccggaactccctcgaggtcagtttccatataagacatggtatgtagtggatcctgccgaaatttagtcaactaatattaggtatgtggtatccataactctgacagtagcccccgacttcgatgcaaatgaacgagttcatattctcaaccgcagactttggaggaactgttatcgagctcacatgaccgttctcggtgagtttagagataacgttagacttcctttattagcctcatgcgggcaccgaaagggtttgtctaagtcaatctctgatgtcgaccgagaaagtacagagcgtacgactaagtctcccgtcttgctgtaatcgagaatttggattgaagtcaagaaactttatctcggcgggtacaccatctcttcattccgtattctttgtcgagatccagcaaccgttctcgagtgatcgagaaggcgtagagtctgcgacggagccttgtcgacatttgtcgtactcgccttagtcgatcttggtgtagaaccatagagacatggagtcttcgataatgtcgaatagaattttcctgaaatcaatactcagaaaagaatattagatagaaatagcccccgagcgaattctcaaagggtgacatgttataatatggcagactagtgaattgaatgtacagaccagtgctttgtatatgagcgtcttctctcttaccgactccgatcagtcagtttgtagagtcatacactctccctagcccccagccttgtcgtcggagaatcgttctcagaagataaggctcttggacctttgacctgcctcggttgaacaagcactgatcctagcccccagctgtgaagttggaaaatccatttccgattacacagcttggttaatacgcacggcgagaactcttacatgaccagatcttacatggtctttcgtctctgaaggatccgacaaggccttatcggctctgggcgtccccaaccgaagttcccttaggttcctcggaggccttgtcaagacggcgtaaagggacagtaggataggtttcaacgctaggtgtcatctgggtaagggatctctgggtaaaacacttggcgatcttatgcacctgatatcaactttgttgaaagaggggtaatgggagaatcgctacatcgctggtcgaggaccaggcagtagtcgtaactcgaccacttgaagtggaagtagtgggagaaacgctacatcgctggtcgaggaccaggcagtagtcgtaactcgaccacttaaagtggaactagtgggagaaacgctacatcgctggtcgaggaccatgcagtagtcgtgactcaaccacttaaagtgaggcgagagagatcactatgttttactggttcgagaaccagaagtaggagtcttttaatcacctataggggcgctaaagttagtttattacatgtgcatatcatgtggccagcatgactcacatacccaacttatagcatatccggatgtccgctcgcaatcatgtcgggtgattaaaccgacggcgtttgcgaggaattatccgttaacgaccttttctcgagtagtccagccatggccggtgttatgagataggtcgtcggtcttcgttggtaagttgggtgcgacgactccgtatttgtcgagaatgttctcgatagtggggtgtactcgaccataacctactcgagtgctcaaatgttgctgaaaaatattttctagaaggcaagacatatagcagagaatatcgagtatgtactaaaaactgcatggatcttctagtaatatcaggatataacgagcagatgtaaatatcaggcattatgtaacaagcatgacttatacagaagaagacagagcgagcccccacctttagatcgtagtcgatttaacatcagggacacccgcgcaacagatattattgtataaaaagcgtgctctgggtaaacataataaattatggatctgacaatactgtatgatctgaataggtacgataaattgcagataaaatattgtgtacctttgtagatacatgccggatgtatctacgaaattagtagatcaattttaaaaaaccaatctaccaattaccttgctgcgtactcgttcgatatcaggcgatctgacatcttttggtacgccgcggagcttgaggcttggatgatctcgatagaccaagttgtcgatgacgatgatggttccgatctagtcagaagatgtacttggacaggttggatctccccacagccgaagtcgtcgagtagcttgttgtcggagagtccatctcttaaacccatctcgtcgaaatcctgaagcaccaaaatccccctacctggcgcgccactgtcgacgtttgatgtcgcaattctggtatttgcatggtatggggatcgtcgatgctaggatatacgcaagactgaggtaaaagagatggagacagggatttttatacaggttcgggcccctgagttgtcaggtaataaccctacattctgttggccgaagccggtattgctcttattcaccataatcacacgagtacaatatttggggtagccaatctaactgttgtcgacatggcggtctgacgatctgactcgtagtcgacaacaaggtagccttcctcctcgaatccgtgcccggcgagatcagagatagcgctttcgtttctcccgacagtattcggagacaccgtagggtattagccgtgcttatccctgaagtcgatatccggcggcgtgtcttggcgtatgtaggcttctatgttgattgtgttgggtgttgatcctgtcgagtgttgatcccgttgggtgttgattgtcttgtcccccctctcctcctagggggtcctgtatttatacccataggtgtccccttgtccaagtagaactagggaaaccaatatggatacaatccgagtagttgttgtcgtttccatgtagaactctgattgtctttccttatccagaactccctcgaggtcagtttccgtataagacatggtatgtaatggatcctgccgagatttagtcaactactattaggtatgtggtatccataaccctgacagtgagtacttagcacgccttaagatgagttgggtgtttggattcttaattaacgagggagaaagcagatgacagccaatgg

SEQ ID NO: 59887 - DNA, 8311 bp, Oryza sativa
ataattgtgctttgagagcctcatctcatcccctttataatctctctctccatgggaagcaaagtaaggtgtgaaggcacctgagaggagagagcttgacaaagagcatcatgcatgatgcccaactaggcccacagtatggatggtgagggcgtgtagcaaaaaagaaggcataacctttttgggtgaaaaagaagaaaaggtcagggagtttgagacaccaatgaaaggaagagaaaggattagtcacttttgaaggcagaaagattgcactactaaaagtcatggggagaaggagaaaagagctcctgtcttttaagatgggctaattgcgaagtgggatgcactctgcagcaaagatgcccctctttgcataaagggagcaccccttctttctgtttgctagggaggggttttttggccacttaggattccttaaaaacaaatgtgaggtgccaagggaaagttggagccccataaaaggggcaaactccggctttgtatgaaaagttcctcaaagcatttttcgcagtggcttccccctttttctttttattagtcaagcataacaatcccttgctttctactgccaacacatttgctcattctttgtactagtaccaaaagaattttatgactgtactgcctctctactgttccatgtgttcataagcattaggtgcctttttttccactcaaggacttgcatgcattgcatgataacgaaaagattctccaattacaaaagaaggggctctgaactgaagtgacatgtgcaaaagcttctttcagcaacgatttgtgtcccatttctgataaacgaaaaacaatacggtccatcataagttaatgactttgtagataaccccttgctattggattgtgtttgctactactaatgaacagcccaacataagaggcagaaacaagataaaggcccagaccatttaggcctcatttggaagggccttaatccaggcccatccacatgtgatgggctgggattttgtgccttaatccaggcccattcacatgtgatgggctgggatttcgtcctatccaaacaaggcattaatttcgtactgtgcaacagagggatcagaaaacacacagaaggtgccttggaaacaagggttgcaagttgcaacactcaatatccagcaatctcgatctataattaattgagtacatataattgctaaaggcggtttaagtaacatgctggatagacctaacaacagtgattgacagaaacacggtataagcaagtgatgaagatattccacttcaaggaactgagaagcaagcagctatgcaggtacatgcattacatggttgggtcgaataattacagtgaactcggtaattctagcaaaattctgataaacacacgatatttgaccatttttgagcgccgtaaccgtaagcggggtgagtaatagatatgacatgcctgtggcctcacctgctgggaactgcactgcacgcgagctaggtttcgtaattagtagttctccacaattctgagtaccgacgaatatgttccaagagcagcgcttatggtgcccaatattattataccaatacttgcaacgacctgagattgaaacaaaaatgtcaaccacggatgtagttgacaaacaaaagaaacaaaaaagaaagagagcgatttttggtgttggtctaccacgcgatgtgcattttacctgggcagtcgttgctttattttgcctaatcttcaagaagcacagtgcaggcattatgacggcctgtaatcataaaaaaaaatgttgaaatgagtatgtttgttgctccttgttcaagggtttatctgaaaacaagattctagcaaaaaagagttcccccaggtattctcaccaaggatccattaagagccctccgagccttgaataacgcaaggcccaattcagaaatccaaggcatacgcagtgttgccaccaacacagatttataaggcccattccccattaccaggcttctgctatgccaggtttaaatttaagatccggttaaaaaaagggtttaaattttggttaaaaagcataggaaaccccaaacgaaggttttgatttaataactggatttaccatgccaaacaagtatagttaattgcacattagacaacatattttgactgggttgcgtaatacaaaggaattagcaatctttgagcatagaaccacctaaactgactccacactccacagaacaccagtttttgaccatttgatgggaaaaaaggtttagaagaaaaaaaatatcgcatctcaaattgcataaagttggtattttttcgagctaactcttcaaatgatcaaaacccagttttgtggaacattttaattatagagggagtgtctggaggtgtaagcggctaacccacaaatccaccggtttattttggcctataagtgggttcgcaggttagtcacttacatctttagtgtcatgcacaaaaggtacttataagtacatgatgttttgagaactcaagtagaatataggtggttaaatgagcaatttactaaaaaaaattctttctgagagaatgcagctaagagagtttcaggaaaaatgaagcagaattaggtacatatgccagaaaattgtgtatacgtaccgaaaaatggcataagaaacgcaatgcacacggttgatgcaacaagggcagtcctcagtataatagagcagattgtttcgttcaaaaatccttcagggcgcaactcctctaaactccgagccaatgggtttaacaacagggcatatctgttgtggttaaggatcaagccatatttttttttaaaaaaaaggatgaagcaattcctatgaataattaggcaggcacataaataatcacaatgtaatcctagaagccagaacactacaagttttgatattcaaaaggatacttggtgaaagggttgataacctgaaacacatgacaattcaatggtaaatattaagaaaaaaagaacagttgcagtttcaaaaactgtaatcaacaattctcaccgtggtccacagtgcgaccttggaggcaaatgaatgtttaggaagattcagagttatttgcgagagagttttatctccgaacatgagatagccaatgatagcaaacgagccatatattgctgtgcaaattgcaaaactgcacgacatgataattttagaacattgaaacatttaattactcaacatagttaatctgcatccgaatgaagttcacacataccatataaacagtgccttagtgaatttcgtgcggtctgacattgattggtaaatatttggaaacactgagtgcccagagtagcagaaaccataaatgccaatagcaaacggtataccacctaagtttactgctttcccagtcaaatgaaaccctacgccatcagtagcgccaactaaaacgacagagaggaaaacaagaagagttgcaataacaccacccgctgcacaagaaattcaataaaccttgtcaattcaatttgctgccttaatatcattaatgatcgcagtgagaaaaatacttgaggttaagagtgttgagaccagaaaggtaggagagaacccgaagatctctcaaccatactgtaggcaagactattagagcagtcaacactccaaagaaatgtttcccatcaatatggacgccaagccaatcaaaaccaatatgagagaaaattgatgtcatattatctccttccaaaataatgaattccacacaatatgactgcatccaatgaataacatatataagataatattttttttagaaaggattgaataagataaaagagtgctcagttggattgatcaataaaaataactagatgaataccccgccgcattgctacggaaaattaagttatataatatgtacaaataatatgtaatatgatcaaaactaaaacaaattggtacaattttgagcctaaaaataattaagattgcatagttttatgagagaagaagaagagacaatttgaaccatagatgtatcatctaaaggctaaaaataattgaggtgatgtggtttaatgagagaagagagaaatagcattaactacacttagtggggatgaactatataggattagatggaaaactttgcaacataaagccaggtgaaagctacttacatatagctcagtatagagtataatctgcaaaaacattaaagaaaaagaatcagccattgtttcttctctaccagaagttaaaattagttgcacaaaaaagtctgataaagatcaatataatatgcatttcatcagtcatgaggtatcaaacattgaaatgccatattttatagtttacaaatatgccatatgcactcctttttagtgggagtcagcattttagaaaaggaaaaagaaaatccagagcttgagcaggcaggtgtttctaccagttactgaaccttaagagagcgcttttcataagcatggatcatatcatcaataatcgcatacaagcaaggttatacaaaatagaaaactaatacagcttgcacagtggtggtgtctccattgtccaggttagtcttactctttgatacacttgcacgaattatttcgtttattaccatcaatggttgttcttacattgcaaaaaaaaaaaggaatagaagtttctacagattgtcattcttttaatttaatgaaaatcccagattattaaaaatgactttgattggtgctgagatattcggatgcaatcttgcatgcaatgcaatacaattcacttgataggaaagaaaccaggacttacagagatcagcagacgaccaatcctttcaaaagcagcctcgccaatgtctggatatgtagaaataccatctttgctctcaaaacagggtttcatcagaactcccgtataacagccaacaatagcaaacatagctaggaccgcaaggcctacccatccagctttatgaattgtaaatggagtggaaagaagtccaacaccagcaagtacattaacccctaccaaaagaacaagtaaacattaagcatttcttttatcttaggcaggtaattgagcaatctaacatgttaatgatagtaccattgaacaccgtctgtgtcacactgcatccttgagcgatgtagacttctccagtatgttgcgtaagtaacgagcttttcctatctattgctgaaccaagagtctttctcaagctcttgacagagtcttgcttcccatctagcttatcagacaacaagggcaacttcaggtcggatcccagactactacgaccaccatcaaggatcgagtatttgcttgtagagggacccaagtaaccaaagctcggagatgcagcaattgtataggtgtcagttgtttctctgcaaaacaaacagcatatcaccatcataatgtttgcacataacggttgggaagaaaacaaaacatgtggtttaacagctggcattcatcaagcttgggtattagattgccagcaaagcccttgtcttaatttttttgagacaaccaaaaacaactatacgatgtgtcagtacaaacaatcccctgatcgacaaagcaaaaatgattttgtacatattagtttaccatgatcagagtcagtgttaatgaaagcaaccaagtccacatcagcacagaactttcactaacaacagttggaattggcagagcaacaccaccactaaccatggcgcagtagagcacacaaatcaaacgatgtctgcacgaggagtcgatcaaacaaagagtgcagccataaaatgattttgtacgttaatagtttaccaccagcagaggtttttttttttttgaactagggcttgaaagcccccatttctattatcagaaatgcaacagtagtactctgctaaaacaagagaaaggaaaggagattacagcactcaggctgtgaattttttatagaccatagcactgtgtttcttaagcaaaatgagaggaattccaccccacatcccaacctggggacacagcaagcacagtttaccaccagcagagttagatagtgttaatggtcaaagttagtagtatcagaactagcgcaacaatatcccatcccaatcatcaggaaattgaaaacacaaccgggtccccgtcaacatacaattttcacaagcaacagtggaaactgccagagaaaccccaccagagcaaaccgcccccactaagcactaattgaacgcagtacagcagacagatcaaacgatgtctgcacggctgtagtacgagcgaggaggcgatcgaacagtgattgcgaccgcgcacgttgcggtttcagacccgtgctgtcggagcactgtcgaatcaatcagatgttctacgagtgctggtaaattctagaatccaggccactcggatcaaacatgaactgtttgcccgaactatcccaaccaaacacgtcaacgatcaatctagtattatccgaacaagcgctcagtccagtcccatcacgaaactcacaagttattccgtccagtacaattcaacgaaatctacccatcaacatgagatttcacaaacagcggttgaaatcgatagaactaccatgaaccatcaccaccaccaaaaacaaaaacaacgcagtaaacgaggaggaggatgaagcggagaatgcaacgacgtaccggtagctctgcggccactggcgggactggaacgagcgaggcgatcccaaaccttcgccgtcgtcatcccggtcgtcgtcgccgctcccgccgtcctcgtagtcgtcgtcgaagctgcggcgcgggctctcctcgatgtcgccgtcctccagcgtcatctcctcctcgtcctcctcctcctccttccggtgcttcgcctccgccgccgccgccgccgctgccatctcgcagtacgttcacagcagcgggcgaaacgcacaagtggaagcacacgaggttggaattggattgcgtgtggtggaatcggggggagagagagagagagaggaggcttcgggagagatggcgaagcggaggcaggtattgatggctgggattgggttggagtggcgcgaagccggaggaggggggtgaaatagaaaggcgggggagcgcgcgtcgcgacaagctggcagaggcgcggattggtcgaagaagccaaggtgggcgtgggcgcgggggtttattgagacggggaccccagtccacgtacgctgacatgtgggggaggttgcggtggggacgttgggttgaggcggtttcggcttgtgggggcgcgtgggcgtgtaagggcccgtttagtttccaattttttttcttcaaacttcaaacttgtcttttatattgaacttttttacacacataaattttcgacttttctatcgcatcgttttaatttcttcaaatttctaattttggcgtgaaactaaacacagcctaagagcaagtttaatagtatagcccactactaactccaattcatctatagccaatctaatatccaattcatacaataattacttactatattattaatacatggtcccacctatcctatatatattgtgtcttagagtctgtgctgcagctggctatagttttatagcacgctgctcttctctctcatcatttatctcattaaaatatgtttgtagctagctaatagtctgctattgtacatgctctaatccttagggctgacatgtggggccatgtggagactgaattatcgtagcgcagttgcagaccgatcagctgatttggcaacagtgatttctagagcacggaccattttatggatggaccgagtccctactaggatgggccctaaatatcccggggaggtccatactagcagggttcggctggacgacaaatggtagacatttgaatcagctgcacatgcacaaatcagtgaagtaataggctaagggcatgtttagttccttaaaaacatcacgtcgaatctttgaatatatatattaaacattaaatatagataaaaagaaaaactaattgcacagtttgcatgtaaatcgcgagacgaatcttttaagtttaattaggccatgattagccatacgtgctacagtaacccacatgttctaatgacggattaattaggcttaagagattcgtttcacggttttcaggcgagtcatgaaattagtttttttattcgtgtccaaaaacccctttcgacatccggtcaaacgtccgatgtgacatccgaaaattttcatttcaccaactaaacaggccctaagatagcctaaaatatctcgctgatacaaccaaatcacaaattgcagtgccagtgtccagtgtccaatttccag

SEQ ID NO: 59888 - DNA, 2135 bp, Oryza sativa
  unsure (1)..(2135): unsure at all n locations
tagcttccgcatttccccctctaggcgacatcaaggtcctttgaataagaatcaaaacctaaaccacgattgtgtgtgctaacgttagattgatcaagaatcatgtgaggctctttttaccatcagaaaatctttgcaaagaacttttaaataacaaacctgctgagtaagaatagcacaatttttacaagcatccaaaagacctttttgttttctacaagttgagcatgaaaacacctcatcttgtttaataatttcttccatgtgtttaacacgctctaaagcatctttcaacttcaactcattcaaaacacactttgagcaatcttgagaaatcaaaacaccattgttttgttttgccttatttgcacatgtagcattgaccaaagaatntgacaaaaagcatctttgtattttttcaaaacgttctttgtcaaaatctactcatcaacaacacgagcatgtaaagcaaatccaagagcaaaagaagactccaactttttagatttttcaatctcaaattctaatttcttggaattaacagaattgacatctcgcaaagcattaatttcagaaaataaaacttcacaagattgacaattatcatcattaggaatcaaagattttaatctagcaatttcagcattaagaatctcaatagtatgatccttctcatcaagcacaatagaacatgtttgaagtttcttagcaaatttataagcagcatattctaattgatcataactaagcttttcttcattatcatcattagattcatcaacatcagaacttgcattacgagcaataaaagctagatcaacttgcttacctttgctctcatcttcatcttccgattcatcaaaagcttttataatttcttggattaaccactgaatacaatgcttcttcttctccttctccttcatgttcttcttcttattcacgtcatcatctttgactctaccatcatcttccttctttcctctcccaagcttaggacaatgcgagcgaagatgatcaagtgctccacactcaaaacaacgattcggttctcctcttttcctgttcctaacatttttcatagctcgagaaaatttgttagataacaaaaccaagtcctcctcctcgaactgtttgagttgatcatcggacatggcattaaataaagcaagaacagaagacttcgatgaagaagcaccaacatccaaagaagttgaagaaaaaaccaaagcactagacttagaatcaactttacgagtaagaatattcatctcatgagttttcaattttgtgtaaagcgaatccaaggtcaaagtagacatgttaacagactcctgaatagatgtaactttcatctcccaaatagacatgtcaagaccattcaaaaagtgacgagaaatctcagattgtggataattagcatcataagaagaatcaacagatctaagatcactcaaaattttattaaaccgagaaagatagtcatccaaagcttctctaggtttcatctcaaatttaatatactcctttttgaaaagatcacgacgaagttcgttaatattatttgttccttgatgaaaattactcaaagcaatccaaatctcatgagcagtttgaagatgagcaacacgatcataattcgaacgagaaatcccactcaaaagaatattgcgagctttgctattttgttcaaaagcagttttttcaacagcagtattaatagcttcaggactcacataaggatgagaaacttttttccaaatatcataatcttcagccataatataagattgcatcctactacaccaatgagaaaaatcggttccattgaaaacatgaggcttagttgaaaacctagcgggagtagccatggcaaaaactctagatcgataaaaatccaaaaaagaaaacaaggctctgataccacttgtaggatcgaatcacaagaactaagccaaccagaggggggtgaatggttgatatacccaaaaaccaaaacttatagcggaaataaaagttaccctcaaattcgatggattgcggtctaaccgaaggtgttgcgctggtcgaaccgcctgatgaacgtcggtctgaccgagatcgaactccggtcgaaccgacgagatgcctgctgc

SEQ ID NO: 59889 - DNA, 1550 bp, Oryza sativa
aatggaaccagcaaattcagtatattttttatttttaaatgaacgataattgtcaggatattctcttttccaatcagtagtacactataatcaaaattcatttgaaagtgaaactgacctctatggtactgatgtatgctatagtaggaaggaggaaaactaaacagcaagtatatattcattttattttcaattttctctctagttcagtcactttcgaacagatgcataatagctgttgacaatctagtactgggatatgcacacacacatatacacatataagagacatggaacttgttagaatgtgattgtgtttatctgtttcccttctttccttatcccctccgatattgttctataaatcggttgcggtagatatggaaggtttgggcctatatgtaatctgtcatatcgataatgcaatccattgtgtcgtgccaatcacactttcatggtatcaaactaggtttctttcctcgcttccgcctcttctccaccctagccgccggccggcgaatcctaccgctgccatggccgctccttcctctctcactggggactccatccacgacgacaccatcaaggtcatcaccgacgctgttcgctcctccttccaacaccctcccgggtttgatgacgcccaggccaccgctgtcgctggcgacgctgccgaacgcgcgcgaccgcggctcgcaccgccctcgcccctgtgttcctcggcatcttccagccggccccatgtaacatacctgaattctaggattaaggaatttccatcaaaactagttgaaagggaagttcttcaattttgtaaaccaaaaatttccattttaaacctaggtgaagttgatccaactcttgcatgaataaaatttgagagcaaattaaaactttttcatctttaacctaggacttggatgcaacccaagtgaaagcatgcatactcgcataaatcatattttgacttgagtccttcatatgcatttggattttcgatttgcatttcataataggtctcatgaatataattgcaatccagacaaacaactaaaccattagggcctagtgctaactaatggaaaataatacataggaaccataatacaccttaaaatatatcaacaagaacaatgtcaagccctacaaaactaatttggtcatccatctgaagactagtcatgaacatggaagtgaacaaataaattaactcatatagggtatattccaccttaattacctttataagcattctcttaatttaatactagagtaaacttatgcataaatagttaaggagcttatgaaatgaggtaaactaaaattctaacatatcaacatcacctcaggttaagaagagtctaaatataaaagttttaaaaacatttacatacatttaggaaaggaaaataagtcttgctaattatctaaaataatctgtgcaagataaaatcattggaaaattcatgtaggctctaattaacatatacaacacacagtaatttcggtacaatttaataactaaatttgatacctcaaataaatcagtt

SEQ ID NO: 59890 - DNA, 1174 bp, Oryza sativa
cgcgctcttctttcgcttgtatcgagaagccttgcagacaagacaagcatctaagttcgcgtattgcttgtggtacaatatgcaatcatttggacacgcgtgaattctccggacctctaaccctaggggacacagaacctgttttgcttcatatgtcgtctcgggcaatgtgttctcctgaggaagcatgtccttcagtattcccaaaagttctgtaaaactcttgtctgaccatccactactagccttcaacttcattaggtctaatgttgctgataatttggtgtgctttggcttgcatcctgcgtataaaggagtctccgagtcactgaccaacctgctgaacttcatggaatctctctcgttcatagctgggtcatcaacgtcacgtaacatgtcttgcagcatatcagggtccacatcaactatttcaccgcccaatggagatgggacaaacatgtcatgctcttcttcatctccttcttcatgattgtctgcaccactcccgtctgcagctgcaccatcagtaccaagatcttgctctccatgcatcatcacccaacatgtgtatctctccatgaatccccggcgtatcaagtgagcgtgtacttccttttcatcttcccacaaaatctcattcctgcaatcactacatggacaacacatgtacttgtcgtttcttcttatcctatcctcctctgcggcttttatgaaacttaatacaccatctctatactccttgtactgacgcctcaagccagtcgtgtacatccaacttcgatccatcgctgaacaatgaacacaatattagttaacatctcataacataagtactactaaattaacaggaaatgtttagtaccttttacttacttttatgatttttcctgtttttgtttgcaaaaaaattacaaaaattcgcccccttcaacctcccaccaaaatagtgaacagtgggataaactacagacaacggactgctggagtatatatagtgtgcaaagtatatctcaatcgggccaaaaaaatgtcatctctaacgggcgcacactaatctctaacgggcacaaatagaagcctgacaccgataagagtcatcggtgacgggcattaaggccatctcaatcgggccttctttggagcccgacaccgatgacactcatcggtgacgggc

SEQ ID NO: 59891 - DNA, 19723 bp, Oryza sativa
  unsure (1)..(19723): unsure at all n locations
aagtctttgcagcagacttttgcccaaacatattctctaaaaaaattacatgaaatatcctaattaatagatataaatgccgtctcaggactcaatccgtgcatgacaatcctcatgaagctcattaactcaacccgacaatgtgtaccgcgtcacattgtcggactcggctcaatcggctaaccttgtccaactcggactctgccgatcccggtcatagcagatgcggactttagcagatccttgctctgtttccagaacgacttccatcttggattccgcctcaattttatctccatctctgatactgaaattaccaaatttggttgttaacaacgatccaaaaactgcataaataggtgatgacgatccaaaaactgcagctgttcaaccatcatgttataagcacctttacgaaaaatatatatatgtatatttgatagaatatggtatgttcggttatcagcacatgtgctctatcatcaaggttgtgttattaccgagagttagctaaaattaattatattggttccaggtgaagtgttaaaaaacttttcaagaaataaaaatagggaaagagagtaagagacaaagtgagcagtggatacactgtaggtaccttccatatgataagatcaacatagtcttgaaagtgaaaatagaacttcttcttcagatgctggactctcagtaaacaaatccatgggttcaacaaacaattaaaacaaaaaattttgctccacaacaaattaagttacaaagacggcacacagcagtaccaatgaaagacggcacacagcatagcaagttccaaaattcggcagtatttatcccctcaaaaaaaatcagcagtattttatttcactcttattgggtactccctccgtttcataatgtaagattttctagcattgcccacatacatatagatattaatgaatctaaacacatacatatatctagattcattaacatctaaatgaatatgagcaatgctagaaagtcttacattgtgaaatggaggaagtagcagttagcactattgttagcaagatggcagcaccatatcataactaaacttgaaccattaatctagccatagtaaaaatggattaataagatacattttcttgctaagaatcaggtgtgcgagagcttacagtgcaggtgagtatttgatggcactggtgcaaatcagcttcctctagatggtagcaaaaagaatatctgcagaaatgatgaggtctgatttagaaatgcaaatcctttggtcattacgaagcaccgttttatttcaaaaaatcctagaactagtggaatgcaatcatgtaatccttaaaaaatgaagtataaaacttcaggggaacatttaacccagtggcatttggcacagcaagggcataaacaatgatgatccacctcattacctctccaattttgagcatgtacttatgtatatatgtaatactaaaatacagatatacagaaaacaagaagaaatggtattttacaaagaaatggtttaggaagatgcatgtgctacctctaccaaaccataatttggggtgtacctcaactccagtagcaattgaatagaacaggtaaaataagagttctgctaccttcaaatccaagcttgaacatttctttgatatatccgtagaactcagttctatcactgtcttttccctgtcctattgtcactaagccactatttattgtaactgcctttgtcatcaccttctcatgtttatctgtccagaaacctcatttatgtcatatgtactatgtattaactcaagtgtggaatcctttagctgaaattagcactcatataaaatcatgtctgtgagactctacatgtcaaggtatagcgtatgcattaagcatgctgtgatcaacaaacataatgtagaagggcaataaaaaaatgagaaattacctgctggtagaaccacgccaagcaccattccgtacaagtttttctttatgtgttatatttggttcaccacgtctcttccactcctgacctataattctctatagaaataaaatgcatgcatgtcagcaaacggaaataaaatattgtgatgatctagaaaaaatatcccttctaaagctattttattgtgcatctctgaatgttatgcagcaacattgtgagctttttagtgaaaagaaaatttgagtatccaacaaactaagaccaatgttattagttatacaaactatagaatcccaaagcaccatgcaccatggaccatctcgtcatctataactaatgaaaaatgccatagtatttctgatgaataacatatatgcagcgattaagaatgcatgactagaaagtactgtggcgatatatagaaagctacagactgggtagctccttccggcataaaagcagatcgctaacaacaagcacctcgtgagaagcgatcttcgctaaaagtaactcagctgcaaaaagacagaaaatgtagctatgcagattgacatggcgcacagtgatgctcgctagcttactcttgtagtcttgtggccaccaaggagctggacagcgttcacaacgcgggcctggagcgcggtggtcacacggacgctcctctttgagcccggaagggacggccgccatatgctgccgccaccaagacgaccggagaagaaaaagaggggcattattggatctggagatggcggcctccccccttgccgcgctaggggatggatctggtggttttgagctcaaaaacgccggatctggtcgtccccagcttgcatcggccagatgaagggaagatgtaaggagatatggcggcggcggcgtcgctggggatagtaaggtggagaaggaggaggcggtggcacttggccggggaggaaaaggggagggacggcggtggaactgggccggggaggattggaggagagggaggtggaggcagtactccgatgcggaggggaagcatgcggcggtccagaagacgaggaggtttcgaccaactcgccgccggcagcaccgccaactgctaaagtcggagggcctggcagccgacaaagatacgaggagcacccctcggtcgacatcctcgccgaggagccggcgtccacaagctgcaggctgcagcgcggacgagcgaaggagccaaggcggcagcggcggcggcggcggcggcgcgtgggaagaggagggagaggcggagataagcctgagcgcgagtggggactggatttggcgaggtgatgggggcacggactgctttgatcgtctgagaccgacggatcggacggctcacgcgaaggaaggttactgctgccctagaaagatgggaatttgtattcccgcgcaccaccagaaattgggaatttggagggaaaattttttgtttcattaaaactttaaccaattcatttttttacttgttgtaacgtgtagcttatttattattatatcactaaaaacatatacttctgttgggcaaagaacaatttcactctaataacatttagaatggaaaattttaaacttctaataggataatatttccatcaaactattgcaaactacataattgaagaaggtgtatcatgaatgcattacaaaatttttccatacgagcgtattaagaaataaaattttaaaatttgaaactagtttatctcactcattgacggagcgtggggctcctcaccgggagaccgtgcaagccccccttcgccggttcggccgggggcgctaagtgaggttcttcgccctcgatctgaggaacgtccgcgagagaggaagagcacaagacacgggcgacgtagacaggttcgggccgctgagaagcgtaacaccctactcctatgttctggtggatctgtgcgtgaaggaatacagagagctggagagcgagcccgagttcagggtctagcacccattccccttttttctcctccctccagagtccccctcccttctttttttttctcctaggcctgggcctcctttttatctagtcaggggtcaccacaagggcctctagctgcctaagaaaggaaacatgctttttacaatgagggctagtctacagccggaagtgacctctgacaagcagagcacacgcctcctgccccgctcgcccgcttttccggtggacgcccatttcaaccttcatttaatggccagcgacttccttgccatacttgcgctgaaacctggaatggctctgaccgggactgacataccaactctaggagttagcacgccggctccggctagggacgagagccaggaagctctcatcattccgacgggacggggcgaggcgtgtgacaggccgcctgttgccacctaacccgtgatctgaccggtctgtgaccggtcacacaccgcgactggtcacggaccggataagcgtgcgctgcgccgcattaaatgcggcgtggcgcgctcgtccaacctgctataaatgtgattaggtgagccccgctgtgctcacctaacccacacacatggcgccaaaaccacagggggtcggggcgccccagccctcggggccaaaacgagggcgccccagccctcggggccgaaacgggagcggtccgacccctcggggagacagagggaggggtggccacgtcatcctcgggcccgacccccccgagggggtcgggccacgtgggtgaccgcggctacccaagcctctagtcacgatacccccggccccatgtcaccgacactcatataaactttaaattggatgattttttttctaaatgtttctaaaatcatgctctgtcatgttattgtattcttactactattattttggccatttttcttatgactttgttttataaatttaaattttgaattttaaaacttcaaataatattttgaagtagtaaataatttcagctgaaaaagtcatgaacataaaacttgtagaactcattaagacatacaacttttattttggtcatttcttcattcaataaagtgatactaacattgttcacaaaatttacatatctctcatatagttttataaactttgtgaacaatattattatcactttgtcagatgaagaaatgactaaaataaaagttgtatgtcttaatgagttatacaactttgttgttgataactttttcagttgaaatcatttagtatttgaaaatgttgtttgaagttatcatattttgaaattcaaatttaaattgttcaaacaaagtcacataaaaaaagaccaaaacaaaaggtgtagatcttgataagttatacaactttgttatcgacaatttttccatttgaaatcatttactacccaaaaaattatttgaatttcttatattttaaaatttaaattttatatagttcaatcaaacttggatgaagaaatgaccaaaagaaaattggtagatctcaatgagttctacaagtttgtttttgacaattttttcatatgaattcatttagcattataaaattcaattcgaaattcttatatttttaaattaattttttaataactattttcacatgtggtcctcttaaagagccgcatgcaaaaatctattttcacatgcggactctttaagtggtccgcatgtaaaaatatttcacatctaaacaattttttccctcctatccacttcaaaatttttcatctcttcttctctcctctctctcccatctctggtattttcccctctcactctttctcttcctcactctcaccctctctcctgtctttctcttcctctctctctcatcccgcatatgcgggcggtgcgcccgaggaagaggcgctgggagcaggtgccgccgcggtggcggcggccaggagcggcgccgccccgcgacgcggactccggcgatgatggtaggggcaggcatgggagacggcggcggccttccctcacccggatctgccggcggctatcctcccccgccccgatctgccggcggcggccctcccccgcctggatccgccggtggccaccctaccctgccccgattcgccggcggcgctctcccggcggccggcgcctcctcgttggatccgggaaaggagtacgatgtcaacggtggcggcagcggcttgagaatgacggcgacagttggaggataaggacgacggtggcagcgactggaggacgaccacaggctggcaacggttacatttttcgatttttgaaatttttatttttatcgtgatttttcattttcgcatgcgactggcttatggttgcgctgaccgcatgcgaagatcgtgatctttgcagactctctcgtgcatgcggtccggccaaccgcatgcgaaaatgcatttcgcccatttgcaaaaatggttcttttagtagtgccgaaatttaatatttttgatatgtagctaataatatggaattgttcgcatgtaaatggtatattggtggcataataaaaaaaacatctcccatatctgtgacatattgatatgcgaacaaaatctgtaatatgtactatatataagttgtgtttctcacgagtcacgacgtggctttttatggctagagttcttttccataattgttttcgtaataacttttcgcacctggaggaaacggcagcacacacagacgggaagttccaaccccttcattgacatgcgggcccctccactagtttctccgttagttagttaggattaccgggtgtcatgtttaacaaacacggtaactaaaagctggagcgttgcttttccgtttcctctgtgccatttgcgtaccaaccacaagaaaaaacgttctcacagcaacagatgagtgcgcgccaacggaaaatgatctggagatgggactttgggacccatgttccctagtgtaccaacaaaacacttagtaatatttcagtgttacctagtatcaagagaacactctgtaaagagaatagttacgtggtgtatcttgaaaacactacggaactcaccgagtgccagaaaaaacacacggtacatctctagttacacccgggagagactcacatttggatcatgatcttgttgcttgtgagtgttcaggttaagcatcaaacaaagcttgttaagcggggaagtcaagtgcgtggcgtgaagaagccctcaggactatacggaggtgaaatgtctggtattaatccaaatgtgagccgtagtgttaggttcaagggctgatggatcgaattgattacgcccaacatggaaatttttgtttgatggtaggaagtttcatggttgtaatttgccagtaacagttttgcctagagagagagagagcatgcatgcattgtctttcaattttgtaccaactagagtgtagagccctcccagtcccagggtgagttgccggaagcatgtagaggcgcctggagcacgtcgtgcagggaatcggatcggaggattcggtggcagagatggaccaattggatactatcatggtcatggcgctgtctgcagtgtccagtaggattatgggagtgcgaggcgaaattttgtcaattaatatcaatattggcacacgtcgtgggtgcgatgtttctcaccggaatgaaaaaagttcaaggagcaccaaaatatgatttttggacatagtggagtgtattgggtgcgttcgtggaaaaaaaattacttcctgattcgcgcggcgaaattttctcaattaatgccaatattggcatatattgtcacacgtatgtgcaatgtttttgaccggaatgaaaatgttcaaaaagcactaaaacataatttttttgatatattggagtgtattgggtgcgttcgtggcaaaaaaaaatcacttcgtgattcgcgcggcaaacttttatcaattaatgccaatattggcacacgtgggtgcgatgtttctcaccggaatgaaaaagttcaaaaaaacaccaaaacatgatttttggatatattggagtgtattgggtgcgttcgtggaaaaaaatcacttcgtgatttgcgcggtgaaattttgtcaattaatgccaatattggcatatattggtacacgtaggtgcaatgtttgtgaccaaaatgaaaaagtttaaaaagtacaaaaacatgatttttggacatattagagtgtattgggtgcgttcgtggtaaaatatcacttcgtgatttgcgcggcgaacttttgtcaattaatgccaatattggcacacgtgtgtgcgatgcttctcaccggaatgaaaaagttcaaaagaacacaaaaacatgatttttggacatattggagtgtattgggtgcgttcgtggcaaaaaaaaaattaacccgtgattcgcgcggtgaatatttgtcaattaatgccaacattggcacacgtgggtgcgatgttttcaccggaatgaaaaagttcagaaagcacaaaataatgatttttggacatattggagtgtattgtatgagtccgtagcaaaaaatcactctgtgattcacgctgcgaacttttgataattaatgccaatattgacatatattggcatggtgggtgcgatattttcaccagaatgaaaaagttcaaaaagcaccaaaacatgatttttgaacatattggagtgtattgtgtgcgtccggggcaaaaaaatcactccgtgatttgcgcggcgaactattgtcaattagtaccaatattggtatatattggcacagtgggtgcgatgtttttcaccggaatgaaaatgttcaaaaagcacaaaaacatgatttttggacatattggagtgtattgagtgcgttcgtggcaaaaaatcactccgtgattcacgctgcgaacttttgtcaattaatgccaatattggcacacatgggtgcgatgtttttcactggaatgaaaaagttcaaaaagcataaaaaatgatttttggacatattggagtgtattgggtgcgtcttcggcaaaaaaattactatgtgattcgcgtgacgaacttttgtaaattaattcctatattggcatatatttgccaatttcaattggtcagtctagatctctgatccttcataactattcataaattcagattggcaaatgcaccatcatgcagaacaagattcagacgaatggttgtgacggtgtgttgaataaaattgcatctcttgatagcaccaagcaaatgcatgtggatagtgtagtactcacgtccaccaagcagtgttggtgctaatgcaatctggctgaaagtgtcctctttctgttgcattccatcgaacaggtggtctgcaatagacaagggtgacaaccacatcaaccaggaaagaataaaagcttctggaagctacatggccatcatccccagcgcatagagaaaaatcagaaattgtatcttgtgagaaatcagtattgacaaataggaactaaaccatccacacctaactcagtgttgctgatggtcagttcgtgcattcccagccctggtcgaagaagacaacaggacaatagtccggcagcgacaccaccactggcagccattaggatcagttcaattgcttaattgtacacataatcttctctgattcatgttccagttggaactcagtttgtgttaagaaatccttgaaccagaaatttagcccaaatttccagaccattttgtgtattaaatccctatccagaaatctgcaagggtacacaaaataacaagtaatatacagttcccaacgtaaataaagcataaatacttagagaagaggcacttagtcctcgcatcgaaacgaaaacagcagcagcggaaaaaggcgatcctagcggggcttcagctccactccataggcaacactcaactggggtctgagcctttgtcctttaacatcgtcttcagatcagaagcactacacttttcacttttgaaaagaggaataataccaaggctgagtacaaccaccatactcaccaagccacaccaatgatgcagacatgcaagggggtaaaaggatggcttgtggctctttgcataaaggcggttgcaaagcattttattgagcaaacggtaaaaaagttgattaattaaagtaatattaaatctccccagatcaacgctacaccacgttgaacaggccatccatcccacctgagctaaccagtgcattgagtcgatttattaggggtgacactgatcacagtgaatctggtcaatcgcccataaccacgggcacggctattcgaatagttttactttggccagaggtgcacaactgtaaccacaagatacaatccaccggcatgtcaccgtgctgtcacgtaaaatgaggaaaaactctaataaaaactaagtaaacagtatataaaaagtaaacaaacacgtagagctcaattttagatgaattttgcaaagttgaacggctcaatttggtgttcgtatgaattagatatgaattttagaagttttgagccatttaaatgaatttctataattattaaccgaatttattgcgcaattatcatgatttatgacgtcaccgaggggattggtggcgccgacaagcgggccccacctgtcggtggctcaagggaggcgggtgcacagtggaccgggtccacgcggcaccggcaagcgggcgcaccacgtggtggccatggcggacggagagggcgacgtggcgccgacatggcgccacgggggcaccgatgccgggtggcacggggagggccacgtgcacagcctagatcacccagagggggatcgggcggtcatgggctagcagggcggcagcagccggctgaccgatcaggaggcggcgccgccgggcccgatggtcgtcagcggcgagcggcggcgtcgcacatgggaggtggcgggggaaggagagggggctcaccgagaggacgtgatggcgaggcgaagatgggaaggcggccgacgacaaggattagcggcggcgcttctcgggttggggtcggggacggcgctccggcgactcctgagagtggtggaggtgcggccgagggccagcgggacctggggagcaaagaggaggggttagaggagggagaggcgtcgcggcatggcgaggaacgccggccgagcatggcgtttgcagcgggactcaccggggagcgaggggagatggttacaacggctcccggcagcagtgaggtggtggccgaggatctccttgcccttgcggagccgaaggaggtgacggcgcaccgtgaggaggtcggaaacagcggccggaggtgtcagtcacgcggcggtgacctcgggttcacggttgggtggtagttgcggtggctatttggggaaaccaagcgaaggccgggtgcgcggtgaggtgtggcgatgctagtggtgcgagcggcgcggcacggggactgcgggtaggggtggaaaaaaagcttgggctcgtgagctcagctcgggcttggctcgagctcgcttagcttggctcagctcgggcagtctgcgggagcagcggtggcaggcggctgaatagcgccggtgagcggcggaagaggtcggcacggcgggagcggatttttgggctggatggggaaaatggagcagcggccggggtgctacgcggtgcggcgaatgtagtggaggcggaggcgcggcttggcagtggctagggcagtggtggcgcgtggccggagctcaccggcgagcggcggtgcacgggctcggtgtggggagagcgagagagagtgcggcgggctctggaaagatggggaaaagagagagggagtcctgaggagcattttttataagctcggggaggggagaacgtgcccggacggggcggcaacgggcggcggcgtgggactccggcaatgtgggcgactggggcggctcggcgccgattttctcggggagagtgggggatttgagtggaggtgtcgacccccgattttggaaatcggaaatcttctgtgtttatcagtaccaatccctggatcagtagttggtacacacatacatagccgaatcacaacacatcacgtatgaattcaggctaagagagttaaatacttgcattagggccaggcaggccaacaactatcagagaaacaacagcggaaaacaaaataatacaagggcccggttgacatgccacaagcagtcgactggggaacgagacctagatcgaaaccgcactccgatcatcttgttaagtacgcaagcgtactaaaacaagggcttctcttcaacactctgctaaaagatatatatagagcaacaatgagtacaaaagtactcagcaagccaccacacaaaatgcagtaatgtacaggataatacaaggagtggctatggttactttgcgtaaagctgagttttcaaatatcatttcacaaacctaagacctagcataaactgatcaggttttaactccattgttcattaaacaacgacagttctatccaccatccattgtattcccaaggatagcttcccgccactggtcgtcatggttttctggggtctaccccttctcacctctcgagaagttgatccaccagtacaaaatcatcatgcatcatctcacccatcattttaagaatttagagtctagccaagtgtaatacatgtcccggtgctcaataaccgcgagcacgggtattcgaatagatttggtttactcacactgcagtggatgtacactttacccgtactccgcgactgcccaacacatgagcctcgtcccaacacatgagacgcgtcacggcaaagcctttcaataacctcacattggcagtacccactccatgaacttacatcctcatgcactctaggcgtcataagtttctagcagtgagaggagttctggctctcccgggaagggaagactcacacatgcattaagttatagttaagtttaggtttacacatggcagtcctaccgatggcgacaccactgtaggcacccgccccacgcggtcctaccaatggctgccccaccgtaggccctgcctcacacacatcaagaaaaccactatgcagggatactgcctccgctcggctatttacaacgctaggtctatacccactcgagaagtacggttgtacggaggtcgtttcatgcttagcttcatggctcgatccttaactgaacagggacggcactagcctttaccggacaccacccaagtcctccagccgccccaatcgaaaatagttgtttagtttcatttttcctttcacaaatcatgtcaccaatgtcatggcaatgtggcgctcatgtctccacatgccgtatctcaactactttccctaaggtagttgcccaagcatatagcatatcatgcaaaaaagttttagtatagttatttaaagaatagatagaaataagattgcgtccaatagcatttgaacctataccaaaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgagctcccaaccagtgggaggggaaagtgatctctgaccgcgtgcctgttgaagaatgagccggcgactcataggcagtggcttggttaagggaacggaacccaccggagccgtatatgagaatgcatgattctaaagtaccattactaagcttttgtcataattgactaaggactcatacgtaatcatgggtacaaggaaataatgaggtaaacaataatcaaaggcgtggcataataacaagtaggatattcatcattgcatgcaattttatttataaacaaaacaatttcgcaattgggaccaacatgctcaagggatggggtgatgacttgcctactcaggatagttcttattcttaatataatcttgatcaaccttcacctcctggaagctacatacgttgcctcacgactaaccgatatacaaattctataatacgcgagaaaaaccaatattcaaataacaatcaaatgtgcacaagaaaaatataatgatggtgtcgaacctagggttgctcatactattccggcttgctaatggattctaatcatgctaagggccaagattcttagtctttctattgtcatggcggcttattaggggctaatcatcatagtataaatgagatacacagtgctaatatgtggttaggatttataacaagtacctgtttactgtatgtgatggttctgttgactattcactggaggttaaccgaactatacatatactactccacatgatgacattgtaccgactaacttctaagtggtccaaatacaaccaactctgttattatttctcataaacaagttaaagattcatctataagtattaatattttagttataaaatatgaggctaaactttatgtaaataatttataagtcatgggtttaattacacaaccattaaatagtactagtagtctagtatcatcctatacattaatttgagacatcatttaaaattagtttgtgtggttggtacagtgacaagacatgttagagacaaatattcttacatctactttactgtaaaatataaattttatttgttagcacatttttaaattgactattatgcatcatcttgatattaattattttataattataaatatattttattaaataatgaattatataccattgaaaagaatatgaactttatatgaatttaggttcaagtttcactcaaatccgagtaagttacactagtttaaagattcaaataggaataattgcgaaatagcactgttcataattgattattttagttccgaatcattatccataacctaccgtgactgacaggtggggtcagggttttattattctttcagccgatttgttttaccccggataaaaattggagcgggcccggcttgtcagcgacttggccaggagtcgtcttctaccttcgtcttcttcttcctcccgaccgagcggaagcagcagggaaataaggcgcgcacggcaaggccggtcgagggcgacccgacggcggtgaggggagggtgcggcaaggctccggcgaccttcggccggcggccacagcgtaggatggtgcgggggcgagcagcgtcgcatggccgccatggccgaactcgggtagctaggggctagggtggtagggtttgtttccgaccaaactgatgagggattgagcatctatggtgtacgagttccgtttttacataaaaatagaaggaagagcccccgggatggcatgtccacgttgaactccatgggcggagctttggagctcgggcttggcactgctatggacctaatcgacgaaattgatgggggatttagttcccaggggactagtatgagtcacaggagcgaggaattaccgaggaaaggaggaacgacgaagttccatgtcgcggaacagaggcagacggcgttgatggcgcccgaaggtgttcgtcggcgttccttggcgtccaacctccccaatggcgacggcggcagcgcagctccgcctccacttcctccaacctccagctccggccagagagcctcgcaatggtgatctctagcagtggtgagagagtgatcgcaaggtgttcgatgaaatgcactcgagggaaaaaggcagagagggatggggtttttatgggggcttagcttagggtgtaaggaaaccatggggataagatcgccagcacatggcctggacgagctagagttcaatggcgatcggataagagcaatgaggtcgatgacacagataaagattgatctccttcaatactaaggttttgtgggccatcatcaccctataacctatagtctgcgagttttagccctagctggggaaggggactccgttttatccactggacacaaagaggggcgcatcgttttgtctagcgggtgcatggaggggcgacgggacgtcatggcgtttggataatggggtggatgtggcgatggcgacgcgcttatccaatcggcttcgttcctcatctcttggagcgacggctgaaggagatggcggcttgaccggggtcgagtcgcggacctgcctggcgtggcgcgggctcatgggagctggtccggttcagggttggacacggtgcggacatgatgttggtgcgagacgcgacgaagtggcgcacgagagggagtggcgcagtcagcctgggactgggagcggatggatgcggcgcgagggaagggatgcgcggcatttagcgcacgggcacgacgcggggcgcagtgcagagcgacgtacggaagaggcgcgacgcggacacaacgcggtctaggtgggaggcggctgtgttgggactcgggaggagttcggttcgggatagggctccggtcgagcacctggcggcccatgaacagtagccggctggaaaagagagagaaggaagaaaaggaaaaaggaaggaaagggaggggttaatctgcaaaatagttgggattggaattgagatgtagctccatacattttggattcaagaattcaaatattttatttgaatatttatttgcttattcattagttcccaaatgaatttgctttagattatccaaaaattttccaatataacttggagggtttgataattctaaaattaattaaaatatttaatgtgacgattacaatggtagtgatgtatttactctgtttatatatttatatgatgaattctataccatatggtacttgataaagtgttttaaatgttaatttaaatattccagcgaaacaatcatctatagatgagatcattgtaaagaagtggccattatttcatgtgagattggattcagatgaattcgatttaatcttaccgttttcatttgttacgtatgaaaccaagctatcaacatggtttgaatatttaatatttgatttataatttatagaaattaataattaacttttccttcatttagttttctgccttgtgcataatatttatgggatcgatagataacttattcttgcgatttgtacatctttaattttaatgtttcattgtgacaatttataatatccagcatgatgcaaaagttttaaaaagtttgaaattttagtgatttttattgtcgggaattttcagggtgttacaggaggaatggaggggagccgattccactcggtttgggcgcgagggcgcgagcgggagggcgccggattcggtgggacgtgggcggcaacggccggccatggtttcttcggcctgggaggccagaggtaggaggagggcctgacaggtggggttatcgggcccacctgtcggcgatggagggagagaggaggctggattagggaggtaaaatagactttggggagagagggccgagcaggccgagggaggggaagggaggccagcctggccgggaaggagggggagggaatgggccgagcccaaggaaggaaggggtaagattttctggtgtcgggacaacctgcccaatcagcgtcggaatatgcgatcaggtcgaccgtagtggaacgccgaaggtggacgacgaagtcaatggtgccgcgaacatagcacaggatgcgcttaagagcggcaagatgcggctcgtgcgggtcgtgcatgtgaagacatatctgctgcacggcataagagatgcctggcctggtgaaactcaagtactgcagggcgccaacaagactccggtagtcggtaggatcagcaacaggagcaccaacaatagctgacaacttggcatttgtatccactggggtcgagcacggcttgtagtcagtcatgcctgcatgctctagaatctcaagacagtactgccgctgactgaggtagaggccagaagactgtcgtgtgacagaaatgcctaagaagtggtgaaggctgccaagatccttcatggagaactccgactgtaacgaccgtatggtccagcgaagcagagcatcagaggaggctgtcaacataatgtcatccacatagagcagtaggtagaccgtattatcagcactgtgatggtagatgaatagagacgtatctgatttagcctcaacaaagccaagtgacaggagaaagctggcaaatcggctgtaccatgcccggggggcctgcttgacgccgtagagagacttgttgaggcgccacaccaagtcgggtttggttgggtcaacaaatcaagagacggcccagctggcgaggccggcccagtcggtgcgccgaccgaccgagcaagagaggacggcccaacaggcgaggctggctcagtcggcgcgccggccggccgagtagaggaggctgccccccaccccggagtggtaggtttgtcggactcgcaggccgccggaccagaacggggaaggcgggagcgatgtccaataggcgccggaataggagctgtaaaatcctccaaaaactccaaatcaatagcaatctcattattagtcatttcggctaacggaaaggacgtctcatcaaacaccacatgttgtgagatgataaccctgtcagtggcaaggtctaaacactgataccctttatggtggaggcgatagccgaggaacacacgcggaatggatcgtggggctagcttgtggggggcggtgacggacaggttggggtaacacttacagccaaacacgcgaaggtgggaataggatgggtgggcaccgcagagggcaaaaaagggtgtgcggtgttgtagattcttagttgggtggcggttgatgaggtgggtggcggtgtgaagggcctcaacccagtattgtgcgggaaggttggcttgaaaaagaaaggagcgcgtgatgttgttcagggaatgaagcatacgctcggccttaccgttctgtggggaggtgtgggggcaagacatccgcaaggagaccccgttggtgaggaagaaggagcgggcggaggagttgtcaaactccctaccgttgtcacactagatgctgtgaatggtcgtggcgaattgggtcttcacaaaggcaaaaaaatgagatagtgtagaaaatgtatcggatttaaagcgaagtgggaaggtccacacataatgcgagcaatcatcgagaatgacaagataatatttaaatcccgacacactaggaataggtgatgtccacaaatcacaatgcactaaatcaaagtttgccttggcccaactagtactagtggggaagggaagacacacatgacgacctaattggcaagtataacataaagaggtggtgactctgggtggtgggatgacagacgcctgtgcgaagcgaatgagagcctcatgaccaaattggccaagacgacaatgccaaaggtcaatgttggtggaggtagtgacaaaggcacgtgcagaggccgccgaagagtacgcatctgccgggagaggatagaggtcaccggaactattgcacctgacgatctcggccttggttgggtaatccttcacagagaggccaaaagggtcaagttcaacggatcaccaattatcacgagaaaaacggcatgcggaaataaggctcttaataatctcaggggaaatgagaacattgttaaggacaaaggaatgattagggtaatgtaaaaaggcacgaccaatagaggtaatagggagaagggagccattgccaacaataatatgagagggagtattgcgggtggagctttgggaggtggtgagggtaccggtgttagacatcatatcagaggaaccacctgagtccatgtaccatttggtggagggcggagtggtcaacgtcaccgtgttgtacgcgctggcgaggacccagtccactggaaaggggactgtgcttgtgctgca

SEQ ID NO: 59892 - DNA, 588 bp, Oryza sativa
ggtcaaaaacatcgcaccctcgtgtgccaatattggcattaattgacaaaagttcgccgcgcgaatcacgaagtgactttttgccacaaacgcacccaatacactccaatatgtccaaaaatcttgttgtggtgctttttgaactttttcattccggtcaaaaacatcgcacctgtgtgggccaatattggcattaattgacaaaagttcaccgtgcgaatcacgaagggttgtggtgctttttgaactttttcgttctggtcaaaaacatcgcacctatgtgggccaatatacaccaatattggcattaattgacaaaagttcgtcgcgcgaaccacgaagtgagtttttgacacgaacgcacccaatacactccaatatgtccaaacatcatgttttggcttttttgaacttttttattccggtcaaaaacatcgcaccctcgtgtgccaacattggcattaattgacaaaagttcaccgcgcgaatcacgaagtgagtttttgccacgaacgcacccaatacactctaatatgtccaaaaatcttgttgtggtgctttttgaactttttcattccggtcaaaaac

SEQ ID NO: 59893 - DNA, 3922 bp, Oryza sativa
agatagtaatgctgaataaaaatcccaagtcacttgcccttagttgctggtctacttgtgtcctagatagtagtggttacaattatggctcaagaaataaaatgacactagtaagcagcaaagaaagacttgcaggcaagcttcggcgagtttcagcaaaaactacaaaaccaaactggcagataagctcaacggagcgcgtcgtgagctcaatgcactagtggaaatcaacttttcttttttttttcttttatttttttatattttttcttttttcagaacatgaaaataggcacacctccaagttacagctcaatcggagtagatatgtggcatatggatttttctgaaaccactataaacaaggtgcaggaacttgtgagctcgaacagacaattttgcaagccaaattttggaattttggattcgccaaacccaccgaagggttatcttcggtcaattcccattgactcggaaagaatttggacgtagaccaaaaccattcgaaatgttatcttcttagctttccatacatataaagaacgccccaatccgagcacgtatgcgacctaggcgcccgttttagtgcagactggtcctggactccgaattgcacccgacgtcgacttggtttgggcctccaccttgacttggacgtcctcgatgatcctccatggctctaagtccttctccaagtgtccccttatcccctccattgttcctaatcacaacataatcattaggtagcaatctattttcgaattcatacaaagaagaacataggaacgagctcacctctaaatttaattgtcgcgcacgagctcttgttatcggtccttgaatgaccgttggaggattgttgtgtgtatccgaattagtgatgtccgcatcatacacaaccatcaaaaatcataaacaacagaattatataactcaatgagatctacaactattgtattggtcctttgtacaaataaattcatttgaacaattcaaattttgaattttcaaaatttgacaacttcgaacaaaaattaggattaataaatgattcgaaatgggaaagttatcaaaaccaaagttgtagagctcatcgaggtgcaaaatttttattttggtcatttctccatctgactctatttaaacaaattgaaatttgaaattcaaagtttgagaaattaaaatataattttttgttagtgaacgactttaactgaaaaagtcatcaacaacaaagttgtataactcatcaagatctataacttttattttggtcatttttctatataatatttttttgaaccatttgaatttgaatttgaaaatatgacaacttcaaacaacattttcaaatactaaatgattttaactgaaaaagttatcaacaacaaagttgaataactcatcaatatctataacttttatttcggtcatttttctatataatattttttgaaccgtttgaatttgaatttaaaaatatgacaacttcaaacaatattttcaaatactaatgatttcaactgaaaaagttatcaaaaccaaagttgtagagctcatcgaggtgcaaaatttttattttggtcatttcttcatctgataaaatattagtaatattgttcacaaattttacatataggtgttatagtttataaaaccacataagagatatatcaattttgtgaacaatgttactatcactttatcaggtgaagaaatgaccaaaataaaagttttagatcttgatgagttgttcaactttgctgtggataactttttcagttgaaatcatttagtatttgaaaatggtgttagaagttgcaatatgttcaaattcaaattcaaatgggtcaaaaaaatattatatagaaaaatgacaaaaataaaagttatagatcttgatgagtcatacaactttattgttgatgacttttccatttgatatcatttactacgcgtaaaattattttgactcataaattgaattattatactgcaagttaataatattgctatagttcaacttacaaatataaacatttcatatgtaaaatgaaaaaatactcatcggtgacgggctttaggtaatgcccgatagagattaagtcatgtcaactggggattagtatataacccgtcactgatgagtcatcggtgacgggcctcaagttggtgcacgtcacggatgatggtcatctgtgacgggctccaacttaaggcccgtttgagatatggaatgttatctcaatcgggcctaaagttggtgcccgtcatggatgatggtcatctgtgacgggccctaacttcaggcccgtttaagatatagaatgttatctcaatcgggcctaaactacggcccgtcactgataggtgtcatccgtgacggccttaagttttatgcccatataatatgtttgtgcgaccatatatcaatcgggcactttttcagcccgattgagatgacttccttgtgacggcccgctattttcaagcttgttagaggccgtcacagatagaaggatctgtactagtgtacgcacgagcctgtagctactgactatatgattttgtagtgcatgattatagttttcacttaatggtagtgcatagaaaattaggatgatctgccatttaagttgcttttaggttgtattcaacggtttaaatcatgccgatcatacagaccatcactatatcactcacgcatgttgttcaatatagtttagttattttattgacaatagtaagcttggattcatatcatcgtagttttttttattgttcctatgtgtgcgtactttaaatccatatagacccttctgcaagactgcagctatgcttaacttaatatcaggaacatctataatgtaatatggaaatagctttctgttgcaggctttgccgctccatgcttaacctcttttaccctaaaaaataaacaattttgtacatatattttggaataaatatacctccttcacatataccatatactatatatagtatacgatttgtccgctgcagttatatgtattgttcttcttagtaacattttcttgtacatatatagcattattgttttgtctatactaaaagtattttatgcttattgcagattccatatggcgcatgtacttatttcacagctatcatttggagattcaaacaaaagaatccatgcaagggtctccaggctatggaactttactgatctcaacgatgatacaaaaattttccacactgatcttgtcttactcgatgaaatagtaataatttacctgccaaatccattttcttatttgccttactataccaataattctcttgataacatgatttgtatttataatctgcaggggactagcatacatgcccaaatttatccccctataacagaaaagatgaaacctctccttaaggaagaaaaggtttactacattgactcattcactattagggctgcaaacagaacatacaggccagttgcaaacaacctaatgatcctcttcagtaaatggacaacacttgaagaacacattaatgtccctcctcatttccctagtattacattttcactgacaccatttgaagatgttccttcgcttgtcgagaagaattcattctacgttggtaataacatacttttattgtgttacaactattgttatatgcgtcttctgcaatgccatatcattttattaaatttttatgcaatgcaaacagacattatgggtgtgatcactgaagttggtgcagtcactactatacgtcctaagtccagaaacgctgagagcctaaaaaggacattacagatccgcgatgcaaggtttgtttagtacagctaaatatttacatttttattatttacttaatctttttcgctagcattcacacaaactatctcacatattcttaacactaa

SEQ ID NO: 59894 - DNA, 10033 bp, Oryza sativa
ccaatatgatattttcactgtcctcttatgcagggaacacgttttatagtaaatgtgactgttagaaggatatgcaatgaatattcttgctggtacaattcatgtcgaatatgctataaaacttcaaaaccatatggctctagctacagatgctccagctgttctaacatcggaataccagatccaaggttcataatagaacacgctctgtcttcctacatctttagcaattatcatccacacattgctatggccatatccatttttcatgcaggtacaaagtagtattaattgccggcgatgatgatgctaatgctacatttatccttttcggaaggatcgcacaacgcctactacgcaggccaatagaatctctcattgaagaaaatccaccaaacagtgaatacattccaagtgaaatcacgtcacttattggcagcaattttgcatggaatgttagctttacgcgggatactgtcatgaggagtcaagagtgcctacaggttaatagcattatatcctctggtgcttcaaaccagccactactccttatgtccccagatgcttcaagttcactatcgctcagggaacacaggacaccccaactagcaaatcaaattcttcaacacctaccaagaaatgcattgttgtctcagtgtcttgcctgcagtctagcaggaccaaacctaaaactgatgataaggtaaccactttatagccacccttaaacttgctgtcactcatactgaattacatccactctcacttctttcctaattttgcaagcccaaaactaacacaaaagctgaagaaaacacctcacatgataaatcttcaattgttgtcctgcttgatactactgaaaataaggtactactacatctctttcctttcagctcattcattaagacttaaccgccacttcttttacaagggaaagggacaaactgccaaagaagccaaacaagcaaccccatcattccctacagataccccagccaaaaaaaaggtgctttgatcactcctaggtgcattccaataataaagctttcttccattgtaactaacacatcgtttcaataaacagaggaatgcctacacctacagcaacacctccggtagctaagaaattgttcaagtatggtgcccagcaaaaaggcaatgacaggttactcctcaaacacaaactcacctatctacacataacaaattagcaatttaaaggcatttcctaatctcacaactcttaatttcatctacacagtgaatgagttgtcgacgtgcaatccatctcaagacttttgcttatatatatgtacaaagctatgtcccagctagaagacagatggcagttgtgaaattacccaagactaaagaaccaagatcttttgttcatggctttttgtcatgattatcattgtatataagtgttgccttatctaccttccttagaattgtatgatacaagatgctagcatctgctaccaatgctatagaacatagtatgtatatgcatgcattctagctgaatgacttgcctttatactatctaagtagttccagtaaaatgcctgccgttacactaataagctatccctcttgacacccttcttcacaaatgctcagaattcaatgcttcaaactaattcattctttttcaccacctaaaacagcaaaaaaaaaaacacagccaatttcccaaaaaagaaaaaacacagctaatttcctaaaaaagaataaagcgcgctcccgctctagtgccatacaatgcatgagcttctccctttatcctccccatcttccatatttgtactatcttattactaatgttaaaaacattttttctcataaactagttgtccaatctacgttctgatcataccgatttattcgttgtaccgatttattcgtagtaactaaattttgaaacaagatatcacatgattatattctataaaacaaaaaatatagataaaatccggcacctaaactatagttgcatttttaaaaaaaacgggtacctttatttattttatagataccggtttatgtaaaaattggtagctatagtatttaaaccttttttttataaaaccggcaactataaaagtcgatccagcacctcctccaccacaataaaatttgatcttatccacactcccattgtcgtcatctctctctcgcacttctccttcccactcttctctccatccgctgcatgtcctctccccatcttctcctttgcatccgttagccgcaccgcctcccattcccatcccccaaaaccctaaccccctcgcccgccaccagcgccgccatggtcagcttgtgctcctcctctcgcttcgatttggtttttgagatgaagggtcggtggaggagggagggggcggcagctatggccatgcgactaaacgaggctgtgtggcatgcgactggtgggagcgtgtggcgtcgacgtcaggagctggcgttcttgtgggcagactgcgaatccgggtatgatggccccgccgctgtctcccccttctcctcctctaaatctggcaatggtagcagtgatggagaaggtggtggctggtggccgggaaggaggtggaggtggagcagcctgaaggacctccgttgccagatccggcggctggcagcgaggtctatgacgagctccatgaggggagaagtgcgcaactagtactttatattagtattgattaaatgaaaaaccgcacacacacacagcgctgtacacacacgctgaacgcacccccttataacaccactgtacacgcatatgcacaaacacccactgtacagacacacacaagatgtaaacttgcagcaattcccactttcccagacaacagtaaatttatatcagaagtgcaccctcatgtgttctactgtgagcaccaggtttcggactttcggtgaacatgaattcactatggcaccttcggtgctttcccgacaacagggttggcatttgttctcgtacaccggcaattgttaagactgagttttttttaaggcaaaattggttttatagcattgaaagttctcgattttggctatatagcagcaaaagtttatggttcactttaataacactgaaaattacctcctttactacttttagcattccgtcagtagttccgtctcctcaccccatcctacacacatgtcttcttcctcctgcactctgccagtctgcctcgtatggccgaccactcttcaaggcagcaagcgagcttgacctcgacagtatagtgctgagtgggttggagggtggctggatcaggcaagctagaggtggcatctcttgggtcagcagacaactggtccagggcaaggaggagggggtcggcactcaggtgaaaccgcgacgagcgcgagggtggtgctttgaggcgagttcgagccttcgagggccgatggatgagctcgagggtggcgtgttcgggcgagctcaatggcgccaacaatgagctggaggacgttgtttccgttcaggcccaaggatgcctgtgacgagctggacaacaacgcttcgggcgggctcgaacgcgtcgatggatgagcttgaggatgacgcatcagggggagaccaggggcagcacgcccggacgaacttggaagcggcgcggccgcggaggtggacctggttaagcacgcggcatttgaacaagctctagcatggcggtgcggcagatgagatcgacgatggcgttgtctggcaagcacggaccaacatggcttgcggatagggttggcgtacatgacgagcttgtggagccagcgtcctgcgttcgcaccatggctgaccagcctgacctcgtgtatgactgccatttaggggtgacgaggaaggaacagggcaccgctggtgtttgatatcttttttttttgttgttgaaaaacaataagaagaaaacaaaactaactgaagtttggacggaatgctaaaaataagtaacggaagtaactctcggtgctactaaagtgaaccatgaactttcaatgctataaaaccaaaattgagaactttcgatgcttcagaaccaattttgcttttttttaatgcaaaacgagaccagcgatcaacaaatgattaatcgagggtaattattacaaagttgaaacatagatttatttaattttttttaaaaaaaattacatagaaaagttttacatgaaacataattctaaaaatgtgttcacaataaacaagtagtggcaaacatgagacaagatgtagtcatacagtaaagtattattataatatatggcgtgaactgaaggtattgcattagtataagtacactatattgactgccaaaatgtagggttgaatttgtaggatcatgtgcttacgataggttctatggtaaatgatatagtttaaatgaatcttcaaataaatattatatagatataccttttagagcaacacacttacgtactacggttctaggcacaacttcataagtattaagagaataaggacctaatacattcggcatgtcgaatctaagaagtcacagtcttgttagatttccgtcaacttcatatgttgattttcaaatagactttaataattattttctccttatgtgttggttttttatccgtcattatgaagttgcctgcatatttactctccttgagataatgatgtactgtaacaagtagttgcagcttcttaaaggctaagatttattccattatcttaaaaaatgtacggctaaaatcgattgaacactttaaggtatggcattaaaacctttggggtcttatagattcaccatggcatgcatagttaacatgtttctaagaagagtggaaaccatgataaaaatatgttgaagttttataaatcaaagtacacagtaattaaatcatatattcccacgtttcaggttataagacgttttgacttttgtcaatgtcaaattgctttatgtttgactaagtttgtagaaaaaagtagtaacattttcgacccaagacaaatttatcatgaaaatatattcaattatcgatttgatgaaactaatttaatattataaatattactatatttgtctataaacttagtcaaacttaaaacagtttgaacgaaaatcaaaacgtcttgtaacctgaaacggagagagtatacgataatatgaaggccattaagctcgaatcattcaccactgtcaaatacttggcatccatatggtaacattgaacaggaagatgaatacggaaaatgaaaatactgtctccaatgaatggtgcttcacagtccgaaaatgaacagtatctgaagcaggaacaagatccggaatgcctcactcagcctcgagggaggagaggcattttttgcttgggagtctacaatgtcatgaaaacaggactaacttcaaaacaagtttgtttatttgtttaaatgtacgacatataatgctaaacacagctcacaagtttgctagttagaaactatagatttttgtttgctaagtgcccaacttcttatacagttatacgaggcatgtgtgtcttcattggtttcgaaaccaaattatgataattggtttaataaaaatgttagcttgagaattccaaagttgtcggctgctattttctgaattactaagaaaataaaattattgatttgtcgttactttgaaacttcaattactgactgatagtacaattagaaagaaatttgtacgtgttatattatataacaaattttaatattaaaataagtccttattatagtgtaaattttgatttaaacagattttaaatgttagtaaatcactgtttccgaacaatatgtaaattaagagtaatatgaaaatttgatccattcaaaatatacgaagctaacttttaaaatttgggtaagatccgccgaagcgggtagccttaaccgcaatgtgatggaggaaagcccgaaagctgttcccgtccctgtcaagggagatgccaaccgtctctcctatacaaagctaaaaaagcatttcccatctcaggaccgagaccctgacccatccgcgtcgctcctcgcgcgagcgaccgggcgggtgacaaccctagcgccgccgccgccacttcccctctccctccctaacctcgccactgccggagcggctaggcaacggttcggcgaccaaggacagcggcggcagggcaactagccgaggagcggcggccctgtctagcgcgggagaggcaggtcgacgttcggcggcagctgcggcgacccgacgacgagcttctccagcgacggcgacgtggtgggacggcgaggtggggcaatagcctggacgcagtgggaggaaggtgaaggccggagatggaaggggcgaccagatccggtcttcctggatctggctgtcatcggggtggggagtgatggcggcggggtgaaggtgagaagcggcagcggcgcgaggaagaaaaccggagggggaggagcggccactctggccatctccttcttggattcagtgggggagaatggagttggatgcgcacgaggccggcggaggcggtcggcgagtaagacggtagccaacggatgtggctgtggccagcaaaggtatttgggtggcgaattgaggtgcagctggccggtgaaggcgagcaaggcgatggctggcgaaggcggttgtggccagcgaaggtgctgtcgaggcggagttggttgtcgaggtggccggagaagctgctggccggcggggttttagtggtgatggttgatggccggtggtattgccgcttggagaggtcgtcgttgggttggtcggttggtcgctgacgtggttcgttcgtttggaaagccacaggacacggtgaacaatagtgttgtcggtggcttgatcgccagcaagtgttcctccaagtttgtctggggctcctcccctcctgttgaccggtctgctttcagattctggtcgtggggagttccatggcgaggggcggggagctagctttggttggtagatttgcttggagttcgagagcctcaacactgtcagcgctttgtttttcttgcgtcggcaaggtgcctggttcggtggagttggtgcatgagacctctgcaacgcaacctgttgatggtgtttggggtggagttggagctgcttggctgggtgtggcaagctgggcaaagaaaacccccttgctccttttttggtagtttcgttggggttactgtgcagttggcttcctggcgtttctttgggtaggtgtgttgggggaagtcggagctgcttgtcggtgacaagctcggcaacgataaccctttcccgctttccatggtagcgctgtggtagccagggttgtcgtagttagcagggagagcgagccggggcgaatgtcctgctcgatcttaggctagagccaacgatggtgacgcctgtgtgcgccgttttcctgtggtagccagggttgtcgtagttagcagggagagcgagccgggcgaatgtcctgctcgatcttaggatagagccaacgatggtgacgcctgtgtgcatcgtttctgtgctctactcgttttttcgagtgaaaaccttgcaccgattttcggacggatgttgtttgcgtttcgaagctatcttcctccttggaggctttgtcttgaagaccctgccctacgcttgtctgtggtctgttcataggaagtcggagctgctcttgggagcttggcaacgatgacctatgttttatcctctagttgtgccgtcgcaagttctttatcttgttctccgtgtgggttttgcccggtttccgccttcaaaccgtgtttatgtgaggtttttgggcccggtttccctaaaaaactgggccaagtttctacttcttaaaagaaaacaggatctccctgtccacttctgaggattttactaagaaaaaagaaaatatacaaagctataaggatacctgtcaaagagtcgccggccggcgtgtctgtttcattatgacctgacaattatggcaggaaaagattagctggggtcaccaaagagatatgctgtacttaatgaatataaaatttctgcatattatttgttttcgcgtaagcatatagccagccaaatgtgacatttcaatgcactaatttttggtatgatccaattttggcaatcttatttgtttatcggtacattcgattttttttcagccatctgatttgttatttcaaatggttaagagcaatttcaagatatggcatctatgctactctctcgatcctttaatataaggggttttgatattttgcctgtactatttgaccattcgtcttattcaaaaaattttgaaattattttttttacttactttattatccaaagtattttaagcataacttttcattttttatatttgcacaatttttttaaataagacgagtggtcaaacaatacaagcaaaatatcaaaatctgtattatgggacgaagggagcagttggaaattaatatgtttttacatgccacaggacggcagaattattttaaaccatttgctgatgtcgtaccagaaaacacaatgttgcatctactcctctgtacaataaagattcaaatcctatcttcaggttcatctctagaatttgaatttatgagacagagggagtagataactagattggcagttggcttatttcatttctgataaggtactaaaattgtcaaaaagaatttttttttacaaaacaattatcgtttcagaagggtacaaattggtttgtccaaaagtaattactcgtttcagaaataaattcgtttgtcggaaagtaattatactactcgctatgctttactggtacagaaaagagatggaacggttgaaaagatcaccataaatgaatctgttcattctttatactaggaacattatctttaaaacttattacccatcacttcaactatggtagactatatgtgagagtttgtgtggaataacttcaactatggtagactatatatgagagtttgtgtggaatatgtgtataagtttaagattttgaattttaatatgcgtaggatacagttagagccaaactatgtctaggtcttttgttaaataccgaggcacacatgttgtaaccataagacaactctagcatagtgtgtacgactagcgtacaacttagcccgtggagggtcgtaggtttcggttggacatcgataacaaatctctttctacggtttgtcttcaatattgtattttctacgatgtttcttctgtgtttttagccccctgaatttataaattctcaaaataatacgagtgtagttgaaaaaggtgtaaaaaaactcaagcgtccgtacggctgcgattatatacagccaaatgcacggtactgacactacaccatggatttttgcgattttcggaattgctgaagcctagagctaaaataactcaattaactccgactgttccatgttactattatctaaaaactaaaaagataagcccgcacgaacgcgtggcatcttattcattattttaagaaagtattgaaagaagtcatacctcaccatagtcaccataaattaccttataataaaaaatatgtccgcggtgaaatagagcacaaactttaatatcctaaatgatagaatgtctcccagattcagacaaaaatcactttgtcccggttatatataaatttgtatattgctaccacgaattattatcattgttttaaaaaatgtttgccaatttaatagatgtaactgatttaatatatgaaattgtatcaataccaagaaaacagtcataatatattattaatacataaaaaatatatctccagtacttatctaagtgtttatttccaaattcatatataaatattttaaaaatcctgtttctacctattaataggttaacaccgctaaaattaagagaaaatcccttctatacctctgaaatttcagctaatcccttctacgtccctgcttacttcctcctatacctctaaaatttgattttgatctcttccatacctctcccttcagatgaccatt

SEQ ID NO: 59895 - DNA, 504 bp, Oryza sativa
aattcctgcagccccaatcagtttttgctcttgaaaatgtaagggttggcaatgcctaaaacttgccagaaaatatttggttaattgggccttgtcccaaatagtggcggttttggtccctggatccttggcttcttcaccaaggatggtctacttatgtcattataaatcctttgaaaaaccgttcgttggtcttgacctgatgtatgctaacaagttatcaggctgtcatgatagcaaaacacactctgaaattaaagaacttccatataatcatgtagttataatgttcacctgtatgcattaaattttagctagagaagtgcactgactcttgaatctgactaacaatatgtatgttccagccaatggccggagcttgcaacaagaacttaacaaagaggctgctgatgaacaactgaacaatcaggctcatgaagaggccatgaaaatagatgatgcaaatgcagtaagtactgacgacgatgttcatccagatccaaa

SEQ ID NO: 59896 - DNA, 733 bp, Oryza sativa
aagtttgtagaaaaaaatagtaacatttgtaacccaagaagaattattatgaaaatatatttaattattgatttgatgaaactaatttagtattataaatattactatatttgtctataaacatagtcaaacttaaaacagttcaattttaaccatagtcaaaatatcttataacctgaaatagaggggcagtagctatttgtccccaactccccgagtggtcaccgcaaaatggcttgattagagctagaggtcaacgaaagcgaatggacggacaaacacagacacaggtttgtgcaaagcgaatggacggacaaacacagacacaggtttgtgctgcttagtactactgcatgatgcccgcggctcttttgacccttttttctgccgtggtgcgtcccaggaagggcagcaaaaaggaccagattccgtttcattagggcacccgcaatgattatctataggctctctacaagagatccatgtcagcatattttcctactttgaagaaattaaatgaagagagagcaaagctatctactaacctggagatagtttatagaaaaaaaaacgaggccatgcattagagagttatagatacccatatagacatactattgagggaggttactttaatctagtctattgctgagatgtacatgtttatagagaacatcttactttaccattgggggtgctcttaatacttgaaggaggtaaggactactactag

SEQ ID NO: 59897 - DNA, 1493 bp, Oryza sativa
accttacgacatgcaacaattaagaaatctgcatcttcatcacacttttgtaactgtgcccacagacgaagccaatatgttgccttgaaaatgacctgcatataagtaatagtaggtgatttgtcaaaaaccctatcattcctatcagccacagtgcccaacacaaggcagaagctccaacaagtatcagtttgctctttttgtttatgactccctgaagccaatcatcaaaaatatgagatatgctagtaggaatatataaaccaaaagaaaactgaactgccctccaaataaactttgcaaaatgataatcaatgaacagatgttggatagtctcattttcgtacaaaagcaacatcttaaattaccagtccaattcggtcttgctaaataatccttggttaacacacctcctttaagcaaataccacataaagatcttgatcttaaccggcatcttgagtttccaaattaacttatttctgtcaatgtaaccattattaattaaggctaagtacattgatctaactgagaattggccattctgatgatagttccatctaaaataatcaaaagtattattcaattgaatatgaccaatagatgcacacaattcatgccaaagtgttaaattttgaccaactaaagctctcctaaaagaaacattgagcggaacagaagccatcacactagcaacagaagaacttctccttctgacaatagcatataaagatggatacttttctctaaaggccgtatttcctaaccatctatcttcccaaagtcttatgtgttccccattattcacaatccaagaacccatagttaagaaagttttttttgactttcatgagtcctgaccaaaaatgggagtcaccttgtttcctgtcaacttgggtgatagacttattataaagatactttctcttcaataagtcttgccaaacaccattttcatttattaacttgaacaaccatttactcaaaagacatctattttgaatctctaaattatgaacccccaaaccccccctgttctttgggttggcaaataatatcccatctagtaagtctatactttttcttatggtcatctccttgccaaaagaaacgagatctataataatcaatcttttaaagaacccctttcggaatctcaaagaaagatatcataaacatagctaagcttgaaaggacagaattaatcaaaaccagtctacccccaacagacatatgttttcctttccagctgctaagttttttctctattctttgatcgataactttccaatcattattacatagctttctaaaatgcattggaataccgagatatttaactgaaaaagaccctaacttacaaccaaagatattagaatattgcttataacactcctttgcctgaccaaagcaaaataactcacttttgtgaaaattaattttcaagccagataatttctcaaagatagacaaaatcaattttaaattctttgc

SEQ ID NO: 59898 - DNA, 6748 bp, Oryza sativa
tattgtatatactggtcctcttctcttttaaaagattattagagtatatagttagttttagtgctgttttggtctcagtatatacctggagtttctcatgtactcactaaatttgccccttgacctacctcatcaatggaatatttactggttgcaattacttgattccttcatttatattagaattgatcttagcatcatatttggcaatgtcacaatgaactagaagtgattggattcttatatagcagcagtaactatttgatcctagttaagctagtggtgccgggttttgacaatagatggcccttgatcctaattaagtgtagaaataggcagtctgagattgttagtttgcatagttaccgcagggtccaaatattctggagattccaaacaactattttgaaactgtccaaatatacacttcttttttttaaaaaaatgcatttcttgggcaatttacactacaggtttgccttatacttgaccggtgtgctaattttgtctttacctaccacaatatttcaggttcctttcttctcccagatggacaatcaacttttggacgccatctgtgagcgtcttgtatcatcgttgtgcacacagggcacatacattgtccgtgagggtgatccagtgaccgagatgctcttcatcattcgtgggaaactcgaaagctctacaacaaatggtggccgcactggcttcttcaattcaactaccctgaaatccggtgatttctgcggcgaggaactgcttgggtgggctcttgtccccaaacctactgttaatttgccgtcatccactcggacagtgaaggcactcatagaagttgaggcattcgcactccaagctgaggatctcaagtttgttgcaaaccaattcaggcgtctgcacagcaaaagattgcaacacactttccggtactactcgcaccactggagaacttgggcctcatgcttcatccaagctgcttggcggcgatacaagaggaggaagatggcaagggacctgagcatgagggagtcattctgctccatgagatcagatgactcaaatggtgaagatgactcgccacctaagcagaatctcgctatgaagatcatgagtgggagtaggaaaggacctcagaacatgaaagagttgcctaagctaagaaagccggatgagccagatttttcagctgaaccctgtgagtaaggtctaaaatgcaacagccattgcttctgctaactctgctgctaccagttaaccattgctatactaccatatactgttggatcgacggcacgagttgtccaattgttgatgagaaagttcattaacttggaaactaaaaaacatggagaagcagcgaattcacgaagggatcgaggctttgagttgactagatgttttaggcgttggcaacttgtacatccagatatacacgtctgtgcttgtaacattcttgagatcttagaaacggccgcacccttacatttgactgcagagaaagagcgtaaaagaactgaagaaagatcaaacgtaaaggcagtctgtatttttgggagtctgtaaagcgttagggcggctattttttgcttttaactgatagacatttcgttgtattgtgcaatgtatttttgtggccaaaactgcaggttaacatctatactgtgcatacgttgtgcctcctttgtggctctctctcttgaacatatatactgtgctgtggtctgtggaatgaggagctgttccatttggtaacaaaccatggatacaatcagctgggctgcgtatcaaatatccgttgctacaagaaatttgataatttggcacttttatcgttgtcgacttgctttaattggtaatttttgagagtgacttgtgagatcatagtaaataaatgtagattaggatattaaatatttttttcttttttttaaggccaaggggaccatccaaatatattaagaaggaataaagtaaaaaaaatgacagaaaccacatgctaaccacgtaagcactaaaacgaccctgctatgcgtagtcgatcgtcgccaggtttacgacagcatcacaagaagagactctgaaaacggaagtgtcaaattatcaaatctccatacaagcgtggcacgcagggtggcggccggcgggtaggggagggatatgcatgtgggactgtgggcgactcatcagccgtcgctcgtggagaggcgccccacgcgcgcgcatggtgcgatgcgctcgttctttcgcgcaagctgtgcacgcggcgcggcggcctgggcaggacggtgccgctagttcacggggtggttcgcggctagcccaggtgaatcgcgggccgcggctctgcaggatcgatggcgccgccgccacgtgatggcccacgatacgatgatatgcaagcgtgtgtgtggcccaatccggcgccgcctcgatcagcctcgcgcctgtacacgttgccggtcgctgtgctgcgccctgccagcgcgcggcgccttggacgaacgacgtcgttgttacgctacgcacgctagctgcttgggcttggccagccgtctgcttcgccggcctttatcccagcacgctattcctcccttgcatcacacgctacttgtacggataattgagtcctactactatagtttcccaacccctcttctcgtttttcacgtgcatgtttttcaaactactaaatagtgtgcttttttaaaaaagtttttatatgaaagttgtttaaaaataatcaaattaatccattttttaaaaaagttaacaaatacttaattaatcacgtgttaatggatagctccgtttttcatgcatgggagatggttcccaacacccacctccgaacacacccttaactcgtactacaatattaccaaacggataaacttttctttagataatggaatgaaatagcatcccggcctttactcgaaagagctacagctaattattacaaactagctgtcacaccccaatctgataccgccgtacaacggcacctgacaggagcgtgtcgtagggaaaacggcgtgaaccgcttcctacgaaaccgcgatctcggtaccagtcccaggacatagtgctggtacccacggtgacaaatatgaatcatagcaatccttaaaataaatagatgacttatttaccttaacttaggttgcagctcagacagcccgagaatacaaccgacgacacggacgaggcgaacaccaacaacaacagcagcagcggaaccaacggtctaacacccaacaccacaggcgacggctgggaaccaggacgaaaccctaatcttcacttcactttatcttctcttcagggcggaggaactatatatatatatatttatatagagcaagggtgagtactttcgtactcagcaagtcacgggaacttaggtgtttaatgcaagcttggaagagaggcaaggtcgttttgcaaatcttttatttgaagactttttgaaatcactaagtgatttatttctttctaagtttgggccgaaaagagacttgcgtctcgattcgactttaagagatgtttttcaacagctcatttagtaatgtaccgacctcccgggtcagatcattacttctcggctcccagagccattccacttgattaatcggctcccagagcctttttcattttcttggactcccagagtccagctgcccagcagcaaagcaatccgcttccactcgggaagcctagtctatgatgcccacggacatcccgaatcacacagattcgtttctgaccactcaggtcatccatctgccacataggctgattctggttacgattcccacaccacaataacttttcacaaagcacaggcaaacaaatctacgcaatgggaaccacctcacatccgcccatgactgtgggcacggctgttcgaacagttagttaacctctgcagaggggtacactttacccacaagacacgaacttactctagacactggccggtgtcagaggttcgcgacaaagcctttcccaagccgacccagggatacctcatgccacatagaaggatcaaatcctcacataaacataggccattttaggcgttcacaaatcaaaccccaaccacctcgatcggtaattcagcaagcttctcgttcttgcattaccaggaacccggtttggctccaaccgaccccgtcccggcgttcccaactattggcatgcgaggtttccctgaaccgactagttacttggccagggtgtcccattccaccttgtggttgcactttgattatgttcgatgagtttcccacaggaatcggtccttatatgcgaatacgggacagtgccacataggcacaacccccgcatcgcaagttttcacaattcattttattttcaaacacaccgacaccacatgtcgggttttgaaggcttctcaaacccattccccaagttttcgacaaacagcggtgtatgtgggatatttggtatacgcgctcagagaacacgaataccgaggtaccacaagggtggagcgacaaggaatcagggtagtacgacctacgggaattagtgcgactactgggtaggtccgtcggtttggcacgcaaaccgaggccaagcaagttaagtgtgtgattctaataatgcaagttgcaaacaaaataataatgactttttagttataggggcaattgatcaaagggtgaattgccttgctcaaagtcttcacgaagcttcacgaatcttcaagaaaacccgcgatcgacgaaaatccggtaaccgcaactatacgcaaacaatcgaaaacctaaacaaaagaccaaaagaaagatcctatttagactaattagtagtgccattaaatagatctcaattttatgggaatactggaagttgagcggagtcaatcggagttgcgaattgggtgatatgaattttggaagtttaattggagtttctggaataggagaaatggtttatggaatttgtagaaataatattctcaagaatattattgacagtcactgtcatgcgggaccaaaggaaatggtttatggaattttggaataaggaattgatttatgggacaaaggaaaaaggatttattaaatccctggaaaaagaaaaggatggagggatgttaattggacttgggccgagcgaaggggcgcggcccgaagagatgcgcgggcgcggccgaggcgagcgggccggcgcgcgggagggaggcggcccaaggccgaacgaggcgcggcccacgcgacgcaagccgatggacgcggtccaccgagtcgggcgcgaggcgggacccacaaggcgacgacacggctcacgcgagcggggtgcacgcaaggcggcgcgttggatcggtggaccgggagacctttgaccggtctccgcggggccgggcaggtagatgtggcgtcctcgtggacagccacgttggcacgggcgagggaggaggccgggcggctcattggacggcccacggcgcgcggcgggatccggcgaacggcggcgagccggaaggggcggctagcactggcggcaggaggaggagaaggggaactcattccacggctcggatcaggaagaggacgcgcgacgacggccggcggcggcggccaatctcgccggcacgccgacgtggccgcgcgcgagaagagcgaagggtgcgcgggctcgggcttagccgaaccggtatggtgttgcgacgcgcacgcggtgacgcgggacccgatggtcaccggcggcgcacgcacggcagcgttatgcggcggcggaagcggcgacacggcgcggagacaagggagaagaccgacggccttggggcagccagggggaggtcaaggggatccccgggagcgtggcagcgagaggaatcgacgggagaggagccgacgacgatggattgcggcgcggcaaccaccggagagcaaaaaggggaaaacacgacgagacgacgagggttcgattcaaaggggtgggagcatctccggggttcaaggaatccgtttccggcgtcggattggacggagcggcaccgagattggctggcgacgagaggcggcctccgggacagagcaagagcgcatggcgagctatggcgagcggcggcgggcgcggcgcatcgcacggcaggaggaggattatggtggggagctcaccaacgaagaggaggcagcgttggcggcgcggtcggtgtcgcggcgaggtggtcgcgacgccgaggcggcacggcactgagagggcgcggccggggaagaagggagggagaggtggtgcccggagctcctcgtcacgcgtccacgcacgcaccggctcctccggtgctcggcaacggacgacaacggcgagagcgggacgagcagcaacaaggcggcgacggtggttcggcggcaatggcgcggtgggtgtgaggactgaggcgagtgaaaacgagagaggaaggggtttggggtggcttggttttatagcggaggtgaggtcggtttggggaggggagaactgaccttggcggtcaaggggagctcggctggcggcagcggcggtttcgtggacgatgcgaaagcggcgacggcgtggatgctttgggcgacgaaggcggtggatcgagcggcggagatcgaaccgctggagcgcgggctggcgtggtcaagtagatgaggcgggtggcgcgagcggtcaagcggcgcaaaggtggtgacgccggcagtggtcgggaaagggaaaaagaaggggaaaaaggggcttggtctcttgc

SEQ ID NO: 59899 - DNA, 12900 bp, Oryza sativa
atcggcccggcgctgcgcggggagcgccttgagctgtagcgccgggccgacgggggcggagaccctgggacccggaccaacctccagaacccacctcgggccgccacaatcgctgtcgcccgccgccgtcgccttgtcgacgaaggcgtaggtcgcccgccgctcggccggcacccagcgcgcggaggcggaggcgccgccgacgtggaggtacagcttcgccgcgttcggcgcctggtacttgagatcgagcgctttcagcttcgcgtcgaggaactcgagggaggagggggtagaggtccggaggatgtcctctcgagaggcggcggaggtggcggtctgggcgtcgtactcctcgtcgtcgtcctcgtcgtcggaggaggtgaggtcgaggtcctcgcggctgtgggcgccgcccatggcggttgcggtggtcgacgagaattccgatggatgcttctcgctgcgacacgggaggggggaatggagcggagatgaggggaaagtgagatcgcgggagaggggggtataagtacagaacgccacgtggccgcggtggcgccgtgatggtcggttggtgcgtgcgtgcgcccgacgcgacgcgcccggacgcggcggggacgacgaggtgagggcccacttggcagttgcttcgcccagggggtcaagagaaaagaaaagtaataagtctactttatctccctcgactcatgcgtctggttgaatcgcacccctcaaccgtaaaaccagaccgttgcaaatcgactccctcggtggtttcggaggcggttttctcttacctagcacttacgtgacgggttgacttggtctttatcctatgtgcatcgacgtggcgcttacgtagcactaaagtaaaaagaaacctaaatagaaaggaaaagaaattttgagcctacatgtcagttactcatctcctccctctttattctcgacgacgagcgagatgaagagagcggcgaggcggatggcgggagctcgccggagcgacgggacctcgccggaacggcgaggcagcgggagcggcggcggcgggacctcagtggagcgacaggagcagcaggacgtcggacatgagttgaaggaggcaaaatgaacttattccaaaagaaaaataggcaacctgttgggccgtgaagcccacggaaattcatggatagcatccgctaggcccatccgaggccacgcgtgaaaccagcggcccaatatatatcggctccgctcgaccaccacgctggccgcgtcactctcctccccctcgtatcgctcgggagcggaggtctcctcgcccctagagcgccgccgccaccgccaccgccgcggccgccgcggcggggacttgccggtgccaagtccacacgccatcgtcgctcgcacccttcccgcgcaggtaactccatgcaccttgaagtttcacctcatgcgttgagtgtccacgaccctcgatcccctccgctttcggaaccctagaaacccatctccactttgattccgtcggtttcgttgcttatgtggttcgatccgtcagccggttctagttgaggaaccgtaggaaagctcatctcgtgacgggatgtgatttttttttcttttttgggcggctctcgattagggctacttttggttgggctatttttggtttgtgcgcaagggtatgaaattggatgttgttagttctgtgttgctgtcctgtggagaatctgtgatgcttcactttaagcgatatatgttctttttaactcatactccctctggcccaaaataagtgcagttttagcactgttcatatccaacgattgaccgttcgtcttatttgaaaaaagattatgattagtatttttattgttattagatgataaaacatgaatagtactttatgtgtgactatttttttaaatattttttataaaattttcaaataagacggatggtcaaaacgccgagcacgcatatttatggctgcacttattttgggacggaggtagtactgattaaacctgaaaggtccgaggttgggttaaggattactgcaataggtaagaatctccaaagtcgatactgtggactattatggctgtttcatgttgtgtcgatcagcttcagatttctgacacctagctctttactactatgtggatgaaatgaattcagaactgcactcttagtaaaaagcttgaaaagcttcttgaattagcttgtagcaagtcatagtttatggtctgaaggtgtaacatttatcttttggtcctcttgcattcatgtagaaatatatttagggaagagctataattggttcctttcttacttcagggatttgttcacgatggcccgcttgtatgttggcaacttggatccccgagtgacttccggggaacttgaagatgagtttcgtgtgtttggagttctgcgaaggtcagtttctgcctaggcaatttttccacttcatctaattgggtgtttggtttttgcattgtgctgcattagtcttgtgtagtttttggatagactagttcattaattgtgtgccggaagggtaatagttcatcccagctgtgcataatgccataactgacttgtgcatattcatgcaactatattctgcttgcattataacatcagtcttatggtattttagtgacagaagttcattaatcgtgtaccaggaggaaaatagtgcatcccatgatagtcctacgtttggattgatgatatgtgttgttttaagtgtgacagaactctatgtccttttaccttttttttaataaaaaattcttagctaattggatggccatctattcctgactcaatatagtggtaccccttgtactataagttatttggacgttgcgggtatgtttgttgatgtaattttcaagtgtatttttccatgcagtgtctgggttgcccgtaaaccacctggttttgcatttatcgattttgatgacaagagggatgctgaggatgcactccgtgatttagatggtatgtaacggtgttttttctgcacactgtctgaagtttgtcagaaaattcttttgttctattttgatgaccttttatatgtcaaattagcaataccggtagacttcttgtcctttttgctctttttgaatcaagctttgagttaggggtgggcattaaaacagataactgaagaccaaacccgataaaaacagaaacggaaccgggaaaagacgtgaatctcttgggcatccgtcattggttgcgggtgtgacatctgaaagaccgaacaaactttggaaagattcggtcatcgtgccaatactacccgaagaagccgaggaccgaagaaaccaaatcaatacaatcactaagcagacaacgtgaccatcctatggaccaaaacagcccaacaacaaggtgaggcccaaatccacgtcaatgacccaatccccatgaccccaccattccattgaccgaagcactcctaaccctagttaggccacgcgccgccggcgcaccacttatctcgtcgcatcgcatgtccccttccttccacgccgccatcttctgcagtgctgccgcatgctgctgctcgccggcgtcgccgcagtgtcgcatgcaatcgtgtggtcacgtggaagccataaggaggccacaggctgctggcttgctgatcctgctgcacagccgcatgccggccgctgcgccatcgcgtgccgtctgcgtcgcgcggctgatttctgccgcgtcgtcgccttccgtcccgccagcacttgtcaccatgctagtggatatccgtcccatgtgactgaggtggagccatggaggttttcaggagcaagaagacgagaagattgaagaggacgcacgttctggttcgggcacctcggtttagaccgaagaccgaaccgaattttcggttaaccgaagtagcggttagtaatttttgcttaacaacttcggtttcctgtttccaaagaccgaatttttaaaagaccgaactaaccggaccgaaatttcggtctagaccgaatgcccacccctgctttgagtggccaggaaattttatctgtttgacaatgtctcttatctcgagttcttgaatttcttttatcctattgtattaaaatgcatcctgaccaatcatcttcataggttgtgcaagctttgtccctgtgtagttagaattaatttatgcattatcaggatttgttcaaatgcgtggttcctcttttaataggcaagaatggatggagagttgagctctcacggaactcaagtagccgcggaggtcgtgatcgacatggtgggtctgagatgaagtgctatgagtgtggtgaaactgggcactttgctcgtgaatgtcgtttgcgtattggtcctggaggtctgggtagtggaaagcgtcgtagcaggagtcgcagccgcagtcgcagccctcaataccgcaagagcccgacctatggtagaaggtaactttatagtgctcaatgttgtatataaatatagtagtatggttagtttggtgtcaactttattttccatgcccaatttttttttgatattttgtgttaaaggtggggacttacacatcaataactcttgtctcataatacgcttcgcgtgatccactttttacttgcagttaatccacttgttctattaaacacctactttgttgttgaatttattgtaatatatgatgtaaaagaaaggaactgagctaattattctgcgaacagaagctacagtcctcgtgatcgctctccaaggcgccgcagtgtttcaccagttcgtgggcgcagctacagcaggtcaccacgtggccgaggtggttctccttatgctgatgggtaaggcatattttgttaattttacaattctcgtcttgtatggctttataaatcatatattctttatcattcttatgcatgcctgcttttcaccttttttccagaagagatggtggcaggtaccgccgtagcaggagctagaccctgatgcctgtgcttgaccgtctgctctttggcttgcatgccatgaatgctttaagactggcatcaactgattgacttcaattaaggtttactactttatctgccttgatatttcagcctcttatttctgacgttaaaaaacttatgggatggatgtaatatgcaactaagacatattacctttctactatgtgctaaagagggatcattctgcttaagcgactcagccaactaccggctctgtctgcatggttttgttctgcactcttcattcctcgagcgtgttgcctgcttcatgtgaagttgcaagcaaaagagaatcttccattgtttcctgcctatgatgcctcgttgtggttggcactcttcgttgaagatgctgcatcgtcacaaattagtaacatatttcctctcataaaattgataacattttgagcaatactaactagtgattagtgcagctcgtgcaagtaaatagaccatttttttaatagaaccatgcatcaagagattgatacagcaaaataaatcttcatgtcagtcgttgggttaaaacatcgcattcatctgcagcctgtaattcagcgacaaaaggaatttgctgggttggcttccgcaagaggcagagactaccttttaagcggttccaccgactccaccccttggctttattctttctggtttttccttcactctgcgcatctgtcggccttcttcctgcactgcatcgccataatagtagcctctatatatgggaccttcagatgaaatattctcgttctgcattcttcctaccggcggccattagacaaaatatgttttttttttctttctgtttatgtggtttattacttttatttgtatctcaaccgttcagaacaagtggccagcacttcatgtctcaattgttgtgaattactcttttgacctagagctaataacagcctcagttcatatccatttcatatttatgtgctgtacgtcactcatctaatatatctgtactaagtatatgttgcttgtctggttctggaaccgtagagatccataccataaattagggtctgtttggggagcttatctgagaagcaactggttggtagccaatttctcagaatctgggaagctttgtttcccagtttctggtttctagtttattttctagattctataactatagcttctcagaatctggatcaaaaactagagaagctgtagcatcccctaccactagatgttgtgaaattcccatgttcggtgtgttccgtcctctctagtgattatatttttcctataacaaagttagctcaaaataagccaaagaaatgtttcctggaagagatttggatgtgagtttgctgttcctgagtcagttatggacgtatggtatagttaatcggagttcttgctgataactgtctgtgcttgcttccttttatttctttctttggtcaaatatgatattctgagatacctctcgcgtaaccaaatagatgtgttacaatacaacacttgggatatttcctcaagaagaggtaaaccctggtcggatttttttcatatccattataatttcttgcacgggcacaccacacgatagcgcacgcccacatgttctctaccctggcctctatcacggctctaatcagagttgcttttttttcgtatcaactactagtatcaggctgatactagtagttgatacgtttagcaaacgaagagatgctgtctagttgcagataaatcaaattaatctagtgaaggttggcgtgcaaatatgttaaagcagtcgtgctcttgtgctagtgactgtcagatgacgcgcttcttcgtaaacacaatttactctactcccctcatcacagtgtctatctgtcacaagatgctcgcctgaatatccaatcagcaaccaggcaacctcactgccaaatgaactagataacaagagatcgatttctaaacagaaccaacgagtgtgttcagtatgctactgcgccagatgacgattcgttgatttgtagtactccctccgtcccataatacaagggattttaagtttttgtttgtactatttgattactcgtcttattcaaaaaattttagaattattattttttttgacttgctttattatctaaagtactttaagcataacttttcgtcgtttatatttgcataaattttttgagtggtcaaacagtgcaagcaaaaatttaaaatcccttatattatgggacggagtgagtaatagagtaagtagtggagtagtactcccttcattcctaaggtggagagggattaaactttagttcctaattcctaaacaccacctaaatgatctacctatttcaccagcaaaagcaaggagcagttactaccccatcgatcaacataactttgtatgcagtgctgcttaatacgaagtgccgtccatgatttctgccgcttcctaacgaaatacgatgatcaaattggaacttttatttttggtaatacgaagatcatttaggaatggagggagtactagtttgtaccagatgacgattcgttagttggttttgaacattgtttaaccgccagcacgggacgagcgaatcgagctgcctccgagtgcataaacaacaagcagagtcgcccactcgccaccgccaagtccagtttctctattccccagctgtcgcgcgcacgaggcgccggtggggatcccgaggaaggagagcacgtcacgactcacgacgtggacgcgcgtgagatccctccattctttttgtgactcgtaggtggacttcccctcgtgcgcccgcgcgccaggaacgcgcatagccgcagatggccgcgccgcgtcctcggctcggcaatttgctcgcgatcgccatcacccctcccgtccgtgcgtccgcgggaaacttcccttgcgaatcgcgtgcccgtccgtcctccgcccgcggccccgcccgcccgtgtgtggcgccgcgcgttttctgcgcacgcgcgaggcgtttgctgcagcgacagtgcacagcgctcggagacgccgacgtaggtagttgtatactaccatgaaggcactgcttgtaaatatctgagtgactgtgtctatggcatctgcttttgctatgcggtttagcgtgtcacgctcggtccaacggatcgatcgatcatgcgcttttcgtcatccaaaatcattacgatttagacgagcaacaatgcaacactagtagtagtccttgactccttgcagtactaagagcacccgcaatggtaaagtaagatgttctctataaaacatgtacatctcagcaatagactagattaaagtaaactacctcaatagtatgtctatatgggtatctataactctctaatgcattgcctcgtttttttctctatagactatctccaggttagtagatagctttgctctctcttcatttaatctttttcaagtaggaaaatatgctgacatggatctcttgtagagagcctatagataatcattgcgggtgccctaatgaaacggaatctggtcccttttgctgccctttctgggacgcaccacggcagaaaaaagggtcaaaagagccgcgggcatcatgcagtagtactaagcagcacaaacctgtgtctgtgtttgtccgtccattcgctttcgttgacctctagctctaatcaagccattttgcggtgaccacttggggagttggggacaaatagctactgcccctccatttcaggttataagatattttgactatgtacaaaattgaactgttttaagtttgactatgtttatagacaaatatagtaatatttataatactaaattagtttcatcaaatcaataattaaatatattttcataataattcttcttgggttaaaattgttactatttttctctacaaacttaatcaaatttaaagcactttcgtcttataccctaacctgaaacgcagggagtactaggcaagtgtgcagcagcatcgcatatgccagatggttaatgccacaccatttgcctgcagcagctcggctggaacgtgccagcgatctagagatggcaagacaaccaaccaaacaatggcacctcagtcacctcacggctttcctctgacagatgccgtcattgggggtccaaaccgttagcctcaacatgtcgccacccgttgtttccacggccttttctgctctttttttcttcagccaggacctgatggatgctgatgactttcgcctagtactatttatagtcttgtctactactactacacattcaaagtgttctttttccggtcagttaaatcatttcggatcagaaaaaaaactcattttatttctcatacccttcttcgcctcgacgaccacctaccacccaccttctcatctctcccttctgataatcgccaaagaagaaagaaaaagaaaaaaaaagaatctgaacaactctcgcttgcttaccattaaccacagtaacaagtgcaccactaacccccaaagccatcgattagcggcgactaataaagtaattaagcccaaggtggggagcatccacggggaggagtttctgcttcctccaggctctacgatccccaccgctgcgctgaccaccctcctcgtgccgatgctgcgcagaagatcggtctttggccgcctccccgccagattcggccggtgaagctgccaaggctgctgcgcggtgtggttgacgagttcttgctcgctgactcgctgtagctgatgccatgtttggggcggggaaggtggacgatgagatggcgctcaagaggcagagaaccgtgaggtgagcctgcacgagcaaagcaaaagctcttctttggtctagttttagcttttcagctcttagagatccaacaggctctgcgacctgcgagtgatttggcatttgctgtgagctttttcttgttgttctaggaggaaggacgctttagcctggattgtgccagctttctaatttcctgttactctgcaaacaatttatgtatttgacctgttttttagagcatagactccttttaagaacccaaattaatccattcgatttattctatagcatggtatgatgaaggttttcatcccttttagttgatctggccaggaaagattaacctttcgtggataagaaatatagggcttcaaccaaaattgatattagaattaaattgtgttaatgtacaaaaactgttctaactgtcagttctttatgtgatttagtttacaatgggaggttctatttcattcccaacattatttttcttattttcactgttttggatggacatacgaaaatattcatgatgtagagttcaaacatttatgtgaggctgtaattcacaggttttatgatgagaaggcaaaaccaactataccaactcaccagaaacaggcagggttcgctgctagtaaacttggtgtggcaagctcaggaaagaacaaaatttttgtgccagaagaagagctgtggtacaaaaggattttggacccatcaagtgacttcatcttgacatggaaccacattttccttttttcgtgcttcgttgctctatttatagaccctctgtacttctacgtgccaaaaatctcctatggcaccccaaattcgtgtattgggacagacaggcatttagccatcactgttacattcttccgatcaatctctgatttactatatttcactcacattataataaagtttagaccggcatatattaatccgagctcaaccatgagggtatttggaagaggagaccttatcacggatccaaaggaaattgcgtggcaatatttgagatctgacttcgtagtcgatgcagtggctgcattgcctttaccacaggtaacttggcgctcttccttttattcttgtcaactggagtataaccagtattaatgatcattattgttaggtcgttttcataactgagtatatttgttagctctgatgttgtcttatgttcatttatctgcatgcggacataaatatgctactgtgctaatatcaatcgtgaagttctattgtggatcacctcaattaagtttctttacagcagatgctactatagtatcttgtggataaataatgatttgtaactgtgttagtgctgcccagaccacactaaggacaaaataattttcccctcgcttaatacaaaagatacgcatgttctgcgtattctcaaaaaaaaaaaaaagtgtcacttgctcaatcatcctgtctctaagtcagcatgaaaatcctagggaatcatcatgttcaatcttggcaaatattcttcatagtttaagagccaatcactaaactgaaacattttcatatgatgcattatgaatttaataactattattttaccatcagtgccgaccacatgtattgtctcttgatttttcttgtgaattcctgtaagctaaaattgaacctcatattaatgttccactggataagtttactacaatgggctccaaaatgcagcaacctgccatagcatctccagtttgtttgagctgattttcaatggttataatcttactcatcgggatttctaggttctctatgcttcatagggcaattttgtacatcgtcaaacctaaaagcactaaataactgaattttatttgtgcagctgtttatattgctctttccttcaaatggaggaatcttcgattttgactttgcctgctgcttatgtatctttacatttatgcagatcttaatctggtttgtgataccagctattaagtattccactgatgagcataacaacaatattctggtgctgatagttcttgctcagtattttccaagactatacctcatattccccttgacttatgaaattgtcaaaactactggagttgtcgcaaagactgcttggcaaggggctggatacaaaatgttgctttacatgatagccagtcatgtatgggattcgtaagcgtttacatgaaatgtgttctacatctcaaatattggtgtacagccaaagtcgtattagatgcatttgccagtctttaactccatagctataatgtctccaaattttcacgatctccattcatcttctttcaggtactaggtgctctatggtatttgctatctgtcgatcgccaaactgcctgctggaagagcaattgcaagaatgaaactggctgtgatattaaatttctagattgtgatgtgataccaaatcaaaactgggcaagcaaaactgctatcttcaatacctgtgacgcaactaacacttcaatcagttttgattatggcatgtttcagcctgcattgtttaatcaagccccagggcaacgtttcttgatgaagtatttctattccctttggtggggtttgcagaatctgaggtatttccttgtcaaaacatcttcgtgtcaaactacagcgctataagaaggaacttagtttacagtttccttgtgaaatgtgtgtgttcagaaatttcatgggaatcacggagatttttgtgtcaagcaaagcagtaaattaaatatggaagtttagcctagttcttttaatgggatcattactttaccaattttcaagatctatattcattttctaacgagctatatcctcctcttcctttgcaacagttgctatggccagactattactgtgagtacctatattggtgagactctatactgtatattcttggcagtacttggtctcgtcttgtttgcacatttgattggaaatgtacaggtaatttttaaatgtttagtgatcatgtctacactacgattgattcttttggcacttttttatacactgctactatttttccagacctacttgcaatctatcactgtgaggggtgaggaatggagattaaaacaaagagatacagaggagtggatgaggcatcgtcaactcccacatgaactacgagaa

SEQ ID NO: 59900 - DNA, 1749 bp, Oryza sativa
acaaaacctcaactagtggacactctactcatggcaccactagtttaattttaggtagatgcttcgctatttaattagataacattaggcggttttacaactctagactttgggatattctcatcacctggacactctggaattgttggattattgtggaattggattcaccccgccccctctattcaaaatccccaaaaatggttttaggctgggctcggggtgcatggttttgatggtagcacctcggccatataaggaccggtcttcgggcctctgttgcaaagcactaccgtacttccacatgtctagtgggtaaggcttagtttgtggctcagtctagtcataaacaaaagtacacggattggagatggatgaagtcgggggtcgatggacattctccagggcaaatgaaggctacacgagctgcggcccggtagtcgagatgtcatggcagagggttggtgccctgctgctaggggctcagtcttgcctgcctgtcccgggtgttccggccgtaggcaggattgggtcggtactcttgtctatggctaggatgggttggaaactatgtcacgtcttccgtctgtataccgtggtggtatgtggcacgtggttacacgtgaggaagatgtgtcttgtgggtaaagatgtacacctctgatcagagtataatctattcgaatagccgagccctcggttatgggcaagccgagcaatgtacccaagtcagtgttttaattcttaaaattttgctcaacaactaaaatgtggaatggttggcctgggttggcttaggacgagctgggacccagggtcgggttgccagttcggtctgaatcatcataggccttgggttaaggcaggttcgtgtgggttcacggccttgattaataatattgtttagttctaggatcgtgtttacaaaatggccttgagcaactaaatgtctttaaatgctgtttactgcaaccctaacccctctatgttataattcctttgtactcccttgcatttattctgcatttgtgggtgtgtcttgttgagtacggtggttgtactcagtcttgcttaattttcccaagcccagatgaggagctccttgaagatgaaggctttggtgtctagctcgtgcctgccgtcaagcgcctgtggtcgtcgccctagtcttccgctgtttttcgttgtctttgtgtgctgggccttcgctgcccatgtaataattttatatacgcttccgcttgttaaactctgaattgtatcaacttttggtgtaccttgcctcctgggacaaggaataatacacgcacgtcagggtcgcctgttgggtgatttccggtcgtgacatctcgtcacaagtcctatggttattttatatggaatctcggcaaataacagccgcccaacaacagtcttatatgtgtgcatatatcgaagcgttgatgcacgcaagctggtccggtttatgttatttcttacataagatatttttactccatacttttgtttaaagaatcattcaaaggatttcatggaaaaaaaaagttccgccaagtgccaaggatcgacattttgaactagaaatgttagatggcaccggattattttttttccacctggtgctcttacaaatggagagaatggaatgagtagaattgattgcacgacatttattacataaataaccgttgatactcggtacgtgtccggtcgtctaccaatgtcggcggtgtagtagtagacctttat

SEQ ID NO: 59901 - DNA, 1883 bp, Oryza sativa
ctcgcccataaccgcgggcacggctattcgaatagttttactctggccagaggtgtaccactgtacccacaagacacagccccacatcatgtcaccatgtgcctcagtaccaccacggtacctcggaaaggggctgtgacagtaccccttgcataacacaatccatcgcagcgcaccattcctggatcataatcacccccttataaacaaggcatggactccccagcgacccccgtgggcttatctccgccacttctcagtctggtgctctgcaatgaaccatgctatacaaaaggtaaagccgttgcccacgctggcttgtggttggcacggttaatgtttcacaacagtagctcgcgaaccggtccttaattgtcatgagcacgactctcaaaaccatgtgctcacaacccaccattatcaagttttagttggcaagtaattaattaaccaatcacgattgaccatcgtgagctatcattaaatataaccataagtgatagtgaaacattagttatcccaattgtgtgctaatgtttctaagcatggctaagcaattatatctaatatctagttgaaccaatatataaagctcaactagtcaagttataataacccaaggtatcaaggaataaagtaatcaatgcaaacaggccataacaaaggaataggttcacaccacccagtgacattcgaaaataaatgcacagttgaaataaatagagaatttaaatataggatcaacatgctcaaaggattgtgtttaggatctgtgtgacttgccttgcaataatcggtcttcaattaatcttcttgaatacttccggcgcactcgcgaaccttcgcaacgacggaaacgacaagctaacacgcaaaacgaagaaaaagactaataaaaaccaaataaacaatacataaaaagtaaacaaacatgtagatcataattttagatgaattatgagacttgaacggcctcattctgacttcaaatgaatttattatgaattttacaagattaaatctaattaaagcccatttaaaaagaattaaataaatttaattcaatttatggacaattttaatatgtagatctttattttacacaacttttgcaacttgaaccacattaaactgatttaagatgaattagttatgaatttttaaagattaaatcggattaaaacctttatatggattttaattaaattatgacgcaataatgaattatttttgaaaaggaaaagaaggattattgcgtcagcggctagggtttgcggtggaccgggtgcatggcggcggttcacgcgaacggacggccgagatcaaccctatccaaaacggacggccgagatcgatcggtccacgcccggctcacgggagagggcgacgatgacgtcagcgacgacgtcagcaccggcggcggctcggcggctcggacggctcggacggcgcatgctcgccggcgaacggcggctctacggcacaaacggagggcaccaagacgtagatcacggcgcggcgaactcaccgatgaccaaaacgtcggcggaagaccaacggacggcggcggcgtcgaggaaaaggcggcggagaagatcgggtcgacggcggcgacggtgctccggcggtcttcggcggcggcgaagcggtggacggggacggcggcgaccttgcgaacccgatggtggcgacggcgactgacgacggcggctgcaacggcggcgcggcgcggctgaaccgacggcaacgacggcggcgactagggctacgcggaggcggcgctagagacgacggcgggctaaggcaaaggtggcggcgggtagaagagacactgggggtccttataaaggggctagcgagcggcgacggaggcccacggctgc

SEQ ID NO: 59902 - DNA, 1855 bp, Oryza sativa
cctccccttcctcttctcctcccctctccttcctcctcctcccctctactccgtcttccatcagccggccggcggccggcggcggcagcgcgtggggaggcgggcggttggcgtggggaggcgggcggctcggccgcgtgcgtggaggcgggcggcggcgcgcggggaggcgggcggcggcgtggcgcggccgcgcgtgggcaggcggccgacgtgcgccagcggcggccgcggccgggcgccggctcattttttttaataatttgtggatgtataattttttagattttttgattcattgcatcgcatggatctaagatgtataatttgtataatctgtgatgtatttaatttgtgtgtagttttttaggatttgtgatatagttgatctgtgtgtaggatttgtgatgtatttgatttgtgtgtataagtaactttaatatttgggatgttgatttggggatgtgcatcccattagattcgggagaaaatatatagattaacactagccattagcaaaatcaacaacaaaataaaataaaaaaaatctcgaggaactgtcgtgaactgtcgcttcccaacaccaaccgggactaaagatcgatctttagtccgggttatttgaaccaggactaaagataacgatctttagtcccggattcgtagttccggtaggaaaaccgggactacaaagggttctaaaccgggagtaaagaatatttctccaccggtgcccccttggatgtgaatagcaaaaatgagttactagacaatgaagacgcaccgtagcccggaggcctttgctgtggatgcttggtgcacgtctagcaacatgcacacatgcttcagagttgtcgtccttaagctagccaatgctccaatagcggcgctattaagccagccaatggcccatcaaggctttcacccgcgttttctcattcagtcccacacaactaatccacacaaggagcatgactgttaccgaccaccacactgtacatccaacgtccagcatgggttcatagggttgctcttgttcatcgccatcccttcatgtgcaagccactgcctccaccctcacactggagcttcccataatcaaatctagaagcagactggctataaaaaggtgaggagctccatgcactacaccatgtcctaaaattcccgtctgactttggttgggaaagatgcatgtataccgattaacggtcggtcggtataacttttcgacgaacggacagttgggaattctaattttattagcgaactgtcggtcggtaattatgtaactttttactgataaactgtcggttggtaataataaactttataaaaagagacagtcggtcgataaaaatataacgatatctcgtcggtcggtaataggctaatagccggtggaggaatttagggagccaaaattttcgcctctgcttggccggcacgcgcgcgcggttgcggtggaaaattttgcggcattaatttttttcggcattatttgcaccaaaccctatctatccctttgatccatcgcctgtgtcccctccgccactccatcgcgcgcggaggccaagcgcctccggcgccgccgccgcttcctcccggcggtgctgcctccaggcgccaccgacgcttcctccccacggcgctgccccaggtgccgcctcttcctccccacgctgcgccgcccttcttcgtgccaccgccgccgcctctccgcttcgcagcgccggcgccgactccacctcaatacgccatcaccagtcgccctagcccccacgtccaccttcacagccgccctagccccttcctccgccacccgcaccagccaccctagcccccagtcccccac

SEQ ID NO: 59903 - DNA, 11907 bp, Oryza sativa
aaaaatataaacgtttgccgcatcagactattatagtaatgagtttgttgtgtgatgtgttatttatcacaaaatttatttttagataaagaaataaaaaatatgtatttattttttaaaagaaagtcataaaaatgataatcattcttacaaagataggactaccaatgctcacaataatttttttatgaatgctccagatcaaaaatatccattgtcctattagaatttcaaataaaaattttaatttattacatttgttttatcttcaaaatttatatcaaaaatttctgcaccaattatttactctcattagtttcataaatcatttttcaagcttatgttcaaacctaaagcatcaagggaaaaaagatatttgcaaccaaacataatagtgaaatgaaggaaaatataacagtaggggcatggaagggatcgagttgaaatttcaagggtatagaagggatcggataaattttagggatatgaaaaggattgagtgagttttcaagggtacatagggaatttactttaaaattaaacatgaatacccaatccgaccataggctccaaggctttcttctatgcttccttgaaatatgggtcctgcctcaacgtagccgtgcatgtaaagaccatcatacaacataactttaatgcttagttcactatcgacattggcaccctcatagttggtgtctttcggaaggacaaagagaaaatagaggtaatcaaaacatgtgtttaattaaaacttttgagtcgatttgtaatatagagtagacattcatggtaaggatatattattctcttttgaaaatgagctaggctcattattcgacactacttcaaaatattatagctaaagagacaactcaccctgaatatctgtagaataccgtctcattgtttatatttacatatagtttaagtgtctggattgttttcaacatccgctggtcataaatatttcttgagacagctttacgaacttatttataattgattcattgaagtgcactagcagtcacatcagtggggtgtaagacagcccatcaattatgcccgacgtattggagttcctcgactataacaaaatatatcatcagtggtgcgtatgttactggattgttcatttggtgccaaaactatttggcaaagaaaaaatctagacgtgtgacaataattctagtgatgaattaaggggttgtaatgttgtattatagcaaaattacccgcttcaaatatttttggtagtttttttcacatctctatggcaatgcttctcacttctcagtaccaatcaaataacacaaattggaatttaaagagaactacttgaaaaaacagaacataattaaattatgttgtttcaattttttctctggcgaaacagttgcataaaaataggagaaaaaagaaggattgaagtccggaaggtaagagcatcaccaacaaattagcaataatctatttctaaaatatgatattggggtttcctaaaataaaaataggaagtgaaaaaactttttcctccaagagatagcctaaatttaattccgaaaaattaaaagtgggacctactgttaaactatcaactgaaattcccgttttttctcctttcatgtgcacagagagagatcacgatgacccgcatgcatgctcccaacagaaatttcggcgctcgcgcgggaaggagaggagaagcacggagaaggagagagaaacgcgtgaacgagagattgggagttgctctctcacccttaaatccacggaatgaaatatatggagatgaaatatatgcaaggcttttaggaatatgttggatccaatttttatactaaaaaccatcaaaatcagttttgggaatgaaataggatgactgttggtaacgcaaccatcaaaatcagttttgggaatgaaataggatgattgttggtaacgctgtgcacaaaattttactgaaggggatgtcatgcgcatgagatttgatctaaccattaaaattaatgagtccaccaatttaacttaaaaataatggttagatttagctaatttattatcatgccacgtgacgatctaggagtttttgaaggaatgccacgtagcgatataaaagcgtttgcagtatgttaaatgaagttttagtatatactctctcgattccattttgattatcacgtaagcagagggtgtggagagcaagcataaccaaacttttatcattttgtaattgattatcattggttaaggtgatacatattttcgtgtcctctgagttacatcaaatttaaatattacatttagttgcaccaatagaaattagtcttggttggttacacgcagcacattaaatgatgtttattcactatttacacataaaaaaaataattgttagagaaagatcattctgagaagacctaaaaatgcttgggtgatcatcaaattgaataaagggagtaatagactaaccaagtaagttcaatggattagaaaatatatatgttaacttcttagctgaaaattttaaatttctcagaaaaacatgtagaatataaaataaaaagtccaagcaacaaaaaaaaagcctccatttatctataaggctttgttccatagttattcccaacttcacctcgtgtttccatgcgtatgcttcccgcgtattttaaaacattctatacaaaaattgttttaaaaaattatattagtttattttaagtatttaagcaaatactgaattaattatgtgctaatccaccgctatgttttccatacgtggagcctccagtaaagaacacagcctaaagtagccggtagaatcaccaccactaataccagataaagaaatattgtaaccatcattttgtttaaaatgtggaaataaatatctcattcacggattctcaggattcacttgccgtatattcttgtcatttacaaattctaattttttagataaatgaatcattaaaccacacaaaacaagatctacctagccacaaacacacgattttcagtgacgccttcaaccatctccgctctgggccagcgcactgctcctgctcgaaggcctatcgttgccaccgctcaccactcagcgggggttcctagggtggctgctagctggcgcgtgtgcgccagcagcgagcacttctctcctataacttctctatattagttaatacttaacactaataacgggtaattagagaagattcttaagatttttctttcttttttgggatatttttttactaacagattgaaaatttttaagtcagatttgaaaactttcgatttaagatttaaattttaaagtcaacatttgaaaactttcagctcgagatttgaaaacattcaacttagattcaaaaactttcaactcaagattcgaaaactttcaagtccagatttaaaaaatttgacaactttcaacttgagatttgaaaattttcaactcgagatttgaaaactttcaagtctacatttgaaatatgggtaaattggaaccatgctattataaatttgcaaggtttgagatatgccatcggtatctcaataacatgtaggacccacatgagtcaaagacatgtgggtcaggttggcatatctcaaattttgcaaaattataatggcatggttccaattttcccttaaaatatttgaaaactttcaactcgagatttgaagattttaaagttaagatttaaaaattactagtaaactaatcattagtaaaaatagaaaactaatctaatctaaactaattacgattttttcccctattcatacggcaggaatagcgaacagcaaaaaaaaaaagaataaaagaagaaaatggcggcgtcaaaaaaataaagaaaaaaacagagaagaggcgcgcgcgtgggccttgtgggccagaagtacgcgccggcaacgcgcgcgcgccaattagcgattccgggttcctatcgcgcgcgtacgcgttagcagtttagctggcacgcacgctagctgggcccgtccatgcacggttctcatcaaatgtacatgttgggtaactccttgtaaaaaagttatatatttttttttatttttttctgagcgagttgggctgatattaaatattcgatgcaatttattgttttgcattagcatgctaatatgttacacatttactatttttcaatattaatatagtaatggccccattgctatcacaacagagtcgcccatattgcgtgataccagattaaatatagtactataaaagttcaacaaccaactctctccttacatccttacatccttgctcacgtttttttattatgaaatataattccggcatttgctcaacgagctacaaccaattatatattacaccaattcatcttacttatatgtaccaaaatatgtatcgctagagaaacaaaaaccttagacttaaacaaggtagtatagtttggttggccgggatgtgtttcagtaatttagatttattcgatcaactagagaaagttggggctttctccataaattcttaattgatgttgtggtatgtgaactagaaacaaactattttgaatatgttaccttgcacgtatagagaagaatatgttttcttaaaggcaaattttactacaagacattgcgacttcgtggttttagctatagcacaccgcacgaacttacgttttgggaaaacactctgtaaacgtggttattacgaacttacttttggggaaaaacactatgtaaacgtggttatttatcagcggacaccatatctattaaaatattaatttttgattgaataggagagataaatagcgtgaaaggttaaaaaatgccccttgtccgctcatcacgaggtagtggcgacctgctgcattgcttgatgcttctctgtctctcgatcaagctagctatagctcatggacacatacaattaagcaaaacaggaacaatcgcactaaaaacaattaaagcagcagcagcaaaacgccgcgccgccgctggtgaacgtgtcggtgctatctccaacaggcgttgcgttggtggagagcaagcaacaggccgggtcagcagcaggtgaccatcgtggggtcagccggacctcgtcatgcacgtacggctgcttcatcgatgcctacctggagcgcggcctcgcccggccgcaacctcaacttcgcgtttgatcgacaggcctgcggcggagccggcgacggcgagaccgtcctggccacggacgccatccagttcgaggcgctcggcaaggggggattccacgcgatcgagctacgaggtgttgctcgaggccaccggcgcgacaaggggcggcggacgtattagttattgcaggttgctcggcgtctacctaagagactaagaagaagcacgagggaggaagagtacggaggggcaatttggtcacccgcataaaaatatggcccgcttattatttgaaatgcattattttaatggacgcggcgtgcgctatcaaataaccggaaccggctcctctgactttacagcagcacgtcacgccgtaacgtagccatcgcgatccaccatccaagctgatccaacgacgctccatctttgctctgtgtcatcgatgcaactcccctctgttaaaatcgtcttcttatcctaactagcattttggagggaaaataaaatggtaaccatgtttgccgccaatatacagatttcttcactctgcttatctgttatgatcgagttatacgagggaatcgagttataccaggaaatcaagcgaggatgttccattgaagaaggcgatggtgccacgtgaacactcgaagcataacagcataaactcaattagttgaagaaaatgcttctagaagcattgagaattatatacaaggatatgagttcatctcgagctacactgaattgctgaaggtatagttattcgccggacataattatcttgcatattcaaatgtttcataaagagactataaaaactgttgttcttttctaactcatgctcttaaacgatgcagggttatagttcagagcttttatatcacgacatgacttgagtttagagtttactagtattagaagtttcaatcttagctatttttcatatattcttgtcagaaattttgagggttggttatgttataagatggatgcatatcagaagtttcattcttattctgttatttttcacatctcttgccagaaagaaatacatgatcgtaattaagtaagaagatgacagagtgtgctaattaatgtaggacaaggagcaaagacggagcatccttggatcgccctgtacggtggatcgcgattggttacgttacggcgtgacgtggctccgtaaagtcagaggagcctgttcccaaataaccacattcagagagtgtttttgtcaaagtgagtccgtgtggtgttttacagttaaaattacgaagtcgctattttctaaaggaaaatttgccattttaaaaagctccgactataaaaattaaccaaatcaattagtttattattttagtttttctttgttgcaatacaatgatattttaattactagtacgagaacaatcgtaaccatccttttgttcctaacatggaaagatgtcattggcggattcccaggattctcttgccgtatatccatgtcttttaagtacgtattataattttttggtggagaaaaatcattaaaccacacgcaacaatatctaccaacaaacaaatcaaataaatacatggccggttcttaaacttgtggggtgatgtcacttaggtccatcaacttaaaaattatatatttaggtacgtaaacttggtataatgtaccacgctcggtccaatcgtcctttgatcatgtttgaccgccaacgtggcattccacgtagataacacttctgtgctcagccccctccacatatatcttcgcacataacttgccctgaccagtgcatttaaacctaaatccctcaaaatattcctaaatcggctagagtttctatagtgaggttaacggaaggaggccgagaggtagcgccgtagcggctatggcggcctcagtggtgggattagcggcaggaggcagcgcagtgaagcggggttagcgatggcacaatgcgactggattagtggtgggaggcagcacaatgcagcttgaacgctaggcatctccatggattttctaagcgtcctcgtcttgaagtcactggaagaaggtattattgatcaagtgcccgttgtgcatcgataaggttattttggagcgcagagcaatgtcaattgctaattgggaccgcattttctatacatgcaaggagaagaatgagaggtaagaacgatttgaggattttttttttgagatactagtgtcactatatagctataaggagatatatgcgacgtgttgtgatgtggagggggctgcgagcaaaagtgttgcctacgtggcatgccacgttggcggttaaacgcagtcaaagtatgtttgaaccagtatggtacattaaaccaagttaacggatctaaacatgtaattttcaagttcatggatctaagtgacaccaccacacaagtttagggaccgtccatatatttcactcttgttcttattaagaataagattttacctcggttttcgttagcacgtttttcaaactactaacggcatgattcgtgcctataaaaaaataatatatgaaagtcgttttaaaatattaaatatatcaatttttcaagtatgtagcaattaaaactcaattaattctacgctaatagctttatcgttttacgtgctcgcatttaatcttaatccaaagcagaaacgcacctccttgatgccccttgtccttgtggcagacgtcggacgaaacgccggtgatcttgcactgggcgaacaattgctgatcgctgtcgaggttgttgctgacgctcgcgagcttcctggtgttgtttctggacatctcggcgaccttgcagaggcactccggatcgctcttcaacacctccgccaccgcctcgcagcatggcgttagcatggtggggtcgtcggagacggtcgcgcatggcatgaggtcgtccatgcacgacgccgtccccggctgcagcgtgctcgccgccgctgtgaccggcagcgctggcagcggcggtagcgccgccaccggcacagttgtagccgtctccgatgccgcggcgacggccgccgccactgccattgctgccaggaggaaagggccgatgtgttccatgattgctgtttgtctgaggtgtggacgagagtgattgacgcgcgcggcagctggatttcttccggtatatatacagcagttcataaacgagacaacgtgcgatgaccgatgaccgttcattccactctgtccaattcaggctcgggccctaaatattactatgcgtttcaatttaaaccaatacgtttcaatataattaggatctctagattttgtttttcaaatttcactctttaaaccaatatgtttcgatataattagaatctctagattttatcgttttcaaatttcactctttctgctcgactgaatcggcggaaaggaaacgagtcgttttcttcttcaccctgacaaatgtccgatagtaatcacaactacatcaaagaactctatttcgtgacgacaatgtgaacgtgcatttgtaggcaatagggattccattttttcatttagtaagacaaactaaattgttgcaatgattcttcatgtacttagctgaaatgccactacatatgtacgtgggtgagctttgttgacatagctttggttgtcattggttgtgaatacttcttagtttattgataacgagacatagctaaagaaaggagtatcttcctggtatagttgcaaggcaatgtagataactcaaaaatcggtgctaatagagcttgtccctcgcaggtggaccccccaccccgcctcgtggccacatcgcctcccccggccctagcactgatttatcttcatgttgtgaaactgttgctttcccatcttatttactcgctccgttttcatgatacaagattttctagtattgtcttcattcatatgttcatatggatgttaatgaatcttgacacacacatatgtctaaattcatttatatctatatgaatgtgggcaatgatagaaagtcttacattataaaacggaggaagtatgtaattatgtgtgatgatatagtacacagaagctgaagaaaaatggtgcacagcagctggatcggtctgcttggcctacaagcggcttcttctccatacaagaacgaattaccatggatcgattagctaggccaactgccaacaagaagattattttcgctccagattttattgctagtgtgatgatcaaaagaaaacgtatcgtttgacgaagtggagaattatgtgccaacccaaagaaagggggtttaggaattcatgattcagatatgaaaaacatcgcctttcttagcaagtggttatttcaactactcacggccgatggtgtctggcaacaattgattcgtaacaagtacttgggctcaaaacttgtgtcacaagttgagtttaaagctggggattcacaattctaggccagccttatgaaggtcaagcgtgactttttacattttggcaaattcattatgagagatggtgcccaaattaatcaggtttgggaagacaagtggttgggagaagcaccattgcgataacaatatccttgcctatacaatatagttaggaataaataggatactgtagcaaaagtgctacaaaattaccctccgaatgtatcttggtgaagggatcttattgggccaaaattagtggcatggaataaccttcttccacaaaccgctagcctagtgcttactgaggatcaagataagtttcatttggaatttaacccaaaatggagagttttcagtgaagtcgcattatcttgccttggtacattcagatttgccaaacataaacaaagtaatttagaaattaaaaatcagtggccacagaagccatatcctaattggtcaggatgtcacaattattatatatgctcctctgtttacctttttatttttcatttgtgatcatttaggttaccttacattcatgcaacatggaaaactttaatctgtcaagcagctttatggtttaagagaggtgggctgctgatagtgatagctcagtacgggtattcctccgcgcgtgtatatagtcctaagttaatttcctggggagggtacttctccgtatttatccccgtttgtatggtcatgacgggctatcataaggaacttggcagtcaggggtggcttctcgaagtaccagaagggcatcggaaagagggtattagctaattaatcttatagctaggatgtatgtataatatgtatactagaagtataggtatatattcttttctatttttctttcaacttagcttagatagtttaatataagaatgagtagtcttataattgtgtgtcattctaccctatgaattatattaacccctacttagactatggttattacaagtaatatataaattatttgtacggttttctgtactataatcttccacgggattaaacaaatacgaaatccttggaatactttcgggtgaaatgcaacaatggtatatccgtgcgcttgcggataaactctgtaaccataatataccaggagtatttctgtgccattgttgagaattatatttctagtgatgtcgttaagaaatactaacaagtatttctagcaccgttgccggggaagatttataaaagagattaccattactaaaactttatatttacctttgtataatcactgtcctttgcaggcaaaccttggttgttttcacttttattgtggaaacagggtagtgcatgactgctttcaacttgccagaaaacttcaaagaaaatccattggatttctttcgaagcgtcaagccgcgagttgtcgctccgcagaaaactcacccgacaaagaaaccaatcataccagcgccaccaactttcaagattatggctgacaagaccctcagtgaattcgttgctccctctgctgacaacgtggccactgggctgcaaatcaacatgggagatgtggatttgaatctgaagtccagcctcatcacgatggctctggctagcccgttctgcggcaagcttaatgaggatgccaatagtcatctgcaacagttcctagagatctgcaactcatacacgatgaagggggtcagttctgacactgtcaagctgcgactgtttccgttttccctccttgggaaagcgaaacaatggttttatgccaaccgtgctatgatcaacatctgggacaaatgttcaacgacattcctatcaaagttcttcccgatgggcaaaaccaacgcccttcatggaagaatttcaagtttccagtagacaagggatgagtccattcccaaggcgtgggaacgacttcaggaatacgtggttgcctatccttgtcatgggatggacgactggctgatcctgtagaacttttataatggactcactcccacgtctcgtgatcacctggaggtggcagctggaggaacctttttctcaaagacggtacgaggagccgtcgatctgatagagaaaatggtctccaatatgggctggagcgaggaacgacttcagacccgtcagcgaggcatgcacatcgtcaaggagacgggaatgcttgctgccaagctggacctcctcatgaaacgcttggatgaccatgagaagaggccacaaggctccatcaaggccttggactcacacgtcacgtgtgaggtctacggcagcacgggccactctgggaatgactacccagaaacccgtgaagatgtgatgtacatgggcaataacaacggattt

SEQ ID NO: 59904 - DNA, 1849 bp, Oryza sativa
aagtgggcccggccgtcagccgcccgcgcccgcgggtgcggctgacgcgcgggacccacggcgtcgaccgccgccagccgcgtgcgcccggtccaccgtggaccgtggggctgacgcgtgggccccactccccgtggacccggtccgcgcgtcccctccctcggctgacgcaataatccgtttttttttaattaaaatttaaatgaagaaattcgcaaatattcatttaaagagcatataaacttcaaatggccatatcttggccatttgaactcggaattggaccgttcaagtccctaatttttccttaagatgtaaagaacccatttttgtgctttgtttctgctgttatgtggagttatttagtgttaaagcctttttcttttccgttggtcgtgtagacgctgcagcttcggaagatccgctcttcgtggaagttgaagccgtcgtttgggaaagcgagcaaggcaagacacatcatcttgatcatattgaatcccagtttgtaaaattatgttgatttaaattattgcattatcgctttatttaaattcccgcgttatcactgttttatttagccatgcctatttacctttgttatgaccatattattattgttattgttagtattattaccttgttcaccctagattaaacaaaacctcaactagtggacactctactcgtggtatccctagtttaaatttaggtagatgcttcgcaatttaatcaggtaacattaggtggttttataaccttagacttgggaaattctcatatcacctggacactatggaattgttggagtattgtggaattggcttcaccccgccccctctattcaaaatcccctaaaatggttttaggctgggctcggggtgcatggttttgatggtagcacctcggccatataaggaccggtcttcgggcctctgttgcaaagcactaccgtacttccacatgtctagtgggtaaggcttagtttgtggctcagtctagtcataaacaaaagtacacggattggagatggatgaagtcgggggtcgatggacattctccagggcaaatgaaggctacacgagctgcggcccggtagtcgagatgtcatggcagagggttggtgccctgctgctagggggctcagtcctgcctgcctgtcccgggtatcccggccgtaggtaggattgggtcggtactcttgtctaaggctaggatgggttggaaactatgtcacgtcttccgtccgtataccgtggtggtatgtggcacgtggcaacacgtgagggagaggtgtcttgtgggtaaagatgtacacctctgatcagagtaaatctattcgaatagccgagccctcggatatgggcaagcctagcaatgtacccaggtcagtgtttcaattcttaaaatttgctcaacaactaaaatatggaatggttggcctgggttggcttgggacgagctggaacccaggtcgggttgccagttcggtccaaatcatcgtaggccttgggttaaggcaggttcgtgagggttcacggccttgtttaataatactgtgtagctctaagatcgtctttacaaaatggctttgggcaactaagtgacttttaaatgctgtttactgcaaaacctaacccctattattatccccttgtactcccttgcattaatcatgcattctccggtgtgtcttgctgagtactgtggttgtactcattcttgctcaatccttcccctcttcagtaagagaagctttggagaagaagtcttaggtggagtcctggcttataccccagttgagcgcctgtgcagatggagccgtaggcccgctagtccgctgctgtttatt

SEQ ID NO: 59905 - DNA, 6155 bp, Oryza sativa
ctgaacaaatgcatgcaacagttgtaccactttgtatggcaagcgagaacactgaatattttctcattggaccatggtagtgccaggtacgaaaagtagacacttatgaactcaatatccccttgaatgtcatctagcttcctacctgtggtgctgtatgcatcgatcttaggttccctgttgatcgtttccaatatcttgtatactgcagcctggcctcctgcaaactctctcatgcttggagatgcctgacctgaagctctggtgaatgcaacagtaaagtttcagcttctggaactaataagtagttactgttagtttaattgaaaagaaatatcatatacaatcatggaaaacatacaatagcacataccgactgtagtagctaattcattgactattgaaaactcatatactgaaattgtctgataaggttctttttgaaggaaaaagagatgagaagaagcaattttttaataaaagaagacgctatgaaaatacaattgacgtaaatccaaaaggcctgtgttgcattattgcctttgtcgaatgagataattcaacttttgtgacagtgaattggtattgtgttgacaccaaaatataaagtggatatgctcttagtttgttgctgctaactgaacaatcccttattagcaggatgttcacgaaaacaaaatatacgtgcacacagttggtttagcaggatgttaacgaaaacaatcccttattactgtcaagtgtcaaacagcagctaacttaccttttttttgtcctggccgaacatgtctaaatcagcacaaaatcaaaatactccaatgggtaaagaccattttatcagtcaccaaataactaactgaaaattctatgatgatattatttttttcaatcctaaaaacttttatactcataatatttcttacaaggaaaccatttgtcaatcacgagaacaatgcaactgaattgattaggaggatggccgagaaacttacagcaagccgatgagcacgacgaatatgacattcatcacttgtgctccggtgcatgtatatcccttctccaggatcagcttggcatcataagaaatccccagggagtagccacagaagaggagcactatgaccgtgcccatggccatgccggctgcgacgttctccggaacgttggagctgtacgtgctcttcatgacgcaacctgcatttgtcggaccgaatgttcagagacatggcgacatgtacacaaagttaactgaagggaagactgaatgtttactgttctgctgcgcgaaggccactgcgaagctgctcaggaatgtgacaagaagatggacaaaattaccgatcttgtcacacattctcaagacgaccgacgacctcaccggtgtcatcgtcgtcacctcccaaccggatcggaatcacaagcccatatcgtccccgtcactgccccaccgcttgccgccgtctccgcaccatctagacacaggcagagaaatccacctaggagaaagacgagagggaaagaagaggcgaggggacaaagaggagacgacaacctgtcaagcgagaaggagagatctttcttttagacaacggcagcgatttcgtggcggcgttgtggtggccggtggagtggaagaggaagaagcggcgccagcaagagaaaccgacgagaaatccgcgcggggaagacgagacggggcgcgggctcgagccgaggtcgtcgtgacttgtgtcgcatcaggtgctgctgcgtgcacgccacctcttctctcgtttccttcttcactaagccacagacccggccactccgatggcggcgtgcggcttgatccctagtcaaacagtacaagcaaaaacttaaactcccttatattctgtagcagtagctatctacaaataattaaacctctctattgcaacggggttagtatcaagtatcacaagtatgtttgtcacccatgagtcatgactagtgtcatgttgtgttaccattaagcccattttgaactatggattttaccgaaagctgtaaaattccaagggaaatgtatgtatgcaataatgcaagtgcgagtatgcaacacacctgcggagtgtacttcatatgcttcagttttggaagggtcccaaaaaagcattccttgttgggtcatggacgcagccttattccctccagagaactttgacattgatcctagtatcctacggcccaaaaagccacatgaccaaactgcccctccccccagcacgatgaccgtcaccgacccccttaactaactccccagtgtacctccacgccgtgggagctgagctgatctgatgatcccttctcacttccaagtactacacgaatgtaacaacttgatgtgacctcagttcttctcccatctcctcttctccccacctcgcgcgcgccgccctgcccagatgtttctccactccctcttgatgcaaaacatggccaagaacacaacaacgcagcagcagcagacgacgaggtacgcagttaggcgcaccttgcatgtggcatgatgatgattgcttcggttctacgtgtttggctgacgtgatggttccatgcgcaggtcgtcgaaagaggcgggcggcggcgccgcggcgaggtcgagaggggtgtcgtcgaagaagtcgccgtggtaccagcgggcggttgaggtgttgctgctgatatggaagcagccgacgggggcggggacggggacggggacgacgacgaaggccgcggcggcggcgggggtgacgggcgggaaggcggcggcgtcggggatgggggctcggctgaggaagtcgtcgtcgctgaacgtggcggcgttgttcacgcgggtctgcctgtgcgcgcccatctcgatgtacaacgagcaggcgctctacttccaggcgggcgacgtgacgccacaccggagctacagctacccgcgggcgtcctcggcgtcggcgtccgggtgcggcggaggcggaaacagcaacccgctggtggcaccgccgcccgcggccgagcagagggcgctgatgaggacgcctggccccggcggggagagcgcgaggcggccggtgttccgcggcaagtcgctgacggacgacatcctgatgcggcggttcgtcgtcgacgaggaggccacgcggcggcgcaacgagatggaggtgatccggagccgccacgcggccgccgccaagcggcggcgcctcggccccagcccgctccgccggatggccctagcggaatcggagtcggaggccgacgacgatgaggaggagacgacgacgacggaagcagcggagccgacgtcacggtctcacggaggaaaccccaagccgtaccagtcgcagcgtaacacttctgggggtccctgtctcccctctcaattttttttccttcccttacacttcttctcccgttccttgtgctcttgtcgttgtctcgcaatgatgcaagaagaaaactccgagcaacacgcgcgttctcttcgactcttccatatcgaccgatgcggacgtcccgcccagcccagcgcccgccccgcacgcaaaagtacgcgcgcgtcgtggagaaacccggcgaaaccgacgtgtttcccccgcgcggcgtatgattagggatcgagcaatatatcactagctctatccattcatctgctctactagctatatgctatacaccaggaaaccggccggatatccatggctagctagctgcatatgcatgcatgtatcatgtgcgcgcgcgtagtatacgtatatgtgcatatgcgttttcttttgtagaaaagtaattataaaatataagcacgatgcatgtactggtgtccgcatatctggaaaaggtagctatacatgaaacaaaataactaacgatgatatagatatatagatagagatagagatagatagatagtcatgacgtgtacaagcatatgtataagtatatatacatgtatgccgcatgcaatggcaacttggtgggttcgatcaaattaaaatgaagacaaattagctaattagaaatgctacttaattaattaattgccatgcatggctgtagaaatcaagtgatacgcactattagaaaaagcattatcgcaagcggccaaaaagggtcttcgcaagcggggcggccgtccgcctgtaaacaaacgactatgaagatcgccggtcttctcatgcggagcggccgtccgcctgcgaagataattttcgcaggcggattttcgcaggcggacattggctagtccggttcgcctgcgaaaatagaaagcggccgcctgcaaaaaaaaatagccgcctgcgaaaataggtaggaaattttgaaatttaataataatttgtccgttaatagaaattcttgtaggtagattattatgtacatatattggaagattatcaagcatttggtattgagaaatctacatatattgtataactcaaaagtgttaccaaaatatatatattacaatattttttacattgtgacttcaaatacgccatctagtcatattatggcatagcagtgttccactccagaagatccttgaattcgtcacttgtcgctagggcaccatctgggtcgaagaaatctcctttcacatgacagcactcagagtggatgaagtggcacagatcatgctggacatttgtgatgcctgtatcgtcaaagcttgttcgacgttctaatcttggcaactgcatgcattgaagataaacaatatattaatatcataaacatgtgaagcggtctagtacatagtatagagacttacatcctctgcgttaaccctatacctcccattaaccctaaggaattcccacgcgtaatactcgcagaggacagttcctctaggttgcttgtgacacttcaggacatatcatagaaaaaaaaagataaattttgcaattagtgaaacaattggaatacattaagtgagtgtagtattaccggccaataggtacgtactagcagctcctctcttattcgggtctgttctccacccttgaacttgtagtattggtacacactgtatggatgtcgtaccatttcacattaagaaggatacttatttataatacattcatataaaaatgcaagaatcataatcacttactactgtaagattgttagaaattctttgtatgactggtgtttgtaatcgagagggtccaagactaccacggttccgtctttagggtggatgagtaaacagatataatgatcgctacatattaacaacagcatagttagttagtaccagctaaaataagacatatgtgtagaagataaatgtaccggacttactcaaaattatgagcggccatgacgactctcttattttgaaagtgcaagaaggctcgttcaatgtactgtgcgacagtaatcaacttctccttgtgcaggcccttctgatattcagctatctcttttggagtcttgcccttcagctggtctgaccctggtgctagcctcacggtatgctgtgtttgacagatctgagttggatccaagaagccaataggttcttttttcttcttagcatccatgttttgcatcctacagaagaagtttgttagtaacaatcacatgaatttgtattgtacatatttttcatgtaattaattaaaactcatactcacatgcaccaaacaccgacatagttgacgtccatcttatcccgacgatatatggcgtggagatctgacaaatctagccatatgtaaccttcggcactgaaacaatctgccgatgatcgagctgttatattgcccaagcctttcttgttggcttccatgtagaaggtttgtaatcttctcatctcctatggtccttcgtttagtgcccaatccggcaagagtgctttcccgtgttcgtacttttccgggcaatcatcagttagccagtatgttggcccggctagttcagcggccttctgggggtcatcatctttgtgtttggcacgttccttaccccctctgaagacggttaccatgaacttctccttgttctcatatttggacttgtagtcgtggctcctaagcactctaggcacctcagaactggtagtggccttctcagggaccggggtctcttgcacctcggggtctttcgcaggagaagggtcttcaaatatttctggctctgtaccgtcccat

SEQ ID NO: 59906 - DNA, 1157 bp, Oryza sativa
tgcttcttgtattgccacgcgtattggggaaacccaaacttccatggaacattggagcaaatgccccttgttcgtccacggtgttcttcatttcccaatgctttcgtgaggatgtcatcctcgcgttttggtgagcagacctcttgagaggcctgtctctcagcattcagttcgacctggggtacaattaggacgcgttagacgaagaacaagatatagcataatgaaacttattctatgtgttcaacttacgattttctggtacaccgcttgatcttcgggatttgggaacgaaagagttccgtctctattctttttcacccttgcccttgcccaattccttgcccgctggaccgggatatcaccaagcactggctgggtgttagattccgctgcagcttcatcctccttgtcccattctgcctgtttccctgcgtagcctccggtgccaagccggtgcgggtcaaggttcctggcctgcagatcacggtaggtctggcttttttcccgagactcattcattgatttggcggcatggaactcatcccacacgggtttggtgatgaatgggtatttcacaaatggttctggctgggctgggttgaggacgtacaccgtgaccagcgttgtcttgaaatttttccaacaattccccatcttgcggatagcctgccgcttcagtcatagctcggcctctgcagggtatcggaagctttccttgaactgcctccatgcctcttctttttcttcttgagggaccagatcgatgtggtccttcagaatagtgaagttccgcctccctaggactctgcatatcgtatggaactttttgacagctttcgtcggagccgtcggatacccaagatcgtccacctctgttatggtgtagacttccttaggaatcttattttgggtcctaggattccggctcgatgtagtcccagtagtggtcgtcgacatcggttcgccttgctgcgacatgtcctatgtcactgttgtacggggagaaagtactttttaaacacaaaattgcatctacacacattctcttatggtttgatgtacctctatctcctacctacgttcgcctcatcgacgaaaccatagcatccatactcaatagggccggagcagccgggaactcgacctcgacatca

SEQ ID NO: 59907 - DNA, 1070 bp, Oryza sativa
tgttgtggtgctttttggaacttttcattccggtcaaaaacatcgcacctgtgtgggccatataccaatattggcattaattgacaaaagttcaccgcgcgaatcacgatgtgagttttttccacgaacgcaccaaatacactccaatatgtccaaaaatcatgttgtggtgctttttgaactttttcattccggtcaaaaacatcgcaccctcgtgtgccaacattggcattaattgacaaaagttcgccgcgcgaatcacgaagtgagtttttgacacgaacgcacccaatacactccaatatgtccaaaaatcatgttttggcttttttgaacttttttattccggtcaaaaacatcgcaccctcgtgtgccaatattggcattaattgacaaaagttcgccgcgcgaatcacgaagtgagtttttgacacgaacgcaccaaatacactccaatatgtccaaaaatcatgttgtggcgctttttgaactttttcatttcggtcaaaaacatcgcaccctcgtgtgccaacattggcattaattgacaaaagttcgccgcgcgaatcacgaagtgagttttttccacgaacgcacccaatacactccaatatgtccaaaaatcatgttgtggtgctttttgaactttttcattccggtcaaaaacatcgcacctgtgtgggccaatatataccaatattggcattaattgacaaaagttcgccgcgcgaaccacgaagtgagtttttgacacgaacgcacccaatacactccaatatgtccaaaaatcatgttttggcttttttgaacttttttattccggtcaaaaacatcgcacccttgtgtgccaacattggcattaattgacaaaagttcgccgcgcgaatcacgaagtgagtttttgccacgaacgcacccaatacactccaatatgtccaaaaatcatattttggccttttttgaacttttcatatctagcaaaaacatcgtacctgtgtgggccaatatagactaatattgggattaattgacaaaagctcgccggacgaaccactaagcgagttgttgac

SEQ ID NO: 59908 - DNA, 3578 bp, Oryza sativa
gatcccgtctgctccagccctaaggaatatggatgctacatatctgctgacgaggcggatgcagatagaacacacaggcaaccaaaacccttcctatccaagagccctaacattatcatcagcaaactcctagattgcgtcaaagatcatttcgttatggaacccttattcccatagatacagcaaccatctttggatactgaatttatgggaatggggttccataaagaaatgaccttgaaaacaatctaggatgttggtaacgataaaagatttctagaaatgttgtatttgaacaaaatgttctgtttaccaatttgtcttggtcggtaccgtgcaggcagtaacccgaccaaaccagatttggcaactaggacacttcgtattctccgaaatgccataatttcagtaacttcatttaataacagatttctattaatatacatcccatttccctcaaaatgacccaaaacagcccatactacacaagtcacatatatattattttttacctaaaataacacaagtcatgacatataataagtttggcctcagttttgcttagaaattatgcttcaattatcaccatttgcaactgcccccacccccaaaagaaattaagaacaagtgtagagggctgtccttatgcaaaaaagaaacagccatataaaaacatccataattattcaaccatcacaacccacatcaattcatccatcccattggaccaaaaatatcccaaaaattttgcaaagaaccatataagaataagtctatagggtctgtccttatgcaaaaaaagaaaaagatgagccatataaaatgatctcatactgccactcccccccaaataaaatgaacaagtgtagatggtctgttcttattgaaaaaacccaaaaatcacaagtgtatatggtctgttcttatccattaaaaacccacatttaaacctaaacaagaacaagagtgaggccggcccaaaaatgcatccattttgcaaaacatcccgtactgccactccccccaaataaaatgaacaagtgtagatggtctgttcttattgaaaaaacccaaaaatcacaagtgaatatggtctgttcttatgcattaaaaacccacatttaaacctaaacaagaacaagagtgaggccggcccaaaaatgcatccattttgcaaaatatcccatacagccataaaaaacataccaaaacacatttcccccaaaataattcaaccatcacagcccacatcaattcatccatcccattggacccaaaatatcccaaaaatggtatgttcttgagcaatcatcactggccattcatccatcatagcccacaatatttcatcatcacagcccacatctaaacaattttcatcacatcccattctcccccaaattcacaaattcatccatcacagccatataaaaatgtatcagtagctaacacatatagaaatgcaccagtcatcacagccatataaaaatttaacagtagctaacacatatagaaatgcacaagtcatcacagccatataaaaatttattagtagctaacacatatagaaatgcacaagtcatcacagccatataaaaatttaacagtagctaacacatatagaaatgcacaagtcatcacagccatataaaaattcatcactagctaacacatataaaaatgcacaaatcatcactagctaacaaaaaaattcatcactagcacaaggcatcatatgtagacattagcatctaaacattgaatcaacaaataatcgcactatcagattatcgaatttaaacattatcatcgaatcatcaaatcatcacatataacatgtacacagcaaatcatcacattatgcatcatcatcggtgaggagtacctaccttgcacggtggcgggctcggtgaggaggttgacgtgggctcggggacggcagtcttgggcggcaccgggctcggggacggagtggaggaaggtgccgggctcggggacggcggtcttgggcggcgccaggctcggggacggcgtggagggaggtgccgggctcggggacggcggtcttgggcggcgccgggctcggggacggagtggagggaggtgccgagctcggggacggcggtcttgggcggcgccgggctcggggacggcgtggagggaggcgccgggctcggggacggcgtggagggaggcggtggccgtcggggaggccggatcttgagcgggcccggaggaggtagcggcgtggaggaggtcgacggccgccgggcgtagatctggagaggaggatgtgaggcggccgtggtcggtgaaggacccgtggatcttcgagggaggaggaggcgacagcgttgaggacgaggaggcggcggcggtcgatgaagccggcggtggcggtcttgggcatggaggaggcggtggatctgggagagtgagagagtgagaggcggcgtcggcggcggataaggacccgtggatgaggattgactaagtaaaccctagtcaatcctcatctctatcgggcagactactatacccgatgcggatggcactcatccgtgacgggcgttagtattatgcccgatacaggtgatacctatccgtgacgggcattagaactaagcccgatagagatggaataatctctatcgggcatagtactaaagcccgtcacagatgacttattaaaatatttttaagttataaaaatcatttataattatcttctaccagatttaaaattgctattacatttgttatcacatataattaacaaatgtcttatttacatagtttaaaattcctattaatattttaaattcatataattgacaattgcctttctcacatatagttaaaattcatattactttttttaaattcatataattaaaaattggctatctcacatatagtttaaaataacaagtataattttttaaaaccacataattaacaaatccatttcttcaaatagttttaactggaatggcatgaaacatatgcaattcattcattaaggctccaatacaaattaaatacatcattcacagtgatatgccttccaaatggtgtgaacgaacgtaagccacttagtctttgggatcatcgtcaaggtcgatctgaggtctgacatgaagattcttgttgtattcttcttcatcgacgacgttgtccacccccacaattcttcgcttgccatccctaacaacgtgcatcttcttgtttgcagggtcttttatgtagaaaatctgttcggcctgcttcctagtacgaatggttagtctgcgtatccaaccttggccaggtccactaatgtgaagccttccttgtcgaccttgacacctgtgcggatattcacccaactgcaacgaaataaagggacttttaagttcagatagttcagctcccatatctgctctatgcggccatagtatgtgctcgatccagcctgatcctgatatgcatctagatggactccactgttttgcactgtgctctcacatcttgtgtgacggtataaactgtgtatccattgatatcgtacccttgccatgtatcaacctcccaagata

SEQ ID NO: 59909 - DNA, 894 bp, Oryza sativa
taccgacccatttttacctacggccgggatacccgggacaggcaggtagaactgagcccctagcattgggcaccaaccctccgccgtatgacatctcgactaccgggccgcagctcgtgtagccttcatttgccctggagaatgtccatcgaagcccgacttcatccatctccaatccgtgtacttttgtttatgactagactgagccacaaactaagccttacccattagacatgtggaagtacggtagtgctttgcaacagaggcccgagctttagtccttatagtggccggggtgctacttcccataactggcatgcacccaaaccccaccgaaaacaggttttaggggttttgaaagaggaagagaggtgtatgtccaattccaccataatccaacaattccatagtgtccaaatgagatgagaattcccaaagtctaaaattataaaaccacctaatgttgcctaattaaattgcgaagcatctacctaaagtcaaactagggataccatgagtagagtgtccactagttgaggttttgtttgtctagggtgaacaaggtaataataataacaatgacaataataatatggtcataacaaaggtaaataggcatggctaaataaaacagtgataacgcgggaatttaaataaagcggtaatgcattaatttaaatcaaaataattttataaactgggattcaatatgctcaaggatgatgtgacttgccttgctcgctttcccaaacgacggcttcaacttccacgaagagcggatcttccgaagctgcggcgtctacacgaccaacggaaaaagaaaaagacttttactctaataaactccaaacaacaagcaggaacaaagcacaaaaatgggttctttacttctta

SEQ ID NO: 59910 - DNA, 3136 bp, Oryza sativa
acgaatgaatggtttgttggaaggaaacgtggtgggaggaaaccaaggcgatatttgggccacctgctaagctctaacatgccgaaattaactatactactctctccattttaaaatatactactatcagttacggagtatatacacacttatggacgaaattgcaaagggcggaccacggacgggccaaatataccagcatttacgagttgaatataacaaacgatatgggacaaattgtattgcccctgtggccgaactatttaccgcatactaggtgataccttgcactttgctgcgatattcataaatgattatatgttaaatattgtcgaaatgatgaaaagttgaaatattgagaaaataatgtgaggaagattatttgacatatgcttattgatgatgtgtcatgcttgcatgggatttaaaataggctagaacagtaattgctagtgagtgaagatgttgcatgatgcttgcataggattttaaatgggctagaataataattgctagtgggtgatgatgtggcatatgcttgcatgttgagccttagcttctaataattgttagtgggtaccaactatatagaaagtatagatgggctacaaaaattagggaaatattcatattacatccctcaactataggacgccaactgtaaaacgagagagaagccctccttcaacttataggggaaccaatcaaaattgtcatgggtagcggttctaaattgatacaccaattttttacgagtgctaaaaaattcatttttttccaagaatactaccagtatagttatatatatattagaaaaaaagtagttatttacaatatcaaaaggataaagcatgaaaaggagaaaaagaagagaaaaaaaaaaggacagcgagctagcagcccagcagcagcagcagcagccagcaggcctggccttggggccttggccggtccatacaagcaagacagcagcagcagcagtaaagtgcagtagaagcactgcggcagcagcagcgctacagtaccatcgcggtactgtagctagaagataccctatgtatctacctaacatgtgaccttacctagtactatgaatctggacgggaggatgtctagattcgtagtactagataacgtcacatctaatactaggtagctatattttaggacgaaggaagtagggagcaacttaaataggaaaggttgctcgattcccagaattttggtgttaaagcgaagacggaaaacgtagtgagttactccctcactacgagatatacctttgaccttatttttctattataatatatacaataaataaatgcatgtttacttttattatagtgttttgaaagacaaatgtatatatatttttctaggttctttaaactaaatatttttaaagttattaatggtcaaagttataaaagtttaacctcaatcttgtccaaaaggtcaattaatatagaaccagagaaagtatagtgttagatgtggtccaactgaatgagatggacctaatacagttttcggaccgtgggcgtcacaaggaattacaaaagatcgtaaccagtcaaaaacaaggattgtaactctcattcatcctattttaccaatatatggtcacacctctactcttatactctctccgtccccaaaataaaaaaaaacccacttttgggtagtggggttttttttttacggaaggagtagctcacaagatttagaaactggtacacccttttttatttgaaaaagtctgaattatgctcttaaactattgagtgagtacgaattatccccccccccggcgcaaatacctgaaaacttgatttctttcacactcaactatcaataccggatttctttcacactatcaaaactagatttctttcacactcaactatccaaccggagaggttttggtcttacctggcagtccagtcacaaattcctttttctaattggcgggccttacctataagcctctcaccctctctatctctttcccctctgctctctatctctctctttcccaaatacccctctctctctctcttctccctcccctcatctatatctctctttcccaaatcctctgtcaatttctcaacacgagagggagagccggatgacggtgggcgggggttggagtggaggcagctcggggcggcggcgagtgaggccagaggcagcttggggtggcgggacagcgatgtgcagagaaggagggacggcggtgggattgaggcgggtgagggcgacgggacggttgtgggcgagggtggcaggactacggtggacgcagggcgtgggaccggggggaggggggtagatgcagctcgggcgcggaggacagcgacgggcgggggtgggggcatctcgtcttggatcaggtagaggccctatgtctcgccgccaacgaccactgtctcaacggcactacagtagctcgccgaagacaaccaccgtctcaacacggccaatgctctcctcgatctggatgtgcagcaccttccatgttggccaccgtctgcttcgtgttgcgggcaatgagcgtgcgagagagagagaggggtgagaggggaagagagagatgaaagagatctaacaggtgcgccctattgatttttttaataaaagaattgttcactggattgccgcgtaggacctaaaccgcttgtaaactgctcgggggagggagggggcactggtggagaaatcatctttggtcggttgcccaaaaacaacaatagttccggatgcttaaaaaaccgggactaaaaagcatttttagtcccggtttaaaagtgcaatgatctttagtcccggttagtgttaccaaccgggactaaagatcatcttttgtcccggtttatttattggcacgacgtggcaggtttcctaatatttttagtcccggttgtttataccaaccgggactacaaatcagtttcccacgtatctctctcttccctcgttctctccgcgcgcagagtagttagtactcaatcctcacccttatctcttcctcccctccactctttatctctcccttacgccttatctctttctcaccttcctctttcactctcatctcttactatgcacttcctctttcacacatctgagcgag

SEQ ID NO: 59911 - DNA, 14466 bp, Oryza sativa
ggatgatttgggatgttgagatgtgtggatttgggatgtttgagatattggttgttgctgtggatgatttgggatgttgagatgtgtgatcgatatgtgatgagtgatgtgtgaacacaaatctatgatatttggcgccagaaaagaaaaaaagaaaaaaaataacttttgtaccggttggtaccatcaaccgggagtaaagattctaaatctttagtctcggttggtgttacgaaccggaactaaagatatatttttagtcccggttatttcaatcaggactaaaaatagacatttttagtcccggattcgtagtcccggttgggaaaccgggactatagggggttcccaaccgggactaaaaagcgattctccagtagtggggggtcatccggtatcgatagttgagggtaaaagatgtctgatttttagagggtaattcgtactcactcaatagtttagggtgtgattcggactttagacttttccctttttatttttatgggtgcgaaaaaaaccgaaaaaatattttgtatattactaggcaatacatggttacacttctattctcacaacacacaaaattataacaccatttttatgcgctcgggattacaagtgtttaaatccgagatctctgcatccaaagcttacttaccatctcacctagtaacaatcgttgtttttaagcaaatactatcattcaaaacttataataaacatcatagataacttcgaatgaaaaatttgtcaactataaaattgtaggtctcattaagatcgacaattttcatataaatgttatctttgtccgagattgtttagaaatattaaaaattcacttatcccaatagatctgagaacttataacacaatttcagacatccagacaacctcaaataaaaaaaatttcagacatccagacaacctcaaataaaaaatttatgaactacaacgttgtagttttcattgagctctataaatttcatgtaaaatatattttatatgacttgatacgaaaactttaggtaaaaacacatgtataggagcgatgtaatcatatgtaccggtttaccactcataggtgccgtttttattaagaaacggtatatttgtgatgcctatatgtgccattccataataaaaactgcaccaattaggccgtactagaagataccggttattataagaaccagtacatatgtgatgtctattagcgccggtttattataaaattcagcacgtatgaagactattggtatcgggttttttaataaaccaatactattgagtagttatagatatcggttgttaattttatcctgtcgaaaggtagaaaacgcatcataaaacacactaacgaaaatcgagctaaaatttgtatcccatgtatccgattatcacgtttaaacgaggactagtgacgaagttgccgagacagttcgtcgggcgtgcactacaccagtccgtacacgttcagacgttctccacgccatgcgccccaacagagatctggccggttgcgtaccgactcgttgagttggccacgtagttgacacttgggctgtgtttagttcagcgaaaagtttagattttggttgaaattgaagatgatgtgactgaaaagttgtgtctatgatagattgatgtgatggaaaatggctgaagtttggatccaaactttggatctaaatgttggatagtatagggagaggtatacttcgtaacgtgggacacattgtattgagcctcgggggccggtatatataggagtacatgggaaggagataaggaaggattacagatatggaagaaatccaaacaaaccaatcatatcctaatatgactctaactaccatatactctaacatcccccgcagtccaagcgtgagcagcgcagacacttcgactgtagaagaaaccggcaagagtgctcaatacggatgatagcactttgtgccattgtcgacgtagccaaagcgaaggagccgagagagccgtggtcgatgaagccgtgcgtagagtagccgtggtcgatgtagccgaagtcaggaagctgatgtcgagatagccgagccacagggagcacatgaggcgccgtagagtggttgtggacgcacaggagggcgtcgtggaccaatggcgcgcgaagacgtgctagagacgaagacggtgacacaatcgcggcgatcgtggaggaagatgacgccgaagagctgatgtagtagaaccgtgaaggacgagacgtcacaccgggtttaccagacccggggacaactcgggacgaacgcgcgcaatggtgttgccaataccgcgcggacgaggtaggggaccaccatgaaccatacgccaatattggaggagactagcaaagaaggcctccgagacggtcgcggcgcaagaacggcgtagagggagaattgccggagcagcacgcggttgccgaagaagatcgaagtgtagtcgaggaagatacggcgatactggcgatgagacatgttggacgaagaagaagacgatgtagcgggaccaacggcctggacggcaacgttggaagctatgtagaggtagctggaccaccggccaagagtggctacggtggcaacttggagatgcggcggcgatgctcgaagtagaggaagaagaccctgagcggctgacgatgaccagtgcggacgacgaggatgtcgatgcgcaggcgacgatgatgacgacgagagcggcgaaactgcggtccgagaggacaatacagctacagctccatgtcgatgcagcgacgagaagtccaccgatgatgtagctatgctgagaggagggcacctctcagcactgcaacaaccagtggaggtgtggaccataggcagcggcactgtggcccaagagggcgacgcagcggcaaccataagcttgatggcgtagacgcgtgctcgatgacgatcggttgcagaagtcgttgttgccgggcgcctgaacgggtgatcaagccgaagatgcgtcgggctaaacgatgaagtcgaagtagagtcgatgccgatgtcggagacgcgtagatgtcgatgaggcagtgggcgacgcaaacccgttctctgaacgggaagaaaagagacaagcagcaggaaagcacagtaaccagcccaaagtgctcaatgctccatagaccaagtccattgccatagactaagtccacggacactcttaccccttctatccctgctccttatccagaagaactgaagcagagtgagacaaagcaaagaggagcatggacggctggtccatagcggcgaatttttttgagaattaatattatttttatggaaaatcgcaaaagtagtggccaaccggggaaaatcgcgaaagtaggtccctgtcgaacgggtgcaattcgatagggcacctatcgaacgacgagcagtcgatagagccctgtcgaacggctggcgttcgacacggtcacctgtcgaacggagggagttcgacagggcccaccaccccgcgccgccaggcctgtcgaaccgggggcgttcgacaggtccctccaccgaccctgtcgaacaatgggcgttcgacaggccggtttaaagccccgtccccccagcccgtgatgcttgttcgatttgtttgaggaccacatcgccagccgccgccgagagtcgccacatcgtcgccgtgagcgccggagggagcgagggtaggggatagcaggccggagaggaggccgaggaggcgccggccgggaggaaagggttggcgacgccctccagcagtgaagttaaggtatacattagtaatccctaagtacaatgcatatgaaagtttaataaaaaattggtttaagagttgttaattgtttcgcattgttcgatgttagtatgtatggttagcatacatttgttattgctaaatgttggtagaggtatttaagtaattgtacggttaaattagttcttagttagtacatattattgatatgttgtgtgttaaaatatgtacaaaggtgttatattttatttggattattaaactagttgtttgttactaatagttgtaaattagtacacggcaatgtagtataagttgtaatagggtaattatcgaatgattaaatgattaaacgtgagactatttgtcatgttttatcaggatgtcaggtgatatgcccattcgtctgtattatggcgatgctcctatacaaatatgtgatagcggggtggatttgactgtatatgccttccatgatactagtctgaatgcaccggagcatatgggtttgaacgacgtgttagggtggttgtataatatgtttggggtagatccagtgcacgataaatttgtcataaatgccgtgtggccagtgaggggtcaacatggatggcagtggagagtagtggaggttgcgtcaactaggagttggaggaagtttgttagtaaagtaagggagaaaggctatagcctggcaatagtggtgcagaagacaacatgtgttgatcgatcgggggagtcaagtcatgccgtggtggaagaaactccgttggaaggtggacaagctgaaaatgtttggcggactgagcaaggtcgaggggaagaagtagtagagggtaatacacaaggagaggtcattgttcgtggtactaatcgtgaggccaacgactcggacgatgaagaaccggattcgcctatgcgtgttgatgcagcggaggagaatgaggcggtagtggatcagatggaagtggaaaacgaggaatacattgcgcttgtagtggaaggagaagatacaacactgtgggacaacgaaactaacatacccgatgattggacgaccatatcaatgagtcgtatgaaggtaaacgatggtttagatgcccactggtgttatgatagtaagcaggtgaaagttggacagatgtttcatgacaaaggtcacttacaagatgcggtgaagaggtgggcatttgtccagaagcgtgagttcagggtgaaggtttcaaataggacgacgtatgacgtgaagtgcatacagggtggatgtccttggagagtgcatggttacaagccacaacatgacactttatgggtagcttcgagggttgagcaacatacgtgtttgttggagaatacccgtctggtgcacagaaacctgacagcggcatttgtggcacaaatggtatattcaaaggtggttagaaaaacatctttgtcccctttcaccataatgcatgacgttgagaaagagtacggatatgagatatcgtacgacaaggcttggagggcaaaacagaaagcattggagatgaggtttgaaacttatgaggattcttatcacaatcttcccccactattggaggtgatgcaggcaagaaacccaggcacacacatggctattctcgatgaggtgaatgaatatggggagaatgttcttcgtcgggctttctggtcatttgggtgcatgatagaggcctttaaaaattgcattcctttgctctgtgttgatggcactttcatgacaggcaagtacagaggaacaattctaaccgcgatcggagtcaacgcggatagccatgtcgttcatgttgcttttgcatttgttgaaaggagaacacatcaagctgggtatggtttttgcggcacattaaaatgtgtgttgttgaaaacagaccaaatgtgtgtgttctgcatgaccgacacgccggtttggtatcagcgatacagaagctttgagaagatgtcgaacagtcccggctatggtcagaggtacatagaaaatggagcatgcgagattgtggggctaatctttatagacaattcaggcgaaaaagattgatggacctgttcaagaagttatgcttggagaatcaacaaagaaaggttgatggcatatgggagcacctggatccgttggacacttcacacattggatgggctaggaaaaaacccatagttgccagacaggaggagccggagggacttgaacccattcctaatgaagcaccaagtattactcggcgcaggaagcgtggaagggccacgaagtgcttcacggagtgggtagaatttgagccaagggagaaatggtcgttgttgtacgatacagatggatcgaggtatggtgtgatgacaacaaatcttgctgaagtgtataactggtttatgaagaatacacgacctctaccacttgttgctatcctggagggcatcacgaggggtacacagaagtatctctgtaaaaggtattccatggctagtctgaacctcagcaaacccagtgttaagtatagccccgctattacacagtacatggatgagaaaagtaagaagggaggaatccacagagtgtggcctgctgggaatagagagttgttatttgagatacgatttcgtgacaagagtggtgtcggtattgggactactgacatcacattggaatgcacgttgtggccagagtatcacgcttgctaatgcaattgcaacaagccttacctgttacatcggccatgttcccatgttctttgctgtttcgcaaaagggggtgttgatggaaacatttttgtttctccctactttagaaaggaatcgtgggaggcaacttggcgtggtgaattgcgtggttggcgtgccgtgtgtgatttcactcgtcctcctccagggcaagccaattgggttcctgactcaaatttattagttgatactaagggtcgtcgccagtcgcgcaggatcaagaaccttatggatgaagctgaagtgaaagatcgttctcgtcgtaagaaagcttgcattctttgcggggagaaccattcccgtaaagattgcagcatgtacaatgtagggcaagatgccacaggcgctgatgttcgtcgcgttccaaaggggaagtcgaagaagaaaaataatccttagttcgctattatccttggtggactccctactttgaagatcgttatcgttcaatttatgtttagtgcgtctgtaattttaatttgaactttcttgcacttttattacccgaatctatttgtaatggccttgtaattttcattttgaactgcactgcacttttaatatcgccatgtatttggattgggattggtatttaaatttcgaactgcactgcacttgtaatatcataatatatgtgtcgtgggcttgtaattttaaattgaaatgtactgaactgctcttatcttgatctatgtgtgctggtactgtaattgtaaattgaaatggcatgcaaatgtgttatttgaattatgttgcatacatttattgtactgttaccatacgtgcattgtactaatgtggttttcgatctgcaggtatggctgatcaaaatgatgggcagctgatagacaaggagatcgataggaaccatcgatcgcgacgtcttagtacaggaactttctgcaatgtgctaaagatgcgaggaccggatcaatattggcatattgatcctcgttgggttccaaggtgtgtgaaaatatattgtttttactaatacaaggtgtttatattttcatgtattaataacttgcgctctgtcatgttgtaggctgagagcagctgggttattgacgtttgcacggttggtcgagccttcacgtgcaaggtccgaacgaatccacattgacgcggcgcttatgagtgctcttgtcgatagatggaggcctgagacccacactttccacctcacagttggagagatggtgcccactctgcaggatgtgtcttatttgttggggctgccgatagctaggccagcagttggcccaacaatggtgaatgctggatgggcggatgaccttctggccagttttggtggtgtgctgcctgttgcactggaggatctcacagatgggcacgggcctacgaaaagttggttgaatcagtttcgacaggatgtcttccctgatgaccaggaggagtggatcgtgcagcggcacttagtcgcttacctgttgtggttgtttggatgggtgatgttcacgggaactcacgctgactccgtggacaagcacttcatccactttgcggagcagattgcagagttacctattgcggagattccacagtacagttgggggtcggcggtacttgcggcgacatatgccggactgtgtgatgcttgcgtgaggaacagcaagcaaagttcactccctggatgcccgttgctacttatgttgtgggcgcacgagcgcttcgacattgggaggcctcagcttgactcgtacgcaaactacggtttgcgagagatgtacaggtctggtgttgatgacatcgacgatcgtcccactatgggatccttgtggacacaccgtgaggtaatttttgttaaattcgtttatgttatcattatgaatactagttcacaaactttccttatatgactaatgaaaactactacttgttacagccgcagtgggttagcgggacgacacgtcgtgtctacactcagtttgtagctgactttgatcagcttacgcctgaccgtgttcggtggactccctacactcagcacgatgtcaatgatcgtgcaccgcacggtctcgcggatctttgcacgcgagatatgcaactctggaggacgacttgtcaccttgtggtggacgtgcacgtcgagccacacaatgtccacagggttctcaaacagttgggcatgtatcaggacttccctccgagagatggtcgtcctttggctgatagtcttcataggttagttcacatcacagttgtttaatcctacattttttaaaataaatcattgcacaacattttttctgatgtgtgaatttgttgttgtgcaggtactccagaaaggggctcgggctttcctacgagctagttattgtgaccacggttcagccgacgatacaagagtgggagcacgcagctgataacttggcacttcagacacctccagacgatgggagttattatggagcttaccttcgttggtaccgcagtgttacacgatggaggtgttttcctccacaaggagatagcaccgtcccccaccaggcagcgattactgacacgtttgcccctcagcctagatcagcttacaactcaatggtacgtgtttatttgtggaatttgagcaactagttcaatatttttaaaaagttagcaagtagttcagtatgtctaataaatgtgcaattggttcacctagttccttttcttacataaatgtggaactagttcagtatttataaatgatgtgcaactggttcattatttctaacaaatgtgcatcttgttaaatactcttaataaatgtgcaactggttaaataattttaattgccttgattatttgtggaacaggcggaatttgttgagcacgttcacgtggagtccgacaccctgctgcaaagactagaggcgagacctccagtcgtcaggcctgacgacgtggcgagtgtccttcgcaacttccgtgcacgtgctgccgcactactacgtcgtgtctcctgtcggagcgcggcagatgtggtgcagacgtcgggccgacggccatcaccaccactaccccgacgttccagcgtggatcggagtggtccatcctcttcacgtcgcgggtacgaagcggcccacacatctcacggtcatccttcctttcagcacaccccaacaccggagtacaccagggggtcagccggatcaggggtacccacgtcgagcacggcaccaccacgtccgcaggtattccaaactccgccttatgttcacccctcacagggagtatctgggtcggcacacttcccttacatgccaacgggggacaacgtgttgaacacaccagcatggggacttcatatcactccgcgtgcgccagagcagggccacacacagcacacatgtaagtcattttaaacaataacacgttttagtttctaattatatgtatcgttactaactacgccatattttttggtttctccctcttgtacaaacagacgatgagtacggttcggcgtcgacgcatcacggagtgcctgcttactcccctcgcacagcattcattgaggacttcttttccactgatcctccccagggggaagtagggatggattactggcacgcagcacctcaggtcacacagccgacgcaggagacggaggccggtcaggggccagacgtgacaccacagcaggcagctagagataggcaccccctgataatttgacatatcccactgagcagattaggcgtaggaagaagggaggacctagcaagcgtgcgaagggcactgatcgtccttgacttatctatttgtattaaacttttagtcatttatgttctgtccgtactatttgagaaacactttacgattaacttagtactatcagtactatttcataaacttcttcggataattactcagtagcatacccttcgaatgaatcatgacaaattatcattcaaatatacaaataatgaaactaaataattcaaatattttaaccaacaaataaatactacaatttctgaccaaacattatcataatatatgtcacatacatataacattacaaaaatattttcctttcttacacactaaaataaattacatattattaaaaaaaataacttattacaaataaatggagaacacgaccctgtcgaactgctgtcgaactgcggcagttcgacagcccagcctgtcgaacgggggctgttcgacagccctgcctgtcgaacgggggctgttcgacaggtcctgtcgaacggcagccttccgatctcctcgccagtcgcgctctggccgttcgataggcgccctatcgaactgcacccgttcgacagggacctattttcgcgattttccccggttgaccactacttttgcgattttccataaaaataatattaattctcaaaaaaattccatagcggccatcccccgatggcagtagagtccagatgacgcatccacgagcgcaggcctgcggcgcgggccggcagtgtggggagcacaccggtggagtcggtagccggcggtgggcgcaagtggtggagaagagccctccccgtcaatggcgtcggcacagccaccagatgccggcggggaggtagcagccggcagcgaccagcagcgccggcggggcgacgatgttggtgacggaggccgcgtccccccggcagcggcagaaggagagcgtcgtggccggctggcagcttgccaggcggtcacgaaggcgggccggcgtggacggggtaagtggaggcggtgacggccttagagccgaagggcgtcagggggcgccggcgacggggaccacggcagcgcggaagacagcaacaccggtgggtggcctaacggtgacccgcgagtgctggcgacggagccgcgacctcctcctccagatcccgtcaacaacgacaatggcaggtggccgtgtgttcctttactgctgcttgacgatgaagacaccaagacgtccaggagatcgatttctcgacaatagatgatgacgaagacggaccgcgcgagtggatcgggattgatcttctcggcggcgaactacgacgacgaaaaagaaaagaaaaaaacgggttggccgcccccgggagatcaaaacccccaggggtgacaagcggaagcttgagagaggcgactagggaagcttgagagaggcgactagatcgcccgctctgataccatgttggatagcatagggagaggtatactgcgtaacgtgggacacattgtattgagcctcgggggccgatatatataggagtacatgggaaggatataagaaaggattacagatatggaaggaatccaaacaaaccaatcatatcctaatatgactctaactgccatatactctaacactaaacacagccttggtagtcgcgctgatcactgatcagccaagctttatggtcgcatcccggggttcgtccgctgaaggctcaaggtcgcagaccaacaacagatggatccgcgagctccatgtggttctttgggatgcatgcgatcctgcagtatatgttgatttggctgatggttcgggccactatactgtcagaaggctagcctgagtgcctgattccttcctctggaagtgggatagctcaaggtcgtactccacttgctaagcctatcttgctctttcctctggtaggatccctttctagcacttgctgatctggaaatctttcgctctccctcggtgccgctactttctttggttggtcgctcaccgaccttgctggatgaccgaccatctggagaagcgtgacctcccgcacccaacccattgtgtcttttgcgactagagggattataaaagaacgaagggattaccttgattcacggtcttagctttagagtaaaataggtgagcagtgcctccgggctccagcgtcggtggcagcgaatgccgccgccacgttcaggactccacctcaacatcaagcacaccatatcaacctatgcctccgccagcatcagcttgccgccgatgcacgccgtcgtaacgacatcatcccagggacccttgagcgtcatcgctagggttccacatttcggactgaaatttttgaaattttggtaatttgggacccctctgatacgatattatttcagccggaattttcaattttttaattttttcgtgaattttggtaatatttgttcacatttgactaaattttgttccaaatttcaggatcgaaattttcaagattttaccatatcggagccgcccaatctctagaaccgatttcaaggaccaaactctagcttcctattgggccacgtggagccctctaaatttggcaataccccctccaggaatccgccacgtgtccatttggaggaaagagcctggacgtttcatcgtgaaatgaaaaaaaataataaacgaaagaaaaggtgcattggcgtgtacagccgagtcacccgtgcatgccatggggcatggtggtccagtgcggttgctacagcagcacttgcattgttgccttctcaagctaatggtgcacacaaagccaagcataaataggataaaggaaagtaaagaaataacaaagagaaaagtataaataattttgcaaaatttatctgaataaataaaatacattatggttaaaaccgaaaattgagtcatattgatatcctatatttctacaaaataaatattaagaaaactatatacagaaatatggtgaaagtttggatgaaaaatttgcaatactaagaaataatatttcttcgaatgtgcattttattattgataccatatgcacgattttttggttaataaaattgccacaattttgaggaaacgttacgttttttttctaatagcatctctaatcatttgtccaattattggcaaacactaattacatcatactttggtttttctcatttatctgggacaaacattaaattaaattccattcttctgggacaaacacaaaattagtttccattcttttgaaagattttttttatgggttaaactaacttgtgtaaacatatattacttcatcagttccaaagttccaaattactggtcattctcatatttcaatttttagatcatgatcccatatctccacctttcatcaatgccacatatatccagtaatcaaagttaacattactattactagaaagggtttgcgcgctacgccgcgcagcaaaaaaaattaaacagaaaatattacagaacgattaggtgattaatgcatatacatgtactccgtcagtgatcatttacattgattaataaacaatatactaatatacaggacaaataaagtagctgcctttttctagtgagaactcgtggctaccggaaatggtccatttataagttcatgtgcattcttctctcctgctagttcaatccacaacaaaagcacagcagtatgaatggcagctttggtcctgcaaacatgaaatggttatacttatgtcggacgatataatgcacataatagtttcgttataaagcagcaccgactgaagagtgggagcaccaaactaaatggatcaaacataaaagaagaatatatattatgaaatatagcgcagtctccagctcttatcagtcaaaataaataagtaaataaaagaatatataatatatagaaatatgtaagagcagcaggaaaatgattatccgtaggcatcgccatcgtttggaaagcctttgtgtcatattaaactctgaaaagtgctctagaatgacataagaccaacatcccgtgagctgtttgtttataaacaagttgcccgttaaaagagtaaactatgcctgacaaaaaaaatcatgctagctagctacttacagggaaaccaagatttgcaaccattaaaattaaaccaccatacatagtactccctccgtcccacaatataagagattttgagtttttgattgtaacgtttgaccactcgtcttattcaaattttttttgcaaatataaaaaacgaaaagttgtgcttaaa

SEQ ID NO: 59912 - DNA, 1164 bp, Oryza sativa
accgagccccgccaaagggtagccgcccacaatcataccaccatggaggttgtcgtcgccgtggaaacggcttgctgtccgcgaacctcctccaccactgctgcctctggccgtggaggcgccaccgccgttagatctggaggggggatgcagaggaagaggatagggggggggggcagggatgcgagaaaggtcaaaagagagaccgccgcttgttgtagagaccacccgcggcctccccttgggcgccgccgccccaccaactcccctctcaccggatccggcggaaggaagggcgccaccaccgcgcgccgcctcctctcgagcgccgccgcctgcctcctgccgcctcccctcccaccagatccggcggaagggagggcgctcccgccggcgggacctccgcccgccactgcccctcgggcgctaccaccgcccacggctcccggcacgtacagagagagggaggggatggaggacaaggaggacaaaatggagaaggagaggagctgaggagataaggtcgactcggtgaggataaggtcgatcaatttttattcgttgaggacgcacacgaatcaatcggctcggctcggtcagtttcgatgggtgttggttttttataatatattataggtgtcggtactttaaaaaccggtactatagtatattataggtgcaggttattttaaaaaaccgacacctacagactacaacattggtgccagtttttctgttgaaccggagactacaatattggtgccagttttttctgttgaaccggtgcctacagtgcttaaaggtgtcgatcttttatttttcattgtgcggaggtggaaaaggcttataggtgtcgattttaattgaaccggcacatataagactggtctctacaagggttttttatagttaaaccaacacctatgggtttcttggggatgcaccagtagcccgatagatgctggtgctagctaggctagaactgttatctatgatatcacgtaggtgcgggttttgaaacagaaggcgggacctacggggctgctagctcattcctaggagccccatagccatagatacctattctatgcgataacgagcacctataatcctacagcaaaacattggctgctatgaatgtaccgccattagcagccataaaat

SEQ ID NO: 59913 - DNA, 17278 bp, Oryza sativa
catatttcgcatccgaacttttaaagtccgcaagtctgatatatccctcttttccctataagcactttaaattttttttaagtcattcttatctctacttgtctcccaccccctcattactcatctttatctcaaactactatatgtctcaaaatcctctctcatttctcgcttctctcctcccgagctggcgaggagtggtgaggcatggtgaggagcacgggggacgaccttcccccgctcgggagaggagcggcaaggggcagcggcgggcgacgccattcccctacaggtggcgcgcgtgggacggcctttccccgcccgataaaggaggtgaggagcgataacgacgagcgcgcggctctgccgtgctcaaatccggctgtggcccttcctcgatcggatccagcgccccctcccctccccgcgtggatctgttgacggtagggcgaagtcgaccacggcggtggcgacgggaggatgaggaggacagcggctgcgacgacgacaggattttcggaacatttttcttcacatttattccttttcgcatgcggtcggcttaagtgtctacatgcggaaaacggattttcacatgcggttgtgctggttgcatgaaaaaaaaacgatttttgcataccttttggtgcatttgggccgcttgtccacatgcagaaatcggtttgagcaggatggaaaaaatgtttttagtagcggaatgtatgtgcaccatataaaacgtgtttaaagaaaactaacacttgcaactgttggaaatcgagatagagccaccgattgaatatgatattataccaaatattattaaaattttcactataagctaattaaccatatcaaattacgacaggacaataaaccaaatatgtatctgctatcatactaactccgaaaatttcttttctgaaaaactacactaagttggaggaaaatcctttgggtcgagcgttcgatgcgcgccaaaaaaatcgggcgcccgtgcccaccacagtgttacaagtgtaatcgtgatgtttcattttgttatggatcaaatgttgcagtggattttgatattgtttaataatgtcatcttgatggacacgtgggttgctgatgtacatggggtttaagtgctgcaatgacttcaaatcgtttgttgtatacgttgaaccaagttgttgcatctagcgatctgaccttgtttcacttttttttaagaattgaaacattattttgctatttgctgaaacattatttttatatagggtgaaacatcgtctaattttttgaaaaccattgcgcagagttaggcacggcggtggggcaccatggtgtcggttctccgcggctccagcgacgggcgacggcgtcgccagatctggtctccccgcttggccggggtgatcggcgacgggctcggtcgtcgccggcgccgctccgcggacctggcagggaggtggctagcagcggcgatggtggcggatgtggcggcgacgaagttggcgacgacggtggcggactgcggcgcgtgccgcgacgccggccctcatcaagaacctcaccaccacgagggaggcgcggcgccctcgtcaatgttccggctgtgaacgccgtgcccgtgacgccttcctccatgatgccggcgacccgcgcttcgtgctacaccttcgatccgcgccaccccggccggatctggacggctggcgtttggcggcgctggctagcaacggtggcggctgacggtggcggctggacggtggtggttggacaggggtgtccgtggtggtggcggtggcggctgtcgacgatggtacctatagcggcgatggttgaaggccatcatccggctgacggtgcgtcggcggcggcggcggtatgtggaggcggggaaggggtctagcggcagggaagaaggagtccgggtgcgggcgcgccgtcaacggcgggaacaacttcgggcggtggccttggccgaatcgctgaaaggacaatgttgttgaccgacgacgatccttcttgtgcggattggtggtgtgggtttggacagggaatcgcgggcgaaagccttgccgagccatttggctggctgacaacggcgacgccgtttggcgtcgttccccttcttggaggcgttgttttagcatacccctttcctttctctaccatattctccgggtgaaaaccttgcttcggttccgaacgagcgatggcgacgatccacgtcgcatcctccttggggcaccgctttggagaaacctcttcgtgcaaggatattgtcattggtctatgcattgacttcgaacttcagtcctaggccttgcaaggccttctagctccaccttttgtttttcttttctcagttgggtcatctcttctcttgtttggtgtgttcaacttgtcttgaactacactctcttctggagtagatttttgtaataattggctgtaattctttttgagcaaaggccgggatattatattttattatctaaaaaaatttggtgtaagagcatctataatatagtacaaaagtagtccataaaaattaaactattcccattccattcagctacctagcgacaaaagcttcgaaccaaatactcctactccgcgaccttcattctctttcctgcaaaagttcagtatcgttggttttaccaatgaactaaacaaagctcgttaggttaaagttaggtttacctttggggacagtaatcctgaccagctgtagaccccgtgagaaataacacagagacgtgcgaagagctgtgaccgcgttgccggctcagctccacagctgtaaggccagcacacaccgtaggaccggcacgtggcggccagccacgacaggataagccgatagactgccccggtgccgtggcgtccaggcttaagccccaaccaaaatctgccacgtaacgtggaagctcacgtgggcagccagcactgcagggcccaggcggcggcgccttgccgaccttgccaaagctgagagctccccgcgcctcgccgccgtcgccaaccggcggctttgaattgaggccccagcaacgttcaaacgtgtatccataccaaccgcagccgagcatctgtggtagtatatgcccgtggcatgtcgggaacgcaaatatcgcccagcgcctaacatactagtactaccaaccaaacattatctgatctgatcctgatcctgatccaatctaatctcacatggcgcactaccgttctcgtcatgcagatccagggaggacgcagacggattagcagaagatcagaagaatacgattttcttttatatagggtattttgtagtagttgtagctctaacttgtgcagttgtgcaactcctacaagtagatcggtacggattatgtgtaagacagcaacaaaacagattagccgtcaacgtagccagccaagctctttaaaaagcattaattaaaaccactaccaacagtcaaaccccccaaataaacggaggcgcgcttctactgcccgtgaggcacaacagatcgttacgatttcgaaccatctccatgtcgcatgtcgctgacgacggcagctggccctttttactgcagtcacgggtgagcgaacggccgaagcgacactggcgactgggccgtcccccaccggttgccccgccacgccgaagcatcgcgtgcagacgcagacacagtcaccacgtagtcaaacacatgcccactcgaggtgatatttttccctctgcgttgcacttgtgtgtggcgtacacgtactactaccggatacagtacagtcgtagcgaacgtggctgagttatgggcgtacacgtgggtgtcgcgaggcggagccgcggttgcagtgggaacttgggtctcctccaacctcgtatggtcgacacgtcacggtcggcagcgagggttgacgtgaaggggattgcgggggggactgacgcgtggatggtgactcccggtccccggcacgtgccgctccggcgggtcagtccatccatctggctcactcgtcgctctgtccacgtcggtcggttccaccacctgggtcagtctttttttcgtttttttgactcgtcgctggcttctaaaaagtgtagctaaatttaaatttcaaaaatatttcttttttttgttacgagtactcctactcctatcatttcgtttcacccttagggtgtgttttgttcacgccacaattagaagtttggttgaaattgaaacgatgtgatggaaaagttgaaagttcatgtgtgtagaaaagttctgatgtgatgaaaaagttaaaaatttggagaaaaaatttaaaactaaacaaggccttatcttcgaaactgttgaaaacgaaaacgcagtaatataaggtatgaatgaggtattggcctgttcgactgctagcaacagtatcggcgatacggtatcgcgcacacgcgacgcaaacacagctgcccatctgctgaacaagcttatttatgtgaaaaaaattgctccaataaaaattgatgttttaaagagacgagttaggataagcactcaacatgaaataagattaatactattcgcacacatgggtgcagccagtaatgaagtctactctctttaataaaaaaatataacttaatggaggacaatccaaatttattgttttatgtctcatttctaattaagatgattttcttttatggaggaactctatctatgtgaagctaggcattcaacgtataatcacctgcgcgtgtatgtgcgcgtgagcacaaaagtggtgtgtttactcagttaaaagaaacttacatctataaatacattttagtctacacaagagtataaaagtggtatgtctaaattcgtagaaatagataattgcttatttgaccctgttttaaagcataattatcaatttgaccctacttgtttttagtttacttatttggacctgtttttcaaaatggaatgaactatttgaccatgttccgttaaggcgggttaacacggttaaataggggccaatagtccattttacccttacttatttgacactgttatatcaaaatatacatatatttggaccttttaacaaatctaaatcaatttgacaaatttaatagacagtagctagagctcggaggttgatgctgggtgccgctgtggaccaccctttgcacgccgccaccactccaccgcaagacagcacgcgcggacgtccctacacgcaccgcacggtggcgccgacctccatctgcacgccgccgcccccgaagccgtgcgccggcgccgcgcgatggcgccggcgccgacttccctcagcacaccgccgccgccgaagcggtgcaccgctgccgacctccctacgcatgccactgtgatggcgccactgccgacctcccaacgcgcgtcgcgtgacggagtcgccaccactcctccctccggtcctccgccagccaccgtcgcctgcctcaccgtgcgccgccgccagtgctccctcccttcccacagaaccgccgcctccccatcaaagtccgccaccgctacaccgccttcgctgaccgccagagctagatccgtcgtgcgcgtgcctcggcaccactggatccgtcgcctcatcgccgagtacaaaagtggtctgttcaaattcgtagtactataagactggctgcgttcgttcattggagataggggagattgtcactcgttttccgcgcgcacgcttttcaaactactaaacggtgtgttttttacaaaaattttctatagaaaagttgctttaaaaaatcatattaatccatttttgatgtttaaaatagttaatactcaattaattatgagctaatggctcacctcgttttgcgtatcttcccaatcctctctccctcgaacacaccctaaatgttttattcggttgtatgttcttatattttagaatcgagaaagtaattaactggaatagttatttagggcttgttagtcagggatggaaacagttaaaatgggaacattaattataaatgtgggccatgaatggatcacggacagtagccacgcgttgatcctatccaatagcgtagcacggccgggggaacggtggtccccagcaaaaggagtacgagaagaaaagaatggagggacggcatggcaggcacagtgcaagattgtggggcgccgccacattatcctctctctccccccggcccgtatttcgtgccgcgtaagccaaccgggtgcgtgcccctggcccccactcgcaacatggcttttgctacagctatagagtagttgtactccagtgggccatgcctccatttataactccattggccgcccgtacggatttgctaccaacttgtggaatcaacaacgatatcgttaacccatacccgtaatagcttcgttagtttagtgatcatcgtcacattttctatacttagttaagtttagttaagtatacgggttttttaagttaagtatacgggtttagaaatgaaaattaaagttcgttactcggatacgcttacatcgttttttaatatatagtcgcaataagtgaaaccaaggtaatcttttagcttgttaatgttagcataagagatcactattttttttatataggccttgtttagtttcacactttcaactttttcatcacatcaaaactgtcctacacacgtaaacttttaacttttccatcacatcgttccaatttcaaccaaacttctaattttagtgtaaactaaacacacccatacttaatattttttaacttagaacttaatcttttaagtattttagctaatatttaattaattatgtactaatttaacgttctttttttctgcacgaaggattaggtggtgtttggattcagggacttaactttagtgtctatatttatacactaatttatagtattaaatatagactacttacaaaactaattacatatatgaaagctaattcgcgagacaaattatttaagccaaattaaatccataattaaagaatatttactgtaacatcacataggctaattatgaattaattaggctcaatagattcgtctcgcgaattagttcaagatcatggatgggttttattaatagtctacatttaatatttataattagtgtccaaacatcttatgtgataaggataaaaagttttagtcccatctaaatatggttttagttccaacccacgtaaaagaatacagcctaataaagtaatagtgctaacttagtagtattatcttcttctctttttttgcccagctactagttgctgctagactactgctgctgtgctgtacaagcttgacaggatcatgaagagaaggttagaatgtactaagaaggtgaggtgttattccaagtcttgatcagaaagtaaagcacgcgatctgcaaaaaggggaaatcctcggacgggataacataatcaaagcaatgtgcacagtgacttttcgcgcgaaaaaaaaacatatattagtacgtactgatcctgcatctggtcctggtgatggaattaggtatgggaaagagataaataatataatgggcgaacagtattataagggtggacccggcgctatcaagaacgtgaaggcagtgttttaggatataataaaccaaccaaatcttgacgtactggtagatcattaaagagatggtcctccacgcggccaattcattaagaaatcgataattaaagaagggattaccactacgctagcagtagcagtagtagtagtagcaggtaggagtaattgttatccggataaggttactgcagctggagctagcattatggtacttagtttgtttaggttaatcctcttctgcgcccgcactcagatcggaaaactgcaaattgctgtaatgctgaagctgtcatatgctgtgtctatgtggcccttttcatttgacccgtcttttagcaattttcacacgagaaattccgacgttttcacgctgctagtcgtgtgctcgtgccgggaaacagccaggcgcgcgccgcacagatcaacatcgtgtgctgcacgccgcgggatcggggcacaccagtgaaaatcaccaccgccagagtcaaccaaaacgtacgcgtcgtatgcgcgcgattcgtcgacgcgtctcgtcggagcaggcagcctctcgctgtcgcccgcgtcgcgctcgtcgatctcgatccgttgctaaactcgaacgggaatgcgagctaattacggggtttagcatgtgtaataaggtgcggtgattcgatcgatcggcatcctcgtgcatgcgagccgtacgtaccggcctaccggggggatcgaaaaaaatcgtgtgggtctctagggtcccaagtgtaatcgcttccatgatttttttggtgaggatgatgtatgatgttgacgagcaactcagaaaactactatctcctcaccatcaccacttttatcctctccaaaaaaagagtacgaagtagatttcatcagatggacacttggacggatggtggtgctacgatcacgatagatctcttggggccccttcccaactgtaccagattgcttaaaaaggatggcactccatgtctcacctgaaaggctgatgactcggagctatttccagacgtgctagaaggtgaggtgtcgtccaacgacaccaccacgcaacaatgctcgtcagaaatatatcgtgcgatttctgctgctgctgctgtgtgcgatgcgaacatttcgctggagaaaaagaccagcgcactcgactcgaccaccatgcatgcgctgcgctgcgctgcgctgccatgtgtgcgcctcggctcggcgacagcgcacggcgcgtatgcgattcttgccttggactccatgccattgcagcgccgtgccatgtcgcgccgtggccaggccgccgcgccgcgccgcgcccaagtctttgactcgcgggacgcgccgcgcgcgcgcttttctgcgccggaatgcttgaaattttcgaccgatcggggccctcgttctcccgacatctccgcgccgacactgcccggtaatccgcttgcgttccggtcaactcgtcgcattgctcgcgatggatttcgtcgcggtgcgtacactggttgcattgcatggccacttggccagcaacggcgacgtcgtcgtactcgccgttttttcactcatgtcgttcgaccacaacacaaccactacacacgactacacgagtcgcgactcgcgagtgagtacactacactgcacacgaaaggaacatgacgtagccgtagtatcgcccggtggtcgagatgtcgaatgattggtcgcatccaacgatcggagataagaatatcgtatgctactcgatcgtctgtactactgctattatcgcaaaggctaaaagggggattagctagctagcgacatactcacattggggataatgatgctgtggctatagtgcggcagctgctgctgggatgacaggatgagggcagtgggtacaggtgttgcttttgctttctctgcagatcttcttcaatccatcgcgagatctttgccgtgattgtatgggtttgaccctggcgaatttcggttggcaattgcttagacagttcgatcaggatcaattcccttttcatttcggcgacgtcgtcgttgtggatcagatcaaagagtaggttatggtataaaaacagtacggattcattggaccatcctatacttgattagcatgttcaaatcctttactccaggaatgtttggcagcattccggctcagcatgtttcaggccaccaatgccatcgaaacatgggtacttttttgcacagaatacgccatgttatccggggtatagggcttcggtttgttgatggcgatcttatctcttcccgttttgtggcgaactaattgcgaattatatattgcacgcgcgagaccgtaccgaattagaagtccattaagaaaataaccgaagaaatgaagttgttggaacgtaggagtaaatctactttaattcatatctgcaaatcttgctccagaggcaactaccagcacatttctgtgcctaatccataacaatattaaattactggcacacacgtatgcactactaccattgtagacttggtagtagttgttggcaccactactacctttcgttgctgatctgggtcatgaccattctgcccctgagaatgctatacattcacaaagtcaacaggtcatttgtaagtgtacccgtatatattggtcagctcctgtggtctccgttaatatcggctcgttttggcatgactttatcgaataaattaaatcaggtcaaaccaataatcgagtttgctcgaacaaaataggtgtgtgtgtgtgtgtatatgcaggatgcttaggagacaggtgctgggatgcaggctctccttgcatggtctaattggtatttccatgtcgtgcagaaataattgggaggagatcgtacggctccttgcataattgcattgtatattatattgggtactgtactaatttcttcatctagatatataactagatttagcatcgaccaatgaaacggagtaactggactgcacgcaatagctagctactccagcttgtagtttggtcacacaagctaggtgaggaccagggacaaaaggaagcagagagaggacactgcatgcgtgtcttgtgtcgtgcataatttggggttaaacatgcgttcctgctgctatcaatatgcacgaatccaaggcaaaccaaaacagtagcaaccgataactaactccgaccttaaattaccacggcaatttgtcacgaaccaacacaatcacaccaaatctctcacataaatgccaccgatatattacaatccactcaagaatataagtgtttagggatacaaaattgaggagaaagagaggtatagtttgagaagagagatcagacaagaggaagcaggagattgggactagagagtaggaattgagaggggaagcagcagcaaggaggaggaagaagctatcgtctgaggcgttctggtaattgattcatcgatgaccctggctgctggctgctggctgctttgcctcttttctagtctccttctccctagccgaatgggcccaaagccagcccacttgtctagcctcctggaaagacatcacagcaggccatgtacatgacattcttcccccgttaagaatcggcttgtccccaagccgatgcaactgactcgccagattaatgcccccaagatcccaaggtacctgcagggaaatgccttgttgggcagaatcccagaacaattgtttgatgaccttcgaaccatctgatgtagaccctgcccactgttgaatccacttatccaacatacataaaacctgagcattacaaccacactctctaccatgcttttgctgcctcaaccaccaagccttcacgccttcttcaccactactatcagcatatactccatgagagcccagatgtaacatgcaaatattgagatcagtgggctgagaaacatgcatatgcttctttgtctgaatgagagctacttctttgtttgcaaactcccaaattgctaaaaattgtatggttttaccttgatcaccaaccaatcttgcatcaactaatttaaccactcgataggcccatgtgtgcaagactatgctgtcctcacaaactaaacaaatgaggcatctctctgaacatttaaccagttctattccacgagaattcttactgaaagtgctagcttccaaactgagatggactgcaccaagtttcagctgctccctttgtaacaatagctcatgtgtctgcccatgttaattattccattgaagaataagctcagatgtacatagcaactgttgtagcactgcccatattaaatcccaagaattggcaactgacagccataacaccttgtttgtatattctcttctaataactttcacatttgtccataacattagtttcccttcagatatacacttccaagaaaaattgagcccttgccctcctgctgcacacaaactgaatacctcactcctccattgcgaaggaggaggccaaggttgcaagttgaccaactttcttgttgaaaccctaaatgcctcaccattgtttgatccaaattgagtccaagaagtatcatctagtacatcattgttgttactctgaacctgaaatgaaattggaatagtatagaaccgagcatggcgatgggtacgtctctcatgtgacttgcaagtgcaattaccatcaacattagctccactgaacaaacaatcacaccatgcatcgggtgatagatgggaaatcagcatcagcagcaagaacaattcatgatccccatatgcccaaccataggttgaatgatgtgtgtgctgataggccttcctaaaggcaccagagagacatatctcataccaaatacaccatccaacaatcagattttgcagcaagccctcagtggaattaattgttctactcatgaattgggcaacgctgtagttcaaggagacttgatgagactcaccatataaattcagtgtttcaatttcagctcaaacacttgtttgaataagtggcggccagggttgtaagagttttaccaccacgcctccgctgccttgacaaagctgtggatcaagccatggtaacggccgagaacctgaggtcatctcagctttgttccgtggaattgctgctctccaaggtggtactggtggagggctagctgtgtattctgagctccggtcaaagcaaccatagagtacttccaatttcaatgaaacgaaagagaggccgacaactccaaagtagtcacggctcaagcaccaactccagttcctgggaggaattgcattgatgattaacaatggatctctgaagcataaatacatagtggtgaacttggtatctacttccatgagctccatccactcctccttggccatgtctttgccaccatcatcatcagccaactggttctcacacttcattgaacactcgatggttgttcccatgccaagcttggctgtgtcaacatggttagttgagccggcctctgtactgacctccaatgcgatggaagttggatcagtgttggcgctcaacgctgccacatctctagtggaatccttgctcaaggataaatccaccttggtgtggcgaaatgcctccagcatccgatcgatcttggtgcacaggtcttgaatggtcttgtctaagttctctaccgccttgtccatgtcagtctcagccttcttggtctcgttgaaaggaaccgatgtcaccatggctgctgatgtaattgagggtatagatgaagctgttgtagcagggaacacgcgttctggtgtagcagcagtactcttggccgctggcctggcggtggcgctacttggtaccattgtcaaacaggtggtgtgcgtggtggtggcgccatctccagggaacatctggacgtgctgcacatccattaagcagcccccgtcgtagatgtcgcgaccgtgggtggcggaccgagccctctccgcgtcatggctggacataaatgacacaagagccttgacttgccatgtgctcactgcaagaacctgcaccgccactgctccataggtattgtacacttgatgcaacacctcagatgtcactggatatatgatctggctcacggtgacgcgaaggacagcagctgaatcgcctcttggacaggtcgacatttcatcgaacaggtggtgggcatctcctccaaagacaccaccaccaagttgttggcagttcctctgaccaccagcgctctcccacttcatctccacaccagaaaccccacgaattgactgctctgataccatattgtcacgaaccaacacaatcacaccaaatctctcacataaatgccaccgatatattacaatctactcaagaatataagtgtttagggatacaaaattgaggagaaagagaggtatagtctaggaagagagatcagacaagaggaagcaggagattgggactagagaataggaattgagaggggaagcagcagcaaggaggaagaagctatcgtctgaggcgttctggtaattgattcatcgatgaccctggctgctggctgctttgcctcttttctagtctccttctccctagccgaatgggcccaaagccagcccacttgtctagcctcctggaaggacatcacagtagcccatgtacatgacacaattccgggctagtacgggaccaaaagcatggaaaaatcatgctttctccaacgaaaggataaggctcttggaaacagctactcgatcgtactcccatgaaacctatattcaaatacgtagtaatagaatacgtcacatccaatactatgttgttatattatggaacggaggtagtagtatcgatggtgtttttaagaacttctcccaaaaaaataataataataaatctctaaacagtttttctttttatttcattatgtaaaaaaatagttattgaattaaaaaaaaggtaattttatcatccttaaatttaccagaatgtatcacactttctaatgtaaaatttgataaaaattagtctaaactttaaatacatcgaaatactttttctaggatcataaaatttctcactaaaaaaaactaaaagctaaaagctggctttctcatcttcttcaaattgctaggagctaattaccgatcaataatttgccataatcttttgcggatctaaggagttgttggtacgaatatcgccgacgaggcgcgccaaagatcacccacacacacaacacgcacctcacctcacctgccctccgctgatcgaaattagagcaagcccagcagagcttccatccggacatccatcccatgtttggcgtatggaggtgaaaaaacacggtccagcagagtctccattacacacgccattttagatgtcctccaaaccaagccctctccatgccatatttggcgtttctctctcctcacgccattcccccaactgcccagctccgacgaactcgcgccaccattcgaacttgtgccaaggggaatagagaggatggacataccgggtctgcagttggagatcgccggagtggaggccccgccgtccgcgccgccccactgctcccgccattggtcctccgccgcgcgccgccaccatccggactccgcctgcgccgcccccactgcaggcgccgctgctccttcgctcgtgctggagatcgccggagtggaggccccgccaccatccggcctccgcccgtgccgcccccactgcaaatcaaccggcgtcgctgcttcttcgcttgcgttgcccatcgcgactccgtccgtgtcgccgcgccaccctgccacctgcaccgctgtacctccgcccatggcgccctgcccccgtcggccgcgccatcctgccgcatcccctccgtcgctcctccgcccgcctctcactatctgttggtctcccaggagcgatggatttggtggattttgttttgttttgttttgtttttagcgagaggataaggtaaatgtggctgatgtggttttaaaagaggattaaaggtggtacacagtgttctcaaagtggtaactgcaattaaatcgaaccaacacctattcaaaccattgtaaatatatgcctcttaaaaaatcattagatatatatgggtagttaaaaaatattagtaaaatatagaatagtgtgatatgaatgctgtaatatggatgatttattggagtgggtaaaggtatagaggaggaatcttttttggatgaccattcaaatagaaatatagaagtccaaatttaaatgatctgctgggatgctcttaagcttcttctactagtcctctgttgcgtacgagcaggacgtccaaaggcttcgtcatttaatcgcgtctcgccttgcgcgatctccaatcgagctaatggtggataggtgatcgatgtgttggatattttctggtccggacacgcacactaaaccctatggttggtagcaaaacgcgctgcacggctgcactgcgtcgcgtcgcgtagcatcgcagtgccggtggttatgcttgtgcctttgtcgatggcgtttactagtacatggaaagttggaaacgggagttggttatcgatcatctcgccattattagcggtgatgacacttggctccatcaccatgattcacgattattcgtgtcatcgtgtgcgtgagggcaacagaaaaaaaaggagagaaagataggagtagtactagtagtacacgtgagtagctgttcgtggcatggatgaggtacggctttcaatagtggccggaggttgtggatttggagccttggaggacgtcctacaacggctacaggagtggagttcgtattattggagggcaatggaacgagatctcgacgacacgtcgatatggacacaccagcgcacagtgcatcgcactgccatttgagatgttgtgagtgcatccttttaaccgggagtccgggccattcgattgttctgcacgaggattactgtactgatgtgggccaggacactgctgccaatgtgggtacgtatgggcctctatggcccattaccatcatgtacttacatgatgtgggtcaggccactgctgccaccgtgggtgaatatgggcctccatggcccattaacatcaccagcaactgtatatggctcttactccactatttggtttctggactatgaactgaactaatcagcaatatgttgtgattcacgtcatgtcaagattcactgggcagaagttaaaatataaatggacggaagggaggaacaagtacaagcattcagataagaggatagacacatattgctttcaaatattcatatattctcactttcatagacatagggtgtgtttggttgcaagccacactttgccacacctaaggttaggcaaatttgacaggtgtttggttgtagccacagttgtgacaagattcccctccaacaaattaggtcccacgtgtcaatggctcaaaaaagtgtggcaagattcccttaggcttagtaagttgtggctaacaatttgatcacctcaccttaggcaaggtgtggcaacttttgttggcaagtaatggtaaagtgtggctgggaaccaaacagccccataaaaacgcagattagttacaactccagtcccagaagagattaggtcttcacccagaacgctatcgtcaacatttacaaagagtacaccgaaacctagttacaactaacaagtattacaactccagcaatcttcacaaagagtactagtattatcaacatgcctgcttacaccaaaa

SEQ ID NO: 59914 - DNA, 20276 bp, Oryza sativa
aggcgcttatgtggcattaaaattaaaaaatatatgcggggccatttgttattaacacacacaaaaattgtgggtcccacatgtcatcctctctttatcccttcttcctcctccctctcctcccttctccatctctccctctttctcttcagcgtggggagcggcgtccggatcggcagcagcgacggtgggcggggaccgaagctgtggcagcggcgggcgaccgctggagttgcggacccggaggccggatcagcccctcacttccttcctcctcccgatagaccgcgccatggccgtcgctgctgcgccgccgacgatagccgcttccccatcctcttcggccgtgtgctacaagcgggtgctttgctccattagtgcgtagctcaagacagggggcctggacgccatggccgacctcatggacgcggccgacaacactgcctcatatatgtcgttatccccatcgtcttcctcgtcagcatcgtccgacgaggactcaccttatgggcgtgcgcggcgtgcaagaaggtcttcgtcgggaagcttatggtggaggtcgatggaggacgtcgccacatgccatgctgggagctcgctggtggcaatcatggcgtaggctcttgcgcaccgagtcgggtacgtctgggtcgtcgacgaggtcagtggcgcgctaactggagtcgtgagcttcacagatgtacttgcggtgcttcgggagcatccatcaccactcctcgctttgcgccgccgccttgaggctgagacgtgcccaccaccaccgcaaaatcggaggcggcgcgcaaccttgagcgcccgctttgcatccgcaaggaggacctgctcccgcgcccgtcgcccgaggtccaccgcctggcactcgccgccgccgcctccactcgagcccccgcctgccgccggctcatgtcaaggggagagagagagataagggagagaggaggaagaagaaggatagagagagaagatgacaaattttgtctgtgtaaatgacaaatgggccccgcatataatttttcacataaacgtcacgtcaatgccacgttggatgaagaccaagtcaacactgccacgtgtgcgccacgtcagcgaaaccgccgtccaaaaccactaagggagtcaaactgtactgattttgacagtttgggggtcaagatttccggtattgcgattaagggatacgatttagattcggtggtccgttgagggagtcaaagtgatcttattccgctgatcttttgggaagtttctaccaagtcttgggccgggctgaaaggctgaaagcttgaaatggagtactacttaagccttccagcagaagacacaaatcacccttaataatgcagttaatgagatgatacacaaatcttttgcgtattccttaaagaaagacagaaatcacaatcaatcagacactatttctccacagaccattttgtcttatctccttgtaaacactatacttttccatgttaaaaaatatatatagtttatcctggaatgatcatgcagtatatactattcccttggactggcatgatttggctgcaactccttagaactgcttgcaagcaatccactcggtccctgcgctctgtgaattgtgatgcagaagagaacaacactagcagctaacaaagccaattattaagccaccaaatcacatttaaatccctcctgtgaaggtgccaaaacaccaaactaatgatcaaaagggctgcactgccactaaccacccttttttgttgcctactgctaattattattccaaatcaaatctgtgtcacggctaatggtcgttgcgagctagagctgtggcactttagcataaagtgatatatcagcagatactgaacctgaacctgaagaaacagaagtaggagtagcatgcattactatcactttgttggacaggcataaatcttgcacacaacctgctaacaaccataataattatccctataaatatccaggtattaattttgatgctgaatttccatttattcagtaacagtactctccttctagtaaaaaaattgagaagaagacagtctgaaaatctgaataatctcaagaaagaagaagacaatctgaagagagtagtagagaatcccgaggccattaaacccattgttactcttcagaagaacaattagcatcgatgcaaaacaaggttctcacatcccaaggacccatgggtttccatcaagctcgaggagagaacaggagacttcggaaggttcgatcgccttggtttctaggccatggtccatggacccccgtttttgccggcatgagttactgaattctgaatttctgatggcctcaacactgtaaacaaaatactcattccttcttgctatgctactgctacagctagtagtgctagggaatttccaatgtcaacaccccaaaaacagggaagaaatttgtagtacagtgcttaggtcgagattcgagaagctcactttgttgttcttggtcagctttgacaagttgaggtggcctgaggccctgaacaatagcaccgacattaacttttaaattacttattccgtattttaatgtatgacgccgttgactttttaacaaacgtttgacttttcatcttattcaaaaaatttatgtaattatcatttattttattgtgacttgatttatcatcaaatgttctttaagcatgacataagtattttttatttgcgtaaaaaaattgaataagatgatggtcaaacgttggttaaaaagttaacggcgtcatacattaaaatacggagggagtactaaaaacacacaaatatatatatagctgcgttacagcttataatcaaggcatgttctaaactacggtttggattggttaattactcggtatccattagcacacttttcaaaccgttaaacggcacatttcctactaaaacatttttataactttttatataaaagatcctttagaaaatcaaataaatctatttttcagtatgctgcactagtgctaatctgctagactgctaccactactctgtgatgtggctactacctgtgttccatgccagattgccagctaatgctgtctgccgatggcatcacaggccagatggctcattttgtgcactctgcagtctgcactgcgtttggtcatgcatccactcatcatgcatccacggatcaaccaatgcaaagtgagctcgactagtttcctctcattgttgatatgattgatgcaggtacatacaccactgtatcactaccttcttcaacagtgaacacacatgatctatgctggagatatcttatctgtaaatgttagtaacggtctaattcgtgtgtataaactgcaagaattgcatcaagcagtaacatcgtggagatcgtattaatgacaataaaagaaatatggacgacactgtagcagggaaagtgcagtaaactgaggtcactcgcactgtagtttctgtccacatttttcagtttgaccgtgaattctgggttggaccatgcgttgacttaccagtggtcagcactcctcagagagaggatcacaagagcagagagaaagctttggcatcgcatgcacaaattgcagcagatcaccatgcacttgcaagctttgcattgcaggttgcagatttgcagcctgtttttatgtccttttgcatggacaaggaattaatggagggcacttttgggaacctgcttcgccaaaagccttctggaaactggcaaaagtcaaattcacctcctaccgtcgagtactacagtagaaatcctcatcaaaatagccatcacgatcacgagcagcatggagtactgaagtatctggatctgaataatctgtgcctcgtgattcgcgccccattgttcttgctccctgatctcctgttgcgcttgtgcatcgtcgctctccctctctgcctcggctaatctcacctgagagagagtgaggccatcaaaccattcacaaggtcgtagtggatagtgatgatggcggccagcaccatggtctctttggaagcttctttcagaatcaaaaacttattaaacagtttagcttttgatttaaattctgaaaagttattgttgtagaatctaaaaaataaactataaattagaagataggaacttagcttttctaaattttaaaaaactggctatcaaccaactctttctcagccgtgaaacatatcgtgtagccattaattccgcctgctgcgtctgtccgtctgtatgcgtgtggcgtcggtgcccagccaacgatcagcaccagcggatccggcagattgcaaatttgcaatcttgtgaaaactgataaacattgccatgatgtgaaatcacataatcacagagagctagccatggatgttggatggaagggataaaaacagtaagaaatggtagcatctctacgtaaccgatttttaagggatcaactacaattatagagactacttatgtattttatcaatgaattttttcttaaaaaattgttagatataagtatattacaattatagtgtagatacattacattgtaatataacttgtacgtaacttttaaaaatcgtggtaacatatcgtgttcgtgaaatgaaagtcgtgggggtggggaggagggaccgaatcccctcacttgtatgatgtgtttttttttcttcctcatttacacgaaacttaaaacaaattttactatttaaaattacatgaaagttgcatacaaattacaatataattacattacaattatactaatttacgtttagcaaatttttggatgatagaatttttaggagaaaaaatatccataaatatatagcaaaacagttttaattattttttgataattgcaacacaatagtaagagaaatcaaattctacacatgattagagtcgaaaacggccagaaacgttacaacttttacgatacttcgttaccaaattccttcaccgttctcatacccatgtggatatattcttgcagaatttcatggctaccacctgcctagtacctctccgattactactcgctctacaatactccctccgtcctacaatataagagattttaagtttttactggtaacgtttaactactcgtcttattcaaactttttttcaaatgtaaaaaacaaaaagttatgcttaaagtaccgtagataataaagtaagtcacaaataaaataaataataatttcaaaaaattttaaataagatgagtggtcaaacgttgaaagtaaaaaatcaaaatcccttatattatgggacgaagcgagtagaattttagtactactagtactccactgctgtataaacagttactgaattactgatcatacgatggttcgatttgatttttagtagtagtactaaaatttttcccaaaatcatcacattttagacacatgcatgaagcattaaatataaataaatgaacaaactaagtgcacagttaggatgaaaatcgtgaatcttttgaggctaatttgtccatgattaaccataagtgctatagtaacctacatgtgctaataacggattaactaggttcaaaagattcgtctcgcggtttatagtgaattatgaaattatttttttattcgcatttaaaaaatatccgatgtaatacctaaaaattttcttttcacgaccgcatgtagtagtaatactgtacaacgtagtggtagcaggagccggaagggtgtagaacaatagccagtcaatgcaacctgagtgcaagaagaaagtacacgaggctacaaaaagaaaaacggccagaatcctccacacaagtactacacgttgaacgggacactgatggccggcgtatgcatcacacatcacacgcgccggcaatttgttaatcctgcaaaagtcaatgaagattaaaaataagccccaagtttagttactcgatcaaaacacctcaaaaaaaaaaacaacatcatgacaccgacaaaaccagcaaagaaattaaatgtcgaggacgaaaaaacagatgctcacataaaaacagcttactaattacctgtggtactacacttgctagcgaatcagctacaagaacagcgatgccacagattaattctttttaatacccatttttgtttttttctctggctattgttgcaatccaaatgacctcacattacagtgacccacacctttgcatgtcgcctcatgctttggttgctaacccttcacctaaacacacctaaagctaccccatttcttgcccattgattaataagctaagttaatccctccttgcacattttagtactaattcgcctacgacttctcacacacaaagcttcccttccccctaaacctgcaactgctactgctcctctttttcttttctttttcttccatcgccatcacctgctgctgtgtgtcctctgtccttcttcatcgccaatggctgccatgccaacaccaagatccttctcctacccctagctcatcgcaaaacaagctagaaatcgtctcttctcccaagaaaattcatctttggatcgtagagcgtatttgaagaatgagcaattcgacgtggcagccgtcgccgccgcagactccggcggcggcggcgtcgtcggcgtcggggattgacggcgtggagaacaagataagcccgagcatcgtgttcatcgtggccgtcttggcgatcgtgttcttcgtgtgcgggctgctgcacctgctggtgcggcacctgctgcggctgcaccggcagcggagggcgagggaggacgccgagagcgcgacggcgttcgaggggcagctgcagcagctgttccacctccacgacgccggcgtcgaccaggccttcatcgacgcgctcccggtgttcctgtaccggaacgtcgtcggcgtcggcggcgaggatggcaaggacccgttcgactgcgctgtctgcctgtgcgagttcgccgccgacgaccagctccggctgctgcccaagtgcagccacgcgttccacctcgagtgcatcgacacctggctcctctcccactccacctgcccgctctgccggaggagcctcctcgccgagctctcgccgacgtgcacccccgtcgtcatggtgctcgagtccgagagctcccgcgacatggtccacgccgccgacgatgagccagccgacgtcggtggcgaagacgcgccgggagcggaggaggtggtcgaggtgaagcttgggaagttcatgtgcgtcgaaggcaacgtcttcttcaacgtcaacgccatcgccggcgaaggggatagagccggcacgagcagcaacggcaatggcgacgccaatgccaaggctggtggtctcgggcaaagacggtgccattccatgggatcctacgagtacgtcatggacgcgcacgcctccctccgcgtgtccatcaagccgccgaggaagaagccggcggcggcggcctccaagtcgcgccgccgcggcgccatgtcggagtgcgagttcggcgcctccaagcgcggcgagtcctcgctccgcctgccgccgttccgcgcgacgccgcgcaagaaccccgacgacgacgcggccgcggccgccggcgcgaagctcgccaaggacagcttctccgtgtccaagatctggatggtgccgtccaagaaagagcccggcgccgccgccgagaggcgcgcggtgtcgttccggtggccggcggcgaaggactgggacgtcgaggccgggagctgcggcgggaacagcgccgtgtcgtcggtggcggcggaggagcgcccgtcgttcgcgaggaggacgctgctctgggtcgtcggaggcagcaggcagctcagcagagtcgggagctgttcatgatcaccatttcgatcatcaaatctcaaaatgaaaccaaaaaaaaaaaagatgattcttttgttcagttcttttaccccctccttttgcttgctaggttattggtagcgaactagcgattgcatccaacagcaagagaaattgtaaaacccatatgctacgaagagaagaaattttcctttcatttttaactgcatttgagattttgagtccgggttggtttcaattttcagcaaagtgactccctgatcattactcgaaagaaaacattacctattaggacaatcaaacaccacctaatcactcatcaaactgtacactacagtgtgttaatctcattacaaattagtccattcgattagaccagagaggccaagaacacaagctgcgatggttgcaattgatgatggtgatgcgaaaccgggggcaaaagcaactgtgcacagcatggaaaggaaattctcttgtttgatcccatcgtctgatcggccggcttgttggctctcggcgaccatcaccatgtgagcttgctgtgctgcaccaccaccaccgcactgtgccactgtgcgtgtgctcttttgtttgctcctcgcattcggaatttcgccaggacatctttctcttttcagaggtaaaaacaccacgcatgccgtcaagtttgggaagggatcttgtctgatctgtaaaggctcatcaaagattctctctttatcctatcctttttcctctatcagtttttttctacttaacccactgtgagtccaaccatgagtggatccaagtgtctcagctccagtacttcggttgcaggtacaagatctgagtgaaaggtttggtttcactaataattgacttaatgtagtagaaacaggtaaataagctggagatggaccagcatgtgaaaaggactggtccagctcctctgctactgctactgctacactttctctgctacatcttcacttgagaaaacgagatcttctcacgagtcacacgatctacactctgctgtggtcagtgagctgttctcccattactgcagcaagtccaccacaacgggaaacggtggacacacacacccctcacgttatcacacaggctgttccaacagctcatgcactcatcaattctttgagtactatactccggtggaggagtaaagtttctattcatacgcgtatgatgtacgaagtatatatctcatgaattttatgagttcggacagagatttttataactgcagtctatctctctgagattgacagttcaccggtgtgtggggagatgcaataattgatcggccatactacctgatcggattttactccttcagaatttggtagcttcgtggtcaccgtcgtgtcgtcgtcggccagtgtctgtggtcgtcccgggcgtttggttttctcatggcagccgttgcggtcggtcggtcactaatgctcggaggaagatgtgatcttcttcttcttttgacatcaaggaagatgtggtctttggtaaccgaagaatgatttagggaatgtttgagagaatggtaaaacaaggcgagtattagcgtataatcagctcctacaagatgaccctttccggtgcagcatatgggataaatttggccagaataaatgcactggcgatgaattttcaccaccgatcgccgcttccgtatagggatagatttgttttgcagttgccacttctactcccatgatgaagatgttgagcacctcttcctacgctgccccaaggtaaccagagcatggtcatccattggcttcaacgagtaagaaatcaggctgctaccatcgctcgagaacctctggtttattgagccccccaacacaacacaccacctatgtcggattcggcgcacaatactcctcgcgatcagttagaatatttgaaagtgccgaaacaacaaaagctttcaacagcatagatgaaaccgattaccttctccgacattgttgatgatcttgaagcctaaacgaacgctgccttactctgtatttagccggtgacggtgaagttaggcaccggtgatgaggagcgtagaaatgtccatggcctcgtcgccacgaacggcatggcaccgagcgttttcgtcgccgccgtttttgggatctcggtcgtcggtgcggtcgtcgatctccggtcgtcacgaggtatggcaccggatcgccgtctaatcgtaggccaatgggccccgtgcctcctatttctatttaatttgggcttgaaatcgtttatttctaggcccagttgagcggctttcattgggcttggcctatttgtgtgagagctcgacttgactaatcagtaggcctgagcgcttcaggcttttaccacctccagcgtccagtttgataggcccaccattcgaggcccatatatctgttattatatccttttctttttgcgattatctgctatttcctgctctagcttctccaataatgttgtttttgtgtcattagttgattacaacaactaactgttctaaaaaattacgacaactaactgaactaggccacgttttagaggaaacagtcgacaaggctgccataccaaccaaacaggtcaacctaaaactctccacgtagcgacctttcttactgcgacacatatgtatatagctagtacgttggagtgcacggttaaaattcagtaaccaaaccgagtgctcttgtacaacatcacgtcttgttagcccagagccgtcgttgaactcgtgcacgtccaacgctgtcgctttctcaagaaagtgcatgtgggcacaccaacgaagcaaggttgtagcaccatagattcttgagagaatataccaggccatcgaggcaccaaaccaaccgtcacgcttaccaagaaaacccgaactacttctcccattaaataaatagacgattatgttccattccaatctagattttgtattgagacgagagtagctaactagctaggaaattcagtgattttttttcattactgaacctttttatttttaattttaaaaataaactcttccaaagtttaaaacttattttcaaaatctgaatattttgaccacgctaaacagacgtaacagttttatcttgccataccagtcgatatgatgtggccaaataattgtcagccggacatgaccacgttttgcctactgacatgatcaaaagttcagttattggaaataatttttgaaatggtttctttttaaaattaaaaattaaaaggttcaaggaaaaaaaactcaaattcagtgcacagcacaaaactacaaacgcgcaccgaagggaataatcggcttgggcgcagtgcaggatcaatcaaccggccgcccgcccaggacgcacctgcacgcagcgacgacacggcgcgcacgtcgtcgctgtgggcgggcggagcatatgctcgatcgatcactcctcgatccgcacggatacgacacggggaaatcgtccaaaactagcgagacgtgtgacgactgtgagtatttcttcgtcggcacacatgcttgttgaattagaccaactctgtctatctctgctcatgaacaatgctggcgatgttgataaagttcataacacagtagaatatataatctcattggaagcctctagtgtcgtgttccttggacggacatgatgcttaggtatatgtatattgtgcttgatccgggggaggatttcttggccgattgatcgatgccatgcatgctaaagaagattttttccagctctgatcgatcgagaagcaagcaaggtcatcggatattctcttccttggttggctcaattattcgcacacattgcaccgagccttctgctgccttatcgacgatgcgccggccggcctgcctcatctcttggtcagaacattcggcgtcccatgccatgcatacagttgtttgtacccttccatccagttcagatgatcagatgagatcaccgggaaattaataactcggtgtgcttcatggctcatgtcgtgtcaccaacaggagtcaggcggcaataatatgttggaatttatggacaggcagatgtgccaatgggagagttgataataatagtccaaggcctaatttggtcatatccaaaacttgtcctagggtaggagtactagcaaacacaattcaatatcttttgacagggaacctatctcgatgagaaccaactgtattcgaggatatatggataagaagcatcatcgactgtgagatatctagctttattttcatctgttcttggttccggcaatcttcagatacgagataagaccatgaggatgtggattttttttttcatgtctcgtgatgcaaaaggatagacgaaactaaacagaacgaaacaaaacacttttgggagatagcaacgtatagcagtagctgcttctacgacctactacgatataaaactacctcctctctgaggagagaattctccacacgtaatttatcaagaatactgaatataaatggtttcagacttcacattgccctttccattccagctaccatcacaaaaaaaaaaagaaaaacttaagaagtgattatactcttgatctccaatcaatcaaaaaatatgttcatgtttgcataagttgaagattacattggcgtatgtaaaacgagaaaattattagcatataattaataaagttttaattattataaacttgacaaattgatatatttgttatttcgaagcaacttctatatataaaggttttgcacgaaatataccatttagtagtttagaaaacgtacaaaaatcgaggaaaaatctaaatcttaatgagaaaagaacatgccctaattttttttttgagaactcatgccctaactcgggtcaagcatttctgcctagctacagcaaaagcacgagatgccattcatggcacgatcagatccatgtagctgagccctaccaaaaactactagcactgtagtatcatttctctgaacctggccaggaggagagcagacggcacacagtccagacagacaagccatcggcgcgtcgtcatgcatccgatcctctcctcgcggtcgccctacgccatctgttacctttgatgtcacagtcttgcatggtaggccacacccatgaaaatcaaacaccgttcatggtaggccacacccatgaacttagttttggacttaattttgatttctttcaatcatagtttgtttttcagtattgattattaagttgttaagaaagcataaataagagctttacccgtaatttagtttcggttttggttcgttcaacggctaatcagctgtaatcaaacgatgagactgctccacatgctgaaatgcagaatggacacaagccggatcgatgctagtacagtgacctgacctaaagtaatttaacctgagatggcatcctaggtagtaagagagtttaattggttagtagcgttatggcaagccatgtgtccatatacctccatatcaagattgggtagtagcgaaaagaataagaaagctggaggttttcatgcatatcgtctccttatccttggctacctttgttgacttcagtattggtagaagcctgcccaaagctagctagctatcactaggaaagaagattcgtgctaccctcttaggccagccgggtcaaagcagcttgtcatttcgaccacagctgctaatatgggcgatcacagaagtttcatcagtctttgatccattggaaaaacaaacaaaaaaaaaagaacagcaatgacttggttcaggtttctgggtaaactcctactcctagcaacttcattaggccatagaattctctcctaatccggctgctagttgcttactcctgttcatcagcgacatgaggagattaaagatagatgaacatccacggttgccgacagagtgtggcgggtcagccggacatctgaattatttcggccaaaagtctcttgccggtgagatgaaatgatggatcgtctgtcctttttatcatcagcgttgtcctccacagcctctcgtgtaccacatcaactgtgcctactaacatcaggaacctgttgttccgagagaaaatcgttcccgccataatcatggcaaaaaaaggccttactttagtgccttttttttaaaatctcccaatccctcgtaggagatgtctgcgtccattgaactacaacttggcagctggcgaggctcccgtcttggtacagaactctgaaaaaaaaaaagaaatcaacgttttcacatcatttggattagcaatgtgcagcaattcggaagggggaaaagaaagaattcccagcgtcgttttcacagcatttggatgaggaatgtgttgcaattaaaggaaaaaaaaggaaattcaacgtttccacagcattcggatcaggagaggaatgtgctgctgctgctgccaatatcggcggcgatcctccggtcagcgtcaggcgccggcaagagaaaagagtggagacgtagccggataaggaggaccaaggtctgcgacactggcgctatccggcgtttgggcatccatatcggtctgtaataatgcagcaaaggtgaaaagcatggccaaaatgcccgaacgagacggccactggacggagaagggaagcaagcaagagacaacatgaagaaagaatcatttttccttttttttttttttggttctgatttcatcgtcatcgtcaactacatatacaaggtggctgaaaccttctcgcatatttttatcatacggggcatatacaagcatggaagaaggctgaaaatgttgaaagaaaaagaagaaaaaaaaacaaaaaaaaacctgtttatcctgtaacttctgcagctaacccctaaaccacacgaactgaatcatcatcatcttttccatttgttattggaatttcctccttggtttttatactgtgcagaataatccctgtctccgtcacagtgagccttcgaacgagacccgcagctgcacttgccttggccgctgcgatggcgcattggcgagaccctgcagcatcttgatcacgtcgaccgtgtcgtcgaggtagtacttggccatgctcggcttcttgccgaccgtgcaggcgaacacctcgctgctcgccgggagcttgacgctgctgttcgacgggcaaacgatgctctcgaacatgtcctcgtccgaccggtcgtccccaatgcacagcacgaaatcgggcgccttccctcggctcaccatggatgacaagaggttgtccacaaccacacctttgctgatgccctgcatgacatgaaagataatttgtcatgagagatgattttagtatgttatcactacagaaatttcgaggttggtggtttgggtggcgagattgagattgagttggttcctaacagggataaatattaaaaagaccggggactcttttcgcgaattttccagtccacacgggacatggtccatgctgattcatatcctatttgtcgagcagatatagattgtccccaagtatgtggtggatgaagactggattggattagagcaatccttatccgttgcctttagtttgacagcgacatctagttgatcaacatgttgtgcatacaagtctacaaccagaactaatcaaacatatactgtcaaacaactagaggaaggaaggaagatggcaggcgcttacctgtggatttacttcgacgatatgctgggccctcttaacaacgactggttcatttgcaagaacgttttcgaggtggtcaagcagttcctttgcctggcatgaaccaaaatctggatctgcctcatcgtggtgccaaactaacgcgctttccttgtcttcgatggttgaaccatctgttgcctccttgtaaagcctcatcactggttctgcagtcttcttccaatcaaagtccacggccaacccgcaggtctcccaagctgagtccctgctccacctgtggtatccatagattagtaaaaatcacaaatttcccagaacaaattcaaacgctcctctacctgtcttgtaactgaaaatgacactagataaatacgctaaaacctatgtttagcttaatggcataaatcaaaagcctcctcaagattatcctagtacaatggacatcacagctgcatctagatatgtttatgaactcaatattttgcttcatgttattcgataaatgtactggttgatgtactgtttcatgatttatatcatcctacagatttaatccaaatctaaaacactactaatatgcaagcaaagcaacttcgtaccaacaaggagaatggaagataagagattactaccttgtgaagtaaccatgctctgcagcaatccccagcttctcacaaggtgcaaaccatctgccaagttcatccttccctctaccgctcacgatgaacactctgttcttggggtcctcgcacagacgattcaatacagagatgacctcattgctcggtgccttatcaattgaaccctctggcatcactgtgccatcatagtccaagagaattaagcgattatcagacttccggtatgacggcacaatgtgatcgacagacagccgcctgaaattcgggccaagtgccaccaccttgaaactcatcccaaacccaataccccaatgccgccgcgagaaatgatccttgcaagctcgctgcaggtcctggtcgaaagatttcgcccagtaggcaacatcatgggtgctcacatacttgtagtgcttctcatgtcgcagccgctgctctggctcaggcatcctcagggctgcattcatggcctctgccatagactccacactccatgggttgacccggattgcgccgctgagcgacggggagcacccgacgaactccgacagcacaatgacgctgcgcttggccgcatcatccaggccagtgctctcctgccggcacaccgtgtagatgtagggtatccggttgaggccgtcccgcacggcgctcaccacgcagcactcggccgccgcgtagtacgccgccttctcgtgcaccgacacaccgcggtcgatcagcacgataggggtgtaccccggcgtgccgaaccgcgcattgacgcgggcgctgatcgccctggcttctccctgaacctcctggatgtcgcgcccctcgctgcgcgccgggttcgcgatctgcacgagcaccgcgcggccgcgcagctccgggtgctccaccagcagctgctccatcgccaggaacttgagcccgattcccttgaacaggtcgacgtcgtcgacgccgaccatcaggcgccgccccttgtacgactcggtgagccgccgcaccaggtcccccgtctccggcgccgacaccaccgacctcagctggcccatgtcgatcccgacgggcagaatcttgaccgtgacggtgcgaccatagtactcgatgccgatgtagccgcgcttggactggtaatccaggccgagcagccgcgagcaggcggagaggaagtggcgcgcgtagtcgaaggtgtggaagccgacgaggtcggcgttgaggagggcgcggaggaggtcctccctgacgggaatggtgcggaagatctccgaggaggggaacggcgagtggaggaagaaaccgaccttggcgcgcgggaatcgcttgcggaggaaggtggggagggcaaggaggtggtaatcgtggatccagacgaggtcgtcgtcggggctgagcacctcggtgaggcggtcggcgaaggcccggttcgccgagaggaaagaatggtagagcgcgcggtcgaacggcaacccgcccagcgacgacggcgtgagcggcagaaggtaatggaggagaggccacaggtagtgcttgcagaatccatggtagaatcggcggtggagatcggcgggcaagtacaccggcaggcaagagaagttcgccagcaagtagttgcagagctcgtcggaggccgcctcggttgcgggcggcgggagcgtgccgatgtggaggacgggcgcgccggggggcagccccgagcggagctggtacgcgacggcgtccgagtcaaccgtgaaggagaacccgaacggcgacgccgcgtcggccgcggcgcggagcgggaggcggtgcgacacgaccaccctccgcgcgggggccggcgtggacggcgacgtgggcgaggccggcgacgccgccgacatgacgcgcgggaggcgcagcgacgcgggcgacggcgccgcgtcgtccgccgcggcaacgaggtcgaggaggttgtggcaggagagcgaaggcatcgccaaaacaaaaaaaaatcaccggttcgtgcacccgacgaacaactcgccgcctccacgtcgcatcaagagaagaagaaaacccaacccggcggcgaactactccgatgaagcggaaggatggaaacggccgcaagcgtgatgggcgtggaggtggataagaacggacgagggtgggagagaagagaggacgagctataaatacggtggaagaaaatcgaacgaaagatcgcggggtgggaacgggatagatatatatcgcagcagcagagtctacagagttgagaggaggaagatggaaggggaaggaggaggtgaaggtgaaggtgaaggtggtggggtgtgcttatccatccaatctttgcacggggaggaaatgacggggctgcccctctcactctcgtgtaacggccgggttttatctgaaatcttctcgtgcctcgcggcgtcggggatcgcggaggcgcttacgggagggatacgtcgcgtggtgcgcgcggctgcagacgtattctcaccgaacggttctcacctttgggtgcgggtgggagacggagtgggagacggacggtgggggtggataacgccggggctgttggcaggtgggacagatggggaggagtactggagagccattacttgtgcacggtttttccaaatagtttttcccattattcttttaatcatacggcagacgtatacgtacgtacactataagagacatatatctgttcttgataaaatcatgttgaaacctatctacaaatgcatactccctccttccaattttaattgcaaccacgtgttttcatatccaactttaatgattcaacttattttaagaaaatttataattagtatttttattactattagataataaaacatgaatgctattttatacgtgttttattttttaaataaaatagataattaaaattgggtatagaaaactatggttgtacttaaaatgagatagattaagtaatatttgtgggtagcaggatttgaatcatgaataagtaaagtcatgcacacatgactagcaaaccactagggctttcctatttcacaagatattttgatctgctgcatcggaacgtgaattacgtgggtgatagtaatatggtggtgttgtttgtcatgatgtttatgtgaaaatgaaaagtcgtaaacgaacttccttttataatggtacagattatcactgttctgttgcatgtgttttaaattggactttcatgaccatatcattattgttggtgttgaaattactcctggttgctacgccaaaagaatgtgttatggtgctttcaaaaaaaaaacaatatgttattcggcgtggcaggctccaaatcacattcaacaaaatttcagaatcaaaatcttgcaatcttttagcttctgtcatatatgttgtctgtataggcgagtataaattaaattgaagtatattcttgtcagacgcgtagcatagataatactagataatattgttaactaaccgtaatttaatttataaaacaacatcataacttttttacataagattaaaaataaacacatatagcgcgcgcacagctaagagattcttaaccaccatgacaatccaatattccaagcaacaatacataccaaaattgttgccacaccttatgttaaaaaactattaagaaaaatgtttaagaacatgtgaatattgtgcgtcttccttatcttatacggaaagaagttgatgctaacaattccataaaatctatcaatgcaataaacatgtacaaaacgaagattccgtatcctctcttttttttaaaaaaaaatacccaccatttcacttatcgtactcgcaaacttagaaggaactctacaatccaatcacaacttaaaaaacgattttttatacgagagacaaacagactgtaatatggcgcgtctccaaaactcaaacattcaatttcacgtatggctccttacgaggcccgcatacaaaaatttattttttttaggcgatgcctcttaggtggccacatacaaaaataaacatattttcgcatgcggaacttttaaagtccgcaagtctgatatatcccttctttccctctaagcactttaaattttttttcaagtcattcttatctctacttggctcccaccccctcattactcatctttatctcaaactactatatgtctcaaaatcctctctcatttctc

SEQ ID NO: 59915 - DNA, 538 bp, Oryza sativa
cccccacattctcactctcactgaagctagctttctttctttcttaagctttttttctcgctttcgactgctgctttggttggccgagccagtgaagtagtgaagctgagctctcttgcttcctcttctcctccagtagctgctgctgcctttatgctgctttccccctcctttgacgtgagaggagatcctctcctcctcgctcttcttccttctcctgctcctcctcagctggggggtgggcccaccaccaccaccaccccaaatctccttttcgctgccctcaccacctccaatggcgcctcctcctcctctgcttcttcttcttcttcttcttcgccgtctcctccaatcttcactctctcctccatgctgctgctgctgcaactgcaagaaaaaagagaaaggcaatgtaaaagaaagcgaaagccagcacagctcaagatatattctataaacaaatccatggacaatgcaatgcagttgccgacgacgttgcactctctccctacaagagcacgctttagaccaaaagatc

SEQ ID NO: 59916 - DNA, 2741 bp, Oryza sativa
agtgttgaaaagaaaatctaagtttaattaataaattccaatataaaatggggccagataaaatttcattaaatactttgcttaattctataattcctagatttttctgggatttatttgagctaagaaagtatttttaataaatggaattgcatttaagaaataatttaaattgaaaaaaaggttttaaaagttctcttttggctttgggccgaaagtcggcccaaaactctctctctctctcccccggcccaagtcggcccagtccgcagccgagccgcccgcgcgcgcgtgcgttcggtcgctgacaggtgggtcccacctgtcaggcccgtcgtcttcctcgggccgaaaccctagcgcgccgccgccgagccgccgccgccgttcctttccaaattcggccgttcctttccttctccggccgaattgataggggggaaatgatcgccgggatctcctctaccttttctcctttggaatcatcggctaaaacgttttggaagctcgtggaatcgagttcgattcggatcggtttctttctctccaagcccgaggtttccttcgccgtcgccggtcgccgtgggccttcgtcgccgcctccgagcccctttaaaaggacccccggagtctcctctacccgtcgccaccttcgcctttgcctctcgtcgccggaagagctctagcgccgtgtgccctagctttgccgtcgtcgccgccgctccagccgtgcgccgccgccgttccagacgtcgccgtcgctcgggaaggacgtcatcgtggtcgccgtcgcgtcgccgtcctcgttcgccccttcgccgtcgccggagatcaccggagcagcgtcgccgtcgacaacccgaaggtttccgccgcttccttctcgtcgctgttgtcgtccgttgttcgtccgccgccgttttggtcaccggtgtgttcgccgcgtcgtcctatacgtgctggtgctcttcgttagcgtcctcgcgccgccgttcgtcggcgagcgtgcgccgcccaagccgtccgctccgccgagccgccgccgctgtcggtgacgtcaccgctgacgtcatcagggtcgtccgccgtgagccgccgtggacccgatcgatctcggccgtccgtttggattggatcgaatctcggccgtccgttcgcgtgaaccgccgcccgtgcgcccggtccaccgaaaccctagcccgctgacgcaataaatccctttttccttttcaaaaataattcattattgcgtcataattcaatttaaaccgatataagtgtttttaatccgatttaatctttaaaaattcataactaattcatcttagctccgatttagttggttcaagtctctaaatttttctaaaattgagatctacacattaaaaatatccacacgtactgttcatgcttgtttatgtgttgttttggtaattttgttcttttctgcttagattccgtcgtttccggagagtccgttttcgccggagaagagtttgaagagttccaaggccagcaaggcaagtcacacagatcccaaacaaccctttgagcatgttgatcctatttaaagctattatttcttttcaactattgcatttattttcgaatgtcattgggtggaaataacctattgtttgttatagcccttttgttcttgtttaccttattccttgataccttgggttataataatttgactggttgaactttatttatattggttcaactagatattaggtataattgcttagccctgcttagaaacattagctcacttttgggataacttatgattcactattatttcatgatggcttattgatagttcacgatggtcaatcgtggttagttaattaattaatgtgccaactaaagcctgataatggtgggttgtgagcacatggttttgctggtcgtgctcatgacaattaaggaccggttcacgagtttcggttgtgaaacatttatcgtgccaaccacaagccagcatgggcaacggctttatcttttgtatagcatggttcattgcggggcaccagactgagaagtggcggagataagctcacgggggtcgctggggagtccatgccttgtttataagggggtgattatgatccaggaaggtgcgctgcaatggattgtgttatgcgaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtcgaacaatgtctttcgtgattagtctcacccttctcaccataatagaagatgctataactggtaataatttgattagctcctggtttggaatggtatattcctggtttggagatagaactgtgcagccgggatggttgttcagaatggatgggcctatacaacagggtatgttgtatagtgttggattaatattgtttaaatacttaactgttttaaattctcaaatgtttgctaaatgctgcttttgcaaatggagccctattatgccatcctttgttaccctgtgcacttgcatatttgctgcgtggcttgctgagtatgtcatatactcaccttgcaatcattcatcagaggaagagttcttcaatgaggctgatggtgtggaggagtaggtgtagccttggtcaagctgcctgtggagtggagccgtctgcgcc

SEQ ID NO: 59917 - DNA, 1701 bp, Oryza sativa
tactcagtcttgctcaatttttcccaagcccagaagaggagctccttgaagatgaaggctttggtgtctagctcgtgcctgccgtcaagtgcctgtggtcgtcgccctagtcttccgctgtttctcgtttgtctttgtgtgttctgggccttcgctgcccatgtaataaattaactatttacgcttccgcttgttaaactctgatttgtatcaacttttggtgtaccttgcctcctgggacaaggattaatgcacgcacgtaaggaatgcccgttgggttatttccggtcgtgacacaaagatatattttgtagacggtattattgtccaaaacctcaattagaatgaaaccgaagggagtaatataatttccacttaaaccattgtactactttgtactattattttcaaataatacactattttaaaataaagtttacacaattatattgtgtacctatcaaataaataatttaagatctatattaactaatttatacgtgcactcccattatttaaatcatccgatatatttttttttacattggactatcattctataataatgcattgtttcaacataaagtctacaacattatattgtgtacccactaaattaacaatttaaaatgtatatcaacgaatttacacttacactaaaaccggtggatccgttatttaaatcatcggatctattatttgctaataaataaagcatccaaagctccctttttggctcggtgcacaatgcacgtctgcacatttgccttttgcacacgtgacaaagcgtcgtgtctgaggcatgatcacgaccgctgcagcgctaccgctttgctacatgtcaaatcatatatggagataataaattttgttaataacatgaaaagaaaattaaaggtgtgatgcagcgagagaagaattaagcaccgtgggttgtgtttttggaacacttagttccatttaagctgaaccaagagttgattacataataattataatgtattatgttatgtcgtatttgaattttgtactatttgttcgtacaggtgaaagaaatcattatattataaatatgagcacaatattaaagaatatcaatagaactcttctaagacaagggagtttaagaccctctttttttttgattccatagtttggattttcgtttgcacgcttttcaagtttctaaatggtgtcttttttaaaacaatagtttaacttttagaagtcaattcattcgtttataccctcaaatagcaatcgcataaatcagataattcatcaatttcagttgtcctaaacccgcgactcatggtggacaattggggatcgacggatactcaaagtcataatatgaatatgtaagagctactatgaataactgtaaataggtgtcaaaattaattgctattaattagacatctaatggcttgcttgccatataattactttctctctacgtgtatataaacatcgacgaagctggaacaaatattaccatatgccccatacatatatattaagcggttaatattgtaattacatgtgttaagtcctttaaaatttcttaaaatgctctcaagctatcacgtggtgctctaataaattagagcaaatattagaaattctatcaaaaaaagcaaagcatatattacttgattttcacttaaatcggtacgtccaatattataaaccgttcga

SEQ ID NO: 59918 - DNA, 33842 bp, Oryza sativa
  unsure (1)..(33842): unsure at all n locations
aattgtagcttttgtcatcacctacacaaatatcacttcacttttatcagaagtaaagaacattcacaaccctcgcggcaacacctagccataatgtgggaccttattttaagaaaaaatgatataatagtcactaaccaaaactactgcaccaaaatcgaaagtagtcacaataagttggcaacaaagagccggctaggtagtgggcttaactctcttatgctgaatgtacgttaactgatgcttggtgcagtctattttccctgcacggagaagtaaagcgatagaaatgaaattgctatggatccagatgtgatactgaagaggcaaccatcttaaacatcaaaggggataataaaatattatctggaacttatgctaatcaggtgtgaatgatgctatgtaaatcctaaatggtaaatgtaatacgcactaaacaccttgtttcatctccaggaactatgtgtcctgtaactgaatctgtatatagcactgaaaagtaagtaagattcagaggccccgcaaaaaaagtaagattcagaggcaatgcaatggcctgaacaaaaaaggaaaactgcaataagctagtattggtcagcagcagcacatccacatgacagcaagcatgaggcagagcaaagcagtacagagcagaggaggaaatacatatggagggatggaggaggctcatttcctcaaggcgacggagttgtccatgaagcctgggataacacctgcacaatcaggcaatagcagaaaggggaggaattgataagaatagctacattgccataactggaaaaaagaagccgtcgacagactacctgccagcaaaattaaaggtggaagctaatcatttaattgctgcttcttggcaaactcctgaatccaataaccgtggtgctggtgtgtcaccctgctgcagccctattgatgcactaccattccgtggtctggaagaccagtgtgggtcttgcactggcaaaatgaagaaatataccagcaacaaggctttcattgaaagcaagactgccattttgtctcatgtgattcacctcagcttggatgcctgaaagtagtgtttgcaattttgaaacttatgtaatacaatcaacgtaggttgtatccattgtaaagaaagtcaacccggctttttctttatgaatgtaggaaacatgcatggacttaatgaaattccttttttatgctggttttagatgaatttgtgtttcactctgtttcagaacaaagaattgcatcacaacaggctaaatttgtttcgagcagtgcaagaacatgtttgcaggaataggaccatgaagattgttgttggcaagatttctatatgcaaaatttggtcaacaattgcacagaataaaaataaagcatacaatgtaattcttagacacgataaaatttcttatagttcaaaaagctcaagtttgccaagttcagctggaattcgagctttgcacaggcacagctcttttcatgattgttacagggaggagggttgtcagttgatgacaggaggtcaggattagttgctttggaggtgacaggctaatggtcgcatttgctttagcacatctacatctttaagtttctattgaaaattagacttgtgatggtgatgacaaattcaatttcccttaaagttattttgagactcctccagtctttccactattcattcataaaaaacataaaagattggcatgtggtaatccatggcaaatgattacaaaaccacagaacacatcaaccatgaaactcaaaagtacctgcggagctagtccataacctccatcaatttcttgttcgaagaaaagtagctgtagagaaatatttggcaattgagagaattataaataatattccaaaattcaaaagagatgcagaacataaaagcttcaattccagagcaaccgaaggaataatcaacctcatatcttaaatttactttgtgcggctgaggtgactctgactacaatgcctgaccgagcttgttcttcacttattgttacaccataaaaaaaagagcacatttcttgtcaacctataaatagaaaaatatatgtggtagccatcccattataaacaagatcataacactggtagtggcggaacctttcctgctgctgatgatccaactgggagcgatctcaatgtatctgttccacttatagcttcttcaagaacattcaagacaaaaggagaactggaaggataagaactgaacctttgttgctcgaccaaaatttttttgttgacctgaaccattgctgaaagaatagaacaggaaggagagaactgaatcctttctaattcttcattataccaagctgtcacagaccatgcgcagaggatgtcggacccggatgcttgaaggggacaggtttgacggagatctcaacggccaacttctgccaatccgcttcctccatcctcgcgggccgcccgcttcttccttctccaccggtcaaactgtcagatccggcgaggaattgagctgccgaccacggagcggcgccgtagatttgggtaggagggaagagtggagcggatgggcagagtggagggggccggaggaggtgctggcagaggacggcggtggccggaggacgacgactgtaggagacggataggagagagacgagcggagaaggctgccgccactgcaggtccctcgccgccgctgccagaaggggagggagaagaagggaggggacacggcgggtcggcggcaacaccaacgacgggcgccgcatctgtcctccctcgtcgcaaccgccgccgccggcgcaagtgaagggagaaggaggaagggagcacctgtgccggctccgacgggcgcctcgtccgtcctgcccccggcggcgctgccacaaggtgaggtaggagggagaggagagggagaaaaggggggagggaagacaacggcgtcggctcgaacgcgccatccgccccgacgccgccgtgagggaatgtcatatcggaggatattcagacttgagattaccgaagaaacagagcaatacgtatttgtaaaatgcgctttagcttatgaaaagcgtaaacaagggtgtggggttgatatgttgggcccagtgggcagtagcgtgtggcgtgtatataagccactactgtagcaaatcggaaaactcgtcaaggaagaagaaaaagaaacacgaaacatctctctctcgtcttcttcctctgattcctttcccctttctcaagtctctcgttcttcctcaacgacggcgacttgtgctcgccggcggcgaggtcgtaacaatctggtatcagagccgaacgatccgtcgggcgtttcctcatattctctcggatcggcggtaaaatttttcccatagttcagtttgtggcttcccttttgggtgagctgcagtaaatctgtccataggattcgctgattttggaggagggacaccacggctccggcaaagcaaggcgttcaagtgcggcaagtggtggcggcgatgggcgatatggaggagaggctgatggcggcggtgcaagctctgacggtgaaggtggacaaggttgatgcgttgggtcaacagctgacgcagattgatagcaagttggagaagcagggtgcgcgcttagatgctgtgcagagcaaggtggatctctccatggcatcgttggggcaggtccagtgcgagcaagcgttgatgacgaaggctctcaaggcggcggcaacaccttcttcaccgctacttccgacgccgaggccgactttgtctcaggatgcggcatcgacatcaacacaaccaccacctgaagttgaggtacctgttcgttctggtcaacctccggttcgtgataattcggatgtgcaggggagacgctcttgggtgccaaagatggatttcccaaaattcgatggcacagatgtttgtgtttgggtggataattgtgagacttattttgcgctgtatcaaatcacagaagggtttaaggtttcagcagcttctctgaatatgattggtgatgcagcacattggtatcaggcttggaaacaggagaggggttggcctacttgggagcaattacgtgaggctgtactgaatgagtttgagatcaatatcaaacgtgctaagatggaagaattgctgttgttgactcaaacaggaacagtctctgaatatcgctctaagtttctgcagctggtatatcatattcggctgtatgatcctgctactagtggtttatttttggtgtcccgttttgtgatgggtctgaaagatgaattgagatgctttgtggctgctcaagaacctgaaacagtgcatcaagctgcccgagttgctttagcttttgaggtgccttttgcaatcggaaagtggccttcaagaaggatgtggggaatgtgaaatttggggataaaggaaaagttcctgtgggggatttgtggaaggctcaacagcttaaagagtataggagaactcatggactgtgctttaaatgcggtgaaaaatatagtcctgctcatacttgtggaaagacagagggtgctcagttaaaaactatggaagtttcttcttctgatgatgtgttaactgatgaaattttggatgtggtcactgcttttgaacagttaccggatgataacatgttattatctttgcaagcagtggctggtactagtgctactcattccttgcaattgagagcacttgctgggaatcaagttgttatcattttggtggattcaggcagttctcatagttttatcaatgcagatctctgttcgaaactgaatctatccactgatccaattcctgtttccacagtgaaggtggctaatggtgaaactttacagtgtgaggctcaggtttctgaattttcttggtggatacaggggtgcacatttgtttcttcattgaaagttttatccatgggggggcatgatatagttttgggtatggattggctttctaagttcagtcctatgacttgcaattgggctgacaggtggttggagttcacttatcaaggcaagttggttaaacttcagggtattcagtctcatcaactgcagtatctttctgaagtatcttctgaccaaatgatgaaatggcaagtgggtaatgatatttgggctttagctgtggtcgactgtctttcctctccattgtgtgattctgctgtacctgcatcgattcaggacgtattgcagaaatattcttcagtatttcagcctagtgctggactgcctcctcatagggaattagatcattctattcctttggttcctggtgccatacctgttaatagcaggccatacagatattctcctgcacaaaaagatgaaatcgagaaacaggttcaggaaatgttggaatcgggtttaatttctcgcagctgcagcccttttgcttccccagttttattagttaagaagaaagataacacatggcgtttttgtgttgattacagaaggctaaatgcaatcacaattaagaataagtttcctcttcctattgttgatgaactattggatgaattggctggcacccgtttcttttctaaattggatttgcgcagtggttatcatcaaatcaggatgaaggaaactgatgaggaaaagacagcctttaagacacatcatggtcattttcagtttaaggttatgccatttggtttaaccaatgcgccagccacatttcagtgtttaatgaattccatttttgagccatatttgaggaaatttgttctggtattcatggacgatatattggtttatagtccttccttggagactcatgcaattcatttggatacagttcttcaagtgttgcagcaacatcagttaagcgctaagttgagcaagtgctcttttgcagcttctcagctggaatatttgggccacattatttcagctgatggggtggctaccgatcctgagaaaactcgcattatgagagattggcctgttccaaccaatgttactgagttgaggggttttcttggcttaactggatattatcgaaagtttgttaagaactatggtgttattgctaaacccctgactgttttgttgcagaagaatgcaaagtttatatggacagactcagctaattctgcttttcttcagctgaaacatgctatgtgttctaccccagtgttagccttgccagatttcactaaaacttttgtattggagactgatgcttgtgcaactggtattggagctgttttgtctcaagaagggcaccccattgctttttacagtaaagctttaggcatggctaatcaaaaattgtccatctatgagaaggagttcttggctattatgatggctattgacaagtggagatcttacttattgagaggccctttcactattaagactgatcatcaatctttgtgtcatttagatgatcagatactaggaagtgaattgcaacgtaaagctatgactaagttgattgggttgcaatacaagtttcagtataaacgaggtgttgataataagtcagctgatgctttatctcgtgtgggacacttatttgctacggtttctggtccttatcctaaatggattcaagaagtggttaattcttatgcaacggatgctgatgctcagcaacttcttactgagttggctgtgagtagtcccaatgacaagggattcatgctttctgggggtcttattaaaaaacatgacaagatttgggtaggagctaactctggattacagtctaaattgattgctgtctttcactcttcccctattggaggtcattcaggcattcatgccacttatcatcgtctgaagaagctctttgtttggactggtatgaaacaagctgtggaggagtttgtgcaacaatgtggggtatgtcaacaggccaaacatgagcactgtaaatatcctggtttgctccaacctttacccattcctgagggttcttggcaagacatttcgatggattttattgaggggcttcctctctctaaaggagctaatacaattctggttgttgtggatcgttttaccaaatatgctcatttcctttccttgaagcatcctttttcggcttctcaagtggctgaattgtttctggaccgagtggctcagttatatggaatgcccaagtcaatcgtatctgatcgagacagggttttcactagctcattttggaagactttatttgctagatttggcattcctttgaacatgagtacagcttatcatcctcagtccgatggccaaactgaacgtgtcaatcaatgcttggaaatgtatcttaggtgtgctgtggcgaatactccaagtaaatgggctagctggttaccattagctcagttttggtataatacatctttccatacttcgcttaagtgcagtcctcataaagctctgtatgggtcagatcctagttatggtcttttgccgtctttgtcagttgaggcctcagatgaatcttcctcttctaaagatgccactgcattattgaaggctcgttccttttactccagtacgttacagcaccatttggctcgagctcagaatcatatgaagcaggtggctgattctaaacgtactttacgggtgtttcaagttggggattcagtttttctgaagttacaaccatatgctcaaacatctgtggtgaatcgaccttgtcacaagttggctatgaagtatttcggtccctttcctattttggagcgtgtgggatcggtggcttataagttgcagcttccaccagccagtcaagttcattctgttttccatgtttctcagttgaagccatctgttccttctcatgtgcccgtttatacttctctacctgatgtggttgctttagatgtggaggatctgatccctactgaaattctggattgccgtatggtcaagaaagggaatgctgccattgtgcaagtgcgagttcgctggggttcattgccagataatatggcgacatgggaggattatgatgtgattcgtactcgttttccagcagtttcagctttgggacaagctggatctccggcgggcggcactgtcatatcggaggatattcagacttgagattactgaagaaacagagcaatacgtatttgtaaaatgcgctttagcttatgaaaagcgtaaacaagggtgtggggttgatatgttgggcccagtgggcagtagcgtgtggcgtgtatataagccactactgtagcaaatcggaaaactcgtcaaggaagaagaaaaagaaatcacgaaacatctctctctcgtcttcttcctctgattcctttcccctttctcaagtctctcgttcttcctcaacgacggcgacttgtgctcgccggcggcgaggtcgtaacagggaagggagaagaaggggggagcggggaaccggcgacggctccaacgccgccgacgaatcgccgatcggaagggggagcgaaaggggatcggggagggcgacgtggggaggggagcgctcgtcgattccacgaccaggtaaggacggaaccacctaggaaacgaacggccagattttgtccacgcgtgggaaagaaaagctctgatcacgtggactcaatttgaaatatgaaaataacgaggggttttgtgcaaaatttgatgacgtggatcggctgggcttgcggcgactctagcacctttaagatatctagtactagtattagaatgtactaaatgagcatgataaggtaatttgccgcatctcctcatttgagacgaaattgtctagagtgataaataatctaaaataagaggtaagcaaaatttatatattccatatgagccctaaataagataatacatataccagcacgccaacaggcgtgtagattttctagctttgtaaatttggcattgccccctcaaagaaactgccacatgttcatgtggaggaaattagcctaacgtttcaccgtgaaataaaaaaaaaacattggcgtgtacagtccagcacgcatgcctgcactgggcctggttgtccagcaccgctgctacagcatttcttgttgccttctcaggctaattgtgcacacagtaccaagcagaaataggataaaggaaagtaaaagaataacaaagaaaaatatataaatattcttttgcaaattttatctgaataaataaaatacattatggttaaaaccggaaattgagtcacataccaaaccatattgataccctatatttctacaaaataaataataaaaaaactaaataatagaaatagggtaaaagattggatgaaaatttgcaatagtaagaaccaatatgttttcgaatgtgcagttttactgttgatattgtatgcacaaatttttggttaataaaattgccacagttttgagggaacataactttaacattttttttctaatagcatctctaatcatttgttcaatcaggtttgctataggatactcaaaatattgtataatttgctaatagagattgtaaaatatgtcacggtttaaatatgcctaaaaaaccgataatttgctagatgacacttccatttcaattggagagagaaaatattcaaatagacaataatacccttgaggccacatgcttcaaacatgggcttggagtaatactttaaaaattatgcaactctaaacttgccaatacctccaattacatcgcgaacatacatcgtatttctatcttcacaacatccccaggttagaagcttttgttcctagaaaaattctcatctttttgaaaagtacaaaaaaaaattaggtgttttatagcaaaatttgccatcaaattattggcaatcactaattacactcctacttttgttcttctcattcttccgggacaaacataaaattaaattccattcttctaggacaaacacaaaattaaattccattaaccttttgaaagattttttatgggtgttagagtaactcatgtaaaaatatattacttcatcagttccaaattaccggtcattctcacatttcaattgccctatctccacctttcatcaatgccacatatatctggcaatcaaagttaacattacttttcaaaactattagaatgtagtaaatgagcataacaatgtaatttgccgcatctccttatttgatatgaaatttggtagagtgataaataatctaaaacaagaggtagataaactttttatattccatatgagccctaaataagatatacatgctataaatttactggtgcgccaacgggcgcgcatattttctagtacaactgaaaacgagaaattgaaccctgtcatcgcgccccaccaccgccgcctgcatccgtgtagtgtatccgtcgtagacagagtgtaccaccggcatgaatgcaccgccgcgtcgaaccatccatccccgccgttgcgaccggtcgggtaggtatttccgccattttccggcgtaggcacggaacagggcttcgacggttgacccgtacgtattttgacgcatacgtacgggccaaaattaccaacgccatgtgggccgaaattactgcaacctatgggccgaaagtacaagaagctacaggccgaatttaatctcgccaatcggccgatgagctcaaactactagcgcgtacggccccaattacaagcaatagtgggccaaaattaccagctcctctaggggcgaaactacctccatctatgggttgaaaggaaaaagtagaccgaaggtcccaaacttgtcatcggcataaaaaacgtccttagaccaaaaaatcagatatgcaggtcccttaagtatataaaaccggtcacccgagatccttcagtgatttcaaccccgattttgatctacgtggcggctgagtcagctttagacccacgtgggctccacatgtcaggtgtccacatcaccctctctctttcccctttatgtttctttgtttctctcctcccttcctctcactctttgctcttgcactcgcaggacatggggatgctggcgctaggacgcccacagcggcgcgcggcgccggaggatggtgcggccagcgacggcggctcctagggcagcgcgagcttcccccaggcggcgcacgtgctcagggagggagcaccgagaaccaatcccgcagcagcctccaccggctcatggtccagcacgacaacgtgctcgccacggatctcctcgctgtgctcgccacggacctccccgcccagcgccgccgcatctctttgtcatgggccgctacctcggcggtgccgacgcgtgcgccaagcttgtcgagagcgacaagctgccggtgatggcgaagatgctgggggaggaggggctgatgcaggagctcgctagtggggtccggatgctcatggacccggcatggacgatgccgtggaggtggccgggagggagaagcgggtcacgccatcgatgcggaggcggaggaggaggaggacgccagcaaccgcgccgtggcgggatccggcgggggcgagggggacgctgacgccgacgaggaggagaggatcctgtcggaaggagcgggcgcggggcacgccgnnnnnnnnnnnnnnnnnnnnnncgccgacgaccaccgggagaagcggggcacgccgacgccgacgaccaccatgcccgccgctagggggctgccacctccacagccttcgtctccgcctccgccaccaccacctactggccgccgctccccatccaccggcctccgcacgctcgcccgcctgccgccaccgctgctccgcgcctccactccactccgcttcgctggccgccgcactcgcacgccgcctccgctggccgccgtcgcggcgctgtcctccttctctcccgcctcgccccgtccagcttgcagagaagtgagagagagagatgaggaagggagagaagaggggaaagatagagaagaggctgacatggataaccctgatatgtggggcccacgtgggtcccacggtgactcagccgccacgtagactaaaaccgaggtcaaaatcaccgaaggacctcgggtgaccggttttttatagttaagggacctcgcatatctggtttgcggttcgaggacgttttttatcccgatgacaagttgaggaacctttggtgtactttttccttgttgaaaatacctgcaactacgggactaaattagcagcgactatgggaatcatgaagaaagcacgtacaaaaaggatcgagctagcctgattaggaaattaaggtgaccctattttggtgctataatgtaatctgtcactacttggtctgctaccaaattttgaaacacaaaagaaatattttttttataataccaatttcagtactttattcgtcaccatttcagtattcaaacaatgtggtggcctattgcctatgttcatacaatgatgtgtagcaaatacgtaagaactaaaaagtaatttacatgtaattgaccgcactgttttctcgactctattatgtacttttcaagaatctgaaatctagcgaataccattaattctttgaaggacggagattacatggagaagaaacagcgaatgtgattatggacgcgacattgaggtatatacttttcttcatgacttcatttcaatggatttttcttgctccccatccgccatgtacatcggaagagaagaagaatgctaatttcaagatcaaaacactgagatcgatcaataggctcggttgttgaatgagtccgacttttgcagcctaaattgctcgtagaatttcgcgatgaactcctcggcctgcatgtcgatcggattcgggctgcatccaccgtcctccgtctccagagaattcttttcttcttcctcgtcttcttttccatggccattgacaagctcctgcaggtcctgggcggacgagtagctgctggtcatgctcgtgccatcgctcctgtccggcgacggcggcgggtagtactccaggtggccgtggaggcggagcgggcgcatgccgtcgacgaggttcttccacgacgcgacgtcgctggacgacctctccacgtcagccgccgcgccgccgccggccgcctcggccttcttctgatagcccatggtggcggcggcggcggcggccctcttcttgatgctggcgctgccgttgaaggacatgaacatcgcccggaagaggccgaacgcgccccgcttcttgtcttgctgccggcttccgttggaggaggcgctcctggcgatggcgatgccgtccgtctcctcctccttcatcgtcctgtcgtcgccgtcggttctgtccatggaagcagcggtgatcatcacaacatgatttgtctctgcagctccattgatgtgctccttctcctccgtgctcacactagggatgatgatcacattgtcgccattggtgatactgtctaccttggggttggaggtgatagatagaacttgttctacctccatgggaggaggtagaacaaggtaggggagggctcgaggccttcgagggctaaggttctcctccaaagcgaagaggatcgccaagaacgggagttttatagacaacatttgtcgaggcagttgaggccttgagggtgtagtttgcgtaggttatttttagctctatattttgtggtcagtgtggcattctgttggagagtgagaggttaattctaggtgcattttgagaggttcccaactcccaagcatggctcaattttgttgagagaatatgcctcaaattgggcctctgatctcgtctacaggcctattcactttatcgctattttcaatgctatcaaaatttggtggtactgcaacaaactaagcatgagcttatcaatgtcattctaccaaaatttggtagttcccaaaaattcctctaacaaaaacgtcatcaatgtttggaaaggtatccaaccaaacacattcaacgctatcaaaatttggtaatgccaaaacgcgataaagtgaacaagccctatacattcatgcgccaaagtaagatatatatagtaggggttgacattcaattagatcaatctttattttatttttgacattccggtcataaagaccgagtgatcttgaaaaataataaagaccaaacatttcagtctctatcctgaccaaagttttagaaaattcaaaagaattacacaattcccttataaattttagatcaaaacaaattaggcacacaaaaatcgcatatcctccaatgttggccggtgtcgtcatcgtcgttggagaggctgagtgaaggaagagcctctagaggagatgcagctggcgggcatgcctcaagctttggatgacgttcgagtgtaggccgggttggaggatagtggcgctgactcgggctcgggttcttcggcatcgcagtagaatgcaacgctagctcggtcctcaggcagatgcggagaagcggtggcgcaacttccaggaggtgacacatggcttggttgtcaggtagaggcggagtaggcagcgcgggatcgctcgtcaggcaatgccaagaggtggcgctccgtgtggtgtctaggtgagtggagaagtggggttgattgggatgggtaagaaagtaggatttcctctgttgggcttagagtgcgttctaaacaactatgtgaaacaactacttcatcactttctattaacaatcttctcgaattgctaaacttcttaacatagaagtttctttaaaaaatcaatcccagcacatcctctttctgaacgaaaccttggtggtctattgtgttgttaagttatttcaatcaatttggttagctgagggtgatgatcaaatcgacaaaattttgaataaaattcggttagtgacatgttgagaccgtattagtaactgaattgctctatctcggttccaatcttttcagtttggttttttttttttacccaccctagctagtaaaactagtgtgggagaaagaagaattgcatctactcagcctaagtatggcctacaatgttatggaaaagcattactcagccggctaggcggctataaatatttagcatgtaagaaaaagttgatagtattttcaaactttgattatcaatttagatggtgcatttttaatttcaaatgctttatatgactgcttttttttatttatttgtaagtccttttgcagatttcaggactttgtgtctatgtgcttatcttttatgagccttcctgtaaaacgaactgcccttgcatttcaactatcagtctatcactaaactgtattgaggcgttagcctcaatgtgtttttcagaaacgaaggaacaaaagcattcgaaaataattaataagtacagcttttttatacttgtgttattagttgtttgccaaggcttacaaataaactacgttgaaggacactctaaaaattaagttttaaacttcaatttttagttgtggtacataaaacaacaagcaaacaataataaggaacaaaagttaaggaaaaaaaagaaaacgatttaagaaaggtggttttgaaaaggtaagaaaatttactgtttatcatccttcgaaaatactagtttccagatatcactctaccaaattttcgttttcatttgcccctcaatccgaaccaattctcttccgcaagccactcctagccccattctcactcacgtggttgttttttcatattggtcccgtccaacgtggaagcacgataggaagacattattttttaaaaaaagaacgtgggtgacaataggagtaaaaatgattgttggcaactttttttagcaagaagacaatcacgatcgagacacctaaacgtcttacagtgatatggagtcgccaaccacctcgatctagccaaaaggccaaatcaagatgggttttgtagaaaacggctaaaccggctagcggagccgatttagatatcaaaatcagcctctaggccgatggccgatttaaatcgatatgaggataaatacccgtctcatgggaaacggaaggtttacgggacaaacctacaaaaggggtaatcgcactctcgtagcgacaacagacgatttacggtgtaaatcgataaagatggataaaaactagggtaaagtagaaaacatggctgaaaagtaaaagataagaaaacgattcgattgatctgtgtatagactgtgtgatacattgtttgaaccggccttatctcttaaacaggggttggtctttccctctacaggccctcctatacgtccaacttgggtagacactaatggaaacccgaaacataccttcccgagcaagaaaacatgagacctgacgaaaacagactcgggctcggattccggtctgactggccctttggcggcggtctaaccggcccacacatgacgatcagaccggcccttctagagaaaaccagcagagttcctatatttggattttttcctatttcgacccttaaatgtcaaatttgggtgtaaatagtgatgtgcgggagagagttagtgaggatcggccgagtggtaagtttgaacgaaaatttgggtgagtggcagttgagggaggatggcaagatagtaattttttccacgaagggaagaaaggtttgcatcaaatttgcgaggtaagtaaggtacctacttttaaaaaggtgttgtttgtgtgtaaacgtcgagaggaaatcttcttaagaactgtgaaatacaactacatgataatataatcaagatgtcatggggtaattacagtaaaactaacatttaattattgcaatataagttgaaaacacagccacctagtggagagctgtgcccttgcccgcacatgatattttgattttcccaaactctcaaacgctttatgaaactttatattcatgatattcatgtgacatgtgtttttataactaagattttaatatcttagggcaggtgaaatatctactattataaaaattaaaaatgtttttatcggtataagtcaatccgtgtttaagtcagattttaacttcattcatttttataaaaacagatccatgtttaagtcagtttttaagttcgttctttttaaaactcatatgacaatcgattttgcaaaaaaaaaaaaaatcaaacaaaatcctacagtgatttcaccttgctaaaccgtataataataataagattaaaatagttttatcctttgcaacacacagatatttttaatagtttaataaaaagaattagaagaagcaactattaatttttttttgtcagcagatagtccgtataacttcgtttcgaaaatacgcgccggccgaagattctcggaatgggaactgcgattactgttcgccgccaacctttccagcaaatggcccgccacttgctgacacgacatgacccgcgcaccaaattaaagtagcctcgggaagaaaagaaggtccattggaactggcagcaaagctcgccgagtacgagtagaaaggccagtctccactcccctctccacttctccaggcctctcagattctcacgaactcacagtagcacttatctctccacagggaggaaggagaagctagctagccgccatggtggccctcgctgactcagcagcggctaggaagctcctcctgcatggcgccgccaccgacgccgccgccgtcggcatgagcttcggcctcgacggcctgtggcagctcatcgccggactcttctccggcctcgtccacctcctcctcctcccgttccaggccatcgcccacggcttccaggccctgggccacgccatccaggcgctcttcgctgggctcgggaccgtggcgcacctgctcgtccaggcggccgtcgccggcattggccatggattcgacggcatgtggcatgccatacagggcttcttcgccagcatcgtcgccgcgctcgccggcgcggcccatgggctcgtcctgccgttcgaggcgttctggcggtggctgcagacggcggcgggcggcaccggctctggtttccaaggattgtggcagaacgtgttggccttcttcgccacgctcgccggcgccgctcacgacctcgtccacccgttcgaggcgttctggaagtggctcaggaccgcggccgccgacgccgccgccgacatcagcttcaggctcgacggcctgtggcccctcgtcaagcgcctctacgccagcctcctcgccacgctcgcgagcgccgcccacgggctcgtcccgctcctcgagtcgctctggcgggggctccgcgccgcggccgccgcggcgctcccctacgtgctagtgatcgccgccgtcctatgcgtcgtcgcgcttgtctggctcgcctggccgttcctgttccccgccgcggcggtgatcgggctggcgctcgtcggcgtcgcgggctgctgcgcgttcttactgctcgccgccgccgtcctgatcgggcgggcgctcgtctacgccgtctgcttcggcgttgtcctcttattcgtcgccgccaaggtggtcggcaaggtgctcgaccgggtcctccccgcctgcgcgcggtgctgctacgacgaccgcgtcaccaccaccgccaccaccatgagcgctccggacgccgccggcatggacatctcgcgagcagcgtacgagtcactcccggagctctacgcccagatactgcgctccgccggccccgtcgtggccgcagccgtcttctgctcgcatcccgtcgcgtgggcgtgcgcggcgccggtcgccgccctcttcctcttccgcgccctggataaacgcctccctccaagcgaaccctgcgtcctccctgcggctgcataccctgacactgtcactgacgtgtcggactcacgttccattggccagcatgtcagcgaagatgatgacatgtccgactcatgttccatagtagacccataccacggcgagcacgtcattctgactatacgccagaggattcacctgcgtatacatgtcgtaaataatgtctgtcccgtgtgtgcgctagcttaacgatggttaatgtaaaccggtgctatcgatcaggtgatcaatgttggtttgttggcatgtttggttgtctcggattaccacaactcaacttgtcttgtcataatgttaaaaaaaatggactaagtgtagaatatacggagaaccctacatttatggggagcggattctaatccctcgaggagatatccccccgtatatctttttctttcaaatttaatgcaaatagttggaaaaattctaaaaaaaattgacaatgtagagtataatgatacctactaatccaccaaaattcaagttcaaattcgatctacacatcgagaaacaaaaaagataaatttagatataaacagtacgggactattcatatgctgaatttatcttttttatatctcgacgtgagagttgagtttggacttaagattttgtggagttgtatatatgtgttgtatgaatgttgtcaaatttttccagaatttttcataaccgtttagatggtttttaggtaaacgagggaatatcccctcgagggattagaatagttccccatatttatgttactatatttttcataatgaatattatttaacgtatttacatgataagtcttaaaaagtacattgtaaatttaatgtatttatattgtataagccaaaaatcatattgtaaattcaaatcttatattgggaaaaaaacaagcaaaagcagatagcaaggtgcggcttgccgcaacagaagaaatcaaacggaactaaaaggctcctgtacccgcagagcaatcggacggacagtgaaatagatagagattcgagatcaacctagaaagctatcaaaaacattttaacgtttccaaacttaaatctattataaattaatcaacaaaccgtggctcgactacatttggtatcgaaatgtggttcttaatttactagtataatgttattatcagtattaatttactctttttagtgccaaagtgtggtgcggcgcacttttaacaaaaaaaaaagtgatgaaacgaggtagcaaatttagcaatcacttcatcgaactataagcggaagatcgatagataaattcgatcttaacgggagcaaaccaagcagcttatttttgcttattggatgatcatcccgggtacttttttttttttgccggcggggttttggctctgaattacatgtccgcctgtgaaaatcgatcccctacgatgtcgaaaatgagttttctagtagtgtgaatgcgtatgtttttcaaatttttaaatggtgcgacttcttgaaaaccttcgataagagtaaattttccagagactgttttgaatcctttatagtaacagtttaattcactattcatgtgtaccctaagagcaagtttaatagtatagccaactgttagctccaattcaactatagctaatctaatagctcatccatacaatagttacatactacactagtaatacctggtcccacctgtcatacacatactgcgtcttggagtccgtgctatagctggctacaaatctatagcccgctgctcttctctctccttatttatctccttaaaatatgtttgcagctggcttatagcctgctattgtacctgctctaaataactatcacagatgatttatctattcaatcgttcgtcacaaaacaacacagttatactatagaaaaaatatatcctaaatgcttagaaagcctctttatatttgtattgtagtaagtcagtcattatttacaaactgatatggagtaaacagttctaataggcttatactccgtctgttacaaagtacagattaattatttctaccattcaagttttgtcctaacatataatacaactgtttttccttataccccatatctcaaccaatcataattctttcatactcctatttagtttcaactatactttctttaatacttgtgtcctacttcataatgcttgtgctaactctgtcccaaaataagtgcagtcgtaggtgtccgtgtccgtgtccaacgttgtttgactctccatcttatttaaaaaatttataaaaaaattaaaaagaattagtcacacataaaatattattcatgttttatcatctaataacaacaaaaatactaatcattaaaaattttaaaataagacgaatggttaaatattagatatgaacagtgcaaaactgtatttatattgggacggagggaatactttcgggtcactgagttagagcagcagagattttagtaaaatttacggttttatcactggcagggcagtcctgttcaactgtgtatgagtacaatagacgaatcttccaaagtttcagcaggcactttacttacaagttaagctaacaacatgcgccgaatcaatgcagtctaaagaattaaagttacttttcccccttctttttcattttttcgaaagcggacagtatacttcttttatggttcgtagtactccagttgccactgattcattctttccattatatgttgaagacacatacatacacacacaattgcatacgtagatacccatcgatacgttctctaacactaatgaagaaaccatctataatcggttgcttaaaaaccacgataatcccagctgcttaaaaatttgggactataaatatttttagttccggtttacaagcacaatgggattatgtgatatttagtgccggttagtaacaccaaccgggactaaagacctaactttattcccaattggtattactaaccgggaataaaaatcaaaacacactatataatcactagtacttatcctcttctcccgttcatatagactcctctctgtctcttttttccttgtctctttttgtcctctaactgagagctgagccttatctttttccagccttgtctccttacttcattctcagcgaaggagcggatgggagcgagcattggaggaggacgccgagcaaccggcagcggtggcgggcggcggcatgcgcggcggggaggggaggaggggatgcgtgcgcggtggcgcggagggccgcacggcgctggctggcacggcggcggctggccgacgtggaggggaggcgggtagcggccggccagcgcctctaccggaggggagacggcagcggcatttttttttttttgagaatttttgattcattgtataatcctatgatgtatttgatttgtgtgtgatgtgaatatctgatgtatttgtgatgaatttttagaacttgtgatgtaattttattaagaatttgtgatgtatttggagatgatccttttgatatgtgatctgtgatgatttgggatgtatttgaagattatcgatttgaggatttgggatttcacgatttaaggatgatttgaggatggagtgaaatcaatattcaatgttaaaaacaatgaaataaaaaaaggaacaactggacctggcctaaaatggatttttactcctagttatttcacccgggactaaagatggccatttttagtcccggattcgtggtcccggttatataaccataactataaggggttactaatcgggactaaagcccctttctccagtagtgtatcatacctacgtagacaaaaaaaaaaaaaaaaccagcagcaaccctatagcttactagtaaaatttatacggagtatatagagagacaaacgtcaacttcctatagcatcacagagcgcatgtacaccagcatcactgatttgagaagtgtgtggaatcgtgcacccttaactccaccactacactgtgcttcttagagcaggtacaatagcagctataaacatattttaaagggataaagaaagagagaaaaacagcgggctacagatctatagccagctgcaacacggactccaatacgtaatgtgtgtatgacatgtacccagatattaatagtatagtaagcaactattgtatgaattggctatagataatttggagctagcagtgggctgtactaaactttctcttaggatgtcaatgattttcgttgcatgttttctctacatatagcagttcctcgcttgtcttcttcttcgttggaaatggatcgaatgcccttcagagtagatcataagtcttcccattttcacatggtcaaagtagttatttttttttaaaaaaaatagataaattattgtgtgacacatcttctgtaaatatgtaagattaaatttgatttatgcaaaagaaataaaaaaaattagactaattggtacaggatatagtatattctagaattacgaatttggataattatatcacatcacatattaggtttattaatttattttacgacgtagttgtatacatacatacgtggtccgtgtgatagagtagtggtgatgggctctcgggccactggacctgtagcgtgcgtttagtttgtccgcaaggtcatcatcatagtgtgtttatttgtaatgctagctccattctctgtgatatacaacttcggggctccacatagagtcctactacctccgtcccaaaaaaagacaaaccctggtttccgtgcccaatgtttgaccgtccgtcttatttgaaaaaattatgaaaaaaattaaaaaaacaagtcacgcacaaagtattaatcatgttttatcatctaacaccaataaaaatacggattataaaaaaattttatataaaacggacagtcaaagttggacacgcaaacccagggtttgcctttttttaggacggagggagtaagggtgaaaaatattgacccgtcccgcgcatagagttgggcctcgccctacattacctgcgtgtgtatatttggctcagacttggccttgttggggcgaggatgcagcctcagccaagaaattgccaccgctctaccatccattcatccaccatctaacagctcaacacaaatcaagcaaatcgatcagagaggcttctagccttccactatctttttccatcaagtaacagcatgcaggcaacaaccttctgtttctcttgtgaattaattcaggtattcgcctccactctccgccgatcatctcatccatatagttggaacatgttgctcaatggttattattatttggtctttgttcagtttgctaccatttttaaccttaccaagttttggcaaagttaaaaaaaaagtggctacatttagtttgttgctaaattttagtaagcacatataaaatgttgccaaaattttggcaaccttacgaaaatttggtaatgtcaaaatttggtaaggttgaaaatggtagcaaagtaaacaggtcatttgtctattttaagatccacagctgctactcgctcatcgcatttacggttcatctatttatcctcttgcccaatcccatgtactggaattgatgtcaaggagtttttatttcagtttggatggtgtaagtttttatttcagtttggatggtgtagtacctacagaattttgtgctaaaatctatgtgattttaaaaacattatttcagttgatttttttactagcggaagttgaggatttgtcccatcatgtctttttttaattcctttcttttctacttctgagacttgttagctatgtgcccatgggcagaagcaggtgatctaatctatttccattattaaaaaaaatacgtacaagcaagagatgagcacaattatttacctggctctctctccccctcccctttgatctctttaggctgcacatttatttactaaatagatattgcacgtatattcgctactatagaaaaggcaataggtgtcggttgggaaccccacagacacctagaaagcgacactgatgtgaagagaaaatatgtgccggttctggtgtctgtttagaatcgacacctttaaggtgccacgaataaaaaaaaagacagctcgatgagccgagcaattccccttcatcccaactaatccaagaacattcaagcacacaaagaaccctaagaatatccaacaacatctgctgttgccccctccactccagtcgctgccaacgcctcctctcccctactctggcggaggggaggacgtcgccatgccaccgcctcccctcctgccggatctggcggaggggagggtgtcgccactaccatggatgggtgtgttggatggagtaggaggagaggagaaggaagaagaggagaagccttacttattttttaattaggtgtaggtatatggtaaaatctatttggagagacctctcgcttttaccacgtccatatatagatatagatgtataaaaaaaaaggggtcaatccgtttccctgtgaatgtttacaagccgttgggtacggctgcctctgcctttacaggactaaattaaggaagaggatacggtttccatggagaaaggttgtgcttttttccgagctcttggcgtttctcctgtgggaagaatgaataatcgatgccggcttgcagggccccatttctgttattagtcaaggctattgatcattctacttaactagctagacatttatatagataattagatattgccaatggctgtggttgattgaactctccagttaagcgcatgtacaatggtgcttattaatatactatctctgttgtcatggaagtaaatttgatagttaacatgaaagaaagagaaatattgttgctacgcatgacagcaactcagagtcagctcttagtatttctctatataggctacatgactatagaggctgcttatagagaaatgccctatctgtaggctacatgactctatccgttaagatttagatataatttaatgtcattaaatttacttgcataataagagactctgataacaagtatactttaatatgattttacatatatatactagctagatgcttgtcacattcgctgttcagtctgtgagtgagtttagtgtacgttcgtacgtcttttatgcgattgagtgaaaaagaaataccgtagagggcagactaatatcaagttactaccttgcaagcttgcatccgacgtgcaaaattgattttgtgataatattttgaaaattcaaacaaatgaattgactaatataaagttaaaaagttattttagaattactgttctgagaaacttatgtacagagaatttttacaaaaatcgcatagcttattatttggaaagtgtgggtgataatctacgagagaaaaagaacgggaagatggtccatcccacctaggggtgaaaacggtacggaaatttccgagaattccggctaccgtttccggtttgcaccgaccgtttcaatcggtatcggtaattgtcggtatcggaaatggaaacggtaatctttttcggaaatggtagcggaaataatatggggttttttccgaccgttttgtcggtaaccgttttttatcggtaatttccgtcaaatttccgacaaaattccgaagaaggaagtcggctgggcctggctagcaggaggaggagcccattaggcattaaggagcagcccattccgaataaagaagccaactaggcctgaccgcatcgtcgtcttcatcggcgctggggcaccgccgcgccgtgttgggcgccgccaccaggtcgccgacgccggccgcaacttccttcgccccgacggcctccgtcgcagccggccacctttccctcccccatgctccaccgccggcttccgtgccaccaagccaagcgccgagcgccgccgcaccgccccagcctcctcctccccaccgatgccgcccctttctcctctctccttccccccaccgccgccctgcgccaggccgccatctccggcgcctctctcctctcgggcgcgcgtgaaggagccaaaggcagagaagagaacaagagagaaaacagagaagaaatcgagagagcaggaaaaggaaccgagagaagggaaggataagagagagagaaaataaaagaaagagaggaaaagaaaggctgtgggatccaccggcgggccccaccatcttgactcctctctgtgatcgacctggaaataccaaaaagtctagtttagcatgaaacttaattacaacggtagttatacagtgtcaacataaaagttcttatgcaatgtgccactgtaggacgacgatatagctatgtcaattgatgatgaaataatgaatgatatttgacaaggagctgatcagctgaagccatgccagcttgtgagcttggtgttctcgaagacttcaaatctatatcctaaaaaaagtcggacaatattagttatgctgtaatcctatcatgtaagccacattgtatgctttagccacattgatgttgaagtatcattgaactttatttatattatttgtcaatcttattgtcaacttattaatcatcatataaaggtgttgtgtggcagcataatgatgcaagggtgaaattataaggttatcttcatacatagttaaatgcgggatgataccacagttcgctgtttccgacatgaattttcgacttccgtccgatatcggtatattcccgttccgacggttccgtttccgagataccgatataaccgatatccttaccgtttccgagtatacgttccgattccattttcgagaaaataaaatgaaaatggaaatggtagagggtttttccgaccgtttccgaccgttttcatccctaatcccacccatgacgtatctataagatcatacacattgcatcatatttgttgcgtcaccgccgtatataaactttataatatattaaagtaagtttgatgctcttactatagggatgatgtggctttcgatcttagcaccctcctttttgggtattttctggttttgccaaagcaaaggaatcattagtgcgattaccagtcaatgaaaggtgacctccaacaaccgccaggcatatgattactgtcactcctattaaaattcacatgttctttttatgtgttataaatggaccctttgccattacaaatttaccaatttggaaaaatatcactactattcttgaaaacctactatatgtcactgattttttctaaaattcaaatcatgctattgccgtcaagtttgctatcatcttctctccgagaccatattccatctatgcttacgacgagcgtggagaggccgatgctgtagcgctgggagcaggagagatcaacgacggagagtaatggtgcaaaagagagtacggtgaaagcagcgtcgggagggcgtatgagagtcaacgcgatgacttggatttatcatggacacgagtacatataggcacaatacgtccttatctctataaccgacttataggaacaaaatcgctaaaaaatcagggaaaccggcccggaaaagatagttagcgtgcgcgccgccaacgcgcatttccagcccacgcggcccacgcgcgcgcccttcttttataaagttttatctctctatttgaagatgttatattaaaataatgaactaggtgtcttatagtaaagtgccacaacactagagtaccatatgataaagccgtaaaagtagaatgtcctagaaagttagtgttctaaagtaaattttgccttagtataatttccttttgtctcattttgtctagagcagccaccatcagatcaggtacacccatcacttccatttccacttctgctctgcgatggaaatcctgatggtggcaggagggccggaggggcaacggtagataacataagaagatactagacatacaaggtttagagtggagatgaagctagactgttgctaaaagagagggcgatgaagtgtctactagagccatattttctccggcctattgtcgcgtgcgcgggtgtggacatcggctgcgcgatcgtgtgcggtgacgtcgagggcgctagcacttcgcgcaccgaatgacgcggcacgccctgcgagcagcgtgctcgggtagggcatgggtgacgcacgtcgagacatggtgttaggcccttcgcagtgcaccatgctggtgagttacttcttgcctccacctaggctgcgtgatgccgtggagaagagagggtataggccctcatcccttgacataggttttcctctttcaacaaagatgccagttactcacatgaataaggtggcgaggggggaaatgcatgggagagccgccggagcaagcaggccgcgtagagctcgtcgccctccattgccgacaccactctgcctcactggctcacaccttctttgcctcaggcagatgccgttcctcctcaaaccgccttgtcatctcctactcccgcgtcgccgacctcgccgctgcttcggggaaggagagaaaaggtggtggtgcgctagtggatctaaccgccgcttcgcccggtgtcattgtcgcttgggtcgccgcccctccgcccaacactgtctctactcgacgccttggcttcctctgcccggtgccatcgccgcttgggtcactgccgttccacccgacacaaggattttgattagcctagaagggtgattgagaatgaaacattggatctgttggttactcacgtggagagtacggatgcgctaagtgggaggagaggataaaggaattaaggacatgttgcgctcaatggagatagtagagaaaggcaagtgcataacatataattgcaaataagaaacacaagaaagaaaaataaaagaacgacatttgaatagttcacatgaaaaactaaggatcagacaaaacagactgagtcaaaacccagaggttagagctcttcctaacttgtcataagagtatatatgatacaattctttattccaaagggctaggatttttcccacaaaataaaatcatctaagttttctttatttttcctacaaataaaaggaggcttttaatttaaaatttaaggacttacacgataaggcatccatgcccaccctttcaacccaactgttgttttgcctctctactttttagagtttacatttttgcactatttttttgaaaacaaaccagccatttgcgctcacttttgacgcctcttgggtgggtcccatggtttttagtaacataaatacaaacggaaataaattttttttctacaatgttgaattcccatactcccgttcctggcccgtcaccacccaaaaaccctagaggtggcggtggttctctggtgagcacgcaacgaaggcggtagtttagacgaatgcatggtgttggcaagcgcggtgggcctccgggaggcgcatcgaggctggtatccagcgggggtgcattgaggtggtagccgcagggcttccgcgtggcaagcaacgactaggcgcgtggaggttggcggcggttgcggtgcatgttgcaccttggcacgacgaggcacaaccaggcgccctgaactaggcgacggccgggggggtgtgccacgccatgccacggtgagtggcggccaagtgcgccaaggcagctggcagccatggggctcccagcatggcgagcagcagccatgggcttcccgcgccacggtgctggcggctcagtggcaagcattcggaatggaggtgtaggtgctttcgccaagggtaaaaatgtcgtttcgtcctaaaataacacggttaaacctaccgtcgaaatctgtcatatgcttagaacttatcgatagaaatggaattcaaaacttgggaatagttttgaggagagcctttttctttccaaccaactgatctttcattccatcattctttctttcctcttcgaactttgtgcttgactgtattagtggaagagtggaagggcggttaatagcttgaagaatggaaagagtcttttcgtccctctaagagcagggtataatagcatactataagccagctataaatatattttaagaagataaaatatgagagataagagtagcgggctctagatttgtagccagctgcagcacagactccaaaatgtatgtatgtatgacgggtgggaccagacattaattatgtaatatatgtttatagataattattgtatgaattggctattaaattgactataggtgatttggagccaatagttggctatactgttaaacttgctctaaaagagggaggggagcagtgaggacaaacatctggttcattttcaaaaaatggggaagaaacaaaccctaaaagtaagagtaaaatagcagttgtggttaaaagtgagtgtatgatacaattatccctataatatattaacaagagtaaattaaccctcggtacatgtactgtccgcaggaagttccgcccggaacctttgaagcaaaagcttcccctcacggtggcgtgacatgcaccaatctcgccccaaaaggagtctagtagtagcggaactgtgggaatggagtagctagccggcgagttgccctagtggccgagtcctctcttcttctccccttcttcacccatagtcacagtagtcagttgtcactccacactgctacctgctacattgcagctagctagccatggtggtcctcgccgactcagcagcaaggaagctccttcatggcgccgtcggccgagcccgcaccctcgccggcgacgccgccgtcggcatgagcttcggcctcgacggcctgtggcagctcatcgctggcctcttcggcggcctcatccacctgcttctcctcccgttccaggcgctcgccggggccatcgcccacgtcttcgaggccctggggcatgccatccagtggctcctcgccggcgtcgtcgcggggctcgggagcttggtgcacctgcttgtgatgccgttcgagatgctgtggcgcggggtccaggcggccgtcgccggcatcggccatggattcgagtccctggggcacgccgtccaggtgttcttcgccggcatcgtggctgggctcgggagcttggcgcacctgctcgtcctgccgttcgagatgctgtggcgcgggctccaggcggccgtcgccggcatcggccatggattcgagggcatgtggcagggaatacaagggttcttcgccagcatcgtggctgggctcgggagcgccgcgcacctgtttgtgctgccgttcgaggcgttctggcggtggatccaggcggccgccgccggcatcagccatggcttcgacggcatgtggcatggcatacagggcttcttcgccgacgccgtcgcggcgctcgtcagcgtggcccacgggctcgtcctgccgtccgaggcgttatggcggtggctgcagacggcggccagcggcatcggctctggcttccaaggattgtggcagagcatacaaggcctcttcgccagcgtcatcgcatcgctcgccggcgctgctcacgacctcgtccacccgtttcaggcgttttggaagtggatccagacagccgtcgccgacgcaggcgccggcatcagcttcggtttcgacggcttttggcagtacatccggtccttcttcgccagcgtcgtggccatgctcgccggcgcagctcacgagctcgtccaaccactcgaggcgttctggaagtggctcaagaccgcggccgccgacgccgccactggcatcagcttcggcttcgacggcttttggcagaacacccggtccttcttcgccagcgtcctcgccacgctcgctggcgcagctcatgagctcgtccaaccattcgaggcgttctggaagtggctcaagaccgcggccgccgacgccgccgccgacatcagcttcaggctcgacggcctgtggcccctcgtcaagcgcctctacgccagcctcctcgccacgctcgccggcgccgcccacgagctcgcgccgcgcctcgagtcgttctggcgctggctccgcgccgcggccggcgcggcgctcccgtacgtgctggtgatcgccgccgtgctgtgcgtcgcggcgctcgtctggctctcctggccgttcttgctccacgccgccgtccagatcgggcaggcgcttgtctccgccgtgtcaagcggcgcgcactacctgttcgtccccttcgggcagtgctgcgtcccgctcaccatgatgagggccccgggcgccgccggcctgatgatttcgcgagcagcattcgaatcactcccggagctctacttccagatactgcggtccgccggacgcgtggtggccgccgccgtcttccgcgcgccgtccatcgcgagggcatgcgcggcgccggtcgccgccctcttcggcgcatcatcatgatcaatactacctctctgtcgtcagtaatgtctggcactctggcctctatttgtgatactagctgttaactatgtgagctgtgctaccgatcagcgtgtgtgttgggttaatatggagtactgtatttaatttccaggaatgatattacattactgttaaccagagtacctctctctgtttacaaaatttaaaacttattaaaatataacatatgaaattgttttttttgacaaatatatcaatataattttcatatattaactactgatttttattataggaaaaagtacgaattaccccatgaactatcacggtcgttcgaattaccctcctgaatcacaaaaccggacattcttcatctccaactatgcaaaccggacgaattacccccttcgacccaatccgcagtggttttggtccacgtggcgtacgcgtggcagtccagtcagcaatttatttattagaaaataggcgggccccacctgtcatacacttttcctctctcttctcttctctcactctctcacgaatcacagcggtaggcggggggcggcgagcggcagcggcggcgggggatgaggcggcgagcggcagcggcgacgaggaatgaggcggcgagcggcagcggaggagacgagcggcggcggcggcgagggatgaggcggcgagcagcggcggaggaggtgagcagcggaggaggcggcggcggcagaggaggcggaggaggaggcggcggcggcagtggtggttatgcgactgcgaggtgtggcgga

SEQ ID NO: 59919 - DNA, 2638 bp, Oryza sativa
aaaaaagataaaaaacttgccaaggacatgtgcgctgcatcggattttctgagaaattataaagtactttttcaagttttcacctaagatcatctacctgttaattataagccataacaaaatttaaatttcaaaagttgattttgaagtttttttttattgtgatcattttctatcatcggttttagaaccataaacaatagatataagcacttttaaaagataatttttcacgcttattttttcttgcttaatatgtcaaattgacacgttataaaaaaaaatatggttcaaaacttcaaatcatgtccattgttttgtttaaacactagataaggctaaaaatatatgttgtgtccatttcctcatatggacctataatcccacatgtcggtagggtggtggcagaaccaccaccatcaccattactatagatgtgctacatggtatagttaaaagaaacaataatcatttaaaagtgcatataaaaaacattttaatttatgaattcgcactctatgaaacatgttttaaaaaaatgaagcatatattttatcttatttgattaatgtaattacctttttttaacaagcgtatattatatcatatattataaatgtacgtcttttataggattttttaagggaattgaacttattctttataaaagatatacacagtaatttcttttgatccaaatatactttatgtagtatgcaccaggtaaaaatagcgagcgcgccttctagttttgtttagtccgtgaataatatcccaccctaaatatctactcctatattcctagagaggtactccagcgaccagcctgtaagcctgccacgcagctgctagtacctctaatgttgcactgttcatagttttagtacaaagtagtactactcctacatgcttttactcaaccatcggttttgccctctccacagatgcagactctttgactgttgcataactccatactccataaaaggggtccaccatcggttggaccaatcattagtgatacaagcggaccaatcattagtgataagaggcaaactgttggtttgtagcttgggccatttgtcagtgagatataaaatactgcaatgcatgttactgggtgtttgcattttgtaaaagagccattctcttccttttaagtagtgtaataatatgttggtcttataaacattgagatttgtttacctgtaaattaggggatctgccaatgaggtatttgggctttccaattgataaagaaatacttctgaacaaagattggaagaagcctgaggaaacaattgaaaaaaaaagttggttgctggcaaggaaatcttcagtcaattggagggagggtgagtttaattaatgcttgtcttagtaatactcctttgtacatgttatccttctttagggtgcctattggggttagagagaacggatctttataggaggttcttatggcaggatgatcagggtattaggaagtatcatttggttaattggaatacggtttgttctcccagggagacagggcgtttgggcattttggacttagaaatcatgaacattgctttgctggggaaatggctctggaaccttgaaaattctgaaggtttatggcagcagatgtatcagacaaaagtatttatccaaaaacattttggctgctgcaaaaacaaaatctggggcctcccatttttggcaaggggtgatggaggttagaaaaagtttcttcaatttttgttccaagagaccaggaaatggagataacatccttttttgggaagataactggttaggaggaaaacctttggcagaacaatttcctttttttgtatagagtaactcagaaccaattcattactttggcaaaagttaaaaaaaaaagggtggggttgcatgactttcagaagaaatgtgattggagatgcacttgctgactggaacaaagttaagtcttcttgtgatgagataactctgaacaatcaaagagatgtgacagtttggactctggcaaagaaatggaatgtttagtgttaaatccttttatagagctctaaagttgcaggggactgtttccatgattgggagttcacacaaattttttttttggaaaattaaagtccccttgaagtgaggatttttctgtggttgctgcttaaagagaatgttttaacaaaagataatttgataaaaaggggttggaggaagggtaatgatctgtgtcagttttgtgaacagaaagaaacaattcaacatttattttttgactgtcctctggtgagattcacctggactgttgtgatttgtgcttttggtatgaaccagattaaagacatgagacatatgttaagttcctggattcaaccttgtgacaaattacaaaacaactaatgctagttggtgtggcagctgtactttgggccacttggaaagcaagaaatggcttgttttgatcaaaggcctgtgcactgaggtctagctggctttcgtttgtctttgtttcttttgtgagcacctaggggttctatccttctggttctaagactctgtttttgtaagaacttctgcgtttctttaatgaaaattggagggttctgccctttgctcaaaaaaaaaaaaacattgagatttg

SEQ ID NO: 59920 - DNA, 9921 bp, Oryza sativa
attttcccctttcttgttttttttccatgcatacggcttccctccctttcttattatggcatgggccttcatgagacgatttaatcacaagaattttgcatatcttgctctcgaatttttcatttgtggacatactacacgatatgtatatggatggattgcatgataattaattaactagtaatagtttcttatttactcgagaaaaaaacatgattcaaaagtggtaagtacttaatccatctcctactcaaaacggttttttagataccttaagaaaaatagaaccctaaattattataaaataccatcatcccagctttagtttacccttaatcttacaattttgacaaaatataagtacccgtgcatgcgcgtgggccatcttcctagtaactttaaaaggaaatgctgactggattgccacgcgtacgccaggtaggacaaaaccgctctggattctgttgaaggggggggttaattcgtccggtataaaaagtttggggtgagtgatatctggttttcgggttaagggggtaattcggtcgatcgcgatagttcaggtgctaattcgtactttttcctttatttatttgtgtagagagtaaatgttcattgtggaatgttctgcatgcatacatgcaaccaattaagattaatttctattagttaaactcacaatgtttaaagtgtgaataaatttttgttggacacgaagtgacggagcacattgattaatgtggattaatttcaaaatgatggatattacatttttttttattttgtgcactttgcttagaggatgatcaaattagaatagaatagagggagcagttaaatgtgtatctgctcctgcataggaaaaatactccctatgtttcatgttgatcatcatataaccaatgtccgaccggcggcgtgtgacccacatatgccttcatgtatgtcgaggaggagttgtctgccgtcgtcggtagagacgcatttgagaagtacaccgtttggcgcttttttgtataaatcgttaccgaccatacaatagatctttgctttacgggttattttctcggcctctgtatcgtcctcgggcaactcctcgctgctgatgaatttgattaatgggatgcgccagtcgtctgtggtttcgatgtcagcaacggcgcgttctgcctcgatgacctccgagctgatgtcgggggtgttcgggccaacttcgccgctaacttctttcaccgatggcttcgtcaggatatcgagaaaggtgtcgggctcgagcggttcttgtctggacgcgcgtcgtgctaggtcgtctggctcgacgttgtctttgcgatagacgtgtcggacctcgatcccatcgaacctcttctctaacttcctgacttctgcgagatattttgacaactcggggttagagcatttgtagtctttgtgcacctggtttgtgactagttcggagtcccctttgacgattagtcgcttggctccaagtacggctgcagctcgtatcccggcgagtagtccttcgtattctgcagtgttattggttgccctgaagttgaggtggattgcgtgcttgaattgatctccggagggagatgttaagataaatcctgcccctgctccttggctgttgagtgcgccatcgaacgccattgtccatgtttcattgtcaccttggttgtctgatttgttatctggcatagtccaacttgcaacgaagtcggcgagtacctgggatttgatggcagttcgcggcacaaaatggacatcaaattggcttagctcgactacccatttcgcaatgcggctgacgacgtctttgtttctcacaacttcgccaagggggaaggaggagacaactgtgactctgtgggcttgaaagtagtggcgtaatttccttgatgtcatgatgattgcgtaaagcagtttttggatctgtgggtatcttgtctttgcgtcatggagagcttcgctgacgtaataaactggtcgctgtactttctctctctcgacgataatgacggtgctaacggaatatggcgtggcggcaatatagagaaataattcttcattaggttggggagcaacaagtacaggggggtttgataggtagcgcttgaatgcaataaatgtctcttcggcttcctgtgtccatacaaatttgtcttgtttcttcaacaaagcgaagaaaggttgtcctcgttctcccatcctagcgacgaatatgcttaatgctgccatgcaaccggttagcttttgtacctccttgagtcttgtgggcgacttcatgttctcgattgctttgatcttctcgggatttgcctctattcatctgccagagacaaggaatctgagtagcttgcccgacggtactccaaacgtgcacttctcaggattgagcatgaggcgatatcgtcggagtttgtcgaacgttttcgcaatgagtcgcttgtcttggttttgacaacgatgtcgtcaacgtaagcctcgacgttgttgccgagctggttgctaagtgcaccctggaccgtgcgctggaaagtattcccggcggttatcagtccgaaaggcatcttaacatagcaaaataccccgaacggcgtgatgaacgctatcttctcttcgtcctcttttgcgatgctgatttggtggtagccagagtaagcgtcgaggaagctcaatagctcgcaaccggctgttgaatccaccaattgatctattcgagggagaggaaagtgatccttagggcacgccttgttgaggtcggtgaagtcgacacatattctccattttccgttggccttccgcaccataactggattggctagccactctggatgaagtacttctctgatgaagccagctttgagaagttcgtcgagctcttctcgtatggcttgtttccggtctggtgcaaatctctgcagtctttgcattactggcttggcatcgggtcacaccatgagtttgtgcccaatcacctccctggggacccccggcatgtcggacggctgccaagccaacacatcggcattatcacggaggaacgtgatgagcgcgagttcctatttctcgtttagtgtcgccctgatcttgacagtcttgtcggggttagccctggagagtggaacgatcttgatggtgccgtccggcttcggcgtcttatttggcttgctcactttcttgggtggctcagtcgtggcgggtgggctgggtgtttgctcgaccatgtcgaggctccgcttgtcgcactgcaccgccagctttgcgttcccttgaataatgattgttcccttcggtcccggtatcttgagcacttgatacgcgtagtgagatgcggccatgaacttcgcaagtgcagttctcccgatgatggtgttgtaagctgtatcgaattcagcaacatcgaaggtgatctgctctgttcggaagttgttggcttggccgaaagtcataggcaacgtaatcttacccaaaggtctagacgatgattggggagtaattccatggaagggttgatcggttggtgtcaactcactttgcggaagtcccattgcgtccagagtgctggtgcagagaagattgattgagctgccaccgtcgataagaactcgcgctaccttgatgttctgaatagtgggttcgaccacgatcggatatcgtcctgggatgacggaggttttggggtggtcttcctctgagaactctattttctgctcagaccacttcatcttgggtgcagccccctgccacgtcgaacagacttcacgttccactttcttgtattctcgcttggaggaatacgttgtggagccgccgaagatgtgtgagacgtggaggtcggagtctggatacgcagaatccggttcgtgaggaggcatctcttcgttcttctcgacaacgcgtactcgcttgcctttttcaaacgccatgtgcttctcgagcgactttttgaaaccaatgcaatcctccagagaatgtttgtccgttttgtgtatggggcaccatgatttctttgtgtcgctgccttgtgggtctgggcgcttgggagggttcgcgtattctgctgcgaggacttccgcttgagctttccttttcctatttttgtgatttttcttcttgcttgactcagatgcgtctgcggctggtttcttctctcccccggtcttcggtttgtcgttcttgcgtcttagcgcgtcatccacatgggcgcatcactcaacgatctcgaataatctccgagtagttgtgatgcgtcttgtcggcaactcctgggtagtgtagcgatctctgacaccggacttgaaggtgcgaattacagaagagtcggtaatttcgggaattgtgtttctgcactcgttgaagcgccgaacgtattccctcaatgattcccccgagttctgtgttaacgcgtgtaagtcgtcttcgatcgcgtggtgcttgtatgttccttggaaattggcgacgaattgttgccacaggtctgcccatgaagagattgagtaaggaggaagatgcatcagccatgaacgtgcagaacccttcaacgcggttggtaaatagttcgctaacgcgttgtcgtctgctccggcagcatagagcactgtcgagtagacttgaaggaattcttctgggtcggtgctcccatcatactttttaatggctctgggtcggaatctctcgggccatcggacatcacgtagggaacgaccgaaagccctacacccagcgttgggggcggtgggttgtcggcggtcgcgtgaccttcgtggatgtctgtctgacgatgaagaggatgcggatgatgacgatgacgatgggtcgcttggttccagcgtacggttacgaggatgatgacctggatctcgggaatcctctcgttgtctctcgctgttgtctcggcgccgatctccatcgtcgtcgtcgttgcggcgacggccatgaccagtattgtctggcccccgttgttcgcgatcgttgtaatctcggtcctcgtttgggcggtttcctcgatcatggcgccgtgaagagacatgacgccgagagcgatttgcgtcgtcccgtgtgcgtcgtgcttttcggcgaccgttgatttgatctcgaagatcgccagtgccacgaggtggaggggtagcctgtcgaggtaattccctctgctccggatcttcaccattggcgtcgccgattcgtggctgatcttggtgtgctgcggtagcggcttcttcaaacgcgttgctgaggttggtcatcgattcccgtaatcgttctatccaacacttgaggtcgtcgttcagaacgggatcgtaaggagtttccctcagtatagcttgaacagccctgatgtgctgggctggagtagtcgattgattcgccgcttcagcgttggcttgcgctgacgtgccaacgccatcgatagccaatacctcccgcggcgcacttgttgtcgatgacccatagtcctcgaggagatgtaagaccgatggttcgtgaggatcgtgtcacgtcccaaatcgactctaaaatacatcctcgaaattgtgccgagaataattaaaattcatgtgaaagcctccaacaagtaaaatgtgcaaatttaaaagtcaaataaggcttggaggatttttgtatatttcctaaaagcctaaaatgcgtaaataaattttagtggaattttcagagcacaaataataattgagaagaaataaacaaagttgaaaaggtttataaaaagaaaaaccctaaaagtcttctttccccccctttccctcgtgggccggctcggcccaactctccctccctctctctctcctctcctccgcggcacatcggcctcctccccgcgcgcgcgccgctgacaggcgggcccgcccgccaccctcgctgacgggtggggcccacctgtcatcccccacctcgcgccgcgcccgccgcccgcccgtgccctagcgccgccgccgccgccgaatccgccgcatcccgccgtccccgcgcgcattaaagtgggggggattattccccgcgattccctctcccgtttcccccactttcccctctctctctccctcggattcgctcggattcattcccgaaatcctcgccggcgtcatcaatggagccgagatctccgcgcccgtttcctccctctccggccgctctctctcactcccgacgctatataattgttccccgtgcctctctcctccgtttccgccgctcgctgctcgctctccccgtcggattcgtgctcgcgccgttgtactctctctccaccgtcgccgccgagctccggttcgccgccgtcgtcgctccggacttcctcccgtctcggcgtcacctccatcggcttcgccgcgtcgtcgtcgacctcgtccgccccttcatttcgcccgccgaccgccggagcaccgtcgtcctcgccgtcccgaaccgcgccgccgctttcctccgcttcggccgccgttcccgtcgtcgccgtcgacccggggtgagccgaggaccgcctctttcgcttccctcgcctctccgctctctcggccgccgctccgtcgcgccgttggtcgccggcggtgaccatcggggcgcgggcgcgccgtctcccgtcggccgtgccggcgaggccgccttcgggcgcgccccgcggctgccaggtgggcccggccgtcagccgcccgcgcccacgggtgcggctgacgcgtgggacccacagcgccggccggcgtcagccgcgtgcacccggtccaccgtggaccgagaggctgacgcgtgggccccactcccgtggacccggtccgcgcgccctctctcccggctgacgcaataaacgagtttttaattaaaatttaaatgaagaaattcgcaaatatccatttaaagagcatataaacttcaaatggccataacttggccatttgaactcggaattggaccgttcaagtctctaatttttccttaagaagtcaagaacccatttttgtgctttgtttctgctgttatgtggaatttattagagtaaaagccttttcttttccgttggtcgtgtagacgctgcagcttcggaagatccgctcttcgtggaagttgaagccgtcggttgggaaagcgagcaaggcaagtcacatcatctttgaacatattgaatcccagtttgtaaaattatgttgatttaaattattgcattatcgctttatttaaattcccgcgttatcactgttttatttagccatgcctatttacctttgttatgaccatattattattgttattgttattattattaccttgttcaccctagattaaacaaaacctcaactagtggacactctactcatggcaccactagtttaaatttaggtagatgcttcgcaatttaattaggtaacattaggcggttttacaagtatagactttgggaaatattcatatcacctggatactctggaattgttggattattgtggaattggattcacaccgccccctctattcaaaatccccaaaagtggttttaggctgggctcggggtgcatggttttgatagtagcacctcggccatataaggaccggtcttcgggcctctgttgcaaagcactaccgtacttccacatgtctagtgggtaaggcttagtttgtggctcagtctagtcataaacaatagtacacggattggagatggatgaagtcgggggtcgatggacattctccagggcaaatgaaggctacacgagctgcggcccggtagtcgagatgtcatggcagagggttggtgccctgctgctaggggctcagtcttgcctgcctgtcccgggggttccggccataggcgggattgggtcggtactcttgtctatggctaggatgggttggaaactatgtcacgtctttcgtctgtataccgtggtggtatgtggcacgtggttacacgtgaggaagatgtgtcttgtgggcaaagatgtacacctctgatcagagtataatctattcgaatagccgcgccctcggttatgggcaagccgagcaatgtacccaagttagtgttttaattcttaaaacttgcttaacaactaaaatatggaatggttggcctgggttggcttgggacgagctgggacccagggtcgggttgccagttcggtctgaatcatcataggccttgggttaaggcaggttcgtgtgggttcacggccttgattaataacattgtatagttctaggatcgtgtttacaaaatagctttgagcaactaaatgtctttaaatgctgtttactgcaaccctaaccctttatggtataattcccttgtactcccttgcatttattctgcatttgtgggtgtgtcttgttgagtacggtggttgtactcagtcttgctcaatttttcccaagcccagaagaggagctccttgaagatgaaggctttggtgtctagctcgtgcctgccgtcaagcgcctgtggtcgtcgccctagtcttccgctgtttcccgtttgtctttgtgtgtgctgggccttcgctgcccatgtaataagttaactatttacgcttccgcttgttaaactctgatttgtatcaacttttggtgtaccttgcctcctgggacaaggattaatgcacgcacgtaaggaatgcccgttgggttatttctggtcgtgacaagttggtatcagagccccccttgaccctaggacgagccgtagaccccaagccttagcaatattttcaaaaataaaaatcctttgttatttgtgaaaactgtctagtctctctctgtcttgctgcttcacttatcatcaaaatctgacctttaaaatgttgtttctctttttgtttttgtttgtagatggccggcagcgtcacccgccgtggtttggacatgactggcttcgtcctggagctgcggggcatgtgcgtggtcttagggtacccacatggagtggactaccaggccaggccgcttccggatcaggagggagacgacgcggagccccacgctggttgggaggtcactgctgtgatcctctctggctctcccgagcggacttcgctggcagtcaccgcgggtggagattccttccccgccgcttgccagaacgccgctctcctcgccatcggcactcttcaccagcgctacccggacgagttgcagcactcgccctaccgctaccacccccgtcgcggaggagcctgcgactacgccaccttccgggatgctagctcggaggatgacgctaccatcgtgcacctggcgcgcatggtggaggcgtacgacgcggctcgtatcgacttccatcagatggtgcgccgcgggatggtcgagaacaacatgaagatcctggagctgcaccaggagaatctgcagctcaagaaggacctcgacgcggtggaggcgcagctgcatcagctcaagatcgcccagggagagatctgccgccccaagcgccgtcgtgtctgccgcagccagaagatcaccgcccgcaagagcacctccaggcccgagcttgttcgtcagtccctggcgtggacttgcttcgtcgagacccctcgtgccgagcccgcgcccgtggttccccaggagggggaagcctccggcgttggtagcacggagggtgcgctgttgctcaccttccgccctggcccgtcgcagcggtagacgagcagttagtaggcttgcgcgtgtgttctttctcgtttgtcttcttgttgagtcgtgtggggcatggttatgccggtgtgtggcataactatgtcggagcctgccttattttattcgcctaagcaacttgaactttaatgaaccaattcaatagcagtaataaattcaagaattatagtagtcgtgggtggttcgtttaattgttagctctttccctgtttgctggttctgtgtggggttttcagatggtgacgaccagaagaaatgctg

SEQ ID NO: 59921 - DNA, 10201 bp, Oryza sativa
atagtagcacctcggccatataaggaccggtcttcgggcctctgttgcaaagcactaccgtacttccacatgtctagtgggtaaggcttagtttgtggctcagtctagtcataaacaatagtacacggattggagatggatgaagtcgggggtcgatggacattctccagggcaaatgaaggctacacgagctgcggcccggtagtcgagatgtcatggcagagggttggtgccctgctgctaggggctcagtcttgcctgcctgtcccgggggttccggccgtaggcgggattgggtcggtactcttgtctatggctaggatgggttggaaactatgtcacgtctttcgtctgtataccgtggtggtatgtggcacgtggttacacgtgaggaagatgtgtcttgtgggtaaatgtcacaccctaaaaattcaaataatataaattgttgtttaaatggaatttctagaatttattttaaaagtcttgaaaagaaaatctaagtttaattaataaattccaatataaaaagtggccagataaaatttcattaaatactttgcttaattctataattcctagatttttctgggatttatttgagctaaggaagtatttttaataaatggaattgcatttaagaaataatttaaattgaaaaagttttaaaaagtcttcttttggctttgggccgaaagtcggcccaaaacctctcttctctctcctcggcccagccggcccagtcagccgcgcgcgcgcgccctcgctgtcgctgacaggtgggtcccacctgtcaggcccgtcgtcttcctcgggccgaaaccctagtttcgcgccgccgagctgccgtcgccgccgctttccaaatccggccgttcctttccttctccggccgatttgttagaggggaaatgatctccgggatctcctctaccttttctcctttggaatctttggttaaatcgctttggaaagctttggaatcgagttcgattcggatcggttttccctctctccaagccgaaggtttccttcgccgttgccgtcgccgtgggccttcgccgccgcctccgagcccctttaaaaggacccccggtgtctcctctacccgtcgccaccctcgccttcgcctctcgtcgccggaagagctctagcgccgtgtgccctagcttcgccgtcgccgccgccgcttcagccgtgctccgccgtcgctccagctgtcgccgtcgctcgggaagaccgccgtcgtcatcgccaagtcgccgccgtcctcgtccgccccttcgcagccgtcggaacccgccggagcttcgtcgccgtcgacaacccgaaggtagccgccgcttccttctcgtcgccgtcgtcgtccattccttctccgccgccgttttggtcaccggtgtgttcgccgtgttgtcctctacgtgctggtgccctccgttggtgccgtggtgccgccgttcgccggtgagtgtgcgccgcccgagccgtcttctccgccgagccgccgccgccgtcggtgacgtcattgctggcgtcatcagggccgttcgccgtgaaccaccgtggacccgatcgatctcggccgtccgatttggatcggatcaatctcggccgtccgttcgtgtgaaccgccgcccatgcgccggtccaccaaaccctagcccgctgacgcaataaatccccttttccttttcaaaaataattcattattgcgtcataattcaatttaaaccgatttaagtgttttaatccgatttaatctttaaaaattcataactaattcatcttagctccgatttagttggttcaagtctctaaatttttctaaaattgagatctacacattaaaaatatccacatgtactgttcatgcttgtttatgtgctgttttggtgattttgctcttttctgcttagattccgtcgtttccggagagtccgttttcgcagaagaagagtttgaagagttccaaggccagcaaggcaagtcacacagatcccaaacaaccctttgagcatgttgatcctatttaaagctattgtttctattcaactattgcatctattttcgaatgtcattgggtggaattgacctattctttgttatggcccttttgtacactgattaccttattccttgataccttgggttatattaatttgactagttgagctttatttatattggttcaactagatattagatataattgcttagccctgcttagaaacattagtacacttatgggataactaatgactcactattatttcatgatggcttattgatagttcacgatggtcaatcgtgattagttaattaattaatgtgccaactaaaacctggtaatggtgggttgtgagcacatggttttgatggtcgtgctcatggcaattaaggaccggttcacgagtttcggttgtgaaacatttatcgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgtagtgaattgtgttatgcgaggggtattgtcacaactcctttccgagataccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacacctctcatcattgtaaaagatgcttaaactggtaataatttgattagctcctggtttggaatggtacattcctggtttggagatagaactgtgcagccggggtggttgttcagaatggttgggcctatacaacagggtatgttgtatagcgttggattaatattgcttaattattacttaactgttttatcaaattctcaaatgtttgctaaatgctgcttttgcaaatggaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttaatttccgctgctagaactttattgattgagaggaactatctacctctgtaatgacattatattcgcttattaattagagtaatatttgtactctattatcaatttgttattgtgtgcctcggctgattcctggacgagggttcacacacatgtaagcgtttggaattttggatagaaattccgggcgtgacaagttggtatcagagcctctttgaccctaggttatgccaaatggttacccatagaagccctctgaaaaatattggaaaagtagaactgttctcctccctttctcttttaattaaaccaaactaatggcacatgcacttcttaaatctcttttaatggttctcattcgaaaatttattccagtattattagtactgtacatccattactgtactaatggctcatttttcagcaaaagttttacaatattgttttatttaatcctgctgcaataaaataaatttaacaagttgattttataactttcttttgaaacctgttgttaaaaagtacaaaatttgtaactttgttttcaactatttcaaattatcttgcaagtttggtttactttatttacttaccttttactttgatttctaaactttattcaaattaatccaaaaacttgtgctattaattggatagatgtcttaactctctcctttcacttgtctttagatgccgcgctacaagcctgagtacctgtttggtgttgaagggtttgtccaggagttgcgtactatgtcctttgtcattggatttggaactgcccctttttatgcccagattcgtcatgatcgtcatgaagagaggtgccgtgtcaaagtcaccttaaacagtaatagtgaagatattccatcagtgatgttcgaagctggaggaagaaattatatccatgcatgtcaggaagtggcaaggatcgccataggagagctccgtgaccgctacagtgatcagttggccgatactgagtatcgctaccatcctcgccaaccacagggaagtgaccgtggcagttaccttgagactgaaggaattgagaatgatgctaccacaaggcatttggttgagatgctgtgggctatggatgaaagtcgtgcggagactgtgttagcggctcaagatcgtgaagaccggaatcgtggtaagatttgcaagctagaagacaaggtggatcgcttggagaaggaattagccgcattgaagggagaagcaccgccgcagaaggccaggattcgtctcaccgcaaggaagagaactttgtttgtccctcgttatcaattggcgccaaagatccgcgtggtggagaaagaagttgccccagcaaatcctccggtcatcatcataagtagtgatgaagaagaagaatctaagcgcaaccattccaagattgagtgggtagcaacccaagatgatgaagacgagccttcaattgacctccgatgcttggaagaactagagtgacttgttaagtcgttgtcttagattgttgtgttagtttgcttgcttaaagtttgcttgtgtgtgtctcgcatgtgatttacatcagtggtgggatgtaattgcatgtgtttgtttgcttctgagtgttaggaagttggtgagtttagtggtgtgagagtcttcagtttgtaataatgaaactcagttaagatcaataaaagttaaagtaattctctgtcctaagtagtttccccggtttctcttcttgtgccctgtccatgccagatggtgaacactcgcagcaacgggaatggtcctaacctcaacaaccccaataacaacaacaatggagagaatcccactcttgctcaagttcttgctcaacagacacagcttatgaacatgatgatgcagcaatttcagaatcagcagaaccaaggaaataaccatgtacctcctcagaataagttagcagaatttcttcgtgtgaggccgcctgttttctctagtaccactaatcctgttgaagctagtgattggctgcatgccatagagaagaagttggatttacttcagtgtactgatcaggagaaggtctcatttgcatcacatcagttgcatggccctgcctctgaatggtgggatcacttccgccttaacaggactactgctgaacctatcacttggcttgaattcaccgctgctttccgaaagacgcatataccatcgggagtagtgtctctcaagaagaaggagttcaggtcgctttcccagggatctcgctctgttacggagtatctgcacgagttcaatcgtcttgctcgttatgctccggaagatgtgcgcaatgatgaagagcgccaggagaagtttttgggaggacttaatgatgagctttcttacccactcatggttggagattatcctgatttccagaaattagtggataaggctattcgtcaggaggacaagtacaatcgcatggagcagaagaaacgtcggattgctcaattcaagacacaacagggaaataatcagaagccgcgtcttactttaggaccccagcccatgccacagggaggttcttcgtctgttgttcgtccgcaacgtcagttcttcaacaacaatgctggcaacaacatccgtaatctagctccacgtcctgttgcagttccagcacagcaacaacctgccaagagggagcaaggcaacaagcccgtggtgtgtttcaactgtggagatccaggacattatgctgacaaatgtccgaagccccgacgcgtgaaggttgtccctgcccagaataactctgctgtaccaacatccaaggctcgtgtaaatcatgtcgctgctgcagaagctcaagatgctccagatgtgattttgggtatgttccttgttaactcagttcctgcaacagtgcttttcgattctggtgctacacattcattcttatctatgagttttgcgggaaatcatgggatggaagtagaagaccttagatgtcctttgatggttagtaccccaagtaatcaagcactctctttgcaacgtagcccctctgtcagaatagaaattcaaggagtaccatttctggccaatcttatcttgttagaatccaaagaccttgatgtcatcctagggatggactggttagccagacataaaggtgtgatagactgtgccaacagaaaagtaactctcaacagctatgatggtcgagttgtaactgttcatgcattgtcatctgagtctttaaggtcaagactgaaccagataactttggaagagattcctatagtccgggagtatcctgatgtgttcccagatgatttacctggtatgccgcctaaaagggatatagagttcagaatagatttggtacctggaacaactccgatccataagagaccttatcgaatggcagccaatgagttggcagaagttaagaggcaagtagatgatttgctacagaaaggatacatcagaccgagttcatcaccatggggagctccggttatttttgtggaaaagaaagaccatactcagagaatgtgtgtggactatcgtgcactaaacgatgtgactattaagaataagtatccactacccaggattgatgatttgtttgatcaacttaaaggtgccactgttttctccaagatagatcttcgatcagggtatcatcagttgagaatcaaagaggaagatatacctaagacagcttttaccactaggtatgggttgttcgaatgtactgttatgtcttttggacttaccaatgcccctgctttcttcatgaacttgatgaataaggtgtttatggaatacttagacaagttcgtggtggtctttatagatgatattcttatctactctcgaaccaaagaagagcatgaagaacatcttcgccttgcattggagaagctacgagaacatcaactgtatgctaagtttagcaagtgtgaattttggttgtccgaagtgaaattccttggtcacatcatctcagccggaggagttgccgtcgatcctagtaacgtggaatccgtaaccaattggaagcaaccaaagacagtttcagagattcgcagtttcctaggccttgcaggatattatcggaggtttatagagaatttttccaagattgctaagcccatgacacgactgcttcagaaagatgtgaagtacaagtggtcggaagaatgtgagcagagttttcaagagttgaaaagtcgcttaatatcagctcctattttgattttgcctgatccaaagaagggttttcaagtgtattgtgatgcatccaaacttgggttaggttgtgttctgatgcaagatgggaaggtggttgcctatgcctctcgacagttacgtccgcatgagaagaactaccctactcatgatattgagttagctgcagtcgttcatgcattgaagatttggcgtcattatcttttcggtactcgtacagaagtgtacaccgatcacaagagtttaaagtatatctttactcagtcggatctgaacatgagacaacggagatggttggaattaattaaggattatgacatgggaattcattatcatccgggaaaggctaatgttgtagcagacgctcttagcagaaaaggctattgcaatgctacagaaggacgacagttgccattggaattatgcaaggaatttgaaagattaaatttgggaattgtcggtagaggtttcgttgcagccttagaagcgaagcccactctaattgatcaagttagagaagcccaaattaatgatcctgatattcaagagatcaagaagaatatgagaagaggaaaagctattggtttcttggaggatgagcacggaactgtatggttgggtgagagaatctgtgtccccgacaacaaagatttaaaggatgcaattctgaaagaagctcatgatactttatactccattcaccctggtagtactaagatgtaccaggatctcaaggaaagattttggtgggcaagtatgaagcgtgaaatcgcagaatatgtagcagtatgtgatgtttgtcagcgagtcaaggcagaacatcagaaacccgccggtttgttgcagcctttgaagattcctgaatggaaatgggaagaaataggtatggattttattactggtttacccagaacgtcatcaggccatgactctatttgggtgatagtcgacagacttaccaaagtggctcatttcattccggtaaagacaacttattccggaagtcgcttagcggaattgtatatggcaaggattgtgtgtttgcatggcgtccctaagaagatagtgtctgatcgaggcagtcagtttacttcaaatttttggaagaaacttcaggaagagatgggttctaagctgaactttagtactgcttatcatccgcagacagacggacaaaccgaaagggtgaatcaaattttggaagacatgttgagagcttgtgctctagatttcggtggaagttgggataagaatctaccctatgcagaattttcgtacaacaacagttatcaagctagtctacagatggctccgtatgaagcactgtatggtcggaagtgccgcactccgcttttgtgggatcaaacgggagaacgtcaggttttcggaacggatatcctaagggaagcagaagaaaaggtaaagatcattcaagaaagattgcgtgtggctcagtctcgtcataagagttatgccgacaatcgccgtagggatttgagttttgaagaaggagattatgtgtatcttcgtgtcacgcctctacgaggagttcatcgttttcataccaagggaaaattggcaccgcgttttgtgggaccttataagattgtcagtagaagaggagaggttgcttatcagttggagttacctcaatctttggcaggagtacataatgtgttccatgtgtcgcaattgaaaaagtgtttaagggtacctactgaagaagctaatattgagcagatagaagtccaagaggatttgacttatgttgagaaaccaatccgtatcctggaaacaaatgagagaagaaccaggaatcgagttatccgtttttgtaaagtccagtggagtaatcactcggaagaagaatcaacttgggaacgagaagatgaattgaagtcagctcatccgcacctgttcgccagttcttccgaatctcgaggacgagattctgtttaaggggggtaggtttgtcacaccctaaaaattcaaataatataaattgttgtttaaatggaatttctagaatttattttaaaagtcttgaaaagaaaatctaagtttaattaataaattccaatataaaaagtggccagataaaatttcattaaatactttgcttaattctataattcctagatttttctgggatttatttgagctaaggaagtatttttaataaatggaattgcatttaagaaataatttaaattgaaaaagttttaaaaagtcttcttttggctttgggccgaaagtcggcccaaaacctctcttctctctcctcggcccagccggcccagtcagccgcgcgcgcgcgccctcgctgtcgctgacaggtgggtcccacctgtcaggcccgtcgtcttcctcgggccgaaaccctagtttcgcgccgccgagctgccgccgccgtcggtgacgtcattgctggcgtcatcagggccgttcgccgtgaaccaccgtggacccgatcgatctcggccgtccgatttggatcggatcaatctcggccgtccgttcgtgtgaaccgccgcccatgcgccggtccaccaaaccctagcccgctgacgcaataaatccccttttccttttcaaaaataattcattattgcgtcataattcaatttaaaccgatttaagtgttttaatccgatttaatctttaaaaattcataactaattcatcttagctccgatttagttggttcaagtctctaaatttttctaaaattgagatctacacattaaaaaaaatccacatgtactgttcatgc

SEQ ID NO: 59922 - DNA, 620 bp, Oryza sativa
aaaaagataataaaggttttgttgaatgtatcctttttttttttactgtaagccacctatacttgcatcatatggaaagtgcaacttattgttactttgttttttatttaactcaatcaatctagatgtatttatatgcttatatagaccatgcttttatgaatttggaagagtaggacactattattttttttatcactttgcctctcttgctgttgcttccatccgatttgcaatggcatgaaatggcttgtactggaaaattatgatacgtgagtatgtagcaagtgttactaggccgtgtgcctgaaaaaaatgctaggactagacaaattgataaggaaagtccatgtgtatctgtgattctgtgtatgcgatctaaccctcagtatgcgttgaattctgtgcggttcagagaacatgtttttcttttcgattaagtgcatttatatgttagttgcagtattggctcagtacgggattgcttgtgatgtaaacattgaaaatctagagctagcataataaaaacacacatctttgtttttctatttgtgtagcggtgatcgggtttttcttagtttttcacattacctaatccattccaacaaatgggattcttt

SEQ ID NO: 59923 - DNA, 9143 bp, Oryza sativa
gttgttcagaatggttgggcctatacaacagggtatgttgtatagcgttggattaatattgcttaattattacttaactgttttatcaaattctcaaatgtttgctaaatgctgcttttgcaaatggaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttaatttccgctgctagaactttattgattgagaggaactatctacctctgtaatgacattatattcgcttattaattagagtaatatttgtactctattatcaatttgttattgtgtgcctcggctgattcctggacgagggttcacacacatgtaagcgtttggaattttggatagaaattccgggcgtgacagtaaagatgtacacctctgatcagagtataatctattcgaatagccgcgccctcggttatgggcaagccgagcaatgtacccaagttagtgttttaattcttaaaacttgcttaacaactaaaatatggaatggttggcctgggttggcttgggacgagctgggacccagggtcaggttgccagttcggtctgaatcatcataggccttgggttaaggcaggttcgtgtgggttcacggccttgattaataacattgtatagttctaggatcgtgtttacaaaatagctttgagcaactaaatgtctttaaatgctgtttactgcaaccctaaccctttatggtataattcccttgtactcccttgcatttattctgcatttgtgggtgtgtcttgttgagtacggtggttgtactcagtcttgctcaatttttcccaagcccagaagaggagctccttgaagatgaaggctttggtgtctagctcgtgcctgccgtcaagcgcctgtggtcgtcgccctagtcttccgctgtttcccgtttgtctttgtgtgtgctgggccttcgctgcccatgtaataagttaactatttacgcttccgcttgttaaactctgatttgtatcaacttttggtgtaccttgcctcctgggacaaggattaatgcacgcacgtaaggaatgcccgttgggttatttccggtcgtgacagatcgatatcgattaccctaacgaatcgatctgaggctggagtcgctccttgttccttgccgttatccctgatggggacgtatgacttaggagacggagttttcatggcgccgaggaggactttgcagctcgagaggtcgtgattctttgtcttgtgaataggacaataaacatcccgagttggagaagtacactgaatttgtcacgcccgaaaattcactagtaatttccgaacttatttgtgcataaaatcctcgtccaggaatcagccgaggtacacaaactgacaatttaatatacagattcatcaaattaactaaaacgataaatacttacttatgaggcacttagtcctcatcatgaagaaaactgcagcggaaaataaaatctagcgaagctccggctccactcccacaggcagctcaactggggtataagccaaacgtcttctccttctggattctttttcttcaactgaggttgattgattattgcaaggtgagcatatgacatactcagcaagccacacagcaaatatgcaagtgcacaaggataccaaaggatggcataatatcggctcatttgcaaaagcagcatttagcaaaacatttaagagaagtaaaacagtggagtaattaatcagaaattttaaccaacactgaacagcacacccatgctgcacaggcccaaccattctgaacaaccatacccggctgaacagatctaactccaaaccaggagctaagcaaattattaccagttataacatctataattatggtgagaggtgtgggactaatcacgaaaaacattgctcaactcgcccataaccgcgggcacggctattcgaatagttttactctgatcagaggtgtaccactgtacccacaagacacagccccacatcatgtcaccatgtgcctcagtaccaccacggtacctcggaaaggggctgtgacagtaccccttgcataacacaatccaccgcagcgcaccattcctggatcataatcacccccttataaaacaaggcatggactccccagcgacccccgtgggcttatctccgccacttctcagtctggtgccccgcaatgaaccatgctatacaaaagataaagccgttgcccacgctggcttgtggttggcacggttaatgtttcacaacagtagctcgcgaaccggtccttaattgtcatgagcacgactctcaaaaccatgtgctcacaacccaccattatcaagttttagttggcaagtaattaattaaccaatcacgattgaccatcgtgagctaccattaaatataaccataaatgatagtgaaacattagttatcccaaatgtgtgctaatgtttctaagcatggctaagcaatcatatctaatatctagttgaaccaatatatataaagctcaactagtccaattataatcacccaaggtatcaaggaataaagtaatcaagaacaaaagggccataacaaagaataggttaattccacccaatgacattcgaaaataaatgcacagttgaaataaatagagaatttaaatataggatcaacatgctcaaaggattgtgtttaggatctgtgtgacttgccttgcaataatcggtcttcaattaatcttcttgaatacttccggcgcactcgcgaaccttcgcaacgacggaaacgacaagctatcacgcaaaacgaggaaaaagactaataaaaaccaaataaacaatacataaaaagtaaacaaacatgtagatcatatttttagatgaattatgagacttgaacggcctcattctgacttcatatgaatttattatgaattttacaagattaaatctaattaaagcccatttaaaaagaattaaataaatttaattcaatttatggacaattttaatatgtagatctttattttatacaacttttgcaacttgaaccacattaaactgagttaagatgaattagatatgaatttttaaagattaaatcggattaaaacctttaaactgattttaattgaattatgacgcaataatgaattatttttgaaaaggaaaagaaggattattgcgtcagcggctagggtttcggtggaccgggcgcacgggcgacggctcacacgaacggacggccgagatctaaccgatccaagatggacggccgagatcgatcgggtccacggcggttcacggcggacggccttgatgacgccagcaatgacgtcaccgacggcggcggcggctcggcgaggcagacggctcgggcggcgcacgcttgccggcgaacggcggcgcgagaacgcaaacggaaggcaccgggacgaagcgggcggcacggcgaactcaccgacgaccaaaagagcgacggagaagcaacggacggcgacggcgacgaggaggaagcggcgggaaccttcgggttgacgacggcgatgaagctccggcggtctccggcggctgcgaaggggcggacgaggacggcgacgaccttgcgaacccgacggcggtcttcccgagcgacggcgacggctgaaacgacggcggcgcacggctggagcggcggcggcgacggcgaagctagggcacacggcgctagagctcttccgacgacgagaggcgaaggcgagggtggcgacgggtagaggagagctcgggggtccttaaataggtgcaaggaggcggcggctaaggcccacggcggcggagacggcgaaggaaagctcggcttggagagaggaaaaccgatccgattcgaactcgaatccatcgatttccaaaccgatttaggcgaagcttccaaagaagaaaaggtagaggagatcccgaggatcattttccctcaaacgattcggccggataaggaaagacgcggccgaatttggaaggagacggcggcggcttgcgctagggtttcgggcggcggcggcgacgcgaggaagacggatccgacaagcgggccccacctgtcagcgaccgaacgcgcgcgcgcggctgcggactgggccggctgggccgaggagggagagaagagaggttttgggccgactttcggcccaaagccaaaagaagacttttaaaacctttttcaatttaaattatttcttaaatgcaattccatttactaaaaatacttccttagctcaaataaatcccagaaaaatctaggaattatagaattaagcaaagtatttaatgaaattttatctagcccaattttatattgagatttaacaaattaaaattagatcttctcttataagcttttaaaatcatttctaataattccttttaaacaacaatttataatttaaggatttttaaacaagaaaagctcttaacaattataattagatcattaatgatcaaataattactgaactgttctttgtattattaagagttgagctctgaaaaatccgagaaaatttcagagagttgacttaatcatggagaatttaataaaaattaaatccatccatgctttatatttaggaaattttatttcccacattttacttcacttgtaaattaaagaacatttaatataaattctattaataatttattaaataatttataaatcctgaaacgaaaatcaggatgtgacagaattccacggtctttgcaggcgcgaatttcagcacggacgttgagaaaaacccagcaatcttgaagggtgtgtttcttggttttgtggataggacaccaagacctggtggcttcggaagtcatctttgtcagcccgtgatttatgtcagaaggataaggcttggccgcatcagaatccttcccgagcttgggtgtagtcggtaatccgttctccatttcgacgggtggatttttcgacatggagttgccttggttcgtagccactgcattctcatttccagtcattggaggaccggttgagatcggcatcgtggtgtaaaccgggaagacaatttcgccgacatgagtccataccagcattgttgaagtagggagtgcttggctgaagctggtgttgacgttgttgtcgacgaagctggatggcatagtagtagaaccttgagtaccagatgcctctacctggcgcgccactgtcgacgagtgatactcgtagaccggatatagagggtattggggtacgctggtacaaggatctacgtagtacgacatcgaggaatcaaaagacaagagttatactggttcaggctccttgataggtaatagccctaatccagttgatatgggattatatgctggaaaacacgggttacaaagggaacgatggaacttgtcggatccggcgagattgtagtcgagtggattcgactagctctcgatgacttcgctcctcgtagactccggcttcgtaggctgtgtgggttgtgttggctctgagattcaatgatctatgccctccccggggggtcccttttatatcgcaagtctagagctctccgagtaggactcgaatatactaggcccaatacgatacgtagataacccagatctatccaagaaggactcttcccatttgttgatttcatgaaaggttttcttagaatatacaggaaatatccgcgtacgcgtgggtatgccatgtcgatccgtaacgtatatagaagggtagagggtatgcctgacccgtaaccctgacagatcacgatataaccctgtctctaacgtgtagtattatcctatctctactattataagaattgaagatatttccgcggtccgtcagctatgtttgagtcggttataaaattgaagatgtttttgtggttcgtcatccgtgtttgagtcagttttaattttatgttttggtattttggtacatcatccgtgtataaatcggtttttaagttcgtttgcttttgaaaatacatatccatattttagtcggtttttaagatcgttcacttttggtatacaaaatgaatcatataagaaatctatttaaaaaaactcgcatgctaacttgagacgatcggacttctaactgcagcacatgattttctatatatatatatatccaagcgaactcgaacagtaaatttcattttatctaaaccatataacaataataatattaaaatagacttcacccgttgcaacgcacgggtatttttctagtttaattatacatgcaaattaagtttgcatgcatgtaaattaagtttttgtttcttgtgcatagggacagttgaagtgtgcatgttttttatttttccccatcacatactcgcatacaatgaaatataggaaagttaaggcttccatggttttagcgagaaaaacttatatgatgactaacagagggagtaaacaacagtgcagatgcaatttgcaactaattgaggcactaataaaaatattttttttctaaatacatggtcctgccttgcagtctggcaaaatttagttcaattttcaatcgtactcaacgtgtaaaatgcactcgagacccttcattttaccttgaaagatcagacaaaactaaaaaaaaaaaaatcccaaatcccttccatccatcttaataccacaatattgcagacgaaatcaaacagggctcagatcagggattcgctgtgcctgacttgactgccctgattaccacgtgtcgaaacatgaattcggcaataataaaagaggtagcgcacgagacctaaaagtggatggatgcagagataaggatttagacagattcagtaccttcaattaagaggtaataccctactcctgtttggggatttgaattcgctgggtgtagtatagatctgacgatctagttgtgtctcctgcccctggagggcctcctgcccgccttatataaaatgggaggcaggattacaatataaaaaccttaaccaatacggtatcggtttcctaaatctactttacaatcttatcaaaccaggactttagcccattccataatatacagggaaacgtaatacccaagtcatgatctgttacatattccatagatataagttatctcctataactagtcggataaccatgccgtgtgggtatagggtacctgtaatctccacagcacgggagatgcctcggacgtcgttgaccaccgaggggcacgcgttgctcattttcaagcgactgcctcgtcgatggccggaggagaatacgggttctaccgacggaggagatgcgagagcatcgtagccacaccgccttgtcgttgccgatgccgccactgcgcactgcgcgagtttggatggagaagccgtgtcaatggttcggatggagaagaaaacgagtctcagcccgatagcctaacgggcctgatggcaaaaaaaagtccgtttgacaaataaaaaaaggaaggaaagagtccaaatacgctagattagatagaagtctatatatagcaccctaaaatttaaaactgtacatccaatcccttactttgtaaaaccgttcatattaccccctaaggtggttctgtgtagtggtttttatctaatttatatgtaaattggatgagtttgatcacgtgatatacacattggacatatatatacatacatatatatatatatatatatatatatatatatatatatatatatatatatatatatatatatatatatattaagtataatatatattacaaacaagtatcaacataataatagtataatatcattgtataaatataaattgatgacttaccactgatgatatgcaaatatattatattagttatttaaagttgttcgtttaaactttcaaaataagaaaaatcaccttacggggtaatatgaacgattttacaaaattcaggggtagggttagaactctagttttaaagttcaggattctagctaaatgaacgaactttcatgtagagtttacgggggtatttagacttttttctatattattctatatacatgatttatcccctattcacagtcagatagcccagccgtgtgggtatatagtacccataatctccacactatatctatcatgccgttgccggttatacagcccctcaccggggttaaccacgagaggccctctatcttgccaagcttgtcgtcgcctcctgcacacaagtggcgaggcgttgtcggggttcggcccctccatcaccatccttgttcgctgcttagagagccaaggcagtctctccggcggcagcaaggtggaggagaggggagacaggggcggcttgggcatgtgcatggacaacgcgggaggcggatatcatccatccacataagtattagatactccctccgtttcatgttataaggcgttttgactttggtcaaagtcaaactgctttaagtttgaccaagtttgtagaaaaaagtagtaacattttcaacccaagacaaattcattaagaatatatattcaattattgatctgttaaaactaatttagtattataaatattactatatttgcctataaacttagtcaaacttaaaacagtttaactttaatcaaagtcaaaacgtcttatatcctaaaacggatggagtagtaagaagttctcatttactgatacgtaacaagcaataaccgattgtgtgtccaccctttgcgtgtcctgaagtgcttagtaggttctaaacaaaacaaaataatataatccacacaaccattaagatatcaaagtcttcacatggaagtcaactgtatcgaatgatcagatatgttaatgtagtgagacgtgatcagcaatatattgctcaaccagcttagctaacatggacagagtggactcagtggtgatcacacgttctctcgttcatgaactgatatataatatactctatatatactcgaagaaatcctgcggcatcaatcgcgctctcgtcacacccctcggacatacagcaatcatggaacacatccgctctttcctcctagcagcactggcagtcgt

SEQ ID NO: 59924 - DNA, 5487 bp, Oryza sativa
acacgctggagttcgtcgacaaggacggcaaggagcagtgcttctcggcgcacttcctctgccgccccgcggggcaggggaagtcgatgctgctcgttcggttcggatccacccagacgtcgccgctggtgaaggtgctcccgaggtggtacttccaccagaacgcgtgcaaggtgttcgagcaggacatggggttcctgtcgtcgcagaacgaggtgctgctccgggagaaggtgccgaccaaggagctctacctcaacctccggtcgtcggacacgtgggtggcggagtaccggaggtggatggacagggcggggcacggcatgccgtactacttcgggcacagcacgctgtcgccgccgccggtgccggccgttgtcgagcaggcgccggcgggggcggtcgccgggatgtccgcgtcgttcccggccaagggcggcgtcggcgccacgcacgcgcccaacccgaccaacaggtacttccgccatgtcgtgcactgcaaggggtgcagggacagcgtcaagaggtacgcctcgctcaagaacgccttcgccgcgctcgccgcggcggcggtggcggcggccatcctggcggcgaccaggcaattgaaggccgtcctgctggcgtccgcggccgcgctcgccgcggcgtcgtacgcgtgtaactgggtgctgtctctcatcacgaccaattttattaggacacacaggagactgtaaccgtggcaatggctgtcatgctttggcacatactaatagcaaggtagaatggtacagctatttcattatttttgcccttgtatatttgtatcactacatgagtaaacgacgtttagttatcgatagttttgttatgagtgatgaatgatctgcatcgtactgccaatgccttgcattctcaaatggttgcacacttgcactcatacaaagttagtacactccatcatattataaattacttttttttcaagttaaatttcctgaaagtttgataaaatttatagaaaaaatataacgacgcttataacactaaattaatttcattacatctaacattaaacatattttgatttttttttgttttgtgttaaatatattactatgtttttctataaacttgattaaacatataaaagtttaacttcaaaaaaaagttaaaatgacttgtaatataaaacgtaggcagtacaatgcgaatgtagggtactccatccagctgaggtaaaccaactccaatatatatacaaacacaaacaacgtacccaatttttactgttaaaatacaggcacaatgcctggtatcacacgttattaagtagacagactcgataaccatgacacggacaggacttcttgccactggtttacgcacggttaatattacagaccacacatagagagacggcttagctatttgcaaataagcttgacaagatagatgatgctccaaaaggatgcgatctcagcagttgagtacttacgctggttcatctagaattccctatcggggaagaggagtggggcgacaagggaccaaatgtacagacctgccgttgcccactgggttgcaatcctgacccaaacggatggccacccaacgtcaacaagctttccactctcaccaactgaggttgaccagccagtcaagagcatcgcggagtacatgcttgccaaggagaagatgaggtggaagaacgagtaggagtatgtcactggccttggcacatccttcttttccgcttcctcatctgccttactgaaaggaagcagtggcttgtcggcacctgaaaaagggcaatgtgataagcaacacaccttgcaaatatggaacattgatttagtagatagagcacgcaatctaaccagcacgtggtgagtctggggctgagagcacagttgcagatgagccagcacggacagccgaatagaccacagaaaggatggtggttagcaatcccagcgaaaggctaccagtcgacacagctttggaatggttgtgcagtccattgcattcataatccctcggctcacttgaaagtccactgtagcacaaataggtgcagtagagggcgataactgatgctggcagcaagctaccattgatctgcaaaattcataaaaaggaaccattcattattattacaagcgagtaaccatatttaagatgagatgctagcagctagagcttgtgggtgtaacagctataatttgataaaatgctagaaatcttacacaacaattatcataatgctacaatcttatgcagcaattatcataatacacggacacatttctgacagcttttcgtggtcaaactatggactaatgaactaaatactctatacacagaggctgtgttactatattataaggatacagaacagaccagaagaataatacctttgggtgcagggcgacaatagcaaaaacaaaaacaagaatcagtgtgaagacaatgaagaacagattgattccgcagtcatgtccagatggagtgaaccagtgaaagagcagacccgagaaagagaatgtgacaatgtaacagacaactgagacaaccaatagagccatgtacctgcagtaataaatatgaacaaattattaacaggttttgataaacagaagaagttcatactaaattaaggggacctgaaggtaaacaaggaaaagatcagctactaaccagaactgttcatccttggcaacccaattctcgttccatccatgaacaaagtccaacaaaagaacaacctgaacaagcaggaacagtccagatccaaacttggatattgattctgcaaaaacaaatgacagttaaaattaacaacctggaatggggagaactggctccaattacagtaacaaaaactgataatatagaattagcatataaaactattcaagaagcagcagagtgtatcatcaatcacaaaagtacaagcaacaagttcatccaacaagctgctaagacagtgtcacgtttaccatatatatcaaccaatcaccaataccaagcttggtactcatgtttttaattaccaaataaacaataattgatgatgtatcatcaagccccaaaactggagcaaatattaatactatgcagttagtacacttccatgcctactcacaaccacatggagatccaaaggaccaacggaattatacattaatagttaaaaacacaggcaaccacaaatgcaacaatgtcactcccaactttccaacacaatttcatcctctatatcaaaatactcaaccacaagaacacatgcctcttgaaacattaggaattactacaatttgttcagctaaaatcgcctccaaagttgcaaaacttaagtcttcttcttgataacgacgaatccacacacccacctaatgttttgcagattagttggttcataatttcatatttacaattttatgatccctatatgaaaatatgtcaaccttaaagcttgtatattctttggtttagaaagtgtatcagaccaataggaatctccttgttcaaaaaggttctagcgcagagaatcaaaagttaagacaaccctaaggaaactcctcacaactcccattcgcaccttctctttcactctagcagtgttgaggaaggacttacaaggaaccttttgccactcctatctttaattctctaatagcctatcacatacagatatactgattttaaatattagtgcaaccatctcccaatataatgtcactgcagcatctctataattgtgtttcagaacgattcaattcgtcgtatacacagctacataggtgaaagggggggcattaccgtagaagcttacgacgccgttgggcacgaagaacatgaggaagacgatgacaacccagcagaatatcttggccatccatccgccatggtgtatcttgtcgcgggggtccttctggtccttgatgccagccatgatgatggcgaggatggtgaagaagacgaagttgccgaggctaaccctaagcacggcatcggtctcgaaccactcgcggtcgggcgtcttgtggaagtggttaatccctgcacagatagccgcaagaggcgcgccatgagaaattccgatcgatttcgagagaaaaaaaaagaaccaaatcgaatcacccggaagggattgcgaaggcgctcacatgggatggattggaggaggggcgcggcgacctcgcggagcgcccaggaggcgaagagggagagcgcgaagaggccgcagtaggcgatgcgggcggagcggcggccgatgctgccgaccgccgtacggcacgcctcgcacgcgcacgcggcgcagcacgacgccaggcaagacgccgcccacatggctgctgctcgtcgtcctcctcctcctcctcccttgcggcggcgcggtcagatcgaatcgatcggtgggtgaaggagctcgacgatggctttggcttgttcggatttggggatttcgccgcctctcgggggaagaagctttggtggggatggggaacgcgtgcggcggaggggcacggaagagaagaggaaaggaagccgatccggttttttttcccttttcttgttttttttttccgttacggagtgggtggctaccgggccggttgggttggaccggaccagcccgggccgatcaggagaccgagtcagtcaactactgtattattccagccttctacgtccattacatcaggtcaagcaaaagtaacaggatataggttccgtttactacttccgtcaaaaaaaaaactaatataattgaagatatgacataatttagttcatcatactacattgagcctgttcggtagttctaatttacagccagccactacaatgaaatatagagaacaatcgtagcagctgcagctgttgcggctgcacagccgctgtatagggctgccgaacaggcccattgtgtttcatgtacagctaggttaggttttttggatggaggaagtaagatgaaacaaggatgaaataaaatgagttatctacttacttaacatgattaatttatattttgagaagtaaatttaacaaaatagctagaaacaagtgatctatgtaatgtaatgcagattttttaaaaaaagatcgtatttctagaagcatggagcatgatcaattgtatctgatcatcactttcgaacgggaccataataacacacacatcatcgtcagcttctggcagaataggtaccaaaatgacaatagggagcataagtttgtgagttcagaactcgaaacaatatggtcctgaacttctggcggacaaactagatatcacatcctatattttccctacaacagagctcctaaaacattacagccacagatcacactgtataaggcatgaaagaacaagcaatctgaagtcgcatgccacgacaaccttcaggtatcaaaatggatattgattgactggcagatgctaattgatactgcatcgaaaattgacattagaattttaaccatttcttctct

SEQ ID NO: 59925 - DNA, 4767 bp, Oryza sativa
ttgtcaaaatcatggcataattaaactcaaaagattcgtctcgcgaattagtccaagcttatgaaatagattttataattaatatatgtttaatactctaaattagtgtctaaatatccgatgtggctgggacttagaataagtcactgaaaccaaaaatgctggatcactgaactccgccgtactgtgcgactgtgcacacacacctcacttcacgattaatgtccacagctgcttactgctcgaatgctttttttctaaaaaaaatatttgccgtatatacgacgcgacttttgaccgtgacagaaatttcaaaaatatattttcaagtactacatccgttctaaaatatagcaatctagtactggatgggatatatccctttatctagatttatttattagactaggatgtgtcctatcgagtcctacattgctatattttgtaatggagggagtacttcactccccgtttgaagatttttaccgtttaaaatttatcagcatcaaacaatcacaactatcccgtagaaatttctactgtaaaatcagggggagtaacaaattatcacaagacgcatgctacttcctccgtttcaaaaataaattaattttcacccatcccgtatataccaatgtaaaacaaaaaaaaagaataaaagagcaaatacaagtatacaattgcagatttgtagagctagtacaaaaatgctaagcacatgtgaagaaaagattgattagatgatgtgtcaatttttagagttagcaagttgaccatactacttccaatgcaaatatttttttttactttatttaattcaaatatttatatttttataaactctattacaataattatttaaaaataattttattttgagataaagtaaataggaagagtaaaataaaagcttattatcggacggagagtgtagtacagtacggagtatttgtcagtgccagccaaacgcatgctcatgcatggagaggcgtgcgcatgcagcaactcgatcaatcgttcgaccgggaggcaatacacggtggtactccagtagcatagcacatatacgtccaacccagtcacggccacacctccggccggttagctacatgcgccgcgcgtgcaacttgtcgacgaaaaccatgccttgcacgccagaaaatagccagaagaaaccaaacccggtggttgtttaattgctgacttgcttgcttgcttccctgtctctaagacccatttcagtttggaggaatttcaacacacagaaataacaaaaatagagaaatagaaatacatgcccacttctatcaataggaattttttccatgagatttgtagggatggaaatttttgtttgttttctctctacaacttgtaggcaagaaaattttcctttggtttcattatttctaaatcctatgaaccaaatgatattcatagaaaataatccttagaagttaaaatcctttgaaatttgttcaaaacgaattggtcctaagccacgccgctgtcgtcgcctccatccctcgccggcgtgtaaacgccgccaccgccgccgttgattgggatggacggcgaccttttgttcatctggtgacaataggaaatcgatcgatgggtgggagttgattatggatagggccagcgagccatgagcgacgcgagatcgagacctctcttttgttcttgtcaggtggtgactggacccaacatcgtgtgcttgtgtagtggtatcctaccgctacagggaaaagactatgagagcaagtttaatagtacagctaactcccatgcatataaatagttaactataaaaatatactacaccacagatatccggtctcacttcttatacacacatagcgtcttagagtttgtcttgcagccggctataaatccgcagctcactttcttatcttttctcttttcttctcgatatatggttatagctggcttatagcctgctattgtacctgctctaaagaggcccacgtaaatactcctacgacgatacttattccacagtattactccatccgtcttagaatataagaagttttagagttggacacggttattaagaagttatgtataagtgagtgatggagggttgtgattggttgggaagagaatgttggtggagaagttgttatattttgggataaattttgaggtctaaaagtttttatattttgagttcgaaggaacggtttaacgatgacgtgctactgtgcggtaaataattggcgagtcgcgaaggtgtgccattggtgaagagaaaggtaaaagttgccggagtagttgatggagcaatgatgagctctgggccgggtttgtcatgtgatgggccgtgcagtctgttgtctgggcctgccactgcacagtgaacccattttactacttcatcgtttgacaagtcacacggatgaatggatgatcgcattgccggactagtcctgccaatgccctaccttttttcaagcccctgagcgaatgcaattcgtgctcatgagtcatgagtgccacttttactactagtagtaggataggttaacatacaaattctgatacatggcctaggcaggattaccattgatctattaactttcaactgaaatcataagctactaagagcaagttcaaatagtatagcaaactaccagctctaatttatctatagtcaatctaatagcttatttatataatagttacatactacactattaatacctggtcccacatatcatacacacacggcgtcttggagtccgtgctacggctggctacaaatctatagcccactgctcttctctctccttatttatcttcttaaaatatgtttacagctgacttatagcctactattatacctactctaatagcgtagtgatgattaattcctgagctacacatgccacttagttatataactagagatatgcaaccaataccaatcaaagaagtacaaggtagctatttacacccgttaatcaaattcagtcatatataaatcgaacggttagattgtatgcataacaatctattatattgttaaaggaacagaaaaagaagtctccacgttcgctctcatggcctagaaattctcacattaatcggagaaaaagaaaaggcagaatccatatagaaatacaatttaaaaatagctgaaattcagaattaaaaaataaggaatattagaagaggagactagagtctatatagaaatacaatttagaaatagttgaaattcggaattaaaaaataaggaatattagaagaggagactagagtccatatagaaatacaattaggaaataactgaaattcggaattaaaaataaggaatattagaagtagagtatagagtccatatagaaatacaattaggaaataatagaaattcggaattaaaaataagaaatattagaagtagagtatagagtctgtatagaaatacaattaagaaaaaaaaatagaaattcagaatttaaaaaaataaggaatattagaagtagagtatagaatccatataggaatttaaaactaactaaaattcagaataaacataataaaattaaaagtagagtttagagttcgtataaaaatataatttacaaataactaaatttcaaaattaagaaaaatatgggacgaagagtttaaagtcaatataggaatacaatttagaagtaactgaaatttgaaattaaaaattaaaaaatattgaaagatgagtttagagtccaaatagaaatacaattataaataataaaaattcagaattcaaaaaaaataaatattaaaagacgagtctagagtccatataggaatatatataatttataaataactaaaatttgatattaaaaataattaataactaacatgtatataaaatacaatatgaatattacacattagtagtttcgtaaagttatagcaaaatttaaaattatgttgtcattttaatatatttgaataatataatgagagaatatatatgctattatatgagagaaaatataatgatgctagccgcgcaatattgcgtgggccaccatgctagttttattaattccttccaggtagctgtcaaaggagtagtgtgtagtgtcgtgtggaattcgcgaggatgtgcatgaacttgccaaggcagggatgcagttgcgtgacaaggacacacgtgaaatgtagcgagagaagagtcgtagtagcgggcgcgaccgcgggagtgtatacggagagatgaagcgagctctctccaccaagcaaatcgcgagccaaaccaagaagacatccacatgacgacgcctcgcgccaccaccaccacgtcgcccttctcctctctcctcctcctcccgatctccccctccgccgcgactcctccgcgccgcgccaggacgccgccgccggcggtggcacatggcggcgtgcggtggacggctggcgggaggcggcgacggcgagggtgccgggcggcggcggcggtggtcgaggacggcgtgcttctccccaaagaacaggaggacgacgcgtcggcggcgagatacgactggagggaggagtggtacccgctgtacctcgccaaggaggtgcccgacgacgccgcgctgccgctcacggtgttcgaccggcagctggtgctgtaccgcgacgccgccggcgtgctccgctgccacgaggatcggtgcccgcacaggctagccaagctatccgagggccagctcgtggatggcaagctggagtgcctgtaccacgggtggcagt

SEQ ID NO: 59926 - DNA, 1196 bp, Oryza sativa
cctctcttcttttctcacttctgcttatttttgctgcttgcttgcttcttcgtcttttttattttccttcttcccctcaattcatgatgacacgttcttccttccttgtgtaatttatcaccgttcttggcgttttgcctgatttagaatgcaactgaaaaaaaagaaaaagatcgcagaggaaaaaaaaaggcagcagcagtgggtggtgaaagtatggaaatctctcctgctagtatacgtttgtcgtgtcctctttgttgtgttcttgtcttggggtgttgagatcatgcgagacgagaggtggttcgagagcatcatgagcaatgggaaaatccatatctgctatatcttccctccgtatctctgcctagctgttgcgagtgtgagtgagtgctcgccatgatgtccgaggaggaggacgacgacggcgacggcgacggcgaggtcggaacggagacggcggccatccatctcctgtatgttgcttgttgagtctctctctctctctctctctctctctctctgtctctctctgcgtcgccttgtccgtttcgcctcggtttgatcaaccaaccctgtgtgtgtctgtcactgtgtggctggctgtgcacattgccattgccatgtcctgtgccatgccatcccatgacacggtgtgtgcgtgagagagaaggcatagtagtgtgctgatccgtggggcccacggtggaatggtggtggggcccaccaaagccgatgataccaatgatcatcgtcataaacgcctctccttccgtttcagagttaggagcattaatgatgggggaggggagagggaggtccgcatgtcagattacaggtctgattagcccgggcccaccactccgtgatactaacagtgattacggatgtttttggcttagcttgcagctttgcccccactgcatgaatatatactttacctgtgcagtgcagaaaaaacatgctctaatttggcaaaggcaaatctcttctcttgctaatggcgagtactgtagtactccacttacactactactaatactgttgtgagaaacatctcccattatcttaagaaagtactgtagttagagtaggtaggagtggatgcatgggtgtgtgtggccttggtgttttgctgtctgtatcattgttgtgatggggaattggaaatttgcattggggttgtggtagct

SEQ ID NO: 59927 - DNA, 12207 bp, Oryza sativa
tattttttaaaagtcttctaatcaatatatttatgttttttaaaacaatgctaattatggtaactaatactaattacggtaattaacgttgattaccataattagcggcgcattgtgggcgcacactaggaaactcacgccgcggcctccatcgacttcttccttcctcctcaaaaccaaacgtccatggcgaccaccaccaccactgatatcaccaacgccgccactcctcttcttcaaccctcgatcctctttggacacccacgtccacatcggcgaccgccgccccaacgccaccaccaccgcggaagatgcccagatccaggtctccatctccccggcttccccgccgaacccctcccgcctattcgtccgccgcctcaaccgggacaccgtctccctcctctacgaggacgcccagatcgtctccgccgccgatggcctcctcctcctccgcgtaaccatcgtcaccaccaccgcgccatcgcggctggagaacgactacttcgtctacagctaccagtggcctggacgcccctcgctccgccgtctcccctcgccgccgttccccttccacgacgacgaggctgggatccttccccttcccgttcccggcggtgagcagcaattcaagatcgccgtgctatccgtccgcctgaacgggttcaacctccgattgttcgattccgcgtcatggagctggaccaatgtcggcaaggtgatcgtagcttcgccgcagagaccgttcccaatcaagatccccaggaacgccgctcgcctcaaccagcacatcacaacaacggcgatcacgcttggaggtgaagatggcacgatgggctgggtcgatctctatcgcggcatcctgttctgcgacgtgctaagcggcggcgatcatcccacgctcgttggtgttccattgccgctgccaaggagattggtcgatcgcggcgcggaagtcgaaggatgccctaaggccaataggggtattgctgttcttgatggttgcctcaggatggtcgaattggaagttcatggcgagatacttcctacgcgtgaccctgaaactgggcaccttgatcgtgagatcaagaactgggagctctacatgtataccaacagcaagatcaccggtgcttgggaggattggcaattggtgcacggagttgaagcttctcaaatcaatatcgaccaagcgattcatgacagcttactgcaaccgggattgctgcgtgataaaatgcaggatggcaaggagaggaaattgcacaacctcctcacatctcaacctgctctcagcctggatggtgaaggtgttgtttacttgctgacaaaggccaaattcatgcaacgtcaggcttgggttcttgctgttgatgttaagggcaacaaaatactaggattagctgagtttggcactgacacatacttgggtttgtccctcgcgtattgtcctagtaggatctccagttacatggatgcatggactgtccagacaattagttatattttagtactatataagttcctagtcctatgatttatttgcatgtataaggagcaatcgataggataattggttcatcgaaaatatgctgaaaagaggatgctccattatcgacaggatgtagacttcaagttaattttagtctatgcatttaagaattcaccgatgttcaaaaaaggtggatcaaatttataattgctttatagtggcctactgttacaactacagatctacctagtacctacccatagaagtaaattaccctagaagtaaatgtcttcttagctggtcactgtggtatattatagaggtgggcaaaattcaattgagaagatcgggggacctgaaataaattgagaaggtatttcttttttttctcaacattattatagtcatgctgtcaattctcacgtgcaattacactggatagcagtaacatacactgatcattctgtccacaagctaaaaaccgaaaaatcacaagcacagatacgtaataacacccccaacaaccaagaaaccggtactgaattgaattttccatatacacttcagagttcagagagcacatgggatcgtcaaacacaggacaaactgttcactaacattgaaatggaaaaagaagccatcacaattgttgtcaaacattgcacaacctggtgaacaacacaactcatggattgcaaaaggcacgatatatataacaaaggtcatttttctcctgctaataagtacagagatatcaaaggaacgaactgcctgaacatatgcagaacaccatcagctctctcacaacttatctgtcgggaaaagaaagaggtagtacagcacgcccttaaaccgaagaatactacgggtactcagatattggaacatgatcagccgttactgaggtcaagaagtgaaatttggcaaacgagttcccctcgttgatcctcttcttcagtgaacacatctgcctcttcgtccgtgggaacttacacggccttcggatgtccttacacgtgtcacacgacagcatgttgtacaggaacacatcctccagattcacggccacttccatgatacgcttgataaacgcaaccaagaagtcttcagattggaagcagaagatggtgagaacggacaggttgtggtgcttgaaatcctcagcagaagattcccactctacactcttgttcgagctgtacaaagacgccctcatctcctcgtccttttccatgttacaccaatgatcccatacctgcatgaatgccacgcatatacaagaaaatggtgataagaaataagtttgtggttttgcttgcagctgtatgaaaactgaaaaagcaagcaaaagttttatatcaggtgcaggtgcttgcagctgtgtgaaaatggagtgtcagatagcaacacaccgtcatgcgtagctccttcaggaaaggcgctgcttcgagaatgaacattgtccatgtgagatcacatccttcaggaacacgaaacagattcacaagccttaatttgtagaaaacagatgccagtttttgtggtaattctggttgaacccaaatctggaaggaaaaaaaaagtgagtcgagtagagaggaggctagctcagcaaaaacgattaccaccaacttaccttttcactcttaaaattcaaacgtagatctcttacagagatctttccaaggatcttacttagcttgaccaacttgtgccttttaagaccaacacctgcaagccgtaccgcctcgagtgagggcacataaccaaaagtcaggggatcttggaaagatagccaaccctcaaccatcaattgtgctagtttcggcaagcagttgagcttgatgctttcaaaacggcagctggcaatattgagcacattgagctgtggatgttcaagttgcagcacggtcaaatttcctgaatcgcagttgaacaaacgcaaatactgtaaattctgacaggtcttgaggacgttgtggatgtccgattcaccaaatcttagattccctattatgaggcgtgtgagaccaccaaatgcagttgggcaagcatcgaaaaatgacatgaatcgtctcccgtaatcgatcaaatcatcatcagtgcaacgggtgggtagcttctccactataattgtgaattcggccatctcaaccttttgtgttgtcatggcatgtccaacagtttgtccaattgagatacagtcaccttcattcaggtagaacagcatgcgcaagaggtggatggtatattcatctggattcctgcgttccaagatgctcttcgttgcttcaacaacagcggcattggtccagaccaacacatcatcagataacatggatgcaccattaggcatgaagtgaacaaagtctataaccaattgagaaagcatagaagggagatgcctccaccgtctggagaggacactggttcttgcagcatcgcggacatggagccggtcaaggatgttaagcagaatatcatcaggtaacttgcttagcctgtcactgcctttctgcatttgaccaccaattacaaccacaatcaattcaaaatttaagcattattactggtcaaaagtaaaagagtaatagatgccatgcaaatgatatcatcctactcctactgggcacataacatagcaggcaaaaaagggagggaaggagatgacttacgcggttcatggttgctccaatgcaatggcccttggatgccgctctgttctgcttgccctctatgaaatcttggtggtacaaggcaaccagcagttcactatcttattttcctccaaccatagaatccttctatgaacgattctgtacaataaggaattgttagattgatacccaaatgtgttccaaaaaaagctgataaccaaataaactttaccctttttggcaatgccagtgtaattcagtactgtttgattagcttccaattaagtcacagtgttttgccgcatgatttccgtgcagccttgctcacggctgcttcctccactagatcaaattcccaattgccccccccccccaccccaaaaaaaaaacaacacatcaatctgacggaatttctcgatccaaccgcatacaacgaagcgtgcactatccaatacagcatgccaagtagagagactagagagaggggagcgacgcaacgtactcacaggttgacgacgagcaacgcgatgcaccggtgatacgagcggcggaggaacgcaggcggatggccggccgacggggaggcgaggcggcggaggaacgcaggcggacggctggccgacggggagggcggcgccggcgacgtgagcggcgcggctcggaagcggcccgcgctgcgtcggcggcgggagacgaggaaggccgcggcgtttgcgccgcgtgacgtactctattgagtgggccggccttaacggagcaacgcgagatagtttatatacccaatttaaattcgaattcatatttaaatattttttatagagtgaagtgcatgagcgggccctaaacttgtgcgggcgtgtcatctagatctctaaactctcaaaatacatttttagtcctcgaacttgtcttgagatgtcatctaggtccagaggagctctaacccgctccatgcgctgatgtggcatgtcacgatagcacctacgtgccacgtgtcaagcacatagaaaaaataaaaataaaaggcataatttctcctctctatcttaaattttttttgtcttttttatgtttacctaagaggagaaaatatggtttttaattttattttttatatatgcttgacatatggatttcaatgacatgtaggtgccaccgtggcaatgccacgtcagcgcatggagccggtttgaaccggttaggacctaaaaatacattttggaagttcaagaatctagataacacacctacacaagtttagggaccgctcatatactttactcttttttatatataatattcatacggtatactatatttataaatataaaatctatgcacatgaatatatttttaggttattagatttttatctagtttcttttaatttttctaacttgtttttttttaaaaaaaattatggtgcaggaggagcgtatgtgttagggggagggacagggtgcctgatcgaccacagcgatcacccgtccattagccctcccttaaacaaggtctcaaagcgtttgtttgatctgatcatcgtctcacgtgacgttgttgtgacactgattttgataattgaaaaacacgttatatcgtgcattacggttcaagtataattcaaacttgcgtcaatataaggttgtgttcagcacaaggagattgatatgaaaattctttaattttccacacacacgcttttcaaccgccaaacgacatttttaaaaaaaaataatattcatattaattattttaaaattttaaatagttaatatttaattaatcatatgctaatgatttactacatccgtcccattataagtgcagttatggttttccgtgtccaacatttaaccgttcgtcttatttggaaattttttatgattgttagtgttgttgttattagatgacaaaaatgaataatattatatgtgtgtttaatttttctatatttttttaaaaaataagataaacggttaaacgttggatacgaaaactcacaagtatatttcaactagaaaaaaatgcccgtgcgttgcaacggatgaagtatattttaatcttgttattgttatatggttaagttaaaatgaaattcattgtgggagttcgcttggatatatatatatttaaaaaatcattagctgtagttaggggtttgatcgtttcaagttagcatgtgagttttttaaaaacaaatttcttatatgattccttctatattaccaaaagtgaacaatcttgaaaaccgattcaaatacgaatatgtatttccaaaagcaaacgaacttaaaaactgactcatacacggatgacgtaccaaaataccggcaaaaacatcttcaattttcataataactagaaaaatgcccgtgcgttgcaacgggtgaagtctattttaatcttattattgatatatggtttagttaatatgaaattcactgtgagagtttgcttagatatatatatttttagaaaatcataagctgcagttaggagtccaatcgtctcaagttggcatgcgatttttttttaaacagatttcttatatgattccttttgtatttaccaaaagtgaacgatattaaaaaccgactcaaatatgaatatgtattttcaaaagcaaacgaacttaaaaatggctcatacacgatacacgaatgacgtaccaaaataccggcaaaaacatcttcaacttttataatagtagagatagagatatagattaaaaccaaaacataaaattaaaactgactcaaacacggatgacgaattataaaaacatctttaatttttataaccgactcaaacacagataataagatgtgaaaagatcttcaatttttataataagtacggatagtgattgggacggaggtggtaactcgttttacctatctttctcaatctatcctattcgattctcgtcatcggcgcatcgcctttttctccaccgcttcacttccccactagccacaaggcccacaacccaacaaccttccactgatccacacacagccgcgaggagagagaaagagagaggagagagagatggcggcggagctgacggcggcgcagctgcgggcgtacgacgggagcgacccatcgaagccgatctacgtctccgtccgcggcaaggtctacgacgtcacctccggccgcggcttctacggccccggcggcgcctacgccgtcttcgccggccgcgaggccagccgcgcgctcggcaagatgtccaaggacgacgccgacgtctccggcgacctctccggcctctccgacaaggagctcggcgtcctcgccgactgggagaccaagttccaggccaagtaccccgtcgtcgcccgcctcaccgaatgaaaaaaaaaaatccccccaaatcaacccttagattattgtatcctcttgtgctctacagcttaattccatccgtaattccatgtgtaacttattattacttctccctgtgtgtcagtgtgtctgtgcttgcagctttgctctctggttgcttgattagctgcccaataatctgaacaataagaaatctggggagtaatttaagtattggattgtctggtctttcttttttgtgattgccgcttgatttcttgtgccataggttgttcttaatcttgatctgggtattcttgtatagaagaagcaatgtgctgaatgccttgaccacagaaatttcatggctgttgtttgctgtacaggttcatttggttgtgttcatcttggtgctgtcatagtcagataggtacaacaaaagcaggttctttataagatttttttcttgtggtagtcgatggatggatgttagtgttagtttttcgttctttcatttctggtggatatgctagctttggcaagtgattattttttggttttgtgtgtggattgataaatcattgaagcaatgcacagagacatcagacatcaattcagtcgttaactattacagttttgaacaatgaataattctatatagattattgggatatagataattgttttgaccaatatattgtaaaagttgattacttgataagctttatgactatttcctgtgtcttcttctctctgtcttacctgtttaatatctgactgttgtacgtggaggaagacatgaatgaataatgagtttagctcctaaatgttctcgtggatgttctgattggggagaaaaggtttgttactgatatttggtttgtgtaggctgataattccagcagtttcctgcatcctcgctgtgtgtacattttattttgtgtgaaaaggatattgatatatatggactctggatcgtgagaggggggtatcaattgttataaaggattcctttctttgttttctttccaatttccaatcagcttccatgtgtgttctgaacttctgatacttcaggccgggaaggtggaaaattcgctccgttcccatgaaaaccctacccctcccatggggagtttttctattatattaatatgaaaccctacccctatgagcatcctatggggagtttttctattatattaatatgaaaccctacccctatgagcatcaatcctggagatattgacaaagtttccgttaaaccctgaaaaattcgctcctataggagtcgaatccaggacctcagatgctaccgaggctcttgtaactactaggctacatgccctttcacaggcacaggcaaattgtttgcaacattgttctgattcactgcatatctgaatgaaaccatgaatcaccttacagatattttaacactagtgaatgcactgtgcgtctgtgcccactgccctgttacgaagaatcattatcgttagtttcggtccaacccttgttacgtgcaatcacattggccccagttcatcagttagaacgtgttcacttttgttaccactttcaaacataccaatttttaacattaccaaattaattttaataaggcaacaaactaaacacatccttatcgatgctaccttaccaaattaacttatacattagtaactgtagaattttctacttttaaaaaatctaccaaatattgataaggcattaaatttagggcatgttcagattgtagccaaaataaaccttaccaaattttggcaggatttcttatgtatttatcaaatttggcaacaaactaaacatagatattttttgaaaactttaaaaaaaatggtatggttgaaaatagcatcaataacagcccctaaatacaaccatcaaaatgtgtcaaaattggcagggttaaaagtggatgtaaactgaacaaacccttttactattttggccgccggttgttgggccgagctgcttcatgggccgtgcacaccggagaaggagatgatggactgatggctagttggacaaacctgagccgtccgatgcagatggacggtggatggagtggggggaaccacacgccgctgacgtagctacatgaagtcatcagactccagccgatccgcccacacatgcgcgacgcgcgtcccacgcagccatcaccggctcaccgccgccgtcgcctcgtcgccgccggcccggccgccgcctcccctcgagctcgtcgtctcgaggagcgctcgggttccggtcgcctcctcgtagggaggaggaggatcggaggaggaggggtttcacgccatggtgcagcaccagtatgtcccgcgcaagcggcgggccgagcgctcgttggcgccggcggcgccggcggcgatcttcaacgtggaggcggaggagggcagggccggcgatgtccccttgcacaagcgcgtcaaggaggagctgcagctgcagccgccgccgccgtcactgcaggtagattagattgaatttttatttttatttttttgttttttggttcctcgtcgtggctacgtgattgcggaatacttagcctgttccctattctaaggaaatggtgttatggatttctccattgagaatactaatatattttatccggattaggagtgagatcagcaggaactatttcgtacggtcagcgaaaattaccaccagaaatatcttacagaaatcacttataacgatacccaaaaaaataaaacattgacacgggttgtaaatatttgtgctccttgctttaatctggatatccaggccaacgtgcttcttgatggagattgtcaatccaattaattaggcactcaagggtaattggagattagtgaggagggatattatattggttaagctttgcgtgagagatgctattattacctttttattttgtttctttttcttttcagctctggcaacaaatggatttatttccgaacaaacaaaaaaaaaacatcctaattgagttgctagcgttgattttaggagacagactgaaatgggtaagccaaactttggcgcaacatgcataaaggtagaggatacgagtccgcaattgtgatattggatttgggatggattgttttgtagggttttgtaacgtaaagtgcggctggtaaccgaacacacccttcgtctatgtgagtgaatgctactactacattgaatgctactttattcattccatatctcgctaatttggatgtttgctctagacgctccagacaaattaatctggaaatggaaatgccatgacatgtcctatatttgttccatatctcgctaatttggatgttttctttaggcgctccagacaaattaatctagaaatggaaatgccatgacatgtccttttatgctcagtttgatgacacgctggtaaaaatatatgacttgacatttactggtaaaaaatcaccgtgatacttcctctttagtttggttggtgcgggtatagttgtatgttctttgcaaggtggtcaccaagaaggagaggaaagcctttgatgcaggcctgattttggttacttggctgatttggaaggaacgaaaggctcgcgtgttcaatggccgagcctcgtcaccggcctgtttgtgtacgacgatcaaggatgaatgggaaacgtggctggcggcgggtttgatccctcttccttgagtcggcttgtttgtagctctgttcggagaggtctctgtgtgtttgctccccatctcctttgagcggcggttttttcgcctcacttaaagggatgtggccctatttgtaaccaataatgtacattctttgctcttacttaatatatttcggccagtattttctttgccggcccagcggaagtgtttgaaatttcattgctatttgttcagttattatgcatgtccgttttttataccgttaatgagcgattgtggcaaaatacttattgaccgtgtgtatgggaatatgtaaatcttatagtgcattgttagacattattataagttaggagtttttaaaatatcaaaatctgaaaaattatcagttgtaaaatggggcaacatacaaaatatatctgaaaagtttgggatttgattaatagcgttgtatctatatgtatttgtacaaatatccttttgcgtgctaacataataatcatatactatgtgattagctaacacttcaatttatcctctaagtaccaacatgatgttttgcaggacatgcacatcctcgatggaagtagcccattagggttgagattaagaaaaagtccatctcttttggagctgattcaaatgaagctggcaatggaaaatacaaaaaaggaagacataaaatctaggtctcttattgctagtgaacgagtgaaagcttccaactttgctgcagattttttgaaaattggcacttgggaggtaagagatttcctgttaactgtgttagtactaatatatatgttatcatgtaggagtagtaagtacaacttagatgctctctttcccaaaattttggtttaacattgaaggaaatattgcttatttgcagtgcacgtcacagtatgaaggtgatttggtggcaaaatgctactttgctaagcataagcttgtctgggaagttctggatgctggtctcaagagaaagatagaaattcagtggtcagatattattgctttgaaggcaacttgcctaagaagggctgcaggaat

SEQ ID NO: 59928 - DNA, 2742 bp, Oryza sativa
agatcgaaaagacaggggaagacggatcctgaaagcttcacattgaaaaggttagatcgcatttgatcgaaatgccagggggcgatcaaatgacaactctagtggtgcgaatcctgtgtttggtcgctccgtgcaagaaattgcactgtaaccgctggaagaaatgctctgcatgcaccttattaaaagaaaaaaaaatatatcagtttttgcctctgtagtttgccacctgtgtcaggtagtaccactccaatatgtgcacttaccaacaatagtttctcaaatgctcagtgacaaaaaggaaaggaatgatatacgacaatcaatctccaaaagtactatcataaagttatcaatatttttaaacttattctaatataaaattggttttcggaatttctaaagttcaaccgagtctattaaacgtcgtattgaccagagggagtagcaatctgtgataaacaagaggaacagaaaaattaaattgtctgtcaggcttggccttctgtgtgttctttttggtacaaacaccatgaaaaaaaattaggtggataggacgttaaagtgattatctgattccaatttttgtggatgggacatcaggtggataggacactgttctatgatcagattcaccatctagagttttaggcaattgtgccttgtgaatgattatcggttccaattctttcagacctctggcttcatcagttccaattgaggcagttctgttcgacattgatgggaccttgtgcgactcagatcctcttcatcatgtggccttccaagaaatgcttcttgaggtatggaattcttatacttcttgttttccattaacttttgtagaaagctaattgagaagatgtctttttacagattgggtataacaacggtgtgccaatagacgaggagtttttcataaacaatattgctggaaggagtgatgttgaagctgctcagaatttgttccctgattggccccttgagaaggggctgaaattcctcgaggacaaggaagctaaatacagaaggtacactgcagttaatgacaacatctattgtgtctagtttcagtatactccacagttgtattaagggtgttttcttttgggtggtgagaaacggtaactaccaaccgttgttaacattactgaatcagtatattttcccagactgaatatttataatttttaacttttgcagtttggcaaaggagcgtttggaacctgtaaagggccttgctaaagtggttcagtgggtcaaagatcatggatacaagcgtgcggctgtaaccaatgcccccaggattaattccgagctcatgatctcccttcttggcctcacagatttcttccaggccgtcatcgttggaggcgaatgtgagaagccgaaacccgccccattcccctacctgaaggctctcaaggagcttcaggtgtctgcggaccacaccttcatctttgaggtaaaccacttcttcttcatttgcatctgttgcaaacttgtcatctggttttatttgcagttgaaaaatgtgtgcttttgttgcaggattctgcttcaggcacacgtgcaggcgttgctgctggaattcctgttgttgctgtggcaacaaggaacccagagaagtccctactggatgcaggagccacgttgatcatcaaggattatgaagaccccaagctttggagcgcacttgaagagatagacagagaggaagccaagctaaagaaagctgatgcatgagatgagggttctcgattagatgatatattgcaggtttagctccttttgcatttgcagtaatattgtagccgaagtgatggcgcacagagctcatctttgcacttttgagcttctgtggttttattattctttgttgctactcagcctattgagttggtacagagaaataaagacccaaaactcccattgagttattctttatggatggatgttacttctgagaagtttcaggggtgatcttgttcatcctgccaaaactattgcatttgcttggcttcttgttatctttatccaatggttaagttaaaaaaaaaagaagaagacatatttaaccaatacaggagctacaaaaggacgaaacttgcagacagattaaagtcaagaaaagacagaaatatatgaacatttctccactttaaaagggaggaatgcaggagcaaaaatataaatgagctgacaagaaccagtaatttccagtaaaatttgcacggttgatgtaccaaacattgcagccatctaccatgtagttacaaagtgggaaaatactggcagagctcagtttacaattaccaaacattgcaaccatctaccaagcatttcttccctcttatagtcatgcactcggtcagtagtcactacatagctaaacacccacctggtgatcatccttggggctgcagtagagagtgcggagaaatgttgcaaggaacatttacatgggcaatccatgtatccagacccagttcttcacttcttcatttgaacttggaaaaaaaaacagtagcagcagattcaagaaccttgaagattcctcaatgagtgcattaagcccacaacacagcactctcaaaatgaagccaatccagaaaaaaaggtcaccaaggtggcaaaaatggggcagccctcgattaaattgatgggcaaagcaattgcttattctccaatgacctgcaccttagcacgcttctgcacttcatggagcatgcctaaacttga

SEQ ID NO: 59929 - DNA, 1810 bp, Oryza sativa
cagatttcaccaaggccaaactgaataagtcttctattaggttttgcccattgaaagccaggaggttttacaacataacagtggatgtttctggatattaaattcaaacaactaagtaactgaccattatggttccataattcaaatcaacactgccagttgtatttgagcagcacagagttcaacgtatttgggagaacggacatgtgaagcaacaacaacttatcaatctcatagcaggagcagagctatacattcagcccaaatactggagtagcaagcaggaggaaagatcgggtgaactcacatggagtcggcctcgagcaccttgatgaaagctttaccacggtcggctcggacggctgggtgtcctcacctgcatccatgctgccattgctctgggatgtgccatagagctttgaagctggctttcttggagctttgaagctggctttctgaagggagacgaggagaggagtaggaggaggaagcggcggcaacgtggggctaggggtggaggaaagggacgaggaggtgcaggcggcgcgacggtaccggtggggactaggaggaagaggcggtggcggggggctggaggtggagggcagggacgaggaggaggaagcggcgccagtggcggggtctaggaagaggtgatagtggagagcaggcgacggcacggcggggaagaggtggcagtgggcaggcggcggcggcggtgacgacgaggagatgaggcgcgagggcgattcggcttcgggagcggatgcggcgcgagcgtgacaactgacaaggagaagacgacacaaaggggaatcgcgatttcatcgtagggacgtggaaggacctctctgcaaaaaggagtttctcagagtatcacgaggaggttacaccaagtgaaggatcgaacggctcatgttgtctcgaggggaaatcggacggtccatatattttagatgacgtggcccaaccagattgcaagaaactttagttctttcaatactttagatatgtttatagctggcttatagcctgctattgtacctgctctaacatcttcttctgctgctcctctctctcttcctttatctcttttaaatatgtttatagctggcttatagcctgctattgtacctgctctaacatcttctcatcttcgatctgttcaggtgtggatcgtgtctaaacaaaacaattttatttgacctacgctggtccgtccattgacatattaactccgccgtcgccctcccggcctaagaggcaaggtagaaaatacgatgaggtggaagtcactgatatatggcttatagcctgctattgtacctgctctaacatcttctcatcttcgatctgttcaggtgtgggtcgtgtctaaacaaaacaattttatttgacctacactggtccgtccattgacatattaactccgccgtcgccctcccggcctaagaggcaaggtagaaaatacgatgaggtggaagtcactgatatatgggtcccacttgctagctctaaggaagaagatgctggctcagtgagtcaaaccgaaccgaaagagttgacttgcaccggttttctaaaatttttttagacttttaaattaggaacagcttagctctcaaataatccaatctggaattcacttctatggagatttgaactcaggaccttgggtgctactcaggtcactgcaaccactaggctacatgttctttcacaactgattttttaaaatggtggtgttataccggttttgcgatgagagagactattcaatcagcctcaagagatgagggaggagaaatag

SEQ ID NO: 59930 - DNA, 4739 bp, Oryza sativa
tcattatttccttgagttatttaatttatttctagttgaattgaaccttgtaactatcattagttgaatatcccttgtaactaccattagttgaatatagtggcttatccgtagttttgctccataggtgtggatagatctggtgtggagggtggtttgccgggttgccgtcgagtttaaaaggcaaatacatgatgaactaattgtgttattcatggatggtttgctttatctatttattaccgatatatttctatgtgataagtgattgcttacgttcaaattattgttcatgctatttaggtttcgagttcatcttatgtttacgatgttattcttattttaatattctatgcttgacatggatgtgcaatatgattttcaatttagttctttgttttcggttttaattattcatgttccatgtgagtcatggatgtgctatctgattttctattcatgtccctgtgggtaagcgccgatcacgtttactcggctttgccagaatgtattcactattgtctggaatagaaactaatatttcaattcatgcctatccaagatgggaactactatttttcttagcatgcgcccagcctccatccccctcctgtgagtgaaaagaaacagagacacagcaaaggaaaaagggaatagaaagacgtaagacagacagagcagagaaggatcgagagtaacagaaagaaaatagaaataaaggaaaaggaaaagaaaaataggactattcctacctgtgcgccatcttccctctaaaaagtctattcgatctcctctacttccatgttcaagcccagacattaatccttctatagaagtctagctgacctctatttctttctaggccagagaaattaatttctcggtaaaagtctatcgaagttccctatattttctgaccaggcccaagacttcaatcctctgtacaatcctccatgtttagacaaagttcatatcaggtccctctactaccccttagggaaaagtctgtacttaccccaacaattttctcagcccaacccgaaggaccaattcccacgagtccgcacacgccaaccatcagtaaaggtctactgctacatcgccgacattggtagacgaccggacacgtaccgagtatcaacggttatttatgtaataaatgtcgtgcaatcaattctactcattccattctctccatttgtaagagcaccagggggaaaaaaataatccggtgccatctaacatttctagttcaaaatgtcgatccttggcacttggcggaacttttttttttccatgaaatcctttgaatgattctttaaacaaaagtatggagtaaaaatatcttatgtaagaaataacataaaccggaccagcttgcgtgcatcaacgcttcgatatatgcacacatataagactgttgttgggcggctgttatttgccgagattccatgtaaaataaccataggacttgtgacgagatctttcggtttgcccaaaacctccatgtcaaatatcccgcttcctaggcatcttgcatttagataggttgcaaaccgccttgaatcaaaagcacaactgcgctagcctccttgtttcagccgctggacctattcaaagagttagccaaagaaatatttatgtacgtagctccctattcggcgtgcccttcagtaaaacgggcatgaatttttcatccgaattctttctaggacttacgacaacccgccatgtctttttttccgccataagtaccatatgagcggctaaaactagaacaagagcatcatacccggcgccgtccaagtgcaaagcacttcctatctcaaatacgactgcttcgtcgtaacccttagcgagtaacgtggcatattcaccatcgatgtcctcgacatttacttctcctttgctatatacgctctaaggctgcgtttttggcatccggagaaaaaaaatccctcgttcgccgcgcgcacgcttctcgaactgctaaacggtgtgtttttcgcaagacaattcggtacaaaagttggttaaaaaatcctactaatcaatttttaaggtataaaataattaacactcaactaatcatacgctgatgactcacccttttttgcgtatattctcttttcccctcctcacaaacacaccgtaagtaacattggcgaagtttgatgcctaggaacctgaatgatatgtttatagcttcacatgctattggaactttagtgaccgttgcgtagactcgtataagaatcgctgatgaccttgtcgaatttgttgccaaagtggttcttacctttgtttttctttgacaacacccctcgacacgtcgttcatgctcattcgcgtacctattgccaaccggacaatgggttttctgcccttaacatcttgcgtacatataaatttcatatcggggttgtggaagtccagatttggatcttgcaggctcagtcaagacaaaggatagcatgcactacggaccgaacacttggcacacatgcatgcaaccaatcaattttggaccatgaagctctcttggccttaggttatcatggtacgtgtttccctatttaaagccccgatgatccctacaaactcacacagcaaatccgcgcgcagtagcaacatcttccaacattgaaagatccctgtccagttcattagcaatggccaaagccgtcgccctactccttgcagccatcgcggcatcggccgtgttagtgcaagtggaatgcgacgcccccgtcgagaagagcttcaacaaggccctcctcgcccctgtcgataagcgcttggatgaggcaactcaggccatcaacgaggccgccgactccgttgtggctgctgccccaccagcaaaaaaggatgaagttgaagctgccacgtggaagcggagaatgttcgcctttgctgctctcgggatggcccaaggagatgagaagaaagttgctgcaacttcacttgcctacaagaaagcagctaaagctgtcctcgatgccgccccagctgacaagtttaagttgatggatgaatccttcaaagtggctgctatggaggtaatcgcatcatgagccacacgccaaccttcaataaaggtctactgctacaccgccgacattggtagacgaccggacacgtaccgagtatcaacggttatttatgtaataaatgtcgtgcaatcaattctactcattccattctctccatttgtaagagcaccaggtggaaaaaaaataatccggtgccatctaacatttctagttcaaaatgtcgatccttggcacttggcggaacttttttttttccatgaaatcctttgaatgattctttaaacaaaagtatggagtaaaaatatcttatgtaagaaataacataaaccggaccagcttgcgtgcatcaacgcttcgatatatgcacacatataagactgttgttgggcggctgttatttgccgagattccatgtaaaataaccataggacttgtgacgagatctttcggtttgcccaaaacctccatgtcaaatatcccgcttcctaggcatcttgcatttagataggttgcaaaccgccttgaatcaatagcacaactgcgctagcctccttgtttcagccgctggacctattcaaagagttagccaaagaaatatttatgtacgtagctccctattcggcgtgcccttcagtaaaacgggcatgattttttcatccgaattctttttaggacttacgacaacccgccatgtctttttttccgccataagtaccatatgagcggctaaaactagaacaagagcatcatacccggcgctgtccaagtgcaaagcacttcctatctcaaatacgactgcttcgtcgtaacccttagcgagtaacgtggcatattcaccatagatgtccacgacatttacttctcgtttgctctatacgctctaaggctgcctttttggcatccggagaaaaaaatccctcgttcgccgcgcgcacgcttctcgaactgctaaacggtgtgtttttcgcaagacaattcaacacaaaagttggttaaaaaatcctactaatccatttttaaggtataaaataattaacactcaactaatcatacgctgatgactcacccttttttgcgtatattctcttttcccctcctcacaaacacaccctaagtaacattggcgaagtttgatgcctaggaacctgaatgatatgtttatagcttcacatgctattggaactttagtgaccgttgcgtagactcgtataagaatcgctgatgaccttgtcgaatttgttgccaaagtggttcttacctttgtttttctttgacaacacccctcgacacgtcgttcatgctcattcgcgtacctattgccaaccggacaatgtgttataagccattaacatcttgcgtacatataaatttcatatcggggttgtggaagtccagatttggatcctgcaggctcagtcaagacaagagatagcatgcactgcggaccgaacacttggcacacatgcatgcaaccaatcaattttggaccatgaagctctcttggcctttggttatcatggtacatgtttccctatttaaagccccgatgatccctacaaactcacacagcaaatccgcacgctgtagcaacatcttccaacattgaaagatccctgtccagttcattagcaatggccaaagccgtcgccctactccttgcagccatcgcggcatcgcccgtgt

SEQ ID NO: 59931 - DNA, 5718 bp, Oryza sativa
cccacccgccctagacgccaccgcttcccccggccaccctggacgccgccatccggttccccctcctcgtctcacaccgcgcgccgccatgcatcctccgccacgagagagagaccgagagagattaggaagagagagatagagggggtatgacatgtgggtcccaccatttaaaaaaataaaatgctgactggactgccatgtagaccaaaaccaccacggattggatcgagggggtaattcgtccggtttgcattgttggaggtgaaaaatgtccggttttgtggttcaggggtaattctgacgactgcgatagttcggggggtaattcgtactttttcctttattatattaataatttaaaatattgtggtttgactgcactcattttagtgttagagtatagagatagtatcgtattatacccagttgttatggtacatagaattagtttctatcaatatatttttagagttaattgagattaaagtcttgtgcgcttagctacacatgctcccgaggcggcatacaatggcataaagattgtcatagggcgttgctagttggcgcgtctgcgccactacggcagatcgcacgcgttgcggatgtgcttgggactaagggcctgttttgtagagctccaacttcaatttagctttaggagttgggtctggagtggagtcgtggagctgcctaaacccagctccacctctctaattcattttgtgagagagctccacccagctccgctcccattttaggtggagctaaaactgtttggctgagctccagctgagaggtggaaccggagttgtgccaaacaagccttaagcctggtgcataatgcttaagtgctattcgcaataagtttttataatagaataaaaaataaatagttgagtctagagttttcaaatctggacataactaatattttaaaattctgaaagttttaaaaattaatttaaagattttaaattttgagttaacagtttttaaatttaatttgaaacttttgaatagaatttttttgaatttcgagttgttagtttcaaaatttggagtgaaagttttaaaatagggagatcttttgaaaattgatttgaaagttttaaatttaaatcgacaacagactatgtatgtaaatttaaaactttcaactcctctacaattcctattgatgttgttgaatcaaagcagtccttcaagtcttaacacatactccgtccattccaagaaaaagccaacttctgactatgaatctgtatataacgtatttccagatttatagctagaagttactattttgttttaatagaacagagggtgtaagtttgataaaataaggatacaaaccaagcaatcacatcattgtacttgaactatgagtggaattgattaaatctatagttcaagttacatgtaatactcctttgaaacgttagattctaaaaacgcaggattaaaatgtaatggctttttaattctataggaaaaatcatagaaattgtgcaaagtagccatttagatgcctcacaggataggtaggggaaatttaagattatgcgttgatttgttagagagagaaagaaagaaagtgcgttgaaacttttcaaataaggagtaggcctcttttgaggaaagaggatatatatgcctcttgttagagtaacggtacaatagacaaaattagctagcgatagtgtgtccacggtagtaaatgtggtgaggtgacagagaaacgagtggagagagagaggtagcgagcgactaagtggtgtttacatccaacgactttagtccctgtctttagacactaatttagagtattaaatatagactacttacaaaactaattacataaataaaagctaattcacgagacaaattttttaagcctaattaatctataattagagaatgtttactgtagcattacataggctaatcatggattaattaggctcattagattcgtctcgcaaattagtccaagattatggatgagttttattaatagtctacgtttaatatttataattaattttcaaacatccgatgtgatagggacttaaaagttttaggtggtgtttagatccagggacttaactttagtccctgtctttagacactaatttagagtattaaatatagactacttacaaaactaattacataaataaaagctaattcacgagacaaattttttaagcctaattaatctataattagagaatgtttactgtagcatcacataggctaatcatggattaattaggctcattagattcgtctcgcaaattagtccaagattatggatgggttttattaatagtctacgtttaatatttataattaattttcaaacatccgatgtgatagggacttaaaagttttagtcccatctaaacagggcctaaggtggtgtttagatccagcgacttaactttagtccctgtctttagacactaatttagagtattaaatatagactacttacaaaactaattacataaataaaagctaattcacaagacaaattttttaagcctaattaacctataattagagaatgtttactgtagcatcacataggctaatcatggattaattaggcttattagattcgtctcgcaaattagtccaagattatggatgggttttattaatagtctacgtttaatatttataattaattttcaaacatccaatgtgatagggacttaaaagttttagtcccatgtaaacagggccttagtcccatctaaacagagcctaaatagccactgacgacacactctctccaagacgtgagaagcggcaccaggcctgctgctactggccaacgtgattgtggggtccacatgaggcgatgcgagaccggcaaggcatctaaacggagcttggaggcgaagcgttcgacggcgatacgatagaagctagcagagagctcgttgctggtgatgagagctgcgtcgctcgaggagatggccggctgccacggtttgtggagccccaccggcgacgctgagatttgatatctctgggacggggagcacgggagcgaaaagacatcgacatgtccaagacgacaagaacgagagaaacgagcaaagaaatcaagagccaaccaagagggaggaggagatgcacccgagatcgccggtggtgtcctgctcaacaccgggcgacggccgacggtcttgtcctttctttgagacttggagcattcttgtcctggccatggaaggaaggccgctggcctcccaagcaactcgcttggttttgctctgctttgagaacaagtgggcagaaaaatggtgaagaacattggaagaagaagatataataaaaaaattcataaaaacatgtgggttattgatgcaatagctaactattgtatgcactagctcttatcaagttaactctaatgctgacatagatgtttttggagccaactgttggctgcactattgcccttgctcttagaatcccttaaaaatttagaggcaaatcctatgaaattcctataaagcaagcctaccatccaaaggttctcataggattttatttccaatggattcaattccttcaaatttcccaaggagccctaagacaaccggtgcatgattactacggccgagtttagttctaaactttttcttcaaacttttaacttttccatcacattcaaactttcatatacatacaaacttccaacttttccgtcacatcattttaatttcaaccaaacttctaattttaaggtgaacttaacacatcctatgtatatctccgaggcatgcatgcatttactacttcactacttaactgtagtgtcttccaatggattcaatgccctaggaagcatatcagaatcctaataaatactttcagagatcctttggctgtgtttagttcagcgcaaagtttggattttggttgaaattggagatgatgtgattgaaaagttgtgtgtgtatgacaggttgatgtgatggaaaatgactgaagtttggatccaaactttggatctaaacacagcctttgtggtgttgtggtacaactgtgtccgtatcgtctaacattacatggtaatggcaggggtagcattattcccatcctgaccatccataaaaaatcaagggctaaaaacacaggttgtactaatcgtgctagttagttatccaaaacctcatgcttctttgagacggtatgcattccttagttttagttggcattgccatcattaaacactaggtaaaaccccacgtattgctgcgagaatttagtatgataacaataaaaaaataacgcgtaagatagctagataacattggattaagtaaattaatgtggtttatgataatttaaatttaaatagtatacagaatggtgattcaaacgtaaaaggtaaggtggtataactttatggaagaagaaaagtagggagatagtttggaccgtagattaatcatgtaaaggctaaaaacaattgatctgatatgacttaattagagaaaaaaaaggagaaagataatttggaccatagattaatcatttaagcactaactaagtgagaatgaactatataagtatataggatatcataaaacataataaagatatacattgaaacaatatgtgaatcatgttggatggtaattcaacatgtttgtatttgaaaagctcttaaattataaaaactataaagatatagcatgtttgcatgatatttaaatgtgatgattattagtggatgatgatgtgccatcttgttaattagtggatgatgatgtggcatcttgttagtggatgataatgtggcatccttgcatgttatgtttaaggagttagtgggggatattgtagtgttgtggtacaaccgtgtccgtatcgtctaacattacatggtaatgataggggtagcattatccccatcctgaccatccataaaaaatcaatggctaaaaacacaggttgtactaatcgtgctagtagttatccaaaacctcatgcttctttgcttctttgagacggtctgcattccttagttttagttggcattgccatcattagacactaggtaaaaccccacgtattgctgcgagaatttagtatgataacaataaaaaaataacgtataagatagctagataacattggattaagtaaattaatgtggtttatgataatttaaatttaaatagtatgtagaatggtgattcaaacgtaaaaggtaaggttgtataactttatggaagaagaaaagtaggaagatagtttggaccgtagattaatcatgtaaaggctaaaaataattgatctgatatgacttaattagagaaaaaaaggagaaagataatttggaccatagattaatcatttaagcactaactaagtgagaatgaactatataagtatataggatatcataaaacataataaagatatacattgaaacaatatgtgaattatgttggatggtaatttaacatgtttgtatttgaaaagctcttaaattataaaaactattaagatatagcatgtttgcatgatatttaaatgtgataattgttagtggatgatgatgtggcatcttgttaattagtggatgatgatgtggtatctttgtagtggatgaatgatgtggcatccctgcattgtatgtttaaggagtaatgggggaaattgtattggtttggtacaaccgggtcc

SEQ ID NO: 59932 - DNA, 7150 bp, Oryza sativa
agccggaactaggtatgcactggcatgccgaggctcaccgccaccctagccgccatcgccaatgactccggccatctcatcccgccaagatcaccaccgatggcctgtcgccgtcgttccctcttacttttctcttttggctgccaagcctagttcgccgccgttccccgctggcaacggcgacaagttcaccggccgccctgcctctgctccctccagtacctcctcactgacatgcgggacccacatgattaggccctaagaactcacactagtaaatgcttaaaacttgtgaggttgtattgttaaatacctagagaatgacatgtggacccaaggacatgcatgtaaatagattaaagctcaagaactcttaataaagatacttttaacatgtgctaaggacttcggattatatttcttagaactctagggacttttctacaaaagatctctcactgaccagtgggccctatgtgtttaaaatctggaaaaatataaggaaaatgactagagtagatattttacaattgaaaacttgcccaaactagtaaaatacatataaaatccattttagctcatttttagatgaatcaaatttctgtgaactcatcaaattatgaactttaatttagaaacataaaacttggcacttacagtagaagaaatagctctaaaaattcatataagaaacaatgaacatagagcaccctccaacttataaaatttgtagaaaattcaccttaactgtttttaaatgaattaagttccagaatgttcacaaaatcatactctcatttgtcatgaactaaaacttagcactctctgtaataaaaatgtcaccaaatgtttatttaataaaatctataagtaattcattttaactccaaatgtgcaaaactaaaatttattagttttatagaggcatgtacattagtctgtaaataagtcttagaagaaaacatatctagaaacatcactaaaatttgaataatgagttaatattaaagaacggtttagaaatttctgaaattcgtatcaaaatgaatacaactccaaatgaggtgattcagttctgttagattggcaaaatcatgtacttagtttttataaaataaaatatggcacttacggtacccaaaacatatctaaaatttgaaataactaataactactatagcatatcacttagcttgaaaaatttataataaacatatcacttagcttgaaaaatttataataaaatcattttaactctaaaagttatgaaaccaattttgttgtacacctaagaacattaccttcactgcagcaagccaacaattcataaatcatggacctaaaatgcacctaaaggataatagagcttaattaatctagtgctagtattaaactttgaaaattaataactctcaaatgcaaaatgataaaataaaaattctttcacctaaattcatcttagaccagcactaaccacactagtaaactcatacattttagagcattttagatttttgcatgttttggcatttatcgttaccgttatttcttttagatggcaaaatcgttatcgatgaggggtccgacatgaactttatctgaacaaggaggatgataatgggctctgccgaaagatgaaggaccctaaatggacttgtacagagggttgaagtattgggcctggtcagaaaataggggaacttcgatagacttttactgagaaattaatttctctggcctagaaagaaaaggcaggtaagctagacttctatagaaggattaatgtctgggcttgaacagggaagtagagggggtcgaatatactttttagagggaagatggtgcacaggtaggaatagtcctatttttatttttcttttcctttactagcaaaatgcccgtgcttcgctacggtgtattgaactaaaaatatttgtttttaagcgaagttattttcccactgttttggtatttttttgctcgctagaaaaagtctcaaatgatagagagaaatatagtacctcataataaattattattcaatagtgcgttgcaacgggaaaaattaatattattaacttagtaaagtaataaaaaaagagcatccacgttagctcttatagtctagaaattctcatattaatattatttaattttagtctaaatttaaattctatatcatgacaaataaacaattacatttttagtcgaaaaataaatcaatatcttgagaaaactctagccaaatttttagttaattcagtttagttggaattaaattaataagcagtaataaataattaaaatggtactaatgctatttctgaaaatacaaagatgcttaaaattactgagagagaaaacactaattttatcccatcccaaacttacaggcccatttggaggcccaatagtgcggcggcccaatgtgagaggagccgaaggcgtccgatcgaatggacggtctagattgatcccaacctataaaaatatctgcagccaaaaccctaaccctaaatttcatttcctccctgcccccgatcccctctctctctctctcgatcgaaaagcgacgacggcgccccgaccccccacgagcgactgtggcggtgcccttcccccactctccacgagccgctgcggcggtggcctccccccaacgagcggctgccacggcgtcctccgccccgtctcacctccctcaccggtagccgctccctccggcccatctcgcctccctctccctctcgtctcctctcgcagtggcggcgggttggcggcggatttgaggatggtggtggcgtcgacggcaggtgtgggcagatctagcggcggcggctccctccgccccctctcaactccctctcgcggcaaatccggcggcggtggctggatccgtcggtggtggcggcaaccgtgggcggattcggctactatattttcctctatcatttgagactttttctagcaagcaaaagtaccaaatcagtgtacaaataacttcggttaaaaatatatatttttagttttaatacaccgtagcgaagcatggatattttgctagtaagataaaatgcacggtagatgaagagtcgatttggccaattaaaaacctacttattcatctgctttgctgcattgagatttgtgaagatagagctgatttctgtaatttcttacgtgggtccaacaggtgatgctagcggtgcacttcgtttttctgctgcacacgcgtccacccgagccgagagcccgagagagcggcgcctcgaattcctcgattcttccgccccgctcttatcctttccctttccttctccaatctccaccgcccgcttatttccttatctcttccgcacgcgctcctctcagccggcgacgccatccctctccctccaccaacgacgccgctccccctcctgcttccctcaccaatgacgccgctccccataccccttagccgccctttcccggcggccggcgccctatccttatctcctcgtttttcccgatcaatttctcttcctctcactctcggtctttctctcctccgctgctagtcctctcctcattgcgccttctttcctttccctctttttcttcttctctccacacttccacagtcgacgacaccctccatctccgtccctcccactccccccacggcggcgtcgctccctgtacccctcagccacggcgccctctccccagccgacggcgcccttcccctggtagcggcgccctacccttggcggccagtgcctccgccgctgcgccctgcccccggccggcggcgtctttcacccggcgagcagcggtgcgcaacgggccggggagcggcggcccgcgaccaactcctcggtgtcggcggctctctcctcccgcgagcggcaacgtgcgtcggcgcctctccgcccctcacctcctctcccttgccataatgccacgggagggctcgacggtggcgggcggtggcaggctgcggcgccggcccttccggcgggtagggaggcggtgggcaggggcggtgccctcccctccgccggatccagcgggagggaaggggcggcggccgggcatcccggatccagcgtgaggggaggggatgggaggagaggcggtggcgacccggcggacggcgtcccagcggcggcggcgccctcccctcgccggatccagcgggaggggagccagcggcggcccgacggcgacggcggcaccctccccttcctgtgtcggcattttttttgtttttttagggaaagtgtcggtattttcttgtgttcttgttgataaaaatctgttcaatctgttcttgtcttcttgtagtagtgttttttctaggatttgggtccaaatttgatgcgtactcggattaaggcgcacgggggtaggctgtgaaggccagtaccgaggttgccaccgtgacctttttctttcttcgttttttttttaccatcggataagggttgaagcgggatagatcgcacgcgcgcgtaggaaggattttttttgtgacggacgaaacggacgatcggaaaccttacgaattttttaagtaggtatagatttctattttctttctgttactctcgatccttctctgctctgtctctgtctctgtctcacttctttctctgcctttttcctttgctctgtctctgtttcttttcactcacaggagggggatggaggcttggcacatggtggcagtgggttgaggccggtcggctcagtagggaaggggagagaaaatccaccgggagaaataaaattgattcctaaaagaaggggctgattaataggtagttttaattatttgggtgatgtgtttcatacgcttggtgagcataacagggaagggaaatgggcaactaaatatcctaaaggctactgcacaatcaacgcaatcaatacaacgctgcctcatataatgaaaattcgtaacatgaagcggatcatgctcaatacatcgtctacagcatgcatctaaggtctttgatcggttagtatttgggttgactctattatattatctatctcttcattcttaatccttataggctgcataggattatttgaatattgaggtgagttgagatttgataaatacatttttcaaaaatacttgggatagggaagagcagtaagaatctatgcttttatcaaaataatttttcgcaaataattgtctaaagggtaatgggctatactaaaccaatcctagatcttaatggtggtcgcaagggtccttaggtcctgtagtcgtctagctcaagtaccatgtctgtagggacccccggttttatacaccggtaatcccatgtgttaggtagggaaaactccctggatcagtaggtggtacacgcatagcacataataacatcacaactgacatcgtttacaaatgtttctacaataataatataagggtaacctcattgggtcccgaaatagaccaagcatggtcacttacaatccaaaataccaaagcaatagataagagtggaagcgaagcagcggcggtccatcgaactccataagcaacaactggtgaacctatggtccctaatccatcatcttcaacacgtacttgacaacagcatggcataaatctaatcgacgccaactcctttctaaaagatttaattaagcaagggtgagtacatacgtactcagcaagtcaccactacaagatgaatttaatgcacacaggggtccaaggatggcttggtttatttgcataaagctagttttcacaattcatttcacaaacctattgacctagcagtttgaactgaaaaacatcgttattgttgaagttgtaattatccagggttcatccacctccccaagcctcgcttggctcagtttaccctcacatttcatcttataccaactccaccatatatataaaattatagggttcgttttaagtttatatctaggcctttacctttccaacactgcactcatcatcacattcatacaaaacctacccgacttaggtgccgccccacgagatcttcctaatccgccggtctatacccactaaagaaatgcggtcgtactctgttcgtttcctgtatagcttcctaagtcaatccttaactgaccagggtcggcgactaaccgtttccagacccacccatattctattcatgccgcctaagtcgaaatagttttgttgtattaagttttagttttcgcaaaaggtttgtgtgtggtgggtggcgctcatgtctcaacccgtaaatcatcaatcactcacatcgagtgatctcacatccatagtcatctagcataaatatggagtgtaagtatgtctacaatagcattaataagcattgtcaataattgaccacatataaataaatgactcaggtattcaaaggcatacaatatgtataaaggtaatcaatatcaagggcaggctacattcaattgtaggtacgcaatttataaatagcatgcgatttatttgtaagcaaaacatttagatcaatatgtttaaggtagggagcgtaatgacttgcctttttttttttgagagggcgtaatgacttgccttgctatcggtactaatggtcttcgaggtatccgcaacagttagacaattagaaaactccatatgcgatcagcaatagaaaaccatatagaatcctcctaatgcagtactgaatacctcaaactaattgtgccatttggtagatcaagatttgagatgaattccagaagttgaacgggtctaatcggagttacggtttgaatttccaaagtctaaaggtttataaaccgaggagggagtaccatcgggaagggaggtgatttagactttctgagaggactctgggttgcataaaggaggtagtgtggactctggtggatgtgggtggaggctatggtgggctctatctggttatttcacctatagactttcataaaggggacatcctcatgggttcggcctagggaagtataaggaacttgttcggagggatgaaggatctagtagaaggtacatgtaagtgactcctaataagtctaaaagttggtttaataagggattaaggatggctggcccacatgtcattgagctactataaaagggactaggaagatcgtcactatgcatgagggattgattaat

SEQ ID NO: 59933 - DNA, 5700 bp, Oryza sativa
tacatatttgttagttatacgagaccataagttgcatgcctttctatcagcaatgtaaaaatatttttaatgctatattttctatagagaacacataatacctaattgggtaccacaaattgaaatgacatttagtagcgttgttgaggctcaacaattttcgaaccattatggcggtcaaattggttttgatgttagaaaacgatttgagaatactagcaaacttgatggcaaggctatatcagctgaatttgtttgcaacaaggaaggctttagaacgaacgataaaagagatcctttgataaagactcctcgagctgtgactagaactggatgcaaagttcatatgggagttaccctaaatcgagtgctaggaaaatatgagatacatgatttggttcttgagcataatcaaatacttcaaacccttgaaacctgtcacttgttgccatcacaacgacggataactgaagtgcatgattactacgttcagactccctttgaacaaaggatgaacgaaggatttcttctttctttttgcatttaaatcatgtagaaattattcctaaatgactcttggaacaaaggattgcattctattagaatttctttgaaattccacggtccatagatattttggaagaaaaataacttcatgtttaacctttgaaattttctttgactgctatctctcatccaaatactactatttttactactggagaaatgatcttcgccgggttgccaaaaatctacgatagtcccggttcaactaaaaaccggaactaaaaaccatttttagtcatggtttaaaagtgcagcgggactccagaatctttagtcccggttggtggttctatttgtgtcagacgatgtcaggacgccagagatttattgtcccggtaagtaacactaaccagaactaaaaatccatctttagtcctggttggagttaccaaccgggagtaaatatttatctcccatctccgatcggttaagtccaagacgagattttcttcctcaccgagatatttagataagatcggatcatcccctctcctcctacccttcagatccccttcctcctcctcctcccctccctcctcccctaccatccggtggccggtggcagcgggcaggccgtcggcgccggtagggccgcgagtggcagcggccggcggggccgcgtccggcatcggccgacggggtcgcaagcggcaggcgccggccgtggcgagcggcggcaggcagcggccgtggcgggcggctgcggtggcagccggcgggaggggaggcgggggcgcgcatgcatggaggccgggtgccctctcctctgccggcgtccttttttttatataatttgtgattcactgagatgtataatttatttttttagaatttgtgattcattgcatggatctgagatgtataatccgtaatgtatttgatttatgcgtattttttttaagatttatgatatattttatttgtgtgtataagtaacttaggatttgtgatgtgaatgatttgggatgttattttgatttggggatttggggtttgatttggaaatatgcatggcactcgatttgggagaaaatacatggattaactatagcaagtagcaaacaaacaatgacaaagaaaagaagaccaaccgggaatgccgctaccctaccaagactaaagattcaactttactcccggttatttcatccgagattaaaaatgggcatctttagtctcggatttgtatccccagtttgaaaatcgggactacatggggttcccaactgggattacaaacagtttctccagtagtggtttcttgcctatggtttgtccaaataatcttttatgtgttgttgtcctctattttgcatatatgttcgtaccaaaatcctgtaattgttttctattactgtgttttattgtttgtacgttccaaaggagacctcaatcagaatttagataacgatactcatacatttttaatagggatttagtaaaatttacggttttatcactggcagaatttacaaatgtcagcacatagagtcatcaaattaaaagatgacttacaaattaagctaacaattaagatgactgcacacacagtcaaaagcggaaagtagttatcttgtggttttccttcttttcaagtagttatgtgttacctttatacttttcattctttttaaaagcggaaagtagtactatatgtttatggttcgtacaaaggttgtcaatgattttgcttgcatgtttcctctgcattattgctcgctcaggtggttgtgattcgccttgttgccaactcctgggtagtatagcgatctctgacatctgttttgaaagcgcgaatcacagaggcatcggtgatatcggagatcgtatttctgcactcattaaagcgccaaacgtagtccctcaaagattcgcccggattctgtgttaatgcgtgtaaatcgtcttcgatcgcgtggcgcttgtaagttccttggaagttagtgacgaattgttgccacaaatctggccatgaagaaatcgagtagggcgggaggtgcatcagccacgaattgcagaacctttcaacgctgttggcaaatagtttgctaacgcgttgtcgtctgccccggcagtgtatagtaccgtggagtagacctggaggaattcttctggatcagtactcccatcgtacttctctattgctccgggtcggaatctctcgggccatcggacatcatgtagagaacggttgaaagctctacacctggcgctaggggcggtgggttgtcggcgatcgtgtgtcctccgtggatgtctatcggatgacgaggatgaagacgatgacgatgatgatgatgggtcactcagctccggtgtccgattccgagggcgacgttcagtttctcgagaattctgtcgtcgtccaccattgttgtcctggcaccgatccccattatcatcaccgtcatgtcggtgtcctcgtccagcatcgtctggcgtccgctgttcgcgagcgtcacggtcgtggcggttatgacgatatggtggtgttggtcttcgttcgagtggcctcctcgctcttcgttctcgcgacgtcgtgaagagacacgatgtcgggaacgattctcattatctcgcgcacgtcgtgcttctcggcggccattcagatggtcgcggagatcgccgatgccgcgaggtggaggggtagctcgtctaggcgacatccattgctccggtgcttcgccgtcggcaccgccagctgtcggatgttctggttgtgctctggtagcggcctcctcgaacgcgttactgagattggctaccgattcccatagtcgttctgtccatcgtgcgagatcatcgttaagtacagggtaatagggagcttctctcagtattgcgttgacggtgccgaagtgttgggccggcatgaccgcctggttctccgcctctgcgttagcgtgcgcagacgtgctagtcccaccgatgccaaacacgtcgcgtggtgtactggaagatgatgagccatagtcttcgagcaagtgtagtactgatggctcatggggatcgatgtcgattactccaacgaatcgatccgaggtcaacgtcgctccttattccttgtctgtatccttaagagaggttcctgactgctggaccttaggaagtggcgttttcatggcgcggagaaagaccttgcagcttgagaagtcgtgatttttcgtcttgtgaataggacaatagacatcacgagttggagaagtacgctggattccacgctctttgcaagcacgaatttcagcttgtacgttgagaaaaacccagcaagcttgcaagttatgcttcctggacttgtggataggataccaggactttgttacctcgaaagttgtccttgtcggctcgtggttcttgtcggaaggacaaggtttagccgcactagcaaccttctcgagttcgtatgacatcgatgttccgttctccactacggcgggaggatccttcgacacggggtcgtccggggttatagccacggcgctctcgtttccggtcattgatggaccagccgagattggtaccgtggtgtaaaccgggaagacaatttcgccgacttgagtccacaccagcattgttgaagtagggactccttgaatggggccggtgttgatgccgttgtcgacgaagcttgatgtcatagtagtagaaccttgagcaccaagttcccctacctggcgcgccactgtcgacggtgggtacccgtagaccggatatagagggtattggggtacgctggtacgaggatctacgtagtatgatatcaagaaaacaagagacaaagattatactggttcaggccccttaataggtaatagccctaatccagttgatatgggattatatggagataaccacaaattacaaagggaataatagaactcaatgataccgacgagatcgtagtcgagttgattcgactagatcacccggcgacttggctcctgtagactccgacttcataggctgtggtcgttgtgttggctatgagattcgatgccttaggtccttccgggggtcccttttatatcgcaggtcaggtggtctccaagtaggactcagagacatcggaccctgcacgatatagtaacaacccagtcctatacgggtaggaacctttccattggtgaacttcgtgatgaatttccttagcgtatacagagaacgtccgtacacgcgcagatgtaccatattgccgtatagcgtatatccaagggtagagggtataccttattcgtaaccctgacagcaattacatttttttcatttattctattggggtgctcgtcaagtagtgggagagttcatcgaattgggatacccactgcaacttaagctgtcatataggcaccggtggattggaaagtaacggccaagattttccttggaacttttctgacaaatactgtagctggatgtttcctgtagcgaacaccgtagcaaatactctttagaaccgatgtggcacagattttaaccgtggtcgtatcaaggtgaaaaatgattccgactgcttaagttggagtccctactatagctgcagtcgatccttattcgagttcatcacggtttcgagagacaaacaaattagttattataaagttaacaaactgattaatagctcaactggttaagtttttttaaggaaccaactcacctggttcaagtttaagatttgacacgagtacttttatttgtggctaattatttttttataggtgatgtatccgtcgatagtgatacacctgtgattacttcgtcaatctcaagatataccggtgtagtcttccggaggtgcatacagggatgatgtgtgcatgtgtgcattcatagggtgagtatacgcgtgttgtgagtatttgtgtttgtactatgttaaaaaaagtttaacaagttgatttaatattgttttttaagaaaatactgccgaacaaagttttaggacaaggcacatcatttagtagcatgttaagtactgtgactatgataattcataattaaagtgaacgcgcctggaggttgcaatcaaccaagttctagccaacggcaatatctatgtctaagctatagccttgactattaacagaactgctggtcatgtcaaagaattagttaataataatggaaagctgagag

SEQ ID NO: 59934 - DNA, 8425 bp, Oryza sativa
aataattttgtatagattgtttacttatattttgggcaaagctagaaaggacgaagacaaaactgaggataagaaaccccctaaaatcaattccaaaaccaaatctaaaattcaaaaattttcaattgcagacaacgatactgatctgtgctgctatcgactaattctagttcgtgctctcttgagaaaaaaaaactttattttaggagggactcatgtgacactggtagtctataaatagcagaaccctcccaatatgtagcattggattaataacaaaagtaaactaaacatactatcaacccaacaatgattgagcgatataccattgaattattgatagcacatatcacatgattatttacgcgcgctatacttcttaattataactagatgataccccgcgcgttgctgcggaaattgctagataaaaatataagtttatagcaattagcatgctaaaaaaatttatgactaacgacttgaaaattttgaacatacaactccaatgcagtaaaattttatctcgcgaattgaataaaccatacgtaattatatttgtagtaaaatgaaaaaataaaattgattaaaaataataaataccaaaaaggcaatggagcttaaagcttcactgagccataggcccatagctatgcaggatctcttggatttgatgcatcaacagctagtgccatatgtgttcctacaaagaagttttttccaggagaaattgtgttcctacaaagaagctttttcgaggagaaattcggcatcaattgcgcagtccaaaaggatgtatgtacagaagtaattaactgttagcagtaaaagcaaagagaaattatgccgaatctttatttgatataacatatctcttttcgtgtctggcatatgtagctgtatatatggacagagacgctaaaactttactgatctgaattcagaacgtgacacacctgaaggagcaggactctctcacatatcagttggattttatgtagcagacgatagcctagaaaactttgagctgaaatgagcatttcaggtagtgaattgcaacctgcactattgaagtattgagactaaggaatgttgacctgtttcacagaacatggttagttagcaaacttacagcagcaagtttaaaatgtgacaaactaaaggaaaatggtataagatggaaatgtcagataagatatgaacaaataatatttcaatggaaggtagcgtctagtgagacacatacttatgtgaacctaattaatggtccgtaaacatatgaggtataaaatgagcattataaaagcaaacagagtctgcattagttaaacagatcgagattatggttggaacaacagatacctattagtgttatcttacatttgaacccaatatcttggaagcaaggcagtaacatgagctatatatgcacagcagagagacaattaagaaggatttgagcaaatttccatagagcagaaaatgattcactcgttgcaacaatttgtctcaaggacatgaatataagaatgttagatctctatcataccttgggtacaatctggtcagaaatctgcatactataaagacatttgcccacttaaattaaataaataccttcagatattaggagaaaaacaattgtgtatgcagaagtataaaattgtgctgaaagcagcaattaccacccataagaacgtaccagcaaatcgcatcatatcatcaaccaaaaatactgttcttcttaccactttcttaccggataactgaaacatttggtccatatctaagatcagatatgccataggccaggcctggtgactacatggtgcagtactttacaaaataatatcattgatcttgcattggccaccgatgagcaagaagaaaaaggcaagattgggatccatggtgcatggtgatgccgcagacgaacattggagagagagagaggtaaggactcaaggtccttgaagtactccattatcatgtcttggcaataaatctgatgacagaggtcagagaagactggcatcgagtgaggggggttaaaagaagataaagtggaggagcgtcgagttgaatgctccttccatttgtagaagtggaggcagggcatgcgccatcagtttcacgcgagggagatggaagggggaaggtgaaacgaattagcaaaagattgggtggaagcgaggaagggaaacagccctgacggtcagggggaggggggggtggcgtgggtggggaggagaagcggcgctggcagagtgcgccagggatgggggaagcgcgacgcggcgacgatgctgggcccgcggctggctcgcgctagggatgagaggagacgcgatcgtggccggctagcgggcccgcgctggcgcgcatgatgggggagaccgggagaggaagcgaggacgtcggcggagggcctgcgtctggcacgcgcgcgatggggagaggaagcagcgcgtgatggaggaggcgaagcgggacgcagcgtggatgcggtggaggggcggcgacgcgagatgcgggagaggagatgtcatgcctagaaattcactagtaatttttcgaacttatttgtgcattaaatcctcgtccagaaatcagccgaggtatacaaactgacaatttaatatacagattcatcaaaataataacgttacatacttacaaaagaaaagaaaactgcatcggaattacggtctagcgaagctccggctccactcccacaggcagctcaactggggtataagccaaacgtcttctccttcgcaacttgtcttcaactgaggtttgattgattattgcaaggtgagcatatgacatactcagcaagccacacaacaaatatgcaagtgcacaaggataccaaaggatggcataatatagggctcatttgtaaaagcagcatttagcaaacatttgagaattgtaaaacagtagagtacttaatcatcaatattaatcaacactgaacagcacatccatactgcttaggcccaaccatcctgaacaaccatacccggttgcacagatctatctccaaactagaaatgtaccattccaaaccaggagctaaattaattaccatcaattatcacgttattattaatgagtagtgtgggactaatcacgaaagatattgttagacccgcccaaaaccgcgggcacggctattcaaatagttttactctggctagaggtgtaccactgtacccacaagacacaacccaccgtcatgtcaccgcatccgtgcagacacgtcaccatggcgagtgattgtgacaagacccctcgcataactcaactcaaagcagtgcaccgttcctggatcataatcacccccttaaacaaggcatggactccccagcgatccccatgggcttatctccgccacttcttagtctggtgctccgcaatgagccttgttatacaaagtgtctagccgttgcccactctggcttgtggttggcacggttaatgtttcacaaccgaaactcgtgaaccggtccttaattgtcatgagcacgaccatcgaaaccatgtgctcacaacccaccattatcaagttttagttggcacattaattaattaaccaatcacgattaaccatcgtgagctatcattaaatatctatcattaagtaatagtgaaacattagtcatcccaatcgtgtgctaatgtttctaagcatggctaagcaattatgtctaacatctagctgaaccaatatataaagttcaactagtcaaattataataacccaaggtatcaaggaatagagtaatcaatgcaaattggccatacaaaggaataattcacaccacccggtgacattcgaaaataaatgcacagttgaaataaatagagaatttaaatataggatcaacatgctcaaaggaattgtgtttgggatctgtgtaacttgccttgcaataatgggtcttcaattaatcttcttgaacacttccgacgcactcgcgaaccttcgaaacgacgaaaacgacaagctaaaacgcaaaacgaggaaaaagactaataaaaccaaataaacaaaacaaacatgtagatcatgattttagatgaattatgagtcttgaacggcctcattctgacttcatatgaattaattacgaattttacaagatttaatctaattaaagcccatttaaaaaggattaaataaatttaattcaatttatggataattttaatatgtagatctttattttatagaacttttgcaacttgaaccacattaaaccgagttacaatgaattagttatgaatttttaaagattaaaccggattaaagcatttatatggattttaattgaattatgacgcaataaagaattatttttgaaaggaaaaagggatttattgcgccatcaaagacggtccacggtagaccgggtgcacagaggcggtctgcgaaaccaatggccgagatctaatctaagccaaacggacggccgagatcgatccggtccaccacgggtctacggctgactaagcactgacgtcgatgatgacgtcatcaccggcggtggctcggcacaccatgctcgacggcgaacggcggcgaggcggcgcaaacggagggcaccaacgcgtagagctcggcccggcgaactcaccagcggcttggacgacggcaaacgatgacggatgacgacggcggcgaggttgaagcggcggcggtcttcaggtcggcggtgacggcggtgctccggcgggaaacggtggcgacggaggggtggacgaggtgctgctcctcctcgcgatgccgatggtggcgacgacgaccgaaggcggcggctgcaacggcggcgtggcgcggctggatcgacggtagcagtggagagctttgggtcaacggagtcggcggcgctccgacgtgctacggtggcagcgaagcggtggacggggaaggcgacgacctcgcgatgctaaagaaggagacggcgatcgacggcgacgaccgaagcgacggcggcgcccgactggactcccgccggcggcggcgacgcaaagaaccacgcggagacggcgctagagaaggcggcaagctagggcgaaggtggcggcggatagaggaggtcccggggatccatttttaggggctaggaggcggcgacggaggcccatggccggcggcaaggagatggaaagttttagggttagaagagagagattgatccgaatcgagctcaaatccgtcggtttccaaacgaaattagcccgggattcctaaagagaaaaggaagaggagatcgaggagattatttcccctcaatcaattcggccgaaggaggaaggagacggccggattttagaaggagatcggcggcttgcggcgcggctaggagcggccgaaggttgaagacgaatgacaggtgggccccacctgtcagcggcaccgagagagagaggagggagggacggcggactgggccggctaggccggacgcaagcaggccgaggagaggaagagagacttgggctgactttcggcccaaagctaaaagagagattttaaaacctttttctatttaaattattcatgaaatgatattccattgattaaaaatacttccttggctcaaataaatcccagaaaaatctatgaactacagaaacaagagaagtatttaacaaaattttatctaacccacttttatattgagatttaacaaattaaaaattagatcttctcttttaggcttttaagattatttctaaataattccttttagacaacaatttatattttaaggatttttaaacaagaaaagcactgaacataattataattagatcattaattgattaattaattaatttagggattgagctctgaaaaatccgagaaaatttcagagagtataattaatcatggagaatttaataaaatttaaatccatccatgttttaaatttaggaaattttatttcccacatttaacttcacttgtaaattaatgaacatttaatataatttctattaatagtttattaaataatttataaatcctaaaacggaaattcaggctgtgagaggagaggaacgatgcggagaggagcgatgtgcgcgtggggccggcgaagccaagatgcgggagaggagaggaggggagcgatgcggggaggggaggggagcgacgcgggatcaatgcgcgtggggccggcgccgcaacgagatgcgggaggggagaggagaggagcgatgcggaggaagggctcgatgcgaatctaacggtggggacaaaaaggggtgacgtggaagcaccaggaagcagagaattgtagtagtggggatgatttgtataggtatataggattccttgtaaatacactacagtgaagtagtaaatgcatgtctcagttgtaaataagtttccttgacactaaattaattattcaaattagaaaatatggccccataactataaatatataacgcactgttggtaacgcacaagatcttgttagacattagatctatgttagaatataaaaattaatgctctttagcattcgataatatttttatgttgtgttgcaatggttgatcccactcatattcaaaagaggaaattgaatttaagcagtatgtcctctatttcatactataaaatgttttggttttttaaatagattcatacatggatcaatgtatgtgcttcatatgtgtgttcaaaaaaactcatgtgatgttggtgaatatagacaagggatgaagaagataaaattaaaaaaatgtttctctaccctataccacaaataatggggtcaagacttcaaagacaaatgccacttatgtcacatcattgtattttctatctatataatcacatggaacacctaaacaccctctagaatccttcgcatccatataccccaattcatctgtgtcctccccacaacggtcgtcatggatatatcaatgcagagcttggtacactgttgtgagtatcggacgttgggcacaatggctgaaccgacatgggccctagtggggagtcggcgttggtgacagaggtcaactagatatatactggctcattgatgcagtcctctatgagtgtgatgacgatggactaggcacccgatgcgaaccccggcaggaacttaacaaatctcactgaggaagttggtccccaataatattttgattctagcattataaatttttaaaatgcatttaagtgaatttataatatttcattaaaaatattagatgcacctgcatataatgtggaataatgtgaagataatgtgaggatgatgattgacacgatatgaaatgcttggagtaataaattgtaaataatgtgtcatggttgcgtgagctttaaaattctctaagacaaataattgctagtgtgtgatgatgtgccatatttagtgatgaaaacagattagaaacatatagaaactagctctaccatatccgttgtcatattgtttttctgaattggaataaaaaaacatggatacaaaaatggaagtgaatattatcaaatactgatactgagcgaatacaaaacaaaaacagaatgaatacagtaacaagtatttgacaggatataaaacccgttaattgagcttccttaatctaggaagagatatcgctggttattttctttgaaataaaaggtcactatctccaaaatttatatcgtcaaatttataggtgattgtaaatatgattatccacttcatagtcccaagatgtcttatttgatgcatagcttacttaccatatcatgtatgttcttgttgtatagattgaaaatgttattcactttattccgtttcaagtttttacactttaaatattttaaattataaatgtcataaactatcccattcaactctacaactttcatatagagtttgtttccatcaaatgtcatttgaattgtacattacagattttgtaaaagcagatatgatattttgtaatgaatatttagaccccctaaatgatctcaaataataaagtcttcagcaacaaagttgtagatctctcgtcgagctctacaattttgatgtaaagtttgtattcatctaacttcatatgataaagttatgtatatctatgtgttttttaattaattaatacttgcggtctacggatatctagagaaaaatccaggatactttccgaccgtttttcaattccgatggatagtgtccttactgtattcggttctattctgagaaaatactcagaatttgtttctatatccgaaaatatttggaactatctaacgaacctatttgttttaaaaacaaggtccgaactgacgaaaaatatgtaccaatttcatctctagtcgttacatgttaagatttaaaagtagtgggtactaattatatagaaggtatagatagattgagtatggggggtg

SEQ ID NO: 59935 - DNA, 1654 bp, Oryza sativa
cccagagagtgtccgagtcactgaccaacctgctgaacttcatggaatctctctcgttcatagttgggtcatcaacgtcacgtaacatgtcttgcagcatatcagggtccacatcaaccatttcaccgcccaatggagatgggacaaacatgtcatgctcttcttcatctccttcttcgtgattgtctgcaccacttctgtctgcagttgcaccatcagtacccagatcttgctctccatgcttcacccaacatgtgtgtctctccatgaatccccggcgtatcaagtgagcgtgtacttccttttcatcgtccaacaaaatatcattcctgcaatcgttacatggacaacacatgtacttgtcgtttcttcttatcctatcttcctctgcggctttcataaaacttaatacgccatctctatactccttgtactgacgcctcaagtcagtcgtgtacatccaacttcgatccatcgctgaacaatgaacaaaatattagttaacatctcatgacataagtactactaaattaataggaaatgattagtacccttttgtttacacccaaatttggcacctaggattaaaataggaaagattgccaaaatttggaagtcaaccggtttcctccgagtgggccggtctgaccgccgtgtgttgggcggtcagaccgccggttgagggtcggccaaaccggcggtgtgtagccggtctgaccggcaggtccgagtccgattgtgtttcgtcgggtctcgagatttccttactcgggaaggcatgtttctggtttcctttggtttctaccccgagttagacgtggaggagggcctgtagagggcaagaccaacctctatataagggacatggccggttcattgtaaaaaccaatctacaatcaatcaatcgaatcgtttttcatattgcttttagttttctcttagtttgtccatctttatcgatttgcgccgtaaaccgtccgccgccgctgcgagagtgcgacacctctttgtaggtttgtcctgaaaaccttccgttttgcccacgagacgggtagttatctagaaatcggctccgctagccggtttagttatcaaaacccatctaggtttagctctttgctagatcgaggtggttggcgactttaggatcaccgcaaggcttaaggtgcttcgatcgtgcttgtcaacttgtcaaaaaaaagttgccaacacgttttacttacttttatgattttcctatttttgtttgcaaaaaaattacaaaaattcgcctccttcaacctcccaccaaaatagtgaacagtgggataactacagacaacggactgctggagtatatatagtgtgcaaagtatatctcaatcgggcaaaaaaaatgtcatctctaacgggcgcacactaatctctaacgggcagaaatagaagcccgacaccgataagagtcatcggtgacgggctataggaatatgcaccccgacgagtacattacaacggcaaaaatttaggcccaattgagatgacttcgttctgacggcccacgttgcccaggcatgtaatgggccgtacagatgagaggatctgtgtgtaaacctaccgccaacaaatactagccatatactacataattcttttggtttcttttattttcaaaaca

SEQ ID NO: 59936 - DNA, 2681 bp, Oryza sativa
ttgtgtgaaagatctagcttactgaggagctgtaggccactcaaagcagttggtatggtccctggcaaactgttataggaaagatttagtacgttcaagctttttagattgccaaaatatactggaatgtctccagtgagaatgttttggcccaattggataactaccaagttttggctttgccccagagcatcaggaatttccccagaaaacttgtttgatgaaagatgtagttcgaccagttgtttaagatttccatctcctagatgtatgttaccttggaggttgttacagctaaggtctaactctgagagcttcgtaagatggcctatgttaggtggcataagacctttgaatttattattttgtaagaagagctctgtcaactgagtaaggtttccgatggagggcgtaattggtccgatgaagttgttctcacggagaaatagaccttgcagatttttcaggtttccaatccattctccaatttcaccacaaaaactattgctactgagaaagagtctgattaagtttggaaagttccctatacttggcgggatcgttccctgatatgttatttccgaccaatattaagtgctgaagattgattgatagattaccaacggaatctggtagggatccctgcagattattataagctaatgcgagcacagttaaagaagtacagtttctcagcgcatgtaagaattcccatcctaggttttcattcgcttcaagcttgttaaactgaaggcttagtacagacaaatttgaaagccttccaaaagaggtaggaatttgtccagcgaaattgttgtttgcgaaatctataggtaatagcgctgaagcattgcctaccgaaggtggaatctgaccttccaaaatgttttgactcaaggatactatttggagatgaaggaaggcatcatcaaaggttgtgtttggttaggcttttcaacctgcttttgcttttgcaaaagccaaaagccaactaaagggcccaaaagccacatctatttttgcctaaagccagtttttggtgtagtacaaatcaaaaacatccctaattaaggtccggcagtaatagttgttggaaccttcatattcattccttccaaagagaagcactacaacttgattttaagattgccaatagaagatggaatttgtttaatatgtagtgaaactgttatcttcgagcaatagccactctagttttgctagccttccaacccatccttcaattgtaccacttaaactgttggtatctagtgcaagtgtagttaagcctttaagtctccctatgcttgggggaactattcctgataactcattaccacctagatataactgttgaagatcggttgataagttaccaattgaacttggaatagatccttgtagctgattcgcagctagtgagagaacttgtagaagactacaatttgttaatgcgtgaaaaaattcccagctttgatggctgttactagcttcaagctggttttcctcgagatttagatgatacagattacgaagcttaccgaaagaactaggaatttctccattaaaattgttgttttctaggtctagtctttccaaccctgagatatttcctacggaagctgggatgtaactttcaaacatgttatgatttaacataagccattggagattggggagggcatctccaatattcggtggcagtgtagtaccaaacttattcaattccaaagctagcatctttagagaagacatattaaagaggacatgtggaatttcacctgacaggtcattgccacctaggagcaacctcgacaaatgtgacaaattccctagttggtcaggaattgttccagtgaagtgattagaagctagagctaatctctctaggtgagtgatgttgctgagggttggtggaataattccagtgaaattgttccaggaaagccgtaagaccaaaagattggagaggagatctagtttgaggggaatttcaccagccatgaaattcttagacagttccaatattcttaggctggagcaattgacaagtgtttccggaatcacatcttgcaatgagttcgtgctcagattaaggacttgcagcatatgcagatggttcagaggaggtaacaagccagagaactgatttgtggacaggtccaatttctcaaggaatgttaggtttccaagagagcttgtgattacgcccgctaagctttggccggagagatccaacgccacaactcgccctggccgagttgggctgcatttgacgcctttccacctgcacaacggggtggttctattccaggaactcaagcttcctttcggatcgttagtaacggcctccttaaagtcgagcaacgagagcatgtcagtggtgttgtcgtagagctgggagcagttggtttggctagaatttagcagcaatagcaacagtgtaggcatgacgagtttcatgagcgtcattagctgttatctgcagaagataaagcattgcacaatttatttcaacacaaaatatcgaaacgtaaatgggcaattgacataagcatttatattgacgtgcaattcttttcacgaaaaaataagcattggtaagaagatatatgttttgtactgtaaaaatctaatctaaaggcttaggaaaactgcacttgactatcttgaacagaact

SEQ ID NO: 59937 - DNA, 5848 bp, Oryza sativa
cattgcacgactttagatacctgtagaaaagctctatatttatgggtcgtaatatatcatatgatgaactatgtttttattagacatatagaaatatcatgaaattgtcctttccctcaatcagggtatccaacttttcttgtattttcatgtctcgcatctttagaagcttgctccaagttcgcataaaaagatggccctgaaattgacttcaaatggtgttttgagaattttgcttcaggctccatcttgttccatgcttgccacagcgctattgttagatctgcatctcataaccggataagagtacaatatgatccatgcatctcaaaattaatgggaaaccttctggtttctatgaaatcacaacctggaacatggcaggtgcagagggcttggcattaatcacaactgcaacataggagcaaaccttctggttcctttcgccgtttccataggcgagctggctgggcaaaagacttagcccagtatacatataagccctgtatacatagaccataatatgataatgggattaactcttaatttatttttcttaaaaaaacataggacttggtaaatagttagttagaactaacctatatttgcaagtaaggttcaagtaccatgtagaagatcttttggtttccaaagttcagtcatctcatccagtggctagtacatgcttattccacaatattttctcataaaatacacaataatttaatttatgactttgaaaaggactggacaaacaattacttcctccgtttcatattataagactttctagcattgcccacattcatatatatgttaatgaatctagatatatatgtctagattcattaacatatatatgaatgtgggcaatgttaaaaagtcttataaactgaaacaaagggagtagttaaattctgaatctacgtgaaatcaaccattagtttatcatgaaacttataatggcaccattagaccattgggcgaacaaaatattaaatttaaagtaggtgctttctaaagttgactaataattattattattattatcatgcttgcacaggacacaacctaaatgtaggtagaatttcacttccaggttgttacatagtatgatactgcactaagcattataagtttgaagttgataagcaatccacatggttgaacacatctcagaaagttagaatcagcgtctctgaagttccgagattatttgtacattttagtaccaagaaaaatattacctggtttggatggtgccagcttccttgttgataagatctgcaagttccaaaactctcaaattttaacagaggagatacttttacggttttacctttggggagataattgcacctgttgcgtctgtaccatcatttgagggtgtttctatcataggattcaaagtatatatttggggggaagtgaagccaaaacactcagtatgaaatggttagtatctaacctgtgaaaaagatgatcacaataccatttatttggggacatatgttcagatgtcatctgctaaaccagtggaatcatagcttaaaaacaaaaggttgagtagatacattccaatttggttaaatgggtatatacaacattccaatttgattaaatgggtatatgcacaaaagtttgggtggtttctagaaattttgaaaattatgctttggaggcacaattgaaatgctttcttaatagaatttgtgtgaagaaaataaaaaggacttgatttaatgacacagtcaacaacaataaatttcttgttctatcaaacaatattattcctcaacaactcgtatccagtttttaccattcaagaagtactaatgttcatgattcataccttagatgcatggtagcaagttaaataaaaaatgaaaccacaaattttgacaggacgtttatttcataattgtcacttcaggcaaagaccaataacgcaaatcaatattacagtcattgctttaaaactcataacatcaagaaaaagaaatacctgataatacaatatttgattgctttattatttgcttcataaattatcaaaattcattcttaatcagtgaatacacccttcacagcaaaccggaagctaaatgtgtacttagagtcaaatacatttgatctttaatagtcaaatttcatttaagcttaagcaaacacattgtagaattatcttttataggtttccactcccctgcttgctgcagctttgctcgttagacaaacatatatagatacacaaatatagcaatacaccagtcatttatataatgttaggagcaaccttttttttttctaaatgcatgaatagctagtactactccttactttttttcgggaaattattagtattagttatatcccggtgaaccactgccatcgaattgattcagtgagttggacgttgggcatccggaggaaaatactatttcaatccacttataaattcatttgttatcacacatatctttgataactattgaaataattgtatgtaactatttataattaatgaacctgaagttacattttgataggatgcattctttttacagtgctcttaaatgaaatttgcccacccaaaaactgaaattacatgagaggcttaattaaggactccattatagaacttattgatcacctttttagtctaaatcaacttcttagcactaggtgaagccgtggttcctgtacatcgtacatgctttaccaagacgaacaccgtaaggagcaaggagtttagatacttaccacagctgtcgatgttgggactttttgtatttcccttggccatcgtcattggagaagtggcgctgcagagtaggtcctggggaaccagaggcactcagatggagatgcagaagataaggcggcaagtgaaattccgcgtgcatcgccgtcaggtcgagccatacctcccgaatccgaatcagccccaccatcgccggatccagaacaggtaggaggaggtgatgccgcagtagtgttggggatgggaatgaggaggaataggatggggtgtggctagggcagggggaggtggaagcggagaaaggggaggtatggattcctttgcttcccactgcaggctcttcttcttacctctccggtccccattgatgtggtggagattgggaggagacatagcggctttggagatgggactagcacacaatctagcacctccgcctcccggtcccgggagtgggggcggcgtagcgaccagggaaggggaggcggcctcccgagacggtgtcgcaacagatccaggtagcaggggtgaaaatgaaaaatggtaatactagggaggtggaaggatcttattgcgaaagattttgccaatcaatgaatccaacagctcacatcatctgtaggggcaatcggacggcctatgtttttctgatgacgtggcgcaatctggtggcgaaaaactttagtttttttcactactttagatttcaaattaaagtaattaaatcactataatttgttcggttggttcatagatgataaaacaattaacacaaaaaattttaattaaaaattaggtattcgggaaatatatctttccattgcaacgcacgggcataatgactagttttttttaacatgaaaagtacatttcattcattaagaagatcatctgactaaatcattagccacgagaaaatatgttttcttcaactaggaggtcataggttcaagtcctagttcttctcacacatatatatactagggtttggggaaaggggtgagggttgcaaaaacaacccctaaacttctagttttcagagcgcggttcaattttccgttttttcgcttcttcatatagaatattgttttcttaagaggtcctctaagtaaaagcgcacaacattagaactaaggaccagggatctataacaaattatcaagtaaatgaagggtgtttttgcaaaatcaccaacgacgacacggacgtgcgggagctcacgaaaaccacccgccatccagcgcctcgctgacgcgtcggcacgcgcaggtggccacgccagctcaaaaatctccaggagccgcaaatctcggcaggtttgtatataagcgattcttccgggattactaaataatgcattttgcaggtttgattgtggtcatctccgtactgctcgctgcagtgacccttgtttgctgcaccggctggaaggccgccgcccggtggtgggccgcagggaggagggctcgcacggtacaccccatcgacgccgccaccgccgctgccgccgtcgtgccgactgcctaaagaagcatgttacagtatatatagtgtgttgttgtcatagtgtgcctcgtcctatgtgttatatagtgttgtattgcgataaaaaaatgtactgcatgttactgcaataagtatgattgtgtatgtatttttcttgaacaaattatgtatgtgttggtgcccgtaaaattgcatgttactgcagaagtaaacggatgtataggcaatcccaatcgccgtgccttttttttagatcaaaggcttgacgcctgttaacaatgaaatttggtaatcggcaaagacgtcatcggcttagaatcattattggctgcagcatctcggaatcagccgatgggagttatcaagtcgccaatagtcggattcctgctatatttggttaaggaaatcaatgtactaaaggaagcttatccctaagtgaccgagtttaaagaggatgcggcatggcagtttatctattaattaggaatagtttgttagtttccttttatctttaggaaaatgtgtttagtgtccgataagcactttatattttccttttatctttaggttagtttctttcttgtccgacaaggacttgtatcaacccctgggtataaatatgtacacccggggtctatgtaatgaatcttcacgatcaatacaattcagcgcatcgcccaccctttttacttctactttttttttacgtgccggcggaacttggcacccgacgtggggctgcatcgtcttcgatctccggcgaagggataagtccaatgttccgtcggcccaggcaattgtctcatctacatcggcgtcgttcaaggctgcatcagtacattcgacctcttggattgctctggtttggatgatatatttgctacctatttatcatatgtatctattaatctagtcttagcatatcaatttagctctatcggttgcttctcgttttagggtttctgccggtattggctaaatcacgttgctagattagattagcttagatatctaccacacctgaaaactcagtcaaaggcttaattgtctagatattatgtctcttttcatatttagtgctgcatcagttaagtttgatctactaagtcgtgcttagaaccataatctctagcctacttcttgattgccaataagggtttcatcggggtttcagccggtgagttatctggacgttgcatcggctcataaggattgcatatacatataagttgtatttagccgatgacaacaaaggtttcactgtttaatctgatcttgtggatttcatgacatcagacctccagccgatgtgtgctttaaccttcggatcgatgcttatttatcatattattgctagccaattagtttatacaggactatattgttattttattatatcatcatcagccgattgcctttatatcattatctacattagacatatagccgattgcttaaaccatatcgctatcggctggtatcggcatcggctattatcggctatcggctgacattgctccatcggctgtctagccgatcggctgttttgtctgctgtttacatatcttgtcagttgca

SEQ ID NO: 59938 - DNA, 16712 bp, Oryza sativa
  unsure (1)..(16712): unsure at all n locations
cagcccccagccctcattcctccccccacaaatccagtaaaaaaagaagaaaggggaggagaagagaagaaggggcgaagccctgccggattcagacgccgatttcaggtaatattcatagatcctatatgtgactattgagttaaatactgtgtattttttaaaaactttgtttgaataaatgcattatatttttagggttttagttgtactaatctagaagtgcgtattgtagatatcggtaactacgtagatctgctagtttggaatcagtactttaccgttgcattggcatacacaagaagatattacgttgtagatgtttattgcatgaaagagtaatatgatctagttattttgttgacagatatgtcgaacaaacaaatattccaagtttaccatggcctaggaaacgtccgttacgggccaactgtggtagatctgtcagaatttattgtatcaaaaaggggaattgatagactggctgagaggagtgtaccttctataaaaggatggttaatgaggggcttgagagttgatccacagacaagtgacataacaatcaatgttatagtaagtcaggtaactgagggtttttattgggaactaatgccagttcaaaactctcgagtgtggagatggtatgtggaaaatgcattgcaacgcgggtggtctctagctatggttccgtttgttcacccgaaggatccaggtgtgcagatgaacatggatgatggtgagggaccaagtgctgaagtaaatgagacttctgtggaagaggtcaacgcacgagaggacgggggcgtagtagctccagtgggcattcaaccaggtggagtggccgacgagggggagattgtctgtgccattgtggatgaaatggagagggaggattctgacaacgagcgtgtagaggaaggtgattcgtcagatgatgagacggatattaatccagcagattgggctagtgaggatttttctggtttggtcgtctttgaagaggatagtgtgagatgggagtacaaagaaaatgaggttattcagggagcgatttatactagagcagaaaatatgaaggaggcggtaaaacattttgcagtgtcacttcatagagagttttgggttgccaagtccaaccggtcgcaatatgaagttcggtgtgttaaggaaaaagatggttgtccttggagagtgcacgcttataagggaaaatggaaggattattggacagtgtcatttgttaccaagcatacatgttttccgcacggaggtaagtatttttaaggatttttttgtacatgtctcgcgcatctatgtgagtcgattcatccgattgcttcagggtttcgtgcaccgttcagcaccccgccttcctcggctaggccttatgttgtgccccccacaggtacttaaaaaaacaacagtacttcgacaatcaatttacatgcattttatgtcttagcttataagggtcccgttgtcgatgtgtaggtttcgcccagttcgctacgacgcaggccgcccacttctcccaggctgcagggtcagtgtctcaggcagctgcgtcgacctcgcactcagcgtagttctggtagtacgctgggacttcgtcacaggcagccggcacgtcgagtcagggtccaccactggaccatgctgggacctcgtcggaccacttggtggcttccaccttgctcttcgacatcactgacttcgacttcgcttcaggctcgacagaggacgtcatcggcccctcacagctgggaggcgcaccgccggtgcagacgcaggaccaggcgcaggccactccgccgccagacactcgtgctacccgtgctgtgccaccggatcgtttcacctactcccaagaccacgtgcgagcacaggcccggaggaccaagcgtggtcgcggcgcggggcagggccagtagagcagacttctctttgtttatttgcttcacatgctagtactgtatgcttgtgtaatgaatacattgttattatatgtgcacgatacctttcggcacatgtacgactactttctgccgcaccgatgcagcctcctttattcgcgtgcgatacgagtatttgcccgccattttccgcatacgaccaatgtaactttcggcaccaatcaggcatgtaactttcggtgccaatcaggcgtacccaatatgccccgccacgttcacatgtcagggatatcactcgatttttggtgcctatataagtcgccttaacgagcgaggcctcacaatctttcagaactcaatcacattcagtactctcttccccacttgcttcattacaaatcctaccggctttcgtcaatggctagacgcctgggcgttgaggatccgaactggcgtagagatccttgtgtatacctactaccaccttggtgccagcgtcctctctgcctatgcggtgatcgatgccaactaatggcttcgaggaatcctgatattcgaggaaggcgcttttttaggtgtcctaactatgaccatgaggtattttactatctgcatatgcttattcattccgtatgggcaatcgttttattctttgtaacactactctattcggcagacccgcactacagcttgcgcatacatcgagtgggtcgatacagaaaatctcgttctcgacctaaccacttgtttacaagaaggtcgctggtatttcgcatccgaaagtactgagcaatacttatagagaaaagcggcttacgaatgacaatgtcgtgaacaatagtgcgactggcgggtgctaactacggcactacctccatgggaagcccgtccaagatgcaggtgtggtgatcgttgtcaggttcttcgttccataaagcctacaacattgggtcgaaggttctttgtttgtccaaatattcttgatgacgatttcatggtaagaatattttgattacatgaatccttattttctcacaacatttactaattttgctcgcttcacatctattctttcctcccaggaaccaccaaggagatgtcaatatagagaatggatagacaccagaagtgttctaactccacctagccgtgttgtgcagcttgaactatcagagcaatacagggttactaaagcgcggtttgagagaggagagggatcctcacgtaggggttagctattatcggacaacttggcatattgaaatttctactgtcatgcttccttatcccattactacatcgtcgttgtgttcaactattgcactacctccctcctagttcgaatctaatatcatctatgtaaccgcaatggaaatagttgtatcatgttcaaattgtactactatttcttcatgttacataattctccttgtttaagtccatataatgtttctacgaccgagactgcgataggcctatatcaattatccgagtactaatacgtcaaataagttacaaaataataccttacttaacatatgaaattgcgaaacaaccaacttcaatacatttttataacaatattaacaagttttaccaataaatacttctttaattattattaacataatatagaaaaatcatttgggggtactttttgcatatgggtcccttgccgccctctagtggggcggcaaggggcccaaatgcaaaaaagtacgagccccgagctttttatgggctgccaaaattgcatttagccttgtaggggcggcaaggggctaaatgcaattttggccgacggcggcagacggcgcggtcaacccgccgtctaccacgtcagcttgccgcccacctctggggcggcatggtctatttttgtaatttttttggccgatagattatttttgtaaatatttttaaaaaaatctaaaaatgaaaaaaattcatttaataactagagaggcttgtttgattggagcaggaacagccagatcgaggcccacggggaatccccgttgggttaagcccagtagggattctagcccggtcaactacggcctttccttcctcggtcggctgcggtgcaaggcgatgttgcgacggcaacacagcactgccccttcggtggtcaccttctccgcagtaagtttctttcttccttcccctctcctctcctgtgctgtgtgttatgctagaaccggatgtggcagtgcagtatgtatgatgagaatgacgtgtagagcctaggctctcatgtcaatgacacatatgatggtgtttttcaactccgagatttttaggatggtttcaaagcaaattggcccttctggccttctcaaaatctcaaaattgttgatgtatgaacttagttgaggtttaactgactgagtgctcgagtatgttctgaaataggcacgagtggcatgtttcttaatcttgatcaggcaaggctgtgagtgatttgaaatattgcagatcagtttctgtaaacgaggttgcactaattgtattacctggtttatctctactgaaggcagtaaaaaaaacttcattcgtttgcttaggccaaaagtgtactttgcatgacttgggttgagttcagactctcaagtcctttcagcaaagttcatacttaagttggttgtttcttaatgaatgtcaagcacatgaaaaacatgggttttgtggatatggatgtcgtgaaccagagtaccagtggtctagtgctgctgattggttccttaaataaactagagcaatgaagatggtagatagcttatctgaatttattatccaatcactctaaataaaatggatattggagagagtttaattaaggcatgatgttgttttatgcattattaaatcatgctaaagatagatctggttgaaattttgttgagaattactgcttcagatgctatttatttcctcctattcgtgcagtggttcatggatgtgactagctaaacacctttgtgctgtgtctgtttttgactattcagggccaatgtttgcaatttaattagatttgaaactaatgaagcatattttatctgtggtgcattctgtaaattcatgaannnnnnnnnnnnnnnnnnnnnnnnnnntgcaaaattcagggtcgatgctggacgacagataggctggagagaaggaacatacaaaatcatggcacctgcgagttatgctcccgggaagaagaatcaatcgatcatctggttgccgttggtttgcaataatgtgctgaatttctagttatattttgagggaaccttatcattttagttattttttatgctcttggaaatgcttctgatgttacattctaaagcttagctagtgtgcagtgagcatttggagtcctacaatcacattgtttcttgattaatgctctgattatcttaagtggttgctgatcagataggcacgacaggggaggggtgtgctttttgtgtatatccaatattactaatgagatgatttgtctgggccatccttctcttaagattttccgtgaatgattttcatgatattatgctttcaggaacgcaagctgctgactggtttaatgtggttggatgaccatcagagtgtcgtaacaccatttttgtttgctctaaaactttgtctatgttcttgtcataccgcgcgaatggatcatagtctgctagaaactaattgggaatttatagtagatccctccttatcaaactgaaaaagcatgaaaatcgacagctatatatgtttagagttttgtcccctcaatagatgttcggttttgtaatgcaaatttattacaattgtcacgtcggttcgaaaagatccttgtgcaccgaaagcagttataacttggtgaatggtgatgctctatgttcactaatagtttattgcgtaggaaactggcaccattatgttcagagctgatttataggtttaattaatcggtagtagcaggggcgaagccaggaaaaatagttaccggggccaccactaactgactatagcttataataatcttaagataatcctagaacaaaactatcgaccatataatatgataaaataaagtttttttagtaaagtggttatgttttacatgttacaaacttctcatgtgtacagttacgatccttcatcttgtgaaaacgaacaaccacgtcgtcatcatttggaactgtagctatattttaaaacgcaaggagtaatccatatatttattaccgatacgattgcgtgcagtattgtctacacaactttaattaccgagaaggttatctccaatgataaaggagaattagtaccacatgaactagtaagtgggtatttttcttctcaagaatcacactccattatactttgcttgcctattaatttattaaaaaatggaatgattaatatgtaaaacaaaatacccacgctgctgtagatgatcaaaatcactaatttcttaccttccacttttctagaaagaataaatttatgtttatgtaacagaaatttggagaaatttcatatttcagaaccctaacttcctaaaattttggacttgagaaaccagcctacaaccaatttgtgatgataataattaagaaattgtgatggggttagtgggttacccttgccaatcggcgaagattgggcgaagcgcttcgagccagactgcactgcagcaggaatacagagcagcacaacaaggcaatttgtggacttgtttagcaggaatacaaagccttctgggctcaaatctcatacgtatattgggctgttgtataataagtgctagctaattttctatttactacttgttagtattgtttagttgctaattgagcttgaccagaacaatatcaccggaccaccggggtctagtagtttccttgactggggtcgtagctggtaaattagtgctggtacaagatgtttgtaaaaaatcgtcggggtctactgaccccgataagtgactctagcgtcgcccctgggtagtagtaaatcgtgcccaacccaaaaagtttgaaatcaattcctgcacttacactcccgtttctggcaccgagatattgtaaacttgtgatcagggagttgagtgttgcttttgcttgcctattcagcatggctgacctggtatctccatatataattcgttcaaacaaaataaaataaaaaacatggtatctccattaagaaacctataaaggttcgcacgctgggcgtcttccggggcgagccacgtcagattactgtgcagtaacttggtaactgttgctgtcctacgtggaccaattgccgcgcggctttgtgcgcctagcggcctgtttggttggagggagttttgcctagcggcctgtttggttggagggagtttttaggagggattgggagtttagaaggatgaggctattaaatgttttgtttggttgagagacatgggaattttggtgggatggagatgaggaattgaggaaggaactccctcctttttaatacctgggtaggggcaggtaattgggaggatgggagggaattcctcctttactttctctattactttctctaagcaaatctcagtcatccgtttttattaatgacctaatctccaactaaactccctactaattttcattacctctaccaaacaatgtattgggattaaaaatcaaatttatatcttaatctcatcatcacttctcttatgtaaactctcagtccccttccttcgagttaccaaagaagccataggtgcaggtgtggagcagttgggtagtggcctcgtggttggtaggtgcatgcgttttctgattaaatcatcgttgctgcgtatggtggtttgcggtgcctgtgtggtgggcctttttttgttttgttgggtccattggtcagcgtttgattgagtttggtttcggttgtacttcctccgttttaaatgtaagtcattctagcattttccacattcaaattgatcttaataaatctagatagatatatatatttaaatttattagcattaatataaatgtgagaaatactagaattactttcatggtaaaacggagggagtagtatttttgttgcttgcacgtatcgtcgcttcggctgccgcgcccacgcttggtgcgggatctgagttgccaatcgcgtcgcttggtctttgctaggcccacggatcattggctgggtgagccgaagccgaaggggcgcgcgggcgtcgtcgcctcgagtggaaggcacgccgtttcgcataccgcacgagctttggtaaacttgcatctgcatcaatcactgcagcgtgggcctttagttatgtgggcccatagatcagacaaatctttatatacgatttcaggggtggaaatgaggcgtgtgattgggccacgtggctcactgattatttagggttagttcatctgaaaatcagccacgtgtccctgtgcaatcttagatagtcagatcagtaacttctcaagctggcctgtcttctcctacctgattggtccacatggacttacaaaatgttgacatgtggaacaaagacaagatgcagcctgcagctagcctgctagctacgctctgctttcatggttacaatcctctagatacttccaagctcgtagaagtatagtcaataaattaaattaagaacacctagatcctttggatgatctcaaaaatattaaccctagaataaacattacacagcgaaaaacgatacagcacaaaatttaggaaaaactaggagaaataccataaattggaaaataaataatgacatgttatagtgaaaaaatagttgtcaaaagaaataataaggccaagactttcttttgagaaaaatcaacaactcaagtctagagcctagatgcttttgagctaagggtacaagcggctacccacaaaaacccacttataggctaaactaacctgcaaactcgtttattttgacctataagtgggttcgcgggtgacccgcttgcaccccaattttgagcaggtctttaaaactggagctcaaaaaataaatagagaaaacaatggaaaattaaaatgtaaaaaaaaacatatctctaaatttgaagctccaaaaaaaagataacacaactgaaaatcaaaatatgtaaaaaaaaagggagctaaaaaatagagaaacaaaccaaaatccaaaatgtaaaatttaacagcggagcctcctctactgtgttccttaaaaaaatcacaatgtaaaagaaaaagaaagcacccatggatatcagttgcactgtatagctctgacgatttcagatgctagatgtggtcgattgactatgataataattgaaaatccaacagctcgcaaacaaaattttccaatttatgaaagctacacgtaatttcttactgaacatgcatttttaaataacaagtaggtaacataataaggcatatattactattgtatttccactctcaacctttgataattaaattaattatgtaaaaacttgcaaaattattctgatcatgtcacaggctataaattttgaagcacgccaactggcgtgctgatgatttttctagtattagaactaaagaaagaagcgtggggatggaaagcgtaggatcaatatgctaagctcatttatttgctcacgttaccttccaactcactgctcatctcctctaagagcaggtttaagagcaagtttaataggatagccaactactaactccaaatcatctagagccaatataatagccaattcatacaatggttgcttactatactattaatacccggtcctacctgtcatacactcgttacgttttggagtccgtactgtagctggctacatatctgtagcccgctgctattctctctctttctttatctctttaaaatatatttatagctggcttatagcccgctattgtacctgctctaatagtatcgccagctacaggctataaatgtgtaccatgtcatcttatagctagagagtacaatagtaagctgttgacacgttaaacaagtaatatctttattaattttttaatcacctcaatctctttcttctttacccttccctctctcactccgctgcaagactgacaaaaagcaatgcacaggcgcctaggagctcgtgtgcactggcgactaaggccctgtttagatgggactaaaacttttaagtccctattacatcggatgtttgaaaattaattataaatattaaacgtagactattaataaaacctatccataatcttggactaatttgcgagacgaatctaatgagcctaattaatccatgattagcctatgtgatgctacagtaaacattctctaattatagattaattaggcttaaaaaatttgtctcgtgaattagcttttatttatgtaattagttttgtaagtagtttatatttaatactctaaattagtgtctaaagacagggactaaagttaagtccctggatgtaaacaccacctaatttaccgtccgctcgcaccctctttcctcccttctctcgtccatgtcatcatccaatctgacgtgtagctcatatcgccggctcaatctaccttattaaacctgctctaggagcaaggataataatatagccaacttcctactattagcctatcttaaagccaacatatataatagattagctataaggttggtacaatttttttctcctctctctatctctcacttatacatttaatgtatttgtcttggagcttgtgataagctagctcttgtatgagagccaacatccttaatttttcactacctctcttatccatctaagtttatagtaggcttataggtcactattatacttgctctaagggcacccacaatggttatctataggttctctacaagagatctatgtcaacatatttttctacttggaatgtattaaataaagagagagagcaaagctatctactaacttagagatagtctatagagaaaaacaaggcaatgcatgagagagctatagataccaatgtagacatactattattaagatggtttactattaatcgagtatattgttaagatgtacatgttttatagagagcaccttactttaccattgcgggtgctctaagacaccgctgccttcgtccgctccggtcgcagccggcggcgccacaactgttatcctcccactcccaccagccggtttcgcccttttcgtcgccatccgctccttgtcgccgtattggatgagaagctccacggtgccgccgagctcaaccttggcagattgagggacggtgtcaacctcggcggcggattgaggcggcccctcttctccaccccttatcggtgaacacagatgcaagtggtgtgggtcgacgactgcagatcgagcgatgaataacatctcatttggtcatggatcctgacgggtgagatctactcaggtgaagtttccttgccgatatgtttcttggtcttccatgctcacgtttgattcgttctattccttgtctttgtttctatcaacaaatttcaattgttcttcgtttggatcgtctccattactcaaactcgcagctattttgcattcgtgcatggtgggtaccgactcaccatcagcctctccaccacttacattttcctggtttttcctgcttaggtaagaacgccataagatttcctgtttgttcctttggtctgcttctgtcacatccttcgctcacatgccctcgtcgatcttttctccagcagagtttgatcgttgcgaagtctctaggccgcatcccgtgcagctgagcgcaactggcgctctggagactcggatctggtgtacctgcgggtcagccatcgtttagagagcaatcttctttatactggaagaggtaagaaacatatttgattgactgattgggtacggtgttctaaatgccattcaaacaagtgtttcgttctgctcctgttgttactgatctctgaaacgtgacttgttccagctttggattttggagattggtctagattgtaatcacagttgttactgttattaatgaagtgtgcgtgtttatatttttcttttggatgctgtctgaactgagagaggccgacctttgttgcatgttgtaaaatgttgccttcccctgcatattcagcttggataataaccatcgtgtggaccgcaagctacatgttctcattcttttagcctaatcagcttatcagcatagacagatcattaatcctatactttaaattaccagtccgtacattacgaaaacaatatatgagcaatgaacattgaaacaacttgaaggacagaatcaacacatgcttgttgttcatatactttcttccaaatacaattagaattgtaagatgctctacatatattggctgcttgcttgtgttctctggaaataagcaggagttggctttccttaaaaggaaatactctcggcaaactcagacgtggctggaaactgcgcgcggtcagggggagcgactgcgactggaaggaatacttcctgccaatgcgtgtcgctacccagcccaggaaccagcaaagcgacacactgatattatacatgattgtttcatcatgaggttgatttttcctttttcagcttgccatcagtatttagattcgtgctgcttatgtttatcagagtaagcttttccatgttagagtagtttttattttctacttttatggctgacagggcctttgatttggtcccggtctaggtctagctattagcttgcttgatctgatcaaacaaatcaatttctttgttcccttggaagcctgtatgcaagtttatggaaattgaattgtgcctcactacctcccaccatatcgtgcgctttcagcttgaaccatgaaaccaacactatattcatggtcccaatgccccaatgctaattttatttttgtgtgcctgttcttttggttacccacacattccctggtgtggttctcatcaatcaaggtatagattttaatatgaatctaaaacactgaatgggacctcaaaactaaccaactatatggtattataaatttaatacattgaacaatcccctattagtgtaatacttctttatcataagactaattccatttccaatgctgcagaaatcatggcatctatggaagacattggaagtgcattaatccccctagtgggtattggtgattaatgacaaatgtggttaagagattaatgagtttattgagctactttcagatgcattagtccaaggtgtggaaggtggatgcttggagaccccccaaaagtataaaatcaaagcggaccggaactcgagaagtgtatatgatagtttatttattgcaatcgagtttttaggataaaccgtactattaagagggattccaggtgatgctctgagatatgtcaagtgctcttagcgtgaaccaagtgtcaaagtttccctaggagttatttttgcaaatactccatctgtccaaaaatgcaggtccggaacttcttgtcttccaagtccggaagttccggtctgatgaaagaaattttcctaagtgttatccggaagttcctgtcttctaggtccagaacttcatgtctagtttccagttcaaaattgagtaacggctagatgacgtcacctagccgttaaacatatacagctcgtttccagctcgttttttggccattccactttcacttttcatccctagagctgttgctagcctctcctaagtgtttcttgccatctccactcaatctagagcctaattcttgtgagaaagagagattgagagggagagaggaagatttggagatgtgtgaagactaggatcttgggtgagcacttggaatatctcgtgggctgtcatctcggtgcttattactcttggagatgatctcctagacggttagatgtcgcccgcgagaatccgttgcatattgtggatgtcctgggtaagtttgtgaaggatctcctctcctccgaaagggaacgaggtaagttaatgaagttcttgtgctgagattctaaaggttttccaagtagagcaacctacacttgtggcggatttctagaagtaggttgagttggatcttggtggtcactcaattctagaaatttgcctaggagtgtttggggttgaaggttgtggatttcctctggggttttcgcacaagtgaggcaaggggttaatcgagacccagctctttggagctcctcaacggagagtaggatcacaagatccgaacttcgggaaaaaatcgctcttgtctctttctgtgatgtttttgtggatgtttctgtgatctatcccctgcttagaatacctgtgcatcatcttgtgaagattggcttagtctcctgttttgaaatttgattttcatccttgttatgtaacccggaagttcctgtcctaacaacactggaagttccgggcctggcaggccggaagttccggagttccttaccaggaagttccgggtctgtttgaattttaccgctgcgatttgtttttaagttttcagggacagtctattcaccccccccccccctctctaggcttcatcagcacgttcagacatcgctgatgaggatccccaggtagatcaaatggccaatggaggagctccattagctcgagcaatgtggatccagaagggagctgtcaaagttctatttgagtttacgtctgatggatattatcctcactgccgctgttccgtcgagagagcaatggagatatacatgaacaacctcaaggaactcaaggtggatgagccatgattttgctatatctcttgtgatttgccctttgaatacagcaaggtacataacttactccttatcatataatattacaaacagcatgtattcatatcatcttccccatatgattaatgatttcctacttcaccaggtcagttcgatgcttatactttctatcctttttataataaatcgaccacataacgtcaaagctatcagtacaatagtatctgcagtatgacccttccacttgtatatttcaatcaatactataccctttcgtaacgtgtgcctcgatacataaatctacctatgtacctaaacttgccaacagtatagccttcttgccttacttgtataattatgtgatgattgttctcctgtaaaaatatatatgtatctatgtagcaagttattggtggtactatgacgagccttatgaatctagatcagacactcttccttctgagattgctgcaatggcataacaaatatttacttttgccacctctgtgaggttgatgaaaaggaacatttctttaatagtgtcgagacgtttttaaagggaacttgctattctagcaaaatgtgtttctggttctggtgctacatcttcaggcacactgcacacatggtacacctgataatcttattgtcaataaaaaagggtgtcacttttgtgatttgatgttttattttttttctctgtgctttttaagtcaatgtacatactttccattgtgattttgttctgtttttctttcttcaccatgaacaagctttctgctttcaccttatggtcaaaaggataaaagtagaaaaaaaaggaaaaccataagatccaacaacattttcatctacttatacccattcgtaaatttattaagttgcttttttaaagcatgaattaacaatactttttaaatgtaattactcaactggtagcatcttacttgaaggcatcaagctgtaatgccaaagttatatataccatacagatgatgttatcgatccatttatagcccgcgaatattattattcatctgtttatgaacaaacctgtgtttgaaatggtggcgttgttcctctttaattatattagtagtaccgtaaatggttgtcaatatttgaatggttctcctacaggtagaagaatgatgtaaaaattatcatgcatatttgactacacatgaatttagattgctaccgtggctggcaaattttgctgtcaaacttgccatgtagacaccaaggcccactacttcaagcgaggactcctaacggacaagctatatgatgttcatatttaggagtaacaacattcagcaacctatatccccaggaggcgcgccaatgctagcaggaaactgtaagatttatttctatggagacgaaacacgtacctactctgccactgttactatgctaattagtttttgcacctgaagtgcttatcatgcatactgcactcccttgtcaatataagataccatctatgtatgtacctgctgctagagaccacgaactaccaatctgcctatatgtagttaacatggcgattacatgttttcttatattttgttcggtatgtgtctatttgcctttcctaattttcagctccttctacctaactgtctactagcggcgcacattatcagcgacggttaatattatgcttccaccgctttctaataatggaatcaacttttacaccacaccagctatatgcaattggcgcgcaaaggcgcgccacaggctctagtaatattaataggtagagccgtaatcttgagggtagagagagccgccgcccgctgctatctttgttattcttgcatactgctattggtgcttcgaccttgtgtgaataactcaccttctcaattccattttgtctctacatgttaattaatgtgttcagctaatgtctttccgcatatgttttcaagtagatggatgagtctgagtcagagcctatgagagagcattcttccttctttaaattgtcattggttcctcgaaggttagtgatttttttgtactgtaggtg

SEQ ID NO: 59939 - DNA, 10311 bp, Oryza sativa
taacgtgtaatcgtccataagaggccgaatttaatccttaaaaactcatcagatttacccttaaaagtggcatctaacttatttttaaaaacaatcatagatgaatctattgtagatgctatttgttgttgggtagattgtattacctcatcattacttaccaagtcgggagcgagcttaggaagtggctcgggcttaatgatcacgccttgacgagtcatagtgcacgccctcatcaacgcttcctgtgtcatctccttgatgtactcctccatggacttgcggtcttctccttcgaaatcatccaatgagatcggcatgatctcattcccgctcatcatggttgatgaagaaattccttgattaatttcggccatatagctcatagctgaaatatttgaccgaataaattaatatacggtcttcttagaaaacagccgaaacaaatgaatcagctttaatatttctttttcttaaaaatacgtgagcggtagtaaatcggctttgttagcctgatttttcttttttaaataacttcactcggtttctgtacacaacaaagaatatacagaaaccaatactactgttgctggctctagatagactgatagatcggctttgtacagcctgatcgttttcttttcagaacgcgttagatttctgattttttttttcagaccgtgtacaggaaggatactgccggtcgcttgttgctgtttccacacgtggataaagatagattccggctgtatagccgaaacactcgattagacgggaaatcgatgaatcgatggcagcagttagcttgatgaccgaacagtgtcgccgccaaatagattgatccgatcaaaaatacgtagcggcagtgacggattttgtatagattgatttcggctgtttggccgaaattcttgactcgacgaaacgaaaaggtgactagtttaaacggaattcggccgtgatatggccgattagatcgtttcccagcggagtcgccaaaaatcgtgttggcaacttttttgacaagttgacaagcacgatcgcagcaccttaagccttgcggtgatcctagagtcgccaaccacctcgatctagcaaagagctaaacctagatgggttttgataactaaaccggctagcggagccgatttctagataactacccgtctcgtgagcaaaacggaaggttttcaggacaaacctacaaagatgtgtcgcactctcgcagcggcggcggacggtttacggcgcaaaccgacaaagatggacaaactaagagaaaactaaaagcaatatgaaaaacgattcgattgattgattgtagattggtttttacaatgaaccggccatgtcccttatataggggttggtcttgccctctacaggccatcctccacgtccaactcgggatagaaaccaaaggaaaccagaaacatgccttcccgagtaaggaaatctcgagacccgacgaaacacagtcggactcggacctgccggtcagaccggccacacaccgccggtctgaccgaccctcaaccggcggtctaaccgcccaacacacggcggttagaccggcccactcggaggaaaccggtagacttccaaattttggcaatctttcctattttaatcctaggtgacaaatttgggtgtaaacacatgcctccctgcctttttgatgaacaacgtgaatctaaaagcatagaccatgtttttggtcttaggacgataacccaattaccggccatagtacctcctaagcgtcttgccaaacgctcatgaagtatttcttcaagtatttcccgttgattgctcgctgaaaacgctccccttgaagtgtctccaaaaagtatgcgttccctcgaacggtgccgcacactcgataaggaccctcccaactaggagaccacttaccgaactccttggatcgagtacccaaaggcaaaattgtcttccaaaccaagtctctaacctgaaacaactttgctttcatcctcttgttgtataccttggccacccttttcttctctttctctatctcttcgaatgccttcaagcgcctgtcgatgacttcatcaaggttatctcccatcaacgtcttgtaatcttcactggacaaatcatcttgcttgatataacgaagagaaccaagatttacctcctccggtaaaacggcttcttgaccataaaccaactcaaaaggagtgactttagtagcactatgtttagatatcctatgcacccacaatgcttcggaaagcacctcatgccactttgggtattcctcaatctttttcttcactaacttcaacaacgtcttattactcgactcggcctgtccattagcctgagcatagtaaggagaagaactcaacaatttaataccataagattcggtaaaactcttcacttccttagacataaaagaagcaccttgatccgtagttaatgtttgcggaatactgaatctatgaataatatgtttcaaaataaagtcaattacctccgtatgagtcatattattcaaaggcacagcttcggcccacttggtgaagtaatccgtagcaactagcacgaacctatgcccctttgatgacgaaggataaatttgaccaatgaaatccaaagcccatcctcggaacggccatggtttgattatagggttcaacacggcggcgggcgccaattgaacattgccgaaccgttgacaagcctcgcatcctctataatatttgaagcaatcatcaatcatcttcggccaatagaatcccgctctcctaagcaaccaattcatcttgtgggccgattgatgagttccacaaattccttcatgtacctcccccatagccactttagattgatctttatctaagcacttcaacaagacaccatctatgttttggcgatacaaatctccatcaagcaatgtatatttgaatgcttgccgctgaattttccgatcacccttaagtgtaggatctttcaaatatctaatcaaaggaattctccaagctatttctaattcatgggcacaaatgtccgaattcacaattaattcggccttttaatcaattgtaacatgcccccccagctctctacccgagatcggttagaccggccacgcaatgccggtcagaccacaatgtctgcccggtcagaccggccatgcaaagccggtcagaccgctggctaccaccggtcagaccggccgtgcaatgccggtcagaccgtccctggtctataactttgccaatttcgtccaaacttttgaaatcaagcatcggcttttagtatataaatttttcttcacataatagccagatgcttggtatatcaaattattgaaccaaaactccttctttctagacatatgaaaaatcataatatccaactaatatgtctagatgaatactaattcaattggcttttgaaacaataatcatcatggcatcacaacacttagccaattgaagtatgatcaataatgaatcaccaaagtcatatgtgtcacatgcatagattccaataaactaaaaatgtaagtaatcggcttgagcatgtatgcaaaatattaacaatgccaatgttcctaaagaaaactactctagagcaaatcatcacattgaccattgacattagccgaattactagtaagcaaaactttcatggtgcaataaatatgaaatctatatcttatatggtgatccataaaaacacatatgatttggctttaaataaatatcaaagagtcatgagccaaatcatacttcaaacaaattatatgccaacctaccaattctactacctagaattggcatttgcaacatgtatgtataatatcaatttgataagcaaaaacacacatgtgctagatagcaagcaatgttctaataacatggcataggcatataatataatggtaaacacaataaactcataccttgccttagcatccaacaaacggcggctcaaagatgtgatgttgtatccatcgccgttcatcttctcttggttccctaatgaacatattaatgtcttgccccccaagcaaaatcggctttctagattgcgcgatttcgaaggcaagacggataccgcactaacagtcatagcatcatgtgaaggagacttatctctaatgaccgatgattcttctcccatcaaattggatttatctctactatgggaaatcaccggtatcttaacttttacctctttggatctccacacttgcctaggtgcttttcgaggctctaaattattacatgttttgttctccacatcttcggcctccttttccttttgacctatggcccgaagacgttgtagcctcctcttttgagagcgagataagccggaaggtatgcacttcggctgtggttgttttccaggagctaaacaatgattcttcatatttttggtcgaagtggaagctcctatgttgctctcaattttcctactcttctcaaatgccccccggtcagaccggcctctgagcccggtcagaccggccacaagccgtcggtcagactggccagtaaggtcggtcagaccggctgtagactggcggttagacaggccagctgtctcgattagacccccaatgttggcagtcatggcgtcggcttcgatctcctttgcctgcgtggtttccaccgcatctccagtacatgaacatcttgagactcctctttggcagcaacaacctccggagctttggtttctttcctcacccacatcttcttaaactttttcacctttgatccaccggaccgattcttttgtgggaaacggtcttgtcttgaattagatgaatgatttggcactgtcctaggtgattcctcccatccttgatgaaacggcgtagagaattgagacatccatggcatgtaatacataaaaggataaccatatagtgacattggatatggataccatggcatcacaaccggaggtttgtatggagttggtatagttgatggctccgattgctttggtgtttgaccaaatctcttcctacgagacgatcttggtctttttgaatcactagtttgattattaaatcgttgaccggctaatcctttcttgtacttagccataaacatctcaaaaatgagcttcggctttttggtcttttgagaactagatgactcaccctttgcaactttatgatctttggccatcgcatttttgatcctattcttagggagaacatcactaataattccggtcttaggcatagatgtaaccgaaatagtttcacaagtgaccgatgaagtatcaatcggtctttgctccatcaagcttgcatctttaaaataatcatgaaactcatgctccatttgtgaccatgtagaaattgaattaggagcaagtaaactataccatgtagatgcaaagtttgacaaagaaagaggaaacaactttaacttaagcaaatcattactaccggccttaccacattgatcaataaattggccgatatgctccattgttgttctagcatcctcacctgtaaattttgtgaagttgggcacctcaaatccttgcgggtatgggaccgaatctacgtgttcaggatacggcctttgatatgtatgcatagcttctttggatcctatttcactactatcccgcaagacattgtcattatcttttccaacatctacatgaccgatttgtgattcggtcttaggtgacaatgctatttcattttctcttgtaatacaatccgaaccgtcatctagttcggctatatcttcaatgatgctatcatccaagctagcaacacaatccgaaccaccatttggttcggctattccatcgttgtctaaactagtaacacaatccgaaccaacacttggttcggctataatggttattgcattatcatccaagctagtaagacaatccgaaccaacacttggttcggctataatcgttatagcattattgcacaaattattaacacaatccgaatcatcgcttggttcggctatacatgatattgcactatcatctaaactagcatttaagttattgtcatccactcgtcttccctgagccagagcttcatgcaacacatgatcaatatcaagaaatacttggccattcaatttctttttattagaatcaagcaatctatcatatgcaatgttggccaaatctttgtcagttattttcaaactaaaacatcggcttttaatatctctaaatctttcaatataatcaacgacagattcattgtatttttgcctaaccaatgttaaatcaaacaacctaagctcagttttatcagtgcaaaaatgatcatggaatttttgttctaattgaacccaagtataaatagaatttgccggtaaagaagtaaaccatgtaaaagcagtaccggacaaagataaagaaaacaagcgcaatttaaaagtatcactattagcctcaccacattgcgccaaaaattgacctacatgctctcatgtggtcttactatcctcaccactaaacttggtaaattcgggaactctataattacggggaaacggcacattatcataataatcaggatacggctttttgtaaaccctagcatgattcctagtttcaatcccgaatctattcctaataatctcactaattatatcctccatattattaggcccatgttgatttggcggtgaattaggtggcctaataggttgtgtttgtggcgcaatatgattatattggccttgtctagtatcgggaggataccccctagcaacgtcattataagcattaggaacacgtgggggaacttggggactatttgtagtagtagatataggaggatcaaatgttttaaagtgatacaaataactagcattagtcatcggatctattccctgtattggaacaattgcgccggtctgaccggcccagggcccggtctgaccgacatccagaggtgcggtcggaccggcctgagtgccggtctgaccgccggggtaatacccggtctaaccggccgtttggccggtcggaccgacggctaagtcccagtttgaccggccgtcaggcctggtcagatcgaccgtgtgcgccgctccatcggttttactacccgtttgatctataggaggttggttagcagtggtagaggctttatcctttaacgtgtaatcgtccataagagggccgaatttaatccttaaaaactcatcagatttacccttaaaagttgcatctaacttatttttaaaaacaatcatagatgaatctattgtagatgctatttgttgttgggtagattgtattacctcatcattacttaccaagtcgggagcgagcttaggaagtggctcgggcttaatgatcacgccttgacgagtcctagtgcacgccctcatcaacgcttcctgtgtcatctccttgatgtactcctccatggacttgcggtcttctccttcgaaatcatccaatgagatcggcatgatctcattcccgctcatcatggttgatgaagaaattccttgattaatttcggccatatagctcatagctgaaatatttgaccgaataaattaatatacggtcttcttagaaaacagccgaaacaaatgaatcagctttaatatttctttttcttaaaaatacgtgagcggtagtaaatcggctttgttagcctgatttttcttttttaaataacttcactcggtttctgtacacaacaaagaatatacagaaaccaatactactgttgctggctctagatagactgatagatcggctttgtacagcctgatcgttttcttttcagaacgcgttagatttctgattttttttttcagaccgtgtacaggaaggatactgccggtcgcttgttgctgtttccacacgtggataaagatagattccggctgtatagccgaaacactcgattagacgggaaatcgatgaatcgatggcagcagttagcttgatgaccgaacagtgtcgccgccaaatagattgatccgatcaaaaatacgtagcggcagtgacggattttgtatagattgatttcggctgtttggccgaaattcttgactcgacgaaacgaaaaggtgactagtttaaacggaattcggccgtgatatggccgattagatcgtttcccagcggagtcgccaaaaatcgtgttggcaacttttttttgacaagttgacaagcacgatcgaagcaccttaagccttgcggtgatcctagagtcgccaaccacctcgatctagcaaagagctaaacctagatgggttttgataactaaaccggctagcggagccgatttctagataactacccgtctcgtgagcaaaacggaaggttttcaggacaaacctacaaagatgtgtcgcactctcgcagcggcggcggacggtttacggcgcaaaccgacaaagatggacaaactaagagaaaactaaaagcaatatgaaaaacgattcgattgattgattgtagattggtttttacaatgaaccggccatgtcccttatataggggttggtcttgccctctacaggccctcctccacgtccaactcgggatagaaaccaaaggaaaccagaaacatgccttcccgagtaaggaaatctcgagacccgacgaaacacaatcggactcggacctgccggtcagaccggctacacaccgccggtttggccgaccctcaaccggcggtctgaccgcccaacacacggcggtcagaccggcccactcggaggaaaccggttgacttccaaattttggcaatctttcctattttaatcctaggtgccaaatttgggtgtaaacaaaagggtactaatcatttcctattaatttagtagtacttatgtcatgagatgttaactaatattttgttcattgttcagcgatggatcgaagttggatgtacacgactgacttgaggcgtcagtacaaggagtatagagatggcgtattaagttttatgaaagccgcagaggaagataggataagaagaaacgacaagtacatgtgttgtccatgtaacgattgcaggaatgatattttgttggacgatgaaaaggaagtacacgctcacttgatacgccggggattcatggagagacacacatgttgggtgaagcatggagagcaagatctgggtactgatggtgcaactgcagacagaagtggtgcagacaatcacgaagaaggagatgaagaagagcatgacatgtttgtcccatctccattgggcggtgaaatggttgatgtggaccctgatatgctgcaagacatgttacgtgacgttgatgacccaactatgaacgagagagattccatgaagttcagcaggttggtcagtgactcggacactcctctatacgcaggatgcaagccaaagcacaccaaattatcagcaacattagacctaatgaagttgaaggctagtagtggatggtcagacaagagttttacagaacttttgggaatactgaaggacatacttcctcaagagaatacattgcccgagacgacatatgaagcaaaacaggttctgtgtcccctagggttagaggtccggagaattcacgcatgtccaaacgattgcatattgtaccacaaacaatacgcggacttagatgcttgtcctgtctgcaaggcttctcgatacaagcgaaagaagagcgcggctgtgcgggggagggaaagaagtcaaagcggggtggtccggcgaaggttgtgtggtatctaccaatcattgatcgtttcaagagaaaatttgccaaccccaatgaagcaaagttagtatgttggcatgccatagagagaaggaatgacggtttgctaagacaccctgcggattcgattcaatggaggaatatcgatcgaaagcacaaagactttgctgccgaccttagaaacatgaggatatgtttgtgtacggatggcatgaatcctttcggagacatgagcagttctcacagcacttggccagttctcattgcgaactataacctcccgccatggttgtgcttcaaaaggaaatatattatgttgtgcttgttaatccaaggtccgagacaaccccgcaatgatatcgatgtgttcttggagcctgttatcgatgaccttgagattatgtggaaagagggtgtggaaacttgggatgcatatggtcaggagaacttcacgctatgagttctattgttctgcaccattaatgattatcccgcactgggtaatctttctggacaaaccgtgaaaggaaggaggccatgctctgactgtatggaacatacacgcagtaggtggctgaagaaatcaaga

SEQ ID NO: 59940 - DNA, 12178 bp, Oryza sativa
  unsure (1)..(12178): unsure at all n locations
atgtgactaaaaagttgtgtgtgtatgacagattgatgggatggaaaaaaaaaagaaagtttggatctaaacacagtcaatatagtttattttgaatatccaaattcattgtactagaatatgtcacatccacccaaaatctcttaatatatattaaggtacggagggagtagcaagcaagcagcgcagagcagttggctcttggcaagccggaacgccgaagaagtacttagcgacgacgagggatgaaagcggtttaaaagttttcggtttttagacgcgttttagaaaatgggaaatatcacttggaatttttcggagagtttcataaatagaaacgaaatcaattttttttagaaaaaatgtaaacgaatacgatcaggctatcattttgaaaatgggaaataattttcaattattttgaaaatgaactcagattttttttcttggaatcggaaatgaagtacttttcatatttttctagtacggcgttttagatctatttttcttttgactgataaatattttttgtttttattaggccacacatactacttagggccctttaaatcgcaggactgagaaaacataggaatagaacaaacacaggattttgatgtgaatgcaaatataaaaaagggattgcaaaacactctaataacatatgaatgaccatttgattggatcgcaggaaaagcagaataattagaggagagataaagatttgaaggaaagttttcacgaggttctaccttatattagattttctccaaaacttgcaaggtattaggcattccataggaatttcatatcattctataggatttatggatttattttttttgattcaaagggttatatagaaaagatttctataagaatgaaatcctctaaaattcctatgaatttccttcgaatgaaagggtcttatagtcttttacttattgtagttctcatggaaaatcaagtgtacaactagatttttctatatggtttttctggtggatggtatttttgttggatggtcttcctcgtgggttgattttcacgtgtaaaccctaatttgagtgggataatgtttttctttttttttttggttgagatggtgtttttagggagttgttatttttataaggaaccatgatagtgggaaaaaaggggtagctccgcttctaaagtagtacatatatatcaacccgacatatatcgaccaagttcaaaaatattccaacaaaatttttatttttttcataaaagttgttcaattttcttggttcgtggtaactaagcttactgcaggaggagtccggctcaggtgcagggaaccctgcacatagtaatatacaggccaaatcaaatcgcgacacctgtacacaaggtaggtccacccaatcaaccaagtaacaatgtaaacggaggtttaaccacgatcccacaaaatcaggtaacagaaccattcacccgtttagtcctcgttaaacctccgttgcatgcgtaattaagtagggccaccctggacaggtgtcgcaatttgatttggcctgtattttactatgtgcagggttccctgcacctgagccggagatgggtaatccctcgctccggtaagataaacctgatttgcatgcggtggtgctagtcttatggccgtcttggctgccgctgccaccgggcatgttccggcctgcccggccattgccagtttgccaccaagctgtagtgccccatatgtagcagcaagtatttcttccgtcccataatataaaaaattttaagtgaatataatatattatagcacaataaattttgagtggtctgtccagattcattgtaacaaggatgtgtcagattcacaaaaaaattctcttatattatgggatggagagactattacatactccctccatccaaaaaaaaaagacaaaccctggtttccgtatccaacgtttgactgtccgtcttatatagatttttttataattagtaattttaatattgttaaatgataaaacatgattaatgctttatgcatgacttgtttttttatctttttcataattttttcaaataagacggatggtcgaacgtttgacatgaaaatctagggtttgtcttttttttttttttttttttnnnnnnnnnnggacggagggagtatacattacatgtagtactggtactgatgtactcctacatcctgcagtaagtaaaaacggagagtaaaaaggccgcacatggcacagcgaagcaaatttccattttccagcagcaatctgacgggcggagctcttaatcgtacgggcaaccgcagctgtgttctgtgaccgccttacagtagggtagtaaaagtacttccgcctagattaaagagtactcactccggcacatttcaaacgaagccataagttttcatgtccaattttaattactgattttatttaaatttttaatgattagtatttttgttgttattagatgataaatataaataatactttatatataacttatattttatatattatatttttttaataagactagaaaagaatctcgtgactgcgtttaaaattagggagcactaaattttttctttcacagacagctgccggcccatgcttgcgtacgtacaaaccgtcgtcgccaaccggggacaaaagtcctataaatacaaacaagtggcctgtatgctgtgacacggccatgagtggtaaactagtacgggtgccaaaatatggctcgctgattatcgatgagtatgcaggccggcccggaccactggagcatgcagtctacttggatcacagtactactatctcagaatggcattgtacagtattagtatcaactgaaaccactaattgaaatatgatttcactaattgatgaaccttatcataaatttagttagctttttttttctctttcagctggccgacatgatagggtaatcaaatggattaatcaatcatattccctagctaagctcaccagtgtacactgtaactcgagcagagcacagcacgcgcgcggcagcatttccttcagttttaacgacaccatcgctgcagcgtactccgcggttttctttctccgcgacgagcatctcgaggcacccggcgccgtcctctgcacgaatctcaacgcaccacgccttcgccgttgccgtagccgcgcccgcgcgagctttcacacacgctgtcaccgacaaagcaatcaccgggagaggattaattggcaatggtggaggatgattagggcacccgcaatggttatttatatgctttctataagagatccatgccagtatattttcctacttggaagagattaaatgaagagagagtaaagctatctactaacctggagatagtctatagagaaaaacgatgcaatgcattagagagctatagatacccatgtagacataatattgaggtggtttactattaatctagtatattgctgagatgtacatgttttatagagagcaccttactttaccattgcgggtgctcttagagcaagtttaatagtatagccaactactagctttaaatcatctatagttaatttaatagctaattcgtacaatagttacatactactccctctagttctatattaattgacgttttggacaagattgaggttaaacttttataactttgaccatcaataactttaaaaatatttagtttaaagaaactagaaaaacatatatagatttgtctttcaaaacactataataaaagtaaatatgcatttatttattgtatatattataatagaaaaataaggtcaaaggtatatcttgtagagcgtgtcattgttcaaagcgtcaattaaaatgaaatcggagggagtacactattaatacctggtcctacttgtcatacacacactgcgtcttgaagtccgtgctacagctggttataaatatgtagtctgctgctctttttctcttctcttttatttacttaaaatatacttatagctggattatagcatgctattatacctggggtgatctgattaactaaatccgggtgtttatctcgagatcgtcaggtcgtgagcttttggagagcagctatttcatggcaaaacttatggatttgagctcttttcctcctatacttagaacaagatatcaacagggtcaatcggaaaatattattttcttttattatgaatttctggagtggtctatttcatactgcgtagaccattatatttataggttcataggtatcattggtgctatttaagagatatggagtaagattaatgcaagatatacaaacattaaattacaatgcatttaatgacatagaaaatcccggtattaattgcatcagatatgatatagtaatggccgtcttgtaattgcacaagtatcattgctttcatgttccatctctttttatattgtataaattttaaaataaccttatttcctgacacacgtttagaatcgatacctcatttatttataaatttgatagcactcttctgttggtaaaactgacaacattcaattaataggggcataaggaaaatgcaggggataattgtcttgaagtctatagacttacatttagaaaaaaaaattaacatattcaaagtaggtactattaattttctccatattgtcccttttttctttttacaaattgaaccttttccaactcttgatttgatttttcttaggttccttttttttcgttttaaccccctcaccccctgtgcagttacaacctgtggactagcaaagattgatacagatatatacacagactgactatcggactgaacttcaccggacatcgactcgccctgtttagttcacaccaaactttccccaaactctcaactttccatcacatcatatcacattcaaaacttttctactcatatgaactttcaacttttttttccaaactaccaactttcctcaaacttcttcctaatttcaggaactaaataaagcctcactgaacggctgaacctgaaccaagcaagaaaagtgaggcgctgagctgagtgcacactgcagctggaggcctcccatataggctgccgctggagggagaggcccatcgggtaactaatccacgcgtcaaattacttgcgtgtttgggcccacgagatggaactagggagcaaacaaaggtatatatattgcttcatataatagtctcctgtccttacattgattggttcagagtggattggttcagagttgaatctcttccgagaggctgtgaattctacaaaaaggtttgagagagtttgtgcagatttatgaaggggatatgtaagttaactattcttttctgaacataccgtaatgctgttcttcctgcaatggactcatgatatttctttacatacagtatcacatttctgacagtaacaatggacctgcagtgcttgctcatgatcaagatactatcctccttcggcctttttgtccttgtcgacaaaacatgctagagattgcccaaactagaggctgtaattgcaatggaagatgacatgagctcttgtttacaacgtgttgaaatttgaaaagctcgagtcggtatttatgtaatcatcttgtaagcaaaccatcagaaataccaaaggagaaagagtgtctaatgctacaatcttttgatcgggtaaaatccatctagaaaaggacgaaaagagtgtgcattgctacttcttggtgcatttcaggcagtggccacgccgacaaggcttcgttttttacgggcaatgaacacttttgaaattaaggactggtcgagaaagtgtttaagctcataagcaatctgtagctgcaaaatataaagccagtcgacacgattcagacattcagtcgcacagcccaatccatccagagcttcagatgagagggatgacggtgaaccacatcgtcgccgggcggggccgcggcgtccagatagctggggcgatggtggctgtggccgttgctgtggtcgccgtctgcatggtgtgcggcggcgggtgcaaggcggccagcaatgaggaggatgcgtcgtgttcatccgtcacttgattctttttaggggtggagacagaaaatagtatgagtgagggctaaggatttaccgtttaggtagactaaggaagtaaaaagtgtcaaaggggcatttgcccccagtcacctaaattgagtggggccaagggccccgctggttacactctagatccgaccttgattcttttgaagtactccctccgttttatattataagtaagttgaaagtttcaaaaatttgaatgaaaaagtttcacaatttgagttgaaattttcaaattttggctagtgttttttgggtagatttttaaaaatttggagctaaaagtttcaaaatttgaattgaaaatttcaaatccgagttggaagtttcaaaatttgagttgaaagttaactcacttttttaatatttgaaataaatctatttaaacaagtcttggttacaaattatttctcgaatttcagagaagagtagaaaattatagaaataattcaaaatatatcaaaaactttcaatacagtatttaggtaacttccaattgttcaaaatgaattgaaagaagaaaaacaaaaaaatatccatacatgggcttgacctataaggcccataagctaccaggagagtaaggcgcagctgcaccgaaaagttctggcgaaagttattaggccggtccctcccaactagaatgcataggatgagagagtcgaccttgcttgagagagagaccaaaatcctcgtgtaatcccgttctcattcctatttctctgaagtttaggtaggataggatagcaattatgtgcagagagaacaccttcatagttcaaaggctgcttgatgttgaatttttttggataatgggcttggtgttgaataaaaaaggcttggataatgacctttgttagactagacgatgtgcaagctacagatggcgtggccctaactggctcttggggaatgaagtgtgttatttagttcaattcttgtttgcaaaattaatctctcttcacaatttacatcgaactatcataggagcaaagtgcatgcaaggtgttatgatgccacatatgtagcctttgaatctcattatttccaataaaaaaacttatgatactacagtttgcaaagcacaccattagctatatttgcccggtccaccgtagtatacatgcatactatcatcattaagtccatagtcatcataggtgtataattttggattgtcgtctcgaggatgggcactacggatgcttggggtaaccagcttgttgttctcatcttcaatagcttgaatattcctaacaaaagctgctttgccaaatccttcagaagcgaagtgcccactaccaatttgtggtgggtccgaagaagctgttggaccttgaacatatccaccccaaaatgcaaaattacatttgtccttcatggatgaaaattgtgaactcggccaatatccaataggtgtattatttgaaccatatgctagccaccaattcttagtctttggatcctaatataaataaaaaatatattgtaaatactccgtagtttgaagtaaaatgagcattgaacactaatatgtcttgagttatcaaactcggaaaaatgtaattagttcatcttggtttgaattggtttgggctagtttcatgatgtatgacaattgtagccatattgattccagaaggcaactaaaatggtttcagttatgcttactcgacttactatagttatatatttcatacctagacaattcaaaaatatttttcatgcccaaacattttttatgttgatcgtgcacaaatattatataattatttatgtgggtgagccttatgtagtttctcttgttttaatggaattgtaacaaaaaaattcattttaagaaatttacttacatgcatataaagtatctgagtatgagatgattacttaattatcatagatagttcaactaatattatagtgaactgactagttttgcaagaaaacaaaaatctaggagctttaccttgtacaaaaactgcatgcctagacatggaaccaatataactaatcatacatattttaagaatagaacaataccttaaaaataagaacatctattacatattgtggtccattatagacggagataggatgtactcttcctccaagaccaacactgcgactaacttgcacgaaaccaggacaattatgatcaatacaattttttttcaattcttcattatcctgttatcaaaatttattgcaaagtcaataaggaaatatatcaaatatatctatgatatccctattttaaaatttatatggtcattatagatgcttattgaaaaaaaattatgcacatggtaaaaaaaaattgtttatgccttacccaagaaatatggaacctagcaaagctgtcgccactgaagcttggataaacacatgacccagcacctatcccaactcctttgcctacctttggcacactaccaatttgtatccatgatgcactaagatcattgctatcttgcttcacttttggttcatagacatttattgacgcctgtgatccgtatatctcatcccaatatttgattcctgctacctgcaatgaaaaaaccaatgatattttgttgtgaatgaaaagagtagcataagcactatagagataagatgatggagttgaaaaatatcattggtatgtccaatgtgaggatgacaatgtgggtcctaggcccacataccatcctcacattggatattattttccacttatgcatgtttcagtgctacaacatgatgacatattacatagaagtcaatcccttattgtagttaacttgatggcatatctatactcacttcgtccgaaaatataaggtaatttggttggatggaacacattttagtagagtactacgaatctggataggctcccttatattttgggacagagggagtaccttctaagttggagcctactagctctaaagcttaacatgcaaccataccacatcatcattcactataaactgttacatttaaagctcatgcaagcatgacacatcatctacaacttattacattctatagctcaacacactagcatgtcaaatcatcatctcccacatattttctataatatttcaaaatgtatccatccatcatttcaacaatactcaacattcaatcatccatatatttcaaagcaaagcatgaggcaccatctagttacatagaagttccaatcccttattgttgtcaacttgaaccaacatcatttgaccttctcaagaagtacttgtaaaattgggtacaataaaagattttatagtcctttcaatgccattgaaataatattcatgtgagcaaatatcatgtttatggaacagtatcaaagtttcagaatgattacaagctacttgttacttaaaatagcactaaagctttgaaattatagttttctatataactggtcctaccaatggacacaacatatatttaatcttattgtttatcattaagaattttaatgttaacatccaaagattgatttgaaaatgatcatattccataaataggttatgaatagtcacaatcgtggttttgaaaatagtagtgtgcaacatgtgttcatgggactacacacaaattcagtatgatcgtaatcagactttgatcattatataattttaaaattttatgagaagaaacttaccagttgttgtaaatcattgctagccaacgtgctgataccttgcaccatcgtggtgtccagtttgttgttacgcagaattggaattgttcctatggggcagtcgatggtagacaactgtgcatgtgagactgcagctaccagtggcgatttgatatccaaccttatgggggaagagcttggttccatctatttgagatgtaaaactgtgtcaccgtatagtaaatgattggataaaatccttatttgctcttgaaagttgaccgtatcccttattctcaatgatatgcgggtttgggcccaggtgtcaatgactcgtcatgggcaataagggatagggtgatttttacatgcacaaataacattatcaatatagacttgacaaaagacatccatgaagtcttcgcatgtatagttgataatagcatagttacaaaaataagttaattatttcatttcttaatgttaaatgagagtttaagtagtagataaataatgaatattaataaaatgcactcccctccgtttcatgttgtcagttgttttgggtttgttctaagtcaaatttgttcaagtttaaccaactttatataaaaatatagtaatattttcaatagaaaacaaaatatactatagaatatattcaatggtgaattaatcaaactaattgtgtgttgtagatgctgctacttttcctatagacatgttcaagcttgaagaaatttgaccttgggcaaacccaaaacgttttataatatgcaacgaatgggaagcaaatagtatggcttgtcgtgaataaaaaccaatttaaagaattttgctatcatgattttagctacaacttgcagtacctatttattatatataatcatgaatttgaaagaatctacatataatttttggacgaaattaaactaaatcaaatttagccaccatgtgaaagcaaataatagctttgagaaagtggtttacctgaatttcatggtctttgaacagcgggtgtttaaaggttggctgttgattgacgtcaacacaatcgtatatatcaccatcttctgtctaattttatgttacctatgcttgttagacatcaaacgatgcagaatacaccctccaaaaaagatcaatagtcttgcacatacctgaacagtcttattaacttgttgatttgtgaatgttagacctgtgttttctccactatttgtggatttgagctcctttcctccgatagtgagaataatatatgacaaaagggccactcggaaaatattgtttcctttcattgtggaaatcttgagtggtgtatttcatagtgtgtacaccattatatttataggttcataggtacaactagttgtttaaaatgtattatgctgcaatcaatgcaagatatttaatgcatttatttacttgtatagaaaatcctattatttattgcacaagatatgatatagtaacgaccatcataattgtaggtatcactggttccatctttttatataaatgcctaaattttaaaataactttgtttctcgatacgcaatttggatcgatacctcatttattgataagatggacaacattcaattaacaagggcagaaggaaaaggaaggggacaagtgtcttgatgttctatcaaggtttacatttacataatttgtaacatattcaaataaggtggtattaattttcttcaaatttatcactttttaataagttgaatctttcccgattcttgatttaaaattttcatgttagattcttcaaaagaaaattgtgttagtgtttgagttgattatgtgtataaagttagttacaaattaggatttggattggctttgaactttgtttgagatttactttaagctttgctttccatttttccctctctcgattttcatgatttggctctatgtgaatggattggattttgggacttgtgcttggacagcttggtgcattcttgctagattattgagtattagctttcaacccaagttcttttactcttttgccttactggttcattcatttaagtgagtgaaaacccaatcccatagtcgtatttctgcagctcttttttagagatcgatttgtctgcaccccattccattccatcgtgctgttattttttttcgcccttttctcatcaatgtctacccaagaggcctaatttaataacaatttttttttcatttttagttttttttaaaatatttacagaaataaactatcggccaaaaaaattataaaaatagaccctgccgcccacctccggggcggcaaactgacgtggcaaacgggggagggacgggcggtgacggagggaggtttttttgcaggaaaacccttgccgccctctgttggggcggcaaggggccccaatgcaaaaaagccagccggggccggccattttgcaggc

SEQ ID NO: 59941 - DNA, 6391 bp, Oryza sativa
aggaagtccggagcgacggcggcggcgaaccggagctcggcggcgacggcggagagagaggaggacggcgcgagcacgaatccgacgggagagcgagcggcgagtggcggaaacggaggagggaggcacggggaacaattatatagcgtcgggagagggagagagcggccggagagggaggaatcggccgcggagatctcggctccatcaatgacgccggtgaaacttgcgggattaaatccgaacgaatccgagggagagagagagggaaaagcgggggaaaacggagagggaatcacggggaatgattccccccactttattgcgcgcggggacggcgggatgcggcggaatcggcggcggcggcggcgctagggcacgggcgggcggcgggcgcggcgcgaggatagggatgacaggtgggccccacccgttagcgagggtggcgggcgggcccgcctgtcagcggcgcgcgcgcgggggaggaggccggtgggccgcgggggagaggagagagagggagggaattgggccgagccggcccaagagggaaaaaggggggaaaagaagacttttagggatttttctttttataaaaccttttcaactttgtttatttcttctcaattattatttgtgctctgaaaattccactaaaatttgagggctccttttagaccaaggagaatttaacaaaaattctccgggccacatttgaatttttcttgtacgtattttagtgtttgccaatttcttttcgaattttaattaattctattattccttttagggaatgatttttatttcgggatgaatttatcaggacgtgacagttttgctagtcgcacccatggcaattaaggaccggttcgcgggatgccctggaagaacttatcgtacttaccacaagccagcgtgggcaacggcagggcttgtagtgtagctttcctttagctgacgcatccaggcaagggtgggcgtgatggagtttggatgggccctgcgacggcctatgcggcttccggattcacctaggcacgagaggggactgcccgctgccttgcgaggagtgggggtgaaacctgaggtgtggtgtgcttggttagagggggttatgcgaagggtcctgtcacggcctctttccgatatgtcgtggtggcatgtcggcgcacggaaatgtgtcgtggggctgtgtcttgtgggtacagttgtacacctctgatcagagtaaaactattcgaatagccgtgcccgcggttatgggcggtcgaccagattcaccgtgattagtctcacacttaataaatcgacccaatgcactgtagttcaggtgggttggttgggcctgttcaacgtggtgtagcgttgatcagtggagattcaatattactttaattacttaattgttttactgttttgctcaataaaatgttttacaactgcctttatgcaaatagccacaaacccctccttgtatccgcttgcacgtctgcatcattggtgtggcttgctgagtacggtggttgtactcagccttgctattattcccccttttcagaagtgtagtgtttctgagttgaagacgaagttagaagaccaaggctcagaccccagttgagttttgcctgtggagtggagctgaagccccactaggattgcctttttccgctgctgctactttcgtttcggtgtgaggactaagtgcctcttctgtaagtattttacgctttatttaagtttggaactgtatattacttgtcgttttgtgtaccctggctggtcctggacagggatttagtacacagaatagtctggaaatttgggctaaatttctgggcatgacagtgatgaatgggtatttcccaaatggttctggctgggcggggttgaggacgtactccgtgaccagcgttgtcttgaaatttttccaacaattctccatcttgcggatagcctgctgcttgagtcctgcctcgacctctgtagggtattggaagctttccttgaactgcctccaggcctcttctttttcttggaccagatcgatgtggtccttcagaatagtgaagttccacctccctaggactccgcatatcgtagggaactttttgacagcttttgtcggagccgtcggatatccaacatcgtccacctctattatggtgtagactttcttaggaatcttattctaggtcctaggattccgactcgaagtagtcccagtagtggtcgtcgacattggttcgccttgctgcaacatgtcctatgtcactgttgtatggggagaaagtactttttaaacacaaaattgcatctacacacattctctgatagtttgatattcctctatctcctacctgcgttcgcctcgtcgacggaaccatagcatccatgctcaataaggccgaagcagccgggaactcgacctcgacatcagtatcccactcgaacttgctatcaatgtcactaccataagatagtggcaacggtagcaaaatctagtgggatatggatgtcgaggtcaagatcccgtctgctccagccttaaggaacatggatgctacatatctgctgacgaggcagacgcagatagaacacataggcaaccaaaaccctttctatccaagatccctaatgttatcatcagcaaactcctagattgcgtccaagattattttgttagggaacccttattcccatagatacaacaaccagctttggatactgaatttatgggaatggggttccctaaagaaatgaccttgaaagcaatctaggatattggtaacgataacagatttctagaaatgttgtatttgaacgaaatgttctgtttaccaatttttcttggctggtactgtgcaggctgtaacccgaccaaaccagatttggcaaccgggacacttcgtattctcctaaatgccataatttcagtaacttcatttaataacagatttctatgcatatccatcccatttccctcaaaatcacccaaaacagcctatattacacaagtcacatatatattatttttgtacctaaaaaaacacaagtcatgacatataataagtttggcctcagttttgctcagaaattatgcttcaattaccatcatttgcaactgcccccatccccaaaagaaattaagaacaagtgtagagggtctgtccttatgaaaaaagaaacagccatataaaaacagccataataattcaaccatcacagcccacatcaattcatccatcccattggacccaaaatatcccaaaaattatgcaaacaaccatatctctactacttaaaaaataagcgctgcttccatcgtccgtcaaaaaaaccggcgaaaaaaccaggcgagtgagaaaaaaccggcgaaaaaaccataactgttcgatcaaaaaaaggggcgaaaaaataatccgattctgtgcaaaaaaaaggtgacaaaaaaaccgggcaagagaaaaaaaccggccgaaaaaaccgtaattgtccgatccaaaaaaaagggcgaaaaaaatccgattccgtgaaaaaaaaaggcgaaaaaaataaaaaaaaatcggtctgattaaaaaaaaggaatcaggctaaataaaccgggcaaaaaaaatcaggcgaaaaaaaagaatctgattcctacaaaaaaaagggcaaaaaaataaaaataaaaattggtccgattccaaaaaaagagaaatcgggcgaaaaaaccgggcttaaaaattgggtgaaaaaaaccgggcaaaaaaaaaatccgattctatggactgttggtatttcttaacgatattaatagaaatataattcccagcaatggcgtagaaatatttctggtatattatggttacagagttcatccgcaagcgcacggatatatcattgtagtattttacccgagagtattccaagggtatcgtatttattttatcccatggaaagatcatgtagagagaactcaactaataatttatatattacttgtgataatcatattctaagcaggggttaagataatccaagggtagagtgacacacaagcattactactcatcctcataataatttatctaagctaggtggaaagaagagaaaagaaacctattcatatacttctagtatacatattatacatacattctagttagctgatatactagctaataccctctatccaatgccctcctggtacttcgagaagccacccctgactgccgagttccttacgacagcccgtcatgaccatccaaccagggctaaatacggaggaataccctccccaagaaattaacttaggattatatataggcgcggaggaatacctgtactgagctgtcaccatcagcggcccacctctcatccgtaatatataaccccaaataatgatatcccgtaatctagacactacgcctaaactaccagataatactctaatatcatcgtcatgacatagagtaattgcataagcaaacactatacccgtaccaaagcatctcccagataagctagcagcataatcagtataacatgaacataatgtaaagttggtattcatatactcgaaaagtattccaataccataaatttatatagaagaatattctaataaaagtacaaagcttacaaaagaggaaaggaaagctgctagagccatacccgaactcttccaaaggcttccggactcctgattcctattctaattctattccaccagctagatactactaaactaaacttgagaggaatgagagagctcttgctttaggtgtgtgagtgaagtgagaaggtgaagtccttttatagctgaactatgacggttgtgacggttggaatggtcggtaataccctccaaccgtcattggggcttcatctcaaccgtctagccaaaacctggatccaacagaggcgagggaggttcggccgaaccaccaagttgaagttcccaaaattaaaagaggataaacgatattaaaactcccctaactcgaaaagagggaataaaatacattgaaatttcccgacaaaattccctaaattcgaagaaccctaatttagggtaagaaccataagagttaaaatccaaatcaattaaactatgggttcgggttacttaacagacttgaagcccctaagctcaccagagcttcccgggaagcggcaccaccgcaccttcacctcctcacagtcacattgggttccctgtgcgcgcgctgtcctggagcacccctccattgtccttggcgtcgcccctcctgccgacgaggtctaggccgctcggcgctcgttgccgtttgcgcggccgcctagccggaccgtcatcgccgccttcgccgtcgttccacacgctcgtcgcgggagagaaatgggatggggagagagggatttgggagctagggttttgcccctctctctcggtcggcgcttcatccgagcggggaatatcagagacgtccattagatcggacggctcagatatcggcaacgttgggccgccgttgccgattacgctgcgcaaaatgggccgcggaagtgcatcggaccgtccccgcataagtgggccgcgctcagctgctcggcttgcgggccatcgaattgactcggtttgccgaagatgggccaacctaagtttgggccggcttgggaagacctaggccgaaagcaaatttgatcaaacaatgtgactcagattttttaaattaaagtctgttggataaactcctaagtaggctccaaaaaataaatctaaaactaaaccctaaatcctatgctaattcatcaaattagactcggttctacctatttgttaatatatcaaattagacttgatttttactgatttaaggttttcaaggtgtcacattatcaaacaaccatataagaacaagtgtagagggtctgtccttatgcaaaaaaaaaaaacagccatataaaatgatcccatactgccactcccccccccccaaataaaatgaacaagtgtagacggtctgttcttattgaaaaaacccaaaaatcacaagtatatatggtctgttattatgcattaaaaacccacatttaaacctaaacaagaacaagagtgaggccggccaaaaaatgcatccattttgcaaaacatcccatactgccaccccccccaaaataaaatgaacaagtgtagatggtctgttcttattgaaaaaaccccaaaaatcacaagtgtatagggtctgttcttgagcaatcatcattggccattacatcacaaatacatccaacatggcatttccaccaaaaatcatgcaaaattcatcctctgcatagcaatatctagatcatccaactactacaatgcaaaaaacatctactgcatccattgcatccatacatccaattcatccatacactgcat

SEQ ID NO: 59942 - DNA, 4806 bp, Oryza sativa
acttaattaaacatactttaacgaaaaatcatactatttttcgtgcagagtgggagaagctccccaccttagtgctttaaaagtacggaaaataaagtatgatatcaaaacattaaaatcaactccaaaaatacctaaaaatcatatctaaaattaaaatttaaagagtagttaaattctataaatctacaattaactagtttataaaaaaactatcagtaggctgcgtattccatgaagcattaggagctaccacaagaatatatagcatatgattttattagaaacctacaacctatatatccgaaaaatttggggccactgccactacacttaagttcttacaagctaggctcacctacatggtataaaattactttttttggataaaaaaaatactatttgttattcttgtaattttttatactatttgttattcttgtaaatttttgaagtatccaaaatattacaagttgtagcaaaattgggctattcagcaggcgactgctgctacgtgtgtgtgtgtgcggtactgttcatgctggctgtgacgcagctccaaacccaacagcgaaacagtctatatactcatagtttcgtgaaatttatttaaaacttaaattttggctagaactggaggtagtgattgcaacgcagctccaaaccctctagcgaaacaaccttgatacttagggtctgtttgttagagctctaattcataaatttaactccagcttcacatctctagtttattttgtgagagaattttatctaactccgctcccattttaggtgaagcaatggagctggagctacccttatagttccgtgaaatatatttattatttaaatattggctaaagctagagttagtgattgtgacgcagctccaaacccagtagcgaaacagcctcaatgcataatacagttctgtaaaatttatttaaaatttaaattttggctggagcttgggggtagtggtcggttgctgtgaattgggatgatctgatgcgtgtgaaaagggaagggactgatcaatggaaggaaggaggcatggtgagaacgagtcaattgttgggcagatggtgctaggagtacacttctactaccactgcctgcctactccatgtgcacgcctgccccaggcgaccgcatcccaacaccggcccacccccacgcgaccaccaccacacgcatccaactcgggaccacccacccagcgacccaaggacccaaaggccaggccacacccagccccgatctaccctgcactgcactgctcctaccagtacaacggaaagatgagagggatttgcactattactactgtacattaggatactagcagcagctccttcatgttcctacagcttcgccaataaatacccaacagtgccctagtacatgtatatgtacgtcgtacacccctgtgtccaagtaagtactcttgctgtattaaatcctaggccctccatcaggaaatgttacaaacattttaggcctccttttaattggagaaaaacaaaggaattaaaatcctacactattcatgcctttgatttgtaggaatgagaaaaggaaaaacgtaggaaatttcttattcctacaattctagagcaaaaacgtcggaaagttaacatccactctaacctcttggaaaactttccttagtctatctctatcatgtcattcctgtatttttcctgcggtctaatcaaacggtcattcctatatttttcctgtgttttgtaatcctatgttttacacttgcaatcctattaaaatcccgtatttttcctattcctccgtttttttcaattctgcaattcaaaggggccctaagcatggagaaagtaccaaaatataaccaaatataaattttagagttttttcaatcgtatatttgtcttttacttcccttgtcttaaaatacgtgataagacatatattattattatgaatttagacataaatctgctaaatttataatattttgatgtatccactattctatactaaattgctttatttttgaacgaaaagagtaaagttctagctttatcctttaaacctgatatgtactataaaagttttatccaagtcagtcagaggccatgggaataggcttcaccgctaacaaaaacaagcagatgtgtggaagggtgtactaccatggtttgctacggagaagtgcgcagcgttttaattgcaggtccaggcatgtggctggggcacttggagggtgaatttagttcgtttcgtcggttgcgcgcatgcatccgcccgagtgggggtgtgtgtggggtgcgggtgcgtgcatgcatgcacgaacgcgtgcagaattctgcagatggagcgtgcgacgcaacggacggacggacggatcgatgatccgtgtcggcatcgacatccttccggataccgtaatggccaagcccggtttttggccgtttttgtcggagtagacgacggatacggcgctgctctgcctgccgtctcagccatcaccaaaccgtttaaatgggattaccgtcattctacgaaaaccggaaggttatcgtgaaaaccatacgtttaccgtgaggtttattatgattataaaacctaagaagattagcacagatgataacggcgagaaccgcgagattttacaaatcctgcctgccgctgtgcttttcttttgcccatctgagagcaggtacttgtactctctccgtacttaaaaaaaccaacctagtattaggatgggacatatcctagcgcaataaatctgggcatagagcatgtgggctacagatttatagccagctgcaacacggatttcaagacacaatatgtgtatgataggatagaatcagatattaataatgtagtatgtaactattgtatgaattaactattaaattaattatggataatttaaagttattagttggctatataacttgctgtgagctgatgcatgatgcaaacgctgaagcctgaagacgagtctcttatctgatgaaaccgtgatggtacagggctaaggggggcagggagctcagggacaggggtagtgttgtcttttcgcagccactgatctggttttagggggcactgctgggtgggccccctgtcactgtgctcaatatcagttgctatatgttttttcttcccctctgtttcttggctgggctcactaggaatacaggtttaggtcactgtgccaattgaagtgcctgcgatcgatgacagattaactcaggtataattaagagcaagtttaataatatagcccactgctagctccaatttatctatagccaatctaatagctcattcatataatagttatatactacactattaatatctgatcacacctgtcatatacacgctgcgtcttgaagtccgtgctacaactggctacaaatctgtagctcactgctcttctctctccttatttatctctttaaaatgtgtttgtaactggcttataacttactattatacctgctctatggggtagtgacaacacaacttgtgtttgttcggagtggctacctataggataggaagtagaagtactgtagcgcaaccttcgtgttagaataaattttttaaattaatataagatgtgacatattttaacattatgaatttgaacagacatatgatgagattcgtagtattagtgtactagattaatctattctaagatggagggggcactattaacttagtataattatttaaaatttattatcactaatattaattgttatctcacctgtactcatggagaaaagaatgaaaacgagggaagaaaaagtatttatggtttttatggttttctcggctttatcctcatttaatttccaatcgtactttacgtttgtaaaagttgagtagtctgcatagatatgcatcggatccatattaaaaggaatgattctttttttttttgcgagtagtacgtacatacgtaccttgatcaccatccatatgcatcggatccatattagtaggaaagattttaatagatttaatctaatggtctaaaatatcgggtccaccaatttaagtgaaaatcaatggctagatgttttgcttttttcttagaatttctttgatttctctaatttattagagcaccaagtggcggcttaggagcgtttgtaggaagtttaatggacttttagtatataataatagatagatagatagatagatagatagatactaagttataatgacattgccaattttccatcattttgaaatacgttattcgcattactagtattatagtgaattatctacttaactataaaaatacattatttttttaaaaaataaacttgataaataatttagaacagacggtctgaacaatgtggtagaaaagaatatttttttaaaaaaacatactgtaattttaaaagcatggatcaaatacaaataatacacggtattaatccaacggagtaggagtacacccctgaaaaagtgaaaacaacagggccaaagtgagtgctggcctgttgcctgttggcagtggcctgctgatgaattgcgccggagtagcaacaacttcaaacactgtatcctataatcaaaagctctctccatgctgctccggccggagtggcgcacctacctcactatacctctctagcgactaatcctatacgtacttgcagtagtacattggtactggtatttctacagtcgtaatggtgaatgatggctggtctggcagcttggctggtttgccctgctgcttggacaatgttagcaggcgagtctcgttgcacggttgcc

SEQ ID NO: 59943 - DNA, 711 bp, Oryza sativa
gccgtgctcgcagttatcgagcattgggactcacaatggcatcttggttagaaacataattccaaattttattaaataatgttgcattataaacatcatagactttctacttctacattttcagcctttctgcaagtaaacctagctctatacaaatattaccatttcatgcattcattattgattaatataatagcttgctgagtacgttgtactcacccttgcttcaaccccactttttcagagtctatttgatgttcttaccgaagctgggagttcaatcatacaagttagtctcattctaacttagttctcaagtatagattagatagatggtttaagtctatagccaaacattagagttaagtcattctatagcttttgctgtaatagttagccacaaccttgtaaatacccttatattttataaagaaatctcctttgaaaccttaatcaaatgtatgtaatgaagatatagattgttgaacctgtatcaatctaccgatccagggcttgatacagttaaacatgtcggtttccaaatcattagttctgggacccgacacgctgccgctaggccaccgccacacgccgccgtgccagcctcgccaccctcgctggtgtgtttggataatgggaaatgaagggtgggattgggattgggattgggaaatgaataaagggttacggttaaatggaagagaatgaatg

SEQ ID NO: 59944 - DNA, 14427 bp, Oryza sativa
gtgctcctctcggcgattttctcttccaaccgtggaaatttgattcctctccgtggaaatttgattcctaccacattggtggctaggaggttcatcccgcgatcgatttgcgatttcccctctcaaggtagcacttttgatcttctcttttggttcatcatgtttttgccccgatctctaaatatgtgaacctagggagaaaaccttttggatagaattgttcctgctaccttgtagattgtcgatctataggattgtcacatgcactggcctggttaaatcctctattcttcagttttgcaggccggaaattccggtgttcttggcccggaacttccggtctctgtccagccagccagtaaccttgattttgctactgtttcatttaaccattgcactccaaccttgttgattcttgttgcagtggtcattatgcctcgtgagaagagacagaagctttctcaagatgttcctgctgactcaagccccccggttcgtggtcctagggggagattgggcaaagaaaaagttggagatttttacagtgggagtcagattccgatccattccaggagggctagtagcattgtcattcgtgatgcaccccgctctccctctccagctgcatctgactcagatgatggtggcaatgaggatgagcctggttctgaaagcaatcctttgaggctatacaagacaagggctgttgatcctgatcctaaacgcccaagagtgaactatctgaagaatctactcaagtgtggaagggacagaatggttagtcctgatactctgccagctaactctcaggatgacagattcaggaccttggtgtaggttgattggtataactctgtgatcatgggaagatctcatccagtggtagagatgaagtggctagactggcagtacatgtcctcaaagaacaacatagtcttcaatgaggtacgcaaggtgtgtgagcgcaagcacgtggcagatttgttggccttgcagtattcctggaatgaggaagtgattggacagttctactccactgctttctttggcaccactaagaaggggcttgattttgtgaagtggaccattcaagggcagcagtatagggtttctatggcacagtttgctgcagctttggggttagatgatgatgacctgagtcgtccacatatctttgtagaggatgctctgtcaccgaccagcactacctttatgtatgagaaggatgctcccaaggattgtttggggactactcgagggttgcgtccatattatagagtgctgtactctatcttcaggtggtctttgctccccaaagtgggagatgctacagctcttccaggtaggcatgcactcctccttagtcgcatgcgctataacaagcccgatttcagcatcatgaagcttatctggagtgagatctatgagacagtgtgtgagccaaagagaggcttcatctatgctccttatatcatgaagatgattgaggccaagactgggatttgttatttcaaagacaatcaacacaagcctttccgtcctcatgctcccactacttcagctactcctaccaccagagtgactcgtgcttccacctcagctgctccttctttctctgctgcacctcagcgttctgagtcttcttctcccataaagaaggctctcagggctatcttttgcatgtgtgccaagacagctaagaggtaaagaagatagagaggcgtcaaaaggaagattggattgcaacaggcaaggatgtctctgacatttctgatgatgagtttgttgatccttttgctgcttatgagactgctcgagacattgctagtgatgagggtccctctggcacttctcgtttctttaatgaggagtcctctcactccgaggagagcagtgatgatgaggagtcagatgcccctactgagaatgctcctacagatcccaatgaggcagtggatgccgccgggcaagacatcgactctcctcactctggcgacactgagatcattccttctgatggcgataatgatgaggcttgatcctcttcttcccttgtgattttgtctctttttagtgcattgatgtcaaagggggagaaaattgcaatcgaagggggtcaaaattttgtttttgatgcttactgcctgctgtctgtttaatccggaagttccggatcctcttatccggaagttctggacctggcagctccctcgccttattgtcatgtcagcttgtccggaagttcctggtattttatccggaagttccggaccttgcaatcctttggcccctattcttaagaactcatggacatgttctaattctctatttgtgtgaatgtaatggctgttagatgctcttagctgccctttatttatactcctcttcatttatgctatgagtgtcttatttgttgtttgtgatgtgatgttgattttatctttttgagtgctcaacgtgtcgtatcttttgcatataatatctattcttactgctttttgcatcccacgaatgagtagggatgaaggaaactctcctcggttgctcccttatatatatgcatatgagctccactcatatcttccatatgcatacattaagggggagtttcattcacctctaaccattcaaaacaaaattcttatcaatcttttgtaagctttaaccatgttatcatcaatcaccaaaaaggaggagattgaaagtgcattaatcctcctagtgggttttggtgattaatgacaaatgtggttaagagactaatgagctcattgagtagctttcaggtgcattagtccaaggtgtggaagatggatgcttggagaccccccaaaaagtacaaaatcaaagcggaccagaactcgagaagtgcataggatagtttatcttctgaaatcgagtttttaggaaaaaccgtactattaagaggggttccaggtgatgctctgagatatatcaagtgctcttagtgtgaaccaagtgtcaagtttccctaggagttctttttttttttgcaaatactccatctgtccaaaaatgcaagtccggaacttcctgtcttctaggtctagaagttccggtcttgtgaaaaagattttcctaagtgtagtccggaagttccggtcttccaggtccggaacttcctgtcttgtttccagttcaaatttgtgagtaacggctagatgacgtcacctagccgttatacatatacagttcgtttccagctcgttcctcggccattccactttcacttttcgaacctagagctattgctagcctctccgaagtgtttcttgtctttccactgaatctagagcctaattcttgtatgaaagagagattgagagggagagaagaagatttggagaggtgtgaagactaggatcttgggtgagcacttggaatatctcgtgggttgtcatctgagtgcttattactcttggagatgatctcctagacggttaggtgtcacccgcgagaatccattgcgtattgtggatgtcccgggtaagtttgtgaaggatttcctctcctccaaaagggaacgaggtaagttagtgaagttcttgtgctgagattctagaggctttccaagtatagcaacccacacttgtagtggatttctagaagtaggttgagttggatcttggtggtcactcaattctagaaatttgcctaggggtgtttggggttgaaggctgtggatttccactggggtttttgcacaagtgaggcaaggggttaatcgagacccagctctttggagctcctcaacggagagtaggatcgcaagatccgaacttcaaaaaaaaatcgctcttgtctctttctgtgatgtttctgtgaatgattctgtgatatatcctctgcttagaatacctgtgcaccatcttgtgaagattggcttagtctcctgtttcgaaatttgaatttcatctctgttttgttacccggaagttcttgtcttagaacaccggaagttccgggcctggcaggccggaagttccggagttccttaccaggaagttccgggtctgtttgaattttaccgttgcgatttgtttttaagatttcagggacaacctattcacccccccctctaggcttcatcagcgcgttcagtgcgaccgccgctgtggaagccgtcgttgtcgaggacggcaacacctggaagctctcgcgtgggggaggacatggggccgagggatggagaggagggcgaggtcgaagcagtcttcctcggcagtccgctcctctcagcccgcgtcgagaaaggcggcaagccgcagcggagcggcgggcagccatgccagggattgctttttcttttctttttttttgcgcgatggcagattgacgaataacgagcagtctcgttcgtttttgtccctccgcggttgctcgtaaatgggctgaatgggccgtcctcgccacgctcgtgcgatgcggaacgaaggaagcagcagcgccgtgagatgccgatcggatgatggatcgacgctggatgtccctctgacattgtgcgcctaacgtcagacgatctgcttcccgtaatctcgtatactcatgggcacaatacagtgacaaaacaatcgcaatttggccgagtttagtttcaaactttttcttcaaacttcaaaatttttcgtcacatcaaaactttcctacacacataaactttcaactttttcatcgtatcgtttcaatttcgaccaaactttcaattttatcgtgaactaaactgtggagattatggatatcccatatctacacggcgatggtatttggactgaatataggataccgaatataggtagaatatcttatttgtatctcgggtttgtttcttaacttgtacatcaaggaaacaccttgagacttagtcggttacgactgtattttatctgtatctgtatattccgttagggatatagattatcttttgtaacacggactccttcccatatataaggggggtccgggtgcctctaggggcagaggttgattttctccaaatcatacaatcaataatacactcggcggattcatccccggacaggagtagggtattacttcttgaataagaaggcctgaacctgtataaatcctttgtctccaaacccatacacttttccagctagatagccacccccttttattattgccgaaatctagtttcgacagttggcgcgccaggtaggggtagcgtcaagcttttcgccgatcagtgcaatgggttccgtctccggcatcgacgacctcgtcttcccacccgggcagacgtttcggttcggcagcctcgacttcgtcaccaacaacttcggcaagatctctctccttgactcggtgtcagtccagtcgggagagaaccagatttcagtcccgtttggactcccaaacgcggctgaaagttacttcaagaccatctcaatcgagtcggcttcaaaccactcggctgagatcgcatcttctccaacgacaccagatcgagatgatggggcttacccaccggtcctgatgaagctccccgacgatttggctgccatctccatcacgacagcgtctccatcccgcaggcctaggcggaagtcggcttctacaccgatttcgcatgcttcagggaagtcggcgtcatcctccaaccactcggcacggtttcgacggatcagctggatggctactacagctctcccaccgtcgactcgcgccccaccgacatcgtggagtacgacgagtttagctctcgctacaacgacccggatctcgacgacttcgatgaaagcctagatgacaactacacccctctcttcttcggcgtcttcatggccaataatgagacggaggagcaacgccaagcccgggagaccgaagtgcgtcgcgagactgagcgtcgccgactggaggaggagcatcaagcacaagaacaagaacggctacggcgtgagcagcaggagcgtgagcggactgcgaaggaggctgaggatcgacggcagcgagctttggaagcaggacgccgagcgcgtgatctcatcggtcagcaagatgttgaagggacaccggtttttcgcacccctcaacagaatgcggttgccgcgatcaccctcctcgacaccctcctcaaggaaaacgagctcaatcaatctgatcacgtcgtcaacatcctgaaccagacgaagaccatgattgcagcttcggtcccagttaactccgaaagcgtccacacgccgactggcagccgagtcccccacttccgatctcatgactaccgtcatccaagcctcagcatcactggcgcaggatccaatcgcaggagcaggggtcacgacgagcggtccattcactcacctcccgaccatcatagggagcgccgagtggaacggcctcgctcaccacctcgtcgtcgccccgtcgatcttcgcgacacaatcatacagcgccgagcagctcgaggctatcatcattcgccggaccgccacgacgacgaccttgacggagtagcagccttcaccgacgacctgcgtcgagtggattggccagccggcttcaaaccgactggaatagagaagtacgacggtaccactaacccagaatcgtggcttaccgtctacggtctcgcaatccgcgcagcaggaggagacagcaaggccatggcgaactatttaccagtggctctagcggattccgcccgatcttggctccatggattgccccgtggtacaattggatcttgggctgaattacgcgaccacttcatcgccaacttccaaggcaccttcgagcgtcccggcacacaatacgacctttacaacgttattcagaagtccggggaatcccttcgagattacatccggcgattttctgaacaacgtaacaagatctccgacatcaccgacgacgttatcatcgccgcattcaccaaagggattcgccacgaagaattggtcggcaagttcgggcgtaagcctcccaggacagtcaagcttatgtttgaaaaagccaacgagtacgccaaagctgaagacgccgtcaccgcatcaaagcagtcgggtcccagttggaagccaaacaagggtacgccggccacgggaggaggtggaagtaacaacaataaggaccgcaagcgtaagcctgtggaacttgttgcaaccgccacccattcttctcgacagcgttcgcgcgttaacacgttcgacaagatcatgaactcccaatgcccgcaccatcctaactccaaccacgtggccaaagattgtttcgtctacaagcagtttgcggagcaatacaccaagactacaaggaagaattctgacgaagaacaaagcacgtcgaggaagaaggacgacggtgacaccccggcaggatttcaagaccaccgcaaggagctcaaccatatcttcggcggccccctggcttatgagtccaaacggaagcagaagttgactgaacgggagatcaatactgttcagcccgacacgccccagtatcttcgatggtcagagattgcaatcaagtttgaccgctcggatcaccctgaccgagtggtccacccggggcggtaccccctggtactagacccagtggtccgtaatgtcaagcttcgcagaaccctcattgacggtggcagtgcgctcaatatcctcttcgccaagaccttggatgatatgcagattcctcgctttgagctaaaaccaagcaatgcgccttttcacggagtaattccaggattatccgcaactccactcggccagatcaccctcccggtcacctttggcactcgggaaaacttccgcacagagaatatcagctttgaagtcgccgatttcgagacagcataccatgccatactcggacgcccggcgttagccaagttcatggccgtcccgcactacacttacatgatgatgaagatgcctggtccccgaggagtcctagccctacgaagcgacatcaagcaagccgtcacatgcgacaaggagagttgcgacatggcccaaacccgcgagatggcgtctgcccgagaggatatccgactggctgcagccacggcgagcgaaggagaagtgcccgctaccaagatttcaaagagtggagaaagcgaagccaagactaaaaagattcccctagatccttctgattctactaaaactgttgtaataggcgccgagttagattgtaaataggaaagcgcgctcatcacctttcttcagaacaataaagatatctttgcatgtaaaccatctgatatgcccggtattcctagagaggtgattgagcactccttacatgtcaaagaagatgccaagcctatcaaacaacgactccgccgattcgcacaagacaggaaggacgcgatcaaggaggaattaaccaagctgttagcagcatgcttcattaaagaagtccttcatcccgactggctggcaaacccggttctagttcggaagaaaacagggcaatggcgcatgtgtgctgattatactgacctcaacaaatcttgccctaaggatccttttgggttgcctcgcattgaccaggtagtcgactcgaccgccggctgtgagcttctcagttttttggactgctactcggggtatcatcagatccgactaaaggaatccgactgcttgaagacttcattcatcacgccctttggggcatactgctacgtcaccatgccgttcggactgaaaaacgcaggagcaacttatcaacgtatgatccagagatgcttctcaacgcagatcggtcgcaacgttgaagcctatgtggatgatgtagtcgtcaagaccaagcaaaaggatgatttgatcttggatctagaagaaaccttcgcgagcatccgcgctttcaggatgaaattaaaccctgaaaagtgcaccttcggagtaccgtcagggaagctgcttggttttatggtgtctcataggggcatccaagccaacccggagaaagttaccgctatcctcaacatgaaaccgccaagtacccagaaagatgttcagaagctgactggatgcatggcggcgctcagccgatttgtttcaagacttggcgagcgggggatgcccttctttaagctactaaagaaaacagacaacttccagtggggacccgaagcacagaaggccttcgaagatttcaagaaactcctcaccgagccaccggtcttagcctcaccacacccgcaggagccgttgttgctgtatgtagcagccacctcccaggttgtgagcacagtcttggtcgttgagcgcgaggaagaaggccatgtccagaaagtccagcgaccgatttactttgtcagcgaggtcctatccgactccaaaacgaggtaccctcaggttcagaagctgttatatggtattctaattactaccaggaagctatctcactactttcaaggtcactcggtaacggtggtcacatcattcccactcggtgatatactgcacaaccgcgaagcaaacggacggattgctaagtgggctttggagttgatgtctttggacatatcattcaagccccgaatttcaatcaagtcccaagcgttagctgattttgtcgccgagtggaccgagtgccaggaggatacccccgcggagaagatggagcactggaccatgcattttgacggatcaaaacgactttcaggcactggagcaggactttccttgacagccgatgatttccttgacagggagaacgccgtgcgccaccatctccttcaggttctcctccgtcacgtcggacggcgcccattggccttcaaagctttcgcccattggccttcaaagctttctttttcttctgccatcgattttacccgaatgcgctgatttgattcgagggatggctggggagaggtgagggattgaggcggtggatcacgggaaggattttgatgaactttttgaaggtggattcgagtggaatggtgaaccctagtttgccggcgcagctctgtactgtagcagggattggggaaaatggcgagagttccggcggggaagacgaagcgtcgcttcaatctcgggatttcttgttaagggtatcggaggtgcgaatgggcttaggcctgaacagtacctcagcccaatacttttgacagcgtggcccattgtgttccttagagacttaggcattttttgctttggcaatttatgcgcacaatagtgttgcccaatgctgataaaatccttttttatgcggtcatataattctttggaattattgcaatgcaaattaaaaggtgcccgacagaaaggcgttatgctgtttttgtaagcttttttaggctacaaaagctgtctgggttaacttggaatggcttgtttttaccatagtcatttccttggtatgttatatgcctgttttcattatggtaaatagtcatagcctaggctattagacttgttcattaccataatttttataatacttggtgggtaatctttagagttttttattcggatgcctgtcaagtatgttcattcgtggaccttttagagtgttaaccactcggattccttttattatgaccaaaaagcagtcggcaagaatgcctctttaggcgccgcgtctgcttttgtcatatgatgcacgattgtgctattattttgttctcaactatatgtttagtttgttaactaatcacatagttgggggctacacctaattaggtgcatctattcgatgcaccatattctttattttttcgccctttacagtcttcgtcttcgctactcggcaggccttagcatgaaaaatttgaagcactcggattattatctttgagaaggctatgatggttgactgcaaaggtctcgggggctactgtggagattatggatatcccatatctacacggcgatggtatttggactgaatataggataccgaatataggtagaatatcttatttgtatctcgggtttgtttcttaacttgtacatcaaggaaacaccttgagacttagtcggttacgactgtattttatctgtatctgtatattccgttagggatatagattatcttttgtaacacggactccttcccatatataaggggggtccgggtgcctctaggggcagaggttgattttctccaaatcatacaatcaataatacactcggcggattcatccccggacaggagtagggtattacttcttgaataagaaggcctgaacctgtataaatcctttgtctccaaactcatacacttttccagcttgatagccacccccttttattattgccgaaatctagtttcgacataaacacaccctttaactactccgtacactactacacacgccagcagtgatgtgaagcacagcaggtgatcggagagaccatctctaatactaggcctctacactcttacttggccacggcgagttctcgccatggacgacgcatcgattagtactgtaaagcctacgcgccggcgccgaggcgctgggtggcaaggtcgcagcgcgctggcgcgaagccgacgcggccgttctggaggtcgtactccacccacacgttctgctggtggtggtgcccgatcacgtacgccgacatgccggccatgtccgagttgccgaacgtcaggcaccacaccgcctccgcgcccccctcgccgcgccgctcgcctggcaccatgtacaggagcttctccccggacacggccacctccgcgccgcggagtacgaggcccacctccgggaggaggccgctcgccgccgccacccgggcctccggcccgcggaagcacgcgtcgaacgcgccctggaacacgaaccctggctctcccagcggggccaggagcaggcgcgcctggctcgtgaactcggccttgagcgccgcgtaggcgtcggcgaggaggaaggtgaactgcgtgccggagtccaccattgtctgcccggcgccggtgtggtccggcgtgagcacggactttgggatggggagcagcgcgcagccgacgcggatgccctccagctgcacggagtatgccacccggtcgaagtacggcagcggctgggagatctcgatcagcggcgtgtagttgagcggcggagccacgccgccgtcgtcgccgaggaggaggacgccggggccctcgcctggggcgatgcagtaggcgaagcgacgggtgcccgtctgcgtcacgaaggagagggtgccccggttcatgccgaggaggccggtcgccgcctccgagacgtccgtgccggtgccgttgctgttggtggcggtggtcgacgagtaggaagtgatgcaaccgaagtaggcgcccacggccacgggcggggcgccgccagtgaggaggaaggtgtcggtggcgaggaccccgtcggccgaggaggcgtcggcgtaggagagggagacgcggcaggcgttcgacggcggcgtgtcacagaacggcgggacggggaggtcgcggccgcgccactcgcacgccgtcgacgggcaggggaccgcgccgtacgaggaagaacccgacgcgttgaacgccggggtcagcggcggcgcgtagctcccgttgcagagcagccacgagagctcgctgccggtgtcgagcaccatcgtcacgttctgcggtggcgtgccgacggccaccggcaccgtcaggctcacattgtgccggaaccggagcctgttcgccgccggcgcctccaactccacctcctgcacccgcacctgcagcgggaggaccgtgcccgccggcgacctcccttctccgccgctcgcaagaaagacgcagaggcagagcagaacaagagacgcctccatgacgcgcgcgcgcggccggccaacgcagccacccttacgttttacctctcaaaagcgcgcgttaagcgagaccaaactctgcaagaatgcaaacggcaacgcactctggttaattcatcggatgcaccagcatccggcaattacaccatcactacaccttctcctcctcctcctcctcctcgtggcatcgacatctccatcattagcgtcaccttcgcgagcgttttgatctttgcagatgtgtgtgtttggtgtagcagagcagtagagcagcacagtacactacgcctactcgccatgttgcatggtcctttccttcaccctggggcgggctggtcccgtgcgtgcgtgtggggggctctgcagctgcaaacatgtacaggaggtgaagtactacgtacttctacgtggagggatcacggatctcatctcataaatacgctagtccggccggggcagcgaggactttcagcacagatgctcgttgtcgatggcaccatccgttgttaagtttgtcaaaggagatctttctgtgttactattggctccagttcatcctgtctgcggttgagaactcccaggtcgatagctggattctatgccatggaacaccgaaagaccgaacgcactggccagcttgcgcagatgtttcagtgccttgagttcaaaaccgaactagagcgaaacgctactagctgaatcctcggtcctccgtaggggtgagacggtcatgaaaattcccaagcgaatgcccgcttatttctgatttttatcagtcaagcaatgtgaaaatagttacttacagaacaaaaataaaaatgaaaatagtaaattatatgaataaagaaatgaaaatgatttctctgtttaccgacgtttccaaattttaccataattataaatttttatattatagtaattaccgttaatatttatggtccgtatttgacccataatttagaggcatgttaacttctcaaccaaatccctaacttaaatactccctccatttcataatgtaagagtttctagcattgtccacattcatacattcatatggatgttaatgaatctagacatgtatatgtgattggattcattaacatccatatgaatgtgaacaatgctaaaaagtcttacattgtgaaacggaggaagtacatgattaaaaggaagtcaatttataatttatatagtgcaaccttgaatttattttggttggaaaattttgctacataacacctaaaacttgtctaacttgctgatagacatcgaaaaaacgtgtcatgactaaaagacatccaaaaaactggtggtttgccagagaacaatttcgaatcaattgaagagataattttttaagaaagacgagaatgtatttagtaccacatacttcaaacaaggcgttaaaataaaagtttagaaattacgcaactctaaatttgccatcacttcaagtacatcactagcatatatcgtattccttattcactccatcctcagatcaaaagctttcgatcttaggggttttctcgtccttttgaagaattcatttctccaattgagccaaaagtatcttctaacaaattaccatttttttagagtgtcttttagccgtaacacgtttgtacgatgtttcccagca

SEQ ID NO: 59945 - DNA, 5585 bp, Oryza sativa
caaaaaatgtctacgtttagtttgtttccaaaattagcaaatacataggaaatcctgccaaaatttggtaaggtttattttagctacaatctaaacatgccctaaattattaaaaaaataaaatttgcatttatttaatttttaaagcaacttctataaattcttttttgcaagaaacgctaatgagaaccgaggaagaagccaacccgctcttcacttttgaacataccctatgtatggttaatgctaatttatcctctcgtgagatcacattaccttaatcgttttaagcccttagattattcatatatgctatgaaatgtccttcttctctcttgaaaccatggacatcatctcatctatattatttttaccaaaccatcccaattattttaaacatttggatcactgatctattatcactcttatcttattgatctacactatcttaatatttctagcattggaggatctacggaagatgtaattttgtgtaaagcacatgaagttaatttgtctagatacaaagcaaattcattttgtgcttcaacttgttatcatacaattttccaattaatgggaagatgcgatattttgtagtatctctagtattttaaacaaaattaaaaataatgcttctgcgtgtgagtgggttttcttcctagtggtttaaatacttgcgaaaattcaaaaaacaagataagtcattgtgtgacatgtcctttggtaaatttctaaggtcaaaatgactttatacacggagacaaacaagacaataaaaagtgctgttgtatttacaattgaatttgttttttttctccatgtgggtaacgaatctaaccttctatatttttgtgaatagatatatgatcacttatatgttttctaaggccttttcatcttgcttttgaggcactagctgatttctcggctgctcgctactgtgaaaattttgaggcaaagatcctgtttagatctcaccctaaaatttttcaccctatcatatcgaacgtttaaaaacctgcatgaagtattcaatataggctaaaaaataattaattgtacagattgcgactaatttgcgagacaaatcttttaagcctaattgctccatgatttgacaatgtggtgctacagtaaacatttgctaatgacggattaattagacttaataaattcgtctcgtggtttactaacaaattctataattaggttttttttattagtgctcgaacatcctatacgataccctatataatattcaatgtgacaggtcaaaactttacccccatgaacacccccaaagttgcaaagacctcatctcacacagtcaccgactcacagtactcgtacttgtcagttgtcaatctcgacacggaggaagaaggtagctgataccttggcgcgctatccatggctgtccttgccgactcagcagccaggaagctcctccatggcgcctctgctcagggcgtcgccgccggcatgagccttggcctcgatggcctgttgcagctcgtcgccgacctcttcgcgagcctcgtccacctgttcgtcctcccgttccgggccatggggcatgccatccagtggttcttcgccggcgtcgtcgctggtctcgggggcgccgcgcgcgtgctcgtcctgccgctcgagacgctgtcgcgctggctgcaggcggccgtcgccggaatcgcgagcgccgcgcacctgctcgtcctgccgttcgaggcgttctggcggtggctgcgcgacgcggccgccgcggcgctcccgtacgtgctcgccatcgtcgccgtcgtgtgcgtcgtagcgcttctctggctctcctgcacgttcctgtgctccgccgccgcgctaatcgggccgccgctcgccggcgccgccatctcctgcggggcgttcctgctccccgccgccgtgaggaccgggcaggcgctcgtctacgccgtctgctacgccgccaggggtgccggcgtggtgctcgcctgggtgctcccccgctgcgggcggtgctgcgtcgtcctcgtcaccatgaaggcccccggcgccgccggcatggtgatctcgcggggagcgttcgaatcgctcccgcggctctacttccttcctgatactgcgctccgctggcgccgtcgtggccgccgccgtgttctgcgcgcggcccgtcgcgtgggtgttcgctgcgccggtcgccgccctcttccgcgcgttgtgatcaacaaacttctctctgtgcttgttgccggtaatgcctgacatgacatctacgtacttgtgctatctaccgctagtatattataagaagtatagcaccgcgtaaatagtcgtgtgaactgtgctatcaataattcaatggtatatcgctcaatcattgttgagttgatagtatgtttagtttacttttgttattaatccaatgctacatattgggagggttctgctatttatagactaccagtgtcacatgcgtccctcctaaaataaagtttttttttctcaagagagcacgaactagaatcagttgatagcagcacagatcagtatcgttgtctgcaattgaaaatttttgaattttagatttggttttggaattgattttagggggtttcttatcctcagttttgtcttcgtcctttctagctttgcccaaaatataagtaaacaatctgtacaaaattattcttaactaattaaatattcaaattattttacaccaattgattatgggcctatagcttcatgtatggagtactaaggttgtcatcatttgccataaaagcttactaaacttgagtaaggttaggatttgaacaccttggcaagcttaagcctcatttgaattggaggattaccatatatagttcaacttcgtatcaaaataagaaagagatccaatctcttgaaaacatccatttgctttgttttttttccctatgatgctatcaaatggaccattttctgttttcttacgcttttcattcttgtagaattagagtaacacgtaacttcaatttccgtgttttttctatttcaatgtgtttcctatcatacattatatttcaaaggaggcataagagaaatttactagtagtaagtcatttaggatgaggatagtatttattgttggcctttcctaactaagtgtacgttaaaaataaaggtatggtcaattgtataagtacatagcagagaaactgaggatgcgactacgtaaggcgataggtaatagtagtgaacctggcttcccgggtcctgtgccaccaagagcttcatcggccaaatcctcatgcatagtacactgacgcgctgggtgatgatgaggggagggagatgctgcggtcaaacttgttgcatcggcttgatccagttatccccaagctcccgggggctagatccagtaccccgcatagccgcaggcagccaaatctagtggtccctaggggaggtagataccattgtcgagcggtgcatattggctagatctaaccagcccccgagttcatgacggccagatctagcggtggtggagaaggagaattgaaagaggaagaggaggaggcgcagcagtggtagggacgttggagtgggggttagagaggaaaaggcaaaacggctgttggcggcaaggaggcgcatgcatccgaagaaagagagcaagagagagcagagagacgtgcatccttaaaatcctgatgcccattgcccatcggctcaattcccattgatcagctccgcagccagttttttctacagcttccttaaagtagcacatatatgacatatgtagtgagcttttttttaataaactagcacatatcttataagtgttggtttttaattttagccttccatggggcttgagtgaatgggaaatatgttatgtgtgtaattttaggtgaactagtacataggtgccatgtatctgttcttatatatgtatagtcatgtactctctccgtttcacaatgcaagtcattctagcatttacatatttatattgatgttaatgcatctagacatatatatatctatttagattcattaacattaatataaatatgagaaatattagaatgacttacattgtgaaacggaggaagtatgtgttgttatgtggtagtcttaggttgcttagtttcaacaagtggtacttatcttcttaggtagtttattagcatatgattaattaagtattagaaaaacttgaaaaaagattaatatgtttttttacaataagttttcaatagaaaagtttttaaaatatacattgtttactaatttggaaaccgtgcacgtaaaaaacgagagagtaaaaaatggaaaagtgtagaaaaaaacacaacctttatacttcctggttttttttgtccctttcctttttcgagcgaacttgcctaatctacatatcgcaagtggcatgcgagcatcccatgcaatttttacgtacgatactgatacgatttttcccgtgctaattggtctcacatgcacactgaaaggtagtcctggctttagattgggcctcttttcttcgagggagaatgaataatcgatgcatggacccggcaaattatgtttcgtatctctcagctttccattattattaactaattctttgacatgaccagcagttctgttatagtcaaggctatagcttagacgtacatacagatattgccgtcggaacttggttgattgcaacctccaggcgcgttcactttaattaggaattattatagtcacagcatttaacatgctactaaatgatgtgccttctcctaaaactttgttcgacagtattttcttaaaaaacattattaaatcaacttgttaaactatttttttaacatagtacaaacacaaatactcacaacgcgcgcatactcaccctataaatgcacacatccacacatcattctcatgtgtgcacctccgaaagactacaccggtatatcttgagattgacgaagtaattataggtgtatcactatcgacggatacatcacctaaaaaaaataattgccataaatatgagtactcgtgtcaaatctaaaacttgaacctggtgagttggttccttaaaaaaaaacttaaccagttgagctattaatcaatttgttaactttgtaataactaatttgtttgtctctcgaaaccgtgatgaactcgaataaggatcgactgcagctatagtagggactccaacttaagcagtcggaatcatttttcaccttgatacgaccaacggttaaaatctgtgccacatcggttctaaaaagtttttgctacagtgttcgcgctacaggaaacatccagctacagtatttgtcaaaaaagttccaaggaaaatcttggccgttactttccaatccaccggtgcctatatgacagtttaagttgcagtggctatcccaatttgatgaactctcccactacatgacgagcaccccaatagaataaatgaaaaaaatgtaattgcagtggcaaactcctatgacatgttagcaatggttgttcatggagttgaaaaatggctatggtaacctcagaagaaatgaaaaaagatatataaattcgttttt

SEQ ID NO: 59946 - DNA, 12777 bp, Oryza sativa
tgagtgaagtgataggctggctctcaccaagtcgaggaggatgttagatggcttgaagttagtagatggccagcgtgtgagcgtaatggaggaagtcgagccccttcgccatgtcggcagtggtctgcatcctcctcatccgttagaatgctgaccctcctctctctagccccacaaaggcagatggtagcaaagtgtggtattgtccaacccaagaattccaccgtggatatgtaaatgtggaagaaaactaaagaagcagagaaaataagaaacaaaaatactgtgcagcagacagcaagaagcctcaaataaaggaaaataataagctagaatgctccaaccaacctaagtttttagtaaacacattgagtatttttctgcaaattattgcacccaaatgaaactaaccagatcgttgttgttagcacgtagtaatggtggcatcgatgtcgtagccagtcacccaatgtcagccacgatcatcaccccccccctcccaccttcccactacgtcggatgccaggatgggtggcgaacaactgcgttggatgctccttcccggcctcacctcagcacggctggttggaggcacaggctggttggagggtgggcgcagggtggaggtaagggcaggcgccggaggtggcaaagaggctcgggcggtctggagagcaggcaccggcggcgggaatgggcgatgatgctccttcccggcctcagctaagcatgccggcagtaagggtggcacgggctggatgggcggatggggtggaggacgagtgccggcagcggagaggcacgggcggttgggatgaaaacggtacggaatatttctagattccgggcatgttttcggaaacagaataagccggtcggaatttttcggaaacggaaatgaattcagaaatattttgtcagatacggaatcgaatataataagaacagtttccattggaactcggaatcggccggaaacttttttgaaatttccgaagtttcaggcccatacagtacaatagtccataatacattaatacctccctatcccaacccaattcagcataatacctcccatagtccataatatctcccctaacttagagacttagagagtagagagtgagggactgagagagacatcgaagattcctgagccgggcggcggagcaacgcatccagatctcacgttgcctcgtcccccgaagtctgattggagtttttgtccatcgaagtttaaagctcggtttgagggttttttttaattccgataaattttcgttatcgtatccgtgctggttcattttcgctctgttttcggtttcgataatatttaattccgtttttgtatctggggtttccgattccgattccaattccgaaaaaattatgaaaacgaaaacgataaggtggtttccgtccgtttccgtaccgttttcatccctagcgggcagtctgggtggacgcgtgggtgacggttttttttaagagaaggattagagaagcgttaatcagtgttaatcgcagtgttaatccaacttgcaatgtacattgttagattagaggatccaatggttaggaatcttctggttacactttcttaggtggatgtggaaagaaacaaccagtacttttatattagtactagcaaattgacacgctcagttcatcgttcgtatatattttgtagggcacatttaaaaatagggaatgtttcaattggaacatgttaatttgttttataatgtattattgtattacttagatagctcgaaaaaagttatcatgtttactctggatgatagaaatttccacattagtcactaagaaataaaaaagatttggactattagatcatgatgggtttatagattaaaacatcgtagatacaaaagtacaattgtagttatagaaacaaaagctagctgttgtatatgaaatccaatcatattgaaatatatattgcttagaaaataaaactatatttcggaaaataagatttaagtgttgtatattgaatataattctacttttaaaatttagcactatgcaatttgcaaaatgatcccctggtttttaattaaacccaaagtaaattgtattgttatgaaaatccttcgaattccactatttttatccaaattgtttaaggcttctttgtttgtgtaaaaccataattgaactgtctactaaattgaattctgtaatacatgaattttttaaacacttgcaaacaaaaatatcttggatataatataaatcacaaatctatcattagagcccatatatttctaacccacattattgataatttagaccagaccatatatttttcttcctttttccttttctatgggccgtactgccaatgaactctatcacctgcaacctgcaagttataatgtactcatatatgtttcttcttgaaatcacctgagccctcccaacagtaaatacaccatgaaaaaaatgatattttttggtgaacttagtgcatcgtatggcattcattggctgtactcttaggatttttttttctcaccaatgatttagagacaagtgtcaacaattagaggggaagctaagcaccaatcagcccgcagtaaataaattaaactgctagcttagagacctagatatatatgtgcatccagatgttcgggatgacgtactaaacaatatggtgatccatgatttcctgaataaacgtggaatcaatcatgttcgggatgacctacttaacgattccatgatcgatcatgacaaataatttatattttttttattccgttgctatgtaataaaataacaatttagatttttttcatgattgaccaatgcaataattttatttttaccggtgcctgtgataattttttaataatcagtatatgatcaataataatatatatttactagttaaaataaaaaggggagagcgagagagctggagccttgagggagatgttagatgtgtgcacgtaggggaggcagcggtatgtacgtacggacttatcatacctagctacgggatagatacgcacaggagggaggtggaggttgaagggattttttttcttaaagactaatatgatggttcatactaattgattaatcgatttaaataaaaatatatgattagattttcttaatcgatttaaataaaaatatatgattagattttcttaatcgatttaaataaaaatatatgattagattttcttaatcgatttaaataaaaatatatgattagattttcttaatcgatttaaataaaaatatatgattagattttcttaatcgatttaaataaaaatatatgattagattttcttattgccacatgacagtttaagagtatttttaggaagcgtgtgtgacggtttgagagtgtttttaggaaatttaatggatataagagatactccctatgtcccaaaataagcacagcaatgagttcctatctccaactttaattgtctgtcttatttaaatttttttaaaaaaaataaaaaaaaacataagtctcgcataaaatactattcatattttataatctaataataattaaaatacttccagtcaaaaaaataataattaaaatactaatcagaaaaaaatttaaataagttggacacgaaaactcatgattacgcttattttgggacggagacagaacgtaacaaacttttaagcttttgagttgatcactgttgcaaatatgtaccgtaaaacttaaacggtctttatttttctctacgccatatgctaagtctaattgacaggggtttgtattccctctgttctcactttttgtttttcactagtaggtaaatactttatgataattcgtgtccagaatggattggtatgccctctgttctcagaaaggattgtctattggggattgagctgttgataatgccacgatgttccgatcctggtgaggccggagagtacatccctctttcctcagtcttgtgaacttcacttttgtgcactgcacatactgttgtatgtgtcgtgctgttaaacatttggcttgggccttgtttagatactaaaatattttggccaaaaaaatcatatcaaatgtttggacacatgtatggaacattaaatgtgaaaaaaaaaccaatcacacagtttgcatgtaaattgcgagacgaatcttttgagcctaattatgccatgatttgacaatgtgatgctatagtaaatatttgttaatgattaactaggcttaataaattcatctcgcagtttacaggcggaatctgtaatttattttgttattagtctacgtttaatacttcaaatgtgcgttcgtatacttcaaaaaatttatacccaaaaaactaaacacacccttggtatatttcttaaaaaaaaacatgtggcttggttataggtgctgattcccacacaaactggttctatctctaggaataacggtgtgcctcatttatttgaagtacatatacatacgtgttgaataaaacgatcaaacgatggacctatatagctttttttttccaaatttctctggctttgatgtgcacaagtctgtgtgagagtggttcatgtcgtatggacctttgtagcgtgtgtgctagaacaagtataataggggctgaagagccggtgataacaaattcaaagactgagttaatctcacataaagactgagttcgcactaaactttctccaaactctcaactttccatcacatcacatcacatgtattcaaaacttttttactcacataaactcttaactttttttccaaactaccaactttcctcaaatttctcccaatttcagaaactaaacacagcctagccaaaaagctgatgagagaggatcactcggcgactaattagtcgctagcgtcacacactctctaaaaatgtgggacccgatgcatgctttctacaccatacaaaatgaagatatgatgtagaatgtgagagaatatagaataaataaataatagactatattgcaactacttgttgtatctattaactttttaccatggctatagcacacgtggcaattactggagtaagcagcgagcgcttctgatgcctacaaaatagtactccctccatttcataatataagacacaaccacttttttttatgttctataatataaggcatgcatgcatgtagtcaattaactataaccccttctccattaaattattacttttttaaatcctccactctcatgttccctaattatattggatgcatgcattgtatttattaggatgattcaaactacaagatgataataattattttgtggcaaatgcttaccatcagctgtccgacacgaaagaaaaaaatcggacgcctcagtccaaacgagcagcaggtgcatagcaagtctgagcgtgcatgcaagcatattttaaacttaaaaattttttttctctcaaactatttatctgaatttcaaactaattatatcgttggatttgttataattaaatctttataataagatatcacatgactatattatgatgactttttttttactttttaaatgttgcacacattgttaatgtatgttccaacaagtatttattaatgtttcactaatgcattagcaatgttgcacattattttttatatgtttcagcaaacattttttttatgtttcaacaattacaattcgatgcaagctaaatacaaaaatattttaacaaaatcaaatatttgcaaatgtattgtatcatacgatttcttttcaatgtttcactagttgggacataatgtttcatgtagtgataattactgttgcagtcaatactttttatatgttgcatctttggaacattttatgaattgggttgatgcatctgcacaagtgatgaaactttttttagacggtgcaacataagtttgatttttttaataaatattttttatcaaaatatatccatgtgagatcttgttataaagatctaattatgatgaataaaatggtgtaatagaattatatattgaacacatattttagaaaaaggaaaagggagagaaagtagagaaatacatgcatgtgacatacgccatgcatgcgccacaagccaacatgcaaacgacatacgatgcgcatcctgacggatgtgccagacgccaaggatgggcggtcgtccgatatttgataaaatatctgaaaattcttgaacctgagcgcccgatccggcgccaaacaatcgggcgatccctccatgtgccgcgcttcccgcgtgcgcccgcgcccgtgcatgtgtccccaccactgcgccgctcctgccacgtgtccctaccacgcacaacgttgcaacaaatcacccacatattttgaaaatactctattaagagaattcgttttatttgttgttccacataaaatgtttcacctagtgtacttacaatgtttcactatgtatagatctaatgttgcagtgaactgaaacattctttcgctatttactgaaacattgtttttatataaggtgaaacaatgcccgatttaaacgactaaaacattttcgatctacttagtgaaacaattccgatatacttggtgtaacatcgtgcaacatttaaaaataattcaataataagctaaaaaaattttcgtcggaatatatccatgtgtggtcttgttttaaagatttaattgcaacgaatttaatggtgcaattggatcatgatttggattaataatttaagagaaaaaatagtttaaagttacaaaacattaactatccctgtcacacatgcaattctgtatgcaggaaaagttgcatgcatgcatatagctgcgcgggagaagtttgcatctaacagtgacgacacgctatcaatggttgggatttaatccctcgatccgatggctgggatgggcgtccgatttttttctcctgatcggacgtccgatccgtagttctctccttattttgctggtctttgggttaggggtggttatgccttatattttggaatggagggagtactactaaggccattcccaacccaatgactaggatgatgtacatagtattaaataagctgccatctaggatggaaaatgatgtggcaagtgaataaatgaggaaagaagaaaagaagagttcaagtagaagtacaatctaaaaataactgaaattcagaattaaaaataggcaatattggaggaaggtccatataggaaccgaatacgagattaatcaaaattcggaataaaaataaaataaaatccaaaaattagcaaaaaaaaagaagaagtgtccaagtaggaaaataatttaaaaataactggaattcagaattaaaaataagaaatattgaaagaagagtccataccagaatccaatacgaaaataaaattcagaataaaaaataaacgaattgaaattagagaaataaaagaaacgaagagttaaagtaggaatacaatttaaagttacctgaaattcggaattaaatataaagcaatattaaaataagagtacatataagaacccaacagtagatcaactaaaattcagaataaaaaaaataaaattcaaaattaggcaaattaaaaagagagttaaagtagtaatataattttgaaataattgaaattgaaaataaaaaataaaaatatcaaaagagcacaatacgaaaaataaaataaattctaaaattagataaagaaaaataagctttcaactaggaatacaatttatgaataactaaaattggtgataaaaaaaataaagactattaaaagaaaagaccatctaaaacatatgacgagataaattaagtaacaggcctataagggagtagagtggcggcgattgatgggacatctaaaaactattaataaaacaccaaatagaaaatcctaatgacggttaaaagtaaggatgacgggtaggtcgtgaagcaatcggtcaaggcggttggcgggacttctagaaagtaaaaaaataaaccccaatgataatcatatttgatttttaaaatctcaattacgataaaaatgagaggcagcgggcggatcatataggagtataatgggagagccgtcgatggttggcgggtcttctataaagtaaaaaagaattccaacgatagttatatttgatttttacaatcccaatgacaataaagagtatgcggcagacaggtcatagagaagtatagtggcagcgtttgacgggatttctaaatattataaaaaataaaaccgaacaagacaataaactctaaaactacaaggtctaatttttaaaggctcggaacttctaaaaagtaaaaaaaaacaatgataatcacaatgacaataaagaatggaggcagcgagcgagccgtagaggagtacagtagcaaagtcgctgacggtttggcgggacttctagcaaataaaaataaacccaaacgataataatgttcaatttttaaaatcccaatgacaataaaaaaaagaggtagtggacgggccgtaaaggagtataatggtaacgtttgacgggacatctaggaatataaaaatgaaactcaacgtgacaataaactctaaaaattataagatccattttttaaagattctaaggagaatgaatagaaatagtggtagatcgagcaagcaaataaaaaaggggaatttgcaaatttgccaccgattttttcaattttgcaaggatgccactcgaatgacagttccactggtatttttgcaattttctagtggcagttttgcaataacgattcagagcagcaaatttgcaattgccccaataaaaaaggagatgacataactaaggggtagtaactggtgtgacttttaaaaactatataattggaaacacgaggatgataaggtttggtctttcaaagtctcaagtcaaagtaagattatataaaaaaaaatatatgattttgtttaggtgctagtcacgcaattgcgtaggccacccagctagttttacaaaatttccaggaaaaatctgcaggcaaaaattcaaaattgccttctctcacctccgactaagcttgaggagaaggggattgagaagattgggaagatacacaaaacgaggtgaaccattagcgcataattaattgagtattaactattttaaattttaaaaatatattaatatattttttaaagcaactttcctataaaatttttttaaaaaaacacatagttccctcaatctcaccagaacgaacgcaggtaaatttgaatttctggaagaactgttacaaatcgtctgttaacttctggaagatgaacagtatacgatcaggctgagaaattattacctgatgcacacaatggcacaactctcctactcctatcaatcatatcttaattcattgagatttgttatggtccagcagatatagtaccttgaggtactggtaccaccagataccaaataaaatcatgccgttgaattacaatgggcacgattggaaacgggctgaaaaggggcggagaagacccgcgacacatttgcgtacagacgttgccgcaatctcctcgttctcacctgccaacgccaatctcctagccgtcgtgcgcaggtctcctccgtcatcgccgccaaatcctcgattccacgccgccccctctggtgccgagggcaaatactgctgccacatagcgcagcagggaccgaatactctctagttggcctcaacttcacccggtgattttgggaaaatttcaattcaaggttcatacatcggcaaggtgtacggcaatatcgcatcattgaggtggtcagcttgattgctccgccgatgttgctgctcacgccgggccgtgactttttctagtggcaaatcaaactatcaatacagagttgtgtatatgtccgcttaatgaagaagttgcagcgccgttggcagggaaacaatggaggtcagtcggttaggagattcctcccaagtccgttgccagcgtagaacgaggggtctccgctgctgttggccgctcccatggtcaccgcctccgctgtactagtgctggccatcggggaggagggaggaggaggagttcaggagatctcgatttggtgctgctactctggacgacggtgaggaagtgaggtgatctagcacgacgacggttggactcggcgagactccgccacccaccccggcgtccagctcgcaggcaaagaagaggtcctcccctagagatggcaagcctcgaatggacggccgcgggagggtaggcagcttcatcttccctgcttcgtctccactcgtcgtcggcttgcttcagcttatatccagcggcctccctatcacgatgcagggaggagacggcgaggccgcccccatggcttcgcctactggtcttccggcctgcctgaccgtgcggggcgagccctcggtgccgcgcggagacgagggaagggcgatgaggacggggctggaacggtggcggcaacaggtccagtcgctagcttgcattgactccaacaatcgctaatgcgaaaagacaaccttaccctctcacctctcaatcatgatgcggtaccctcccaagtacctggcggtaccgacggatgatagctgttggatctgatccaatcgatggctaagatttagtaccgccccaatctattggactgtaaaaaaaactctaatttattttataacctaagactaagatttcgtctccgtacgtcgatggttggacggtacatttgctcggaatcggccgtggcgcaacggcaacatgaactgaatcgcaattcgcaatgtcttgcacctaactaggagtgtaggactttctaatgcatctatggagaatgccgagccaccgactaggtaatgtatctgatcgaggttggccatggttggcgtccccgagctggaacccatcggccgagcactgcgctgagtagtcgccgacttgatgaggctgccaccgacgtccatggcgaggaagccgttgggcgcgtcggcgaagtcagcgccagtgctggaggcgatgggctgagcctgcgcggcgagacagctgccgtcggctcgtgggtggttgtggcagcggcggcaacggcagcgttgcgtgagaacgactggtcgtcggagtagttgatgtcatctccagccggcgttgtctgcggctggttgccgccgccgccgctgctgccgacgtacatggctgatgacaggcacaacgacggagtcgggagcgcccggctggatcgggatgtgcagcagatcgggtccgccgccgtcgccgttcacggcgttgccgtcgtccagtagacccagcgcagcgcctcccgcctcgcggtcgcggccaccatcgccgcgtccatggactcgagcagcgcccgcgcctcctccgccgtactgatgtagctgaccgtgtcatcccacaggtgcacgcagagatcgcggcactgccgcaccatggcgagcttggccctctccctggcgagcttcaactcgaggcactctcggagcgtgtgcgcctccggcctaggcaggatggcgcggtacgaggcgaggacgccctcctccgactcccacaccgccacctccgccgtcgacaccgcaccgccgccgtctccgtctccggtgccggggccgccggcacagaggagagcgacgtcgacgccgcagaggatggagagctccctcgcctcctccatcagggactcctgcatcttcccgtacgtggcgtcctcctccatcttcatctccccgtacgcggtgttcgccacggggaccgcctatgcatcacttggagggaccgcctatacatcactggggtgatttttgagaaaaaatcatccagattttttcttcctttggatttgcatccaacggactacaaaataaaataactaatataaatttacttacacaacattttcatcaaaattacagtgcacttatatgtcatatcaactaaatttacatatgtaattttagttatataagactgtaattttatatttgaaataaaataactaatgcaaatttacttacacaatatttttatcctcaaaattacagtgcacttacatatcatatcaactaaatttacatatgtaattttatttatataagactgtaattttatattttaaagaaaataataagtacatatttacttacacattatttttattaaaattacagtgcactcacatatcaaatcaactaaatttataaatgtaattttagttatataggactgtaattttatatttcacgacaacgatgagagggacggtgtctctcgccgatcagtgttggccgtgctaccggcggctggctcgccggtcagaggccaccgtgtcactgtgcttctccaatctccgttatcgtgtgcgcttggggtagctagacccgaaggccgacgtgctggtgtccgacgcgccggctaacaaggctgcaaaaaaaacgtgaaatgtcagcaaaagaatcacgcgagtgatcgatagcaaaatcgttggcgacgtatgaaaatttggccacgcacgaaaatacgaatatcaagaaaggatctaatatcaaataattagaaggggtgaggcttcgaatttaggtcgtctaacccatcacaccttgatcgcccacgtacgcttcggtcggcagtggtcgttgctcctccgatccggccgtatagttgtttcaaaagcttccaacaagtccggcgcgtttgcccggcggcgggcggtggcgaggaggatatatatagagagcgagaaggagacgcgcggactcgtccatctctagggggct

SEQ ID NO: 59947 - DNA, 2923 bp, Oryza sativa
ctactcactggttctcaactagtcaatcgtagcgatctctcgtacatttccacttctagtggtcgagtttagactacacctggtcctcgaccagcggtgtagcgattctcccactatttctacttctaatggtcgagtttagactacacctggttctcgaccagcagtgtagcgattctcccactatttccacttctagtggtcgagcttagactactacctggtcctcgaccagtggtgtagcgattctcccactatttctacttctagtggtcgagcttagactactacctggtcctcgaccagtggtgtagcgattctcccactatttccacttctagtggtcgagttacgactactacctggtcctcgaccagcggtgtagcgattctcccactatttccacttctagtggtcgagttacgactactacctggtcctcgaccagcggtgcagcgattctcccactatttccacttctagtggtcgagttacgactactacttggtcctcgaccagcggtgcagcgattctcccactacctctacctcaacaagttgatatcaggtacacaatgtcgccaagcattttacccagagatcccttaccacaaagacacctagcgttgaaacctatcctcatgtccctttacgccgtcttgacaaggactccgaggaacctaaggaaacttcggctggggatgcccagagccgataaggccttgtcggatcctgtagagacaaaagtccatgtaagatctggtcgtgtaagagttctcgccgtgcgtattaaccaagccgtataatcagaaattgggttttccaacttcacggctgggggctaggatcagtgcttgttcaaccgaggcaggtcaaaggtccaagagccttatctcccgagaacgattctccgatgacaaggctgggggcggagagtgtataactcaacaaactgactgatcgaagtcggtaaaagagtagacgctcatgtgcaaaacattggtctgtaaattcaattcatttttagtttttcatatatattataacatgtcaccctttaagcgttcgctcgggggctatttctatctaatactcttttctgagtattgatttcaggaaaattctattcgacattatcgaaagctccatgtctctatggttctacaccaagatcgactaaggcgagtacgacaaatattgacaaggctccgtcgcagactctacgcctactcgattactcgagaacggttggtggatctcgacaaggaatacggaatgaagagatggtgtacccgccgagataaacttcttgacttcaatccaaattctcgattacagcaagacgggagacttagtcgtatgctctgtactttcttggttcacatcggagatggactcagacaaaccctttaggtgcctgcacgaggctgataaaggaagtctaacgttatctctgaactcaccgataacggtcacaagagctcgataacagttcctccaaggtctgcagttgagaatatgaactcgctcatttgcattgaagtcgggggctactatcagggttatggataccacataccaaatagtagtcgactaaatctcggcaggacccaccacataccatgtcctatacggaaacaacctgcggatataggaggagttccggataaggaaagacaacaagagttctacatggaaacgacaaggactactcggattgtatccatattggtttccctagttctacttggacaagaagacacccataggtataaataaaaggccccctaggaagagaggagacacgagacaatcaacacctaccacagtcaacatacagggaacaacagaagccacaacatacaagccaacatacgccaagacaagacgccggatattgacttcggagataggtacggctagtcccctgcggtgtctccagatactgtcagtagagacgaaagcgttatctttgatcttgccggacacgaactcgaggaggaaaactaccctgttctcgactatgagtcagaccttcagaccgctatgtcgataacagttagataggcaaccccaaatattgtactggtgcgattatggtgaataagagtaataccggcttcggccaacaggatgtagggttattacctgacaattcaggggcccgaacctgtataaaaatccctgtctccgtctcttttacctcagtctcgtgtatatcctagtaccaacgatccccataccatgcaaataccggaatcgcgacatcaaacgtcgacagtggcgcgccaggtaggggactttggtgcttcaggatttcgacgagatgggtttaagagatggattctccgacaacaagctactcgacgacttcggctgtggggaggtctaacccgaccggagtttgccttccgacgagatcggaaccatcgtcatcaactattcgatccgacgagatcgatcaagcttcaagacgtcaccgccgcggagaacaacagttcaatgttgtcgatcgtgaggccttggcccgattgattactttgaaaccacgtcgccgccaaaaatctaatcagattatccatctacatcatcagaggtaattagtaagattgattattaaattgatctactaattttgtagatacatccggcatgtatctacaaaggtatgcaatattttatatgcaatttaccgtacctatattcagatcatacagcattgtcagatccatgttatgtttacctagagcatgttttttatacaatatctattatacgagtgttttcggtgttaggccgagaacagtttaacgctgggggctcgctctattttcttccgtataaatcatgcttgtttacggtttacataatgcctgatatttacatctgctcgttatatcctgataatgctagaagatccatac

SEQ ID NO: 59948 - DNA, 12689 bp, Oryza sativa
aaatgataggcatactttgtgccatattccctatttcccgtccatctccaataatcgaatcctccactccttttgtcagttccaagtattcaagtgctaggacctcccagaatttcatgtaatctgtaagaaagggcgacaatgaggttgtgccaaatgtcattgatccatcttcttgttgcagggcatcctgtaccatgtggtttttcctcttggagttgcactagaggttcggtgctaggcttttgaagctatggccgccaatctagttggattccaagaagtttgtttttgcctattaccgataaaaactctagtcaatatcgcgaacaattccttattgagttcatcatagggtgtttcagttttggcgccctccattcataccaaagccatctcagccgtaggctgtagcaatttttccaggttgggtacttcaagaccgccataacagatgggggaacatacctgaggccaaatttatcttgtattttccccatgcatctcataattaccggctcataggaatcatcttcttgcttcgtcaatttctcgaaggtatttctttggcggcttcagttgagtgtaaaattaaaggtgtttttgattattattctgtgatgaacaattgacattgaagattattggttttgatatttggaatttatttacgaagtggttttggagatgattggatttcataggtgatctacaggtactgctgggtgtggtccggtcagaccgggcaggtgttgccgatcagaccggcgtgtatcgcgcggtcagaccggtgcagcccgcagtctgaccggccgacgctgtgtcggtttcggtttcgggttgtttgtttggatatccatgattgtttatgtttatagcttctagatggatactatgtgtatgtaatactgttgtttgctactaatgagtcaagttggggatacgttggtctcggaatatggtttctttgtttgttctatgtgtaggtgactcgagatgccgggagagtatttgcggtgattgaccgggagtcggcttggggatgagacgatgttcgtggtggtcagatatcatgcgggatactaaggctagagttcactgcacgtggttggtgaagattccatatgacatacgatggaggtattgtgtgcgtatgggatgtggagtcgaatttggaaggagtccaaatttggtatgagtggttatgtaaagtttgtttcttgtacgagaaggtttcctatgaggattaggacttctagtatgagtttggttcgtggctttaggctgcctacctcatgtataaatagagagggagcgtgaggcttccctgtatcattttagagagcaattgagttgatagttgagttaggggtttgagtttagtcgagatttttgtaaggagtgctgttggtgcactttgtaaacacagagagaatcaataaagtcgtcatccactttaagagttctttgatttgtgtttcactgggtttcggcggtctaattggtggcacaccggcggtcagaccggcggcgtaagggcggtcagaccagcgttgacgacaggtgacaggagctgatctcggtggtcagaccagagatacaatctcggtcagaccgacggtaactaggcggtcagaccggcacatctacttcggtcggaccgcgatctgtcgaatttgagggtaacttttatttccgctaaaagttttggttttttagcataccaaccattcaccccctctgattagcttaattgttgtgtttcgatcatacattgagatggaactttggaaggtggcgcatgcactctgatggtggcttggtcttcgccgggtaattaattccatgttttttcgtacgtgctatatgtgttttgggtgtccaaaactatttcaagatttctaatgtttgtacgtttttcaaattatgttgtgccatataatgtgttccatttctttcaatcaaaacgcattgtcgataaattttgccactccatgcatgcatggatggtaagccaattttctttttccaagttcatgtcatggagtagtaaattctaaaaccagggacttgtggtcagttttgatggaatccaaagcgtagcatgcttaacatgccgtaaggtgatttatacaacattaattagttgcttccaacacgcataaagaaaatatattttatctcaagtacagctaccaatagcaacttcgacagaccactagtattaattaggtcggctatataatttgaccgggttaactcataatttactgtatacacgggagaatcctgccattagcagccgcacaacatttttaattcaatagaggtgctggtctgctggatatgccaaatagggcctataccagtataaaatcttgaagggtggaaatatggtaaatataacaatcatgcacgccgtacggatatgccaatttaataatttagtgcagctgtacgttctctacttgcaactgattatatatatacacaacaggtaacatagtccgcaaggcatttcaaaagcccctagagagtcaaacatacgtgtccaattatctaacaccctccattccaaaaatgtataagaattccactcttctagtttgtcctaaaatgtctgatttttctaaaaactcaaacattggttcacctctaaaagaaaaatgttttagcactaagacaaaaatgttttaaaatattaaaatggtgggactaagtcgaatcaaagattaaaacatttcattttgactgatgaaacatcaagctttaattgctaaaacattaacggatgtttaagaaccgaagacaaaagagttaatcccttgtgtacccatgaaaatttgcccaatctcttctataccttttaattttactcgaacccctctgtacccctaaattctcgctttgatcccttccatacccctcccgttaggttttcttcattttatagttatgtgtgattgcaaatgtctataatgccctttagatggaggagcaactgcaggtagattggaaaagaattggaatatgttgaccgcacagcatgtgtattttatgagactaataatgagtttaaaacttttattgtggtattggaaaaaaaaatgcaatccatcgaacaatttgttttgaaaaaaaaataatagggttggaaaatcaaagtgacatcagtttgctctgtaaaaaaaattggtacactcaacaggaatgtggacaaaggagaaaatctgtgaaacaaaataatctggatcaataagagcatcaagagcatcatagatcatcaatcaaaatagtagtaaccatacagagcacttcatatcaattttattttcatcatccatacagagcacttcatataaatttcatacaattttattttcatcatccatacagagcacttcatatcaatttcattttcatcatccatacagaacagctcatatgatgcacataccacaatttcatttccatacctaatagtgcaggaaccaaaccaactttccactccatacacaaatgttgcaaatgacagatcaaatatgtcaaacactttgtaaggcatcacaacagcaaacaacaatgaaaactgcaagaagaagaaatgaaaattgctgctactcctaccagtagggcggcgcagcgacgagagggtatcggactttggccgcacgacaggaggaaggtggccggcggtgcctgcgacagagggctatgggcggcagctgcgcgactggaaggcggtggccggcggcgcgccaccgcgcgacgggagggcggggaccagcgacgccctacctcgcgacaggagggcagcggccgacggcgcgcgcgacgggagggcgtgagccggcggcgccccaccgcgcgatgggagggcggcggccggcggcgccccaccgtgcaacgggagggtggcaggagggcgttggccggcagcgccccaccgcgcgacgggagggtggcggctggcgacgccccacctcgcgacgggatgacagcggccggcggcgcgcacgaccgggggggggggggtgggagccggcggcgccccaccgcgcgacgggaggacggcggccaccgcgcgattggagactggcggcgtgcagaggatggggggagaagagaaggagattggatctgtttacctagggttggctggcaggggcattttggtattttttgaaaatactgacaatgtaacacacaggtcacgctacagatcaaacggaaacctaacgggaggggtatggaggggaccaaagtgaaaatttgggggtacataggagatcgagtaaaattggagggtatagaagagattaggtaagttttcatgggtatacaagggattttctcaagacaaaaacatgaaacaacataaaagtagctagtgcggattttgacccaaccataaaacatcaagatacgttagctgaaacatcaaaaaatcacaaactttaccagtttagatatggcttctttctcctattcgatgaccaccggctcctttaatctcagctgcagatccatgccaagacgttgcaggacccttctactccacagcaacggatagccgttgctcccccagaggctttgtcaccttgtcattgtcgattttgtccctcaactacgtccgtccattgtctttctctagctccctagccttgatgaactacaacccatggccgtggcctgatacattcttggtggagtattgagagagaggggggttgatcacaacaatgcggtggaagagtcagagagagagagagaggagggaagagtggataaggatgcggaacggacggatgagagcaatgtccgatattttttttactcattggacgcgcgagccagagtgttttagatcttatgattattctaaaactaccagatttttactgggtttttttcctacttattaacttttgtactagttttttcctccaattactaccaccttgtgtattatgattattttccatttgctacatccttatttttttttaaaaaaaaagcataacatgccctttgtttggtagcatgacacctaagtgatttcagggaatcacacaatctagctattttcacagtaaatttcacaaactatcagatacatcgaccaaactaccacaaaactacatatctaacgtcttgtaccacgaaactagagatttagttcgaaatttctcacaaaactacaaattttcgatagagtataaaaaaagattagtaagtagaaaatttatcataaaactataggttaatgctaatttatcctaaaactacaacgtttatagctccaacataatatttgcacgagctagttaaactctagaatctgcatctttgtgataacttcaatgttaaatctgtatttttttgtgataactttaatataaaatatgtattattgtgatgcttggcattaaatatgtagttttgtgataattttaccactaaacccttatccttagttttatgatacatcgtctcagacatgcatgtagtattgaatggctggagcatctatcactactcttacctagcccaggaatgatggctacaagggttaacccgagggtggtatggttggagggatacgcccttataagttggttccgcccttactaaactagcaatgtggtattaaatatacatatacctctcttatgagccaaacatgctaaatcctagttggaccatgatgttactcttaccaccccccctcccggtcaaaggacccaattcctcgttggtccaacctacctacgtagtcacacaggcatatagtcaaatatctaggatcagcctcttaaccaaagttttaaatctccggctatagctgccgctatagccggagatagctgctgggaacggacggagctaagagatgcagtttttagcgctaagaatagcgggacgctaatagcgccatttagccggcaatagctgctaaactggccgtaatttagcgtagctaaattgtaaaacgcggccggtctggcccaagaggaaaccggcccaactagaccagagtcgagaggtgggtaaagtgctgcaaaccctagctcgtaagctcccagcagcacactatccattccaacttcgaagcgctcactctccagctgcaagaaaagtggaggcggccggcggcagcggcgcaaaggcgtccggcggcggcggtggcttcaagcggatcgaccaacgcaggcggctcgtggaggcgaccagcgccggctgctgcttcgagcgggcgtccaaccagcggcggcggctttgaaggcagctgagcagcggcgcaagtccgacgaggaggtccgtcagtgcaacgtctccgaagcactgaagcagcagcaccaaaggtgacggcatggcacaacaatccggtcaattctcacatcctcctctcttttttgcttgtatgttgcagatcttacaatatgtgaacaagttgtccatatttgttacctctaatttcagatacttgccttatgatgtagatcttactatatgtgaattattttctgtcacgaccggaaatcacccaacaggcgttcctgacgtgcgtgtattattccttgtcccaggaggcaaggtacaccaaaagttgatacaattcagagtttaacaagcggaagcgtaaatataattattacacgggcaacaacggcccagcacacaaagacaacgaaaaacagcggaagactagggcgacgaccacaggcgcttgacggcaggcacgagctagacaccaaagccttcatcttcaaggaactcctcatctgggcttgggaaaattaagcaagactgagtacaaccaccgtactcaacaagacacacccacaaatgcagaataaatgcaagggagtacaagggaattatgacataaagggttagggttgcagtaaacagcatttaaagacatttagttgctcaaggccattttgtaaacacgatcctagaactatccaatattattaatcaaggccgtgaacccacacgaacctgccttaacccaaggcctatgatgattcagaccgaactggcaacccgaccctgggtcccagctcgtcctaagccaacccaggccaaccattccacattttagttgttgagcaaattttaagaattagaacactgacttgggtacattgctcggcttgcccatatccgagggctcggctattcgaatagatttactctgatcagaggtgtacatctttacccacaagacacatcttcctcacgtgtaaccacgtgccacataccaccacggtatacagacgaaagacgtgacatagtttccaacccatcctagccttagacaagagtaccgacccaatcccgcctacggccggaacccccgggacaggtagacggaactgagcccctcgcagcagggcaccaaccctgtgctttttgacatctcgactaccgggccgtagctcgtgtagccttcatttgccctggagaatgtccatcgacccccgacttcatccatctccaatccgtgtacttttgtttatgactagactgagccacaaactaagccttacccattagacatgtggaagtacggtagtgctttgcaacagaggcccgagcttaatccttatagtggccggggtgctacttcccacaactggcatgcacccaaaccccaccgaaaacaggttttaggggttttgaaagaggaagagaggtgtgtgtccaattccaacataagccaaccattccatggtgtccaaaggatatgagaatttcccaaagtctatagttataaaaccacctaatgttgcctaattaaattgcgaagcatctacctaaaattaaactagtggtgtcatgagtagagtgtccactagttggggttttgtttgatctagggtgaacaaggtaataatagtaacaatgacaataataatatggtcataacaaaggtaaataggcatggctaagtaaaacagtgataacgcgggaatttaaataaagcgataatgcaataatttaaatcaacataattttataaaatgggattcaatatgatcaagatgatgtgtcttgccttgctcgttttcccaatcgacggcttcgacttccacgaagagcggatcttccgaagctgcagcggctacacgaccaacggaaaagaaaaaggctttaacactaaataactccacataacagcagaaacaaagcacaaaaatgggttctttacatcttaaggagaaattagagacttgaacggtccaattccgagttcaaatggccaagatatggccatttgaagtttatatgctctttaaatggatatttacgaatttcttcatttaattttcaattaaaaaacggattattgcgtcagccgaggggcgggcgcgcggaccgggtccacgggaagtggggcccacgcgtcagccgctcggtccacggtggaccgggcgcacgcggctggcggcggtcggcgccgtgggtcccgcgcgtcagccgcacccgcgggcgcgggcggctgacggccgggcccacttggcagccgcgagggcgcgcccgagggcggcctcgccggcgcggccgacgggagaggacgcgcacccgcgccccgatggtcgccgccggcgaccaacggcgcggcggagtggcgcccgagagagaggagggaagggggaaacgaaggacggtcctcggctcaccccgagacggcgaagacgacggaaacggcggccggagcggaggaagacggcggcgcggttcgggaagacgagggcgacggtgctccggcggtcggcgagcgaaacggagcggcggacggggtcgacggcgatgcggcgatgccgagggaggtggcgccgagccgggaggaagaccggagcgacggcggcggcgaaccgaaggtcgacggcgacggcggagagagaggagcacggcgctagcacgattccgacggcgagagcgagcggcgagcggcggaaacggaagagcggagctcgggcaacgaatatatagcaacgggagggggagagcgcggccggggaggaaggaaaccggccgcgaagatctcggccgccattgattgcgccggcgatgaatgcgggcacgattcgaacgaatccgagggagagagagagggaaaagagggggaatcgggagagggaaacgcggggaataatttccccctcttgattgcacgcggggcggacgggagcggcgggattcgcggcggcggcggcgctagggcacggacgcggcggcgggcgcggcgggaggagggcgatgacaggtgggccccacccgtcagcgagagtggcgggcgggcccgcctgtcagcggcgcgcgcgcgcgcggggagccgatgggccgaggggaaagagagagagagagggagggaatgggccgagccggcccaagaaggaagggggagggggaaaagacttcttttaggattttctttttataaacctttttaactttgttcatttcttttcaattattatttgtgctctgaaaattccactaaaatttatttaagcattttaggcttttaggaaatatacaaaaatcctccaagcctcatttgacttttatctttgcacattttaattgttgaaggctttcacattgaattttaattattcttttgcacaatttcgaggatagattttagagtcgatttgggacgcgacattttcttactccctgagatctctcgtttgcttgttttgcctgtttaggtggtaatgataatacgtgctatatcagtttgcattattttgatgcttaggcagctttgacgctagcattaatgtgggctaagtttgctttttgtataggtaatccgtccagtgctgcctctgtctcagtagaagctggaccaaaacaagctggtatcaactcagatgatcctgcatgggctcactgtttctgcccagacataaccaagaaacatcacctacggtgcaagtattgtgacaaggtctgcactgctggaattacaagaattaagtaccatcttgctggaattaaaggtttcaatactactaagtgtcagaaagttccaagtccagtgcagcaagagatgtttgatttgcttaccaagaagactagtgaaaaggaacagaaaaacaaagaaaaggaagtggccagagctgaagttgacatagaaaattcagattgtgaaagtggcagtgaaggttcagatcatggcaataatgttcttgtggtgaagccaaaggagacaacaggatctagtagctctagatctgtagcaggtggtcatactattgacaagtactacaagcctccttctatagaagaatctgccagtatgacacaaagagtaattaagctaagcaataaggttcaaacagcattgacaactcagaaaagagaagagaggaggaatagaacttgtgagtacatatgtcagtggttctatgaagctagtattccacacaacacagtaacccttcctagctttgctcatatgttagaggccattggacaatttggtagaagtctgaaagggcctagtccctatgagatgagtggatcgttcttacagaaaaggaaggaaaaggtgatggatggattcaaggagcacaaggaatcatgggagctcacaggttgttctatcatgacagatgcatggacagataggaagggtaggggagtgatgaatttagttgtgcatagtgctcatggggtactcttcttagattcagtggaatgctcaggtgacaggaaagatgacaaatatatctttgaacttgtggacaggtacatagaagagataggggaacaacatgttgtccaagtggtgactgataatgctagcgtcaacacaactgcagcaagtctattgacagcaaaaagaccatcaatattttggaatggatgtgctgctcattgcttggatctcatgctcgaggatattgggaagcttggaccagttgaggaaaccattgctaatgcaagacaagtgactgttttcttgtatgctcatactagggtgttggatttgatgagaaagtttcttaacagagacttggttcgctctggggttacacgatttgccacagcttatttgaatctaaaaagcttgttagacaacaaaaaagagttagtaagactatttaaatcagatgagatggagcaattgggttacttgaagcaggccaaggggaagaaagccagcaaagtgatcaaatctgaaaccttttggaaaaatgttgacattgcagttaattactttgagccattggctaacgtgttgagaagaatggacagcgatgtaccatcaatgggattcttccatggtttaatgcttgaggcgaagaaagaaatttctcagagattcgataatgataagagccgcttcatagaagtttggaatatcattgataaaagatgggacaacaagctcaagactccactacacctggctgggtactatttgaacccctactactacttcccaaataagcaagagatcgagagtgatggatcatttagagcaggtgtgatttcctgtattgacaagttggctgatgatgaagatatccaagacaaaataattgaagaactcaacttgtatcaagatcagcatgggagttttggacacgaaattgccgtaaggcagtgaaagaacaaaaatttcaatccaggttcagatctcaacatgtgaacttaattttattgctgaatatcatttttgttgtaatttgtgtaatgtttatgcagcaaaatggtggctgaaccatggcacaagcacaccaaatcttaggaagttggctgcaaggattttgagtttgacctgcagctcctcagcttgtgagaggaactggtcagtttttgaacaggtaaaaagaaatttgtgacctgtagctttatgtgcatgctgtctattttgaattataatgcttatttatggaatttagatctgacctgcagctttgtgttcactacttggcttataggttcatacaaagaagcgcaacaggctacttcatgaaaggatgcgagatctggtgtttgttaaatttaactccaagttaagaaataagagagagaacaagggtagagatcctatagagaaggagtggatgatgttgtggcagatggtgacaatgaattcattactggtgttgtgccttcatcaagtgaaatggatcaacaatgtgcaaaagagtcacagcagcacacaacaccacaagcaccagcaccagctaaaaggaaaaggcctgtgcacgctaagaagaggaaagtcagaagcctacagtctttgatgcgcaatgccccagtgcatcctgaagctccatcatccgactcagaagattgtgatgatggtattccaatgcagacttctgattctgataagtcaccctctccctctccctatgtctctgagaccgatgattgatgactagaagaaatgaagattgcaatattgcctcatattagtaatttagtatccactatccagaattcttgatgacctttgtgttgtactgttgtctttattctagaatgctgtacttttgtgaaactgatgtttcagtattctgttaaccacttagcctgtgatgtaatgtactcatatgaacctgtaatgtactcatttgaattggttatgtatcaattggtaatggttatgaagttatgccaagatcatgtcttttatttatttattt

SEQ ID NO: 59949 - DNA, 15739 bp, Oryza sativa
  unsure (1)..(15739): unsure at all n locations
ttgtctgtggctcattcagcagcagtcgttctcgcggcgcacgcgctcgcagtgacggccaggacgaacgctgaaagttgtccaggtccaccgatacaattccaaaaccattgagccatcctgccaagcattttccctgatgagtacttagtaccaaagccagcctcaacctctggtacctaacaggaaagcttacctcaaaagaagatgagcgtccataatggcagggaaagcgaagggcgttctactgctcatcatacatggcctcctggaaagaatgggtccagtcccgattgacctgacaactgcctttcaatcttggtcagaagctcttaggctgagatacttctaaaaatggacccccaaagcttcgaccattacctagaccagtagcagtacagaatacctccatggatgctccagcaggatgtttaatcaaccgacattagatgatgtagaatgctcaacgaacaagagaacagcatttcatctaatgtaggtaacaggcttgtgggaaattcatgtagccctgcaactcagaatttgacaatggcaagatgttaacagatgaacacaattagcaggtgatacttcagaagattctatgaggtttcaactttcataggatatatctcccctgccgacaaaatgcccccacaatgccatcaagtaactgatattaaattactgttaactatagaacattggaaacaaacaggcatcatcctgaacatgtttgccattcaactagagaaccttgtcaaagctacacatgggtccactgaatgtcaacctacagttcagggaaggagtgacgacatggacgttttcatggaaattgtatcacagtttttctatcctggggctaaagaaaggccttctgataactagcaacagaaaattaaccacgtatgctgaaatagcttatctactccagagtaaaccattgagtccgttaacaaagaagaaaccaaacaggtcgcttgataactattcacagccagcagttgatgcaagaaaagtaatgcaactcgttagtattccttagtcactagccaatagataggaatctccaggtgcagaaaacaaccaaacaatcggttccatgagcaaccatgaagtacagttgcactccaggaatgacaaggtgaagaccaagtaacacacgataacactgttaactcagaaaagtatgttctactaactgcacagtttgtgcttaaaagtagtagacacggactatgagccaaagtttttaagaaatgaaaaccatttctatcctcaagtgtgaagagtgaaagataattggcatttcatttctgctgcaggcaataaagattggtattagatgtttcaatattcaccatggtaaaagagatgtagaaacaagcagacaactaaggcatggaactgcacgataagttggtaggaggatgggcaggcaagaaaaaagctagcaggatatgaatattgaacttgagttctgtttgaaatccttctgctctaagtaactttgaagttacttctctgtccaaaaaataatcacagtagagtatgatcaggtatagaagtaacaaaagagaacacaaatataaattggtaagaaaaataagtatgctattgcatgaaaccgagccttacggaaaaaacaaaagcattccatggtaactacatccacataaagcaggataatcaatatgtttcttcttccataacactaagccattaacaaaaggttgctagagaatgttttttgggttgcatcaatccatgttgctactgcagccacataaaccatgcatgattgcaaaatccaaatagacaacatgataaattgctacggcataaccatagaaatacaataaaatgtcattatgttgctatatatcataaaagaacacaagggaaaggaaagcaagcacataagaaacaaaaaggaaatttcacagttaggccaaccactatgcattaacatttacattaagagaaagaaaccacaggaatgaacatagacaaagaatcaccatgcattttgcatgatactgtaatattattgttcaacaaccctgccgcagagggaaatgggaacaatacaacaatactaccagcaactctagaaaagcaccgagtgatgaagaaatagaatagctagacctgctatgatgaagttacacataaaccatgcctgcatttaagcatccatttatgggcacagagcaatctgttaattgttcagagatataggaaaagccaaataatttgttagctgagtgatgctgtaaatgtattatctaaccatattacaagtgtaaagcaccatacaccccagatcccaaataaacccccacgatagtttaactcattgaagaaacaaacctactatcttggtatttcaacattacaaagtacaagcataccacagtcagactcaattatgtattattagtttcactctttatcagaataatgaaaacatgacagggcagcatgtgagacaggacacaaaagaaacaacaggcctgacataatgaggttggcatccctattcagcaaccgtactagctcaagatatgatcaagacattatagtgtcttatgtctagatattgtagcaaaatactatgcgaaacgtattatcaatattaaacaggacacacaaaagcttatattcaatttcaccaggagaatacgaacaataacaaataaaaaaggctgaaattttattagaacaagatattgcaaatcagaaatcttcttggcccaatccagtatatacacaaacagtacagaggtaagaacaacactttgttctctctgactacaacattgcaacaattgatttacccaataaattcactgtcattcctttcatgaagtcctgtgcttcttcctcctaatttgctttccaaactaatttccagttgtttgctattttgctcgtggccatctctaaataaactcttaaaacgggacaaagtggaaaaaaatcgcaaggttttcatttacatcaaaagtcccaagaacttataatctgggttcccttcttatactaaatcctacttattcaccactatcaataggagatcgagttaccgagaaaactgcgttcagccactacgggactgcgatgatgaactctccggccgactgctccgaccaaaacaaccaaacagattcctaaatacacggcgaatccgaccttcgccgccatcgacatggccgtcgccctccggccacgttacccgcctcggcccgacgccgttactgaagcccccatccagttcagtgtagacaaccggaagctgctcccttggcccaccggcgaacctcccgacggcgaatccaccgcgtgggagtcgccagatggttagtcccgcatctgcctccgactcgggggccgcggccgccggtagctcgcggcggcagacggggcatgagttgcggagggagagccagggcaggatgcagtcctggtggtagacgtgcttgcacggcatctcccgcgcggaggcgcccggctcgaacgcctcctggcacaccgcgcagtgcgccccgctcccggcaaccgtcaccgacggcatcgactccaccgccgccttcgacgccggcggccgcggcgccgccgcctcgagccgggagaactggtcgagcaggcggtggaagcccgaccccatgaggaggtgcgacacgtcgccgggcagcggccgcagcccgtcgccggagccgtcgtcgtagtagagctcgaacccggacagggaccctccccggagcacgatcaccgggttcatcgccccgcgccggccgctcccgccgccgccgcgcggcggcggctgcgggaactgctccaggaagccgccgtcgcactccgggcagacgaccgtggacggcgacaccctcacgaagcggctgcagtggtagcaccagtacgacaccggagaagacgccatccgcgccttgaaccaaatcgcccccaaaccaaaccaaaccaaatcgaaccagaaactcaaatcgtctgctccaaaactccagacgcagatcgagacgggaagccgaggcgggatccgaggaatcccacggaggcgaggacgccgaaatccccaatcgaattcgccgccggattcgaattgggggtttcggggaggagaggaaactaggggaggcggaggaggggaattgcggggtgggtgagtgggtgcgccgcttttatttgggacggcgcgtcgtcgcgggggggcggcgccgtcgaggtctgacggcggccgcacgtggagcgccgcgattgggtgggatgtgctgacggcgttagctctgtagagtgacgttgactggtcagacgggccgggagtcaaaggggaggcagggatggatggatgggagcgccggcgagccgacgggttaaacagccgccgcgtggatggaagaaaggaggcggttttgacttggcggtaaaacaagttgagtacttcaacatttttttttgagaaacagtacttcaacaattgtattagtttttatttggattccaacttttttcttcgaacgtccaacttttccgtcacaccaaatgtttaaacacatgcattgagcattaaacgcagacgaaaaaaactaattgcacagtttgcatgtaaatcgcgagacgaatcttttgagtctaattacgccatgatttgataatatggtgctatagcaaacatttgctaatgacggattaattaggcttaatagatttgtttcacaatttacaggcgaaatatgtaatttgttttgttattggtctacgtttaatacttcaaatatatgcccgtatacttaaaataaatttggcacgtgaactaaacacggcctaggtggtactactcaggttcaaaacaaaaagcttttcgtgctaacgatacaaggtgcctttatttttcataattgctacgaaactttcgtaagttttttcctccaaaacttttagatttgtgaaatcagatcactttataatttgtgtataaaggaaaaggaattgctaaaaagaaattttcacacatatcaagcgtaagatctcgatgctaaccaatcaaattatagttgaacacaagtttataagtttatataaattatatcgtagatacaatataattataatgcagttatataattacactttaattatgttatagatgtaactggaagtttttaataattcaaaaaattgataaattttagatactcccttattttttttggcaaatcgatatttataacttttaaagtatttatatggtaaggacatgtgatattatattatatttatattgaaagtacttttatatatgttactaatagcacatacatatatagtccataaaattagtgatcaaaccgtaatattgtaaaatgtgtaaaaatttaatacgtcttatattttaatttaatacgtcttatatttcggtatgaatgggatacacggtaatatagtgttggctgatgaccacttgtggcacgatgttggtcttcttttttccgaaacattggtgtaaacacacacttgttatatgtgtacgcacacttagcctacaagagctatatataacacttcgacagattgaagcaacatactccattttagattgacaaaatcactataaatatctcaacatcaacaaatgtatcaactatcactaaaaatataatcagttatattaagaatttaaacttggatgaacaagtttaaaaagcttaactggttgagctatgcttgatacaatctacaatggtctcttcgatcccttacagattatataaaaaagcatgaaacttaaggatggttgtgcaaaataattactatactgctctaggttcgatggattttctgtttctgcccctgtgatggtaattggagcttaatcaccgtgaaggcatgttctatcatatgctcattattttgcagaggctcatgcgtcccaaaaaataaggggacatgtcggccatagttgacagtgtaacatgggagaagttatgctttcctacgcgttttggcataaaagaagtttattcacatgtagtactagcaacacacagctgtaaaacctaatgcctcctggtgaaaatattattaacagctccagatgtctacgtgaatggccactgttgctgtaacatccctttcgttcactcgctttcataacgagtcagcggtacatgctccctgctcgggtcaaatcctggctcatgatgtatccttccgagtctcttaatcataattaactccctgtgataaacaaatgaaagctaaaggcagctgtggggaaagacacccatcccgcttcgtatggatcaagcagcacaattgacaccgcccatcacacatgccctgcacatagttgcatgccacaaattggccagagtacacagatgccaaaaatcagggaggtttgacatgtgcttcaagtccatgtcaggaatgagatcaaatcgttagaaccgaccaagaaatttcgggggtgtttagatggggctaaaactttttagcccatgtcatatcggatgtttggacgctaatttagaatattaaacataaactaataaaaaaactaatttcataaatgagagctaatccgcgagacgatttttttaagcctaattaatccataattatcaaaagtttactgtagcatcacattgtcaaaatcatggcgtaattagactcaaaagatccgtctcgcgaattagtccaagcttatggaatgggttttataattagtgtatgtttaatactccaaattagtatccaaacatccgatgtgacaggaacttggaataagtcctgaaaaccaaacagccccagattgctgtcatcttcaacaagacatgctacacaacaccatgtcttgtgaacagggcctgttaagaagcttcctctccatcccttgaagtcttttatagtcgctgttattcaacagggtctattaaaaagaacacttcttttcaacacctacagattgaatttcgtgcggccactaggtggaattcaggtactacttatttatgtgttagaaatgcagtcacacgttacacaaaattatttgacaagatgctttgtctagaaaagaaaaatatcacttcaatccaccaccaaacttaagacctgtgatgctccatactgtatcaatcatttatacttcatacaaacatttttaacactactcccttcgtcccaaaataatttaacttaagatgggatatgaccaatcctagtataatgagggagtacgctacatatgtaacaggtattcatactccagcatacagaagtgggtttattcctagggtcttagcttatggaacatagacgtcaataacgtatggcacatttcacaaaagaaagaacacctttttttcatccttccagaaggatagcaatcaaagaataaaacatagatctagctgtggctttcaaggctcactacaaaagtcaatgcctaaccagtccaaatccaacctaaacacaggagcaataatatataacaaccatccagcttcaaaagcaacatgcataattcaacaatttcaagctgatctgatgcatagcttcagttttaacagtatccagattgatacagctcgttgaaccttttagcaagaaagtcgatagctgtgtattagcctcaataatagaacggtgctatttttcagaacagaagatgccccaacaaaagtaaaaacaaatgaccaagaacatgctattgttttatttgcattgaaatgcaccatgttgaccattgaaatgcaccatgttgacaagacaattcaatcgtgaattcatgatacagaatttacgaggcacttctagtacagcttctcacaattcataataagaaaaattgataagaaatgatattaattcgaacaacttatggagaaaaggactatcactctttataatggcatcaagccaatgcaaagtcacatgtcgaatatcgatctgcagtaacagaggaaccctgtgagtgcacaaataacctaatgaaactaattacaatggattcatttatgcacgtgccctcattcatctaaagaacatccaacgaagatgtattccccacacttgttaaagaaaagagaggtttagtatcttatgcaactaattgctatatttacttaatcaattcctattctagcattccctaatgtagaatgtcacaaggttgaatactccaaggtccaagcaaccacatattcagtagtaatggaaacaaaatggtagagtgttctgaagttagacccaatttgacatttttactgctatcaaacttggtttccaaaaaaaaaaaagtacgagtactggtaaatcaaacaagccctaagttagacagtggaagatgtgctcacactggaaaaggaagacgaagtgctgtaccagcaatcagaagttcagaactttcttttccttcccctcgccttggccctcttcttcctcgcttcctctttctgcctctcggcctcctccctctcaaacttctccctctccctcttctgcaggaagtcggtaaccgacaggtagatcacctgcattgccaaaacaaacaaagcaagagcgaagatgaacacaatatccagcaacgctatgcgccaattcatggacaaatgctttaaccgcaagcacacatcacgcaccccgatggtgaggatggagagcccgacgaacgcgacggtcaggagcacggacaccacggtggcggtgacgctgtcgtcatccgccgccaccctcatcatggcctcggtctgctccatgggcgcgtcaacttcccccgccgccgccaccgccgctcggccgcggcgcagcctcgtgagccgcagcggcctcgtcgctccgccgcatctcccaccgcgacggagagcagcgtacctcaggaagagcggcagcggcgtcgcctgagccggggacgacgggaggacggcgagggagagcgggtgcgcgtgcgctgccgccattatcctcgcctcgcgccgcccgaagcggaacgaatggtcggaaaccgagcggacaaaacagctgggccaatccgatcctaaatgggcccgcgtgggccggcccatagggttcgcgtgcggtgggtgggcccgcccgcccgcccggccggccgagtaaattccagagggatccatccctatccccaaccttcttctcccccacgccgcgacgtgacgtgacgtcacgcatttgtcactttctcgtagcactctacccctatctaatccggtgcagcacgagaagaagaaggggagagaaaaatatctcgcgcttcacacgcaacgcaagaactcgacgaggcgagcgagcgatcgagcggacaccggcggcataataggcacgggaaggcgtgggggagggaggagggcgacggtaggggatggccggagatcggctgagctggtcggggctgctgaaatggagcctctcctacgccgacgggacgcggccgtctcgcgccatcaggtgaggaggatttggcttgcggagggttgattgctgttggggaaattggaatgtggcgggttctttttttccgtttcttttcttttctttcttcttgtttgcttgagttgtgtggctgatggtggagagttggttgggggtgtgtgggtggtggtgcgcggcagcgaggaggagcggaggtggttggcggaggcggtggagcgtcacatgatggtggacgtggtgagccgcatgagggagatcgcgctgctcatgagcaccccgctctccgtcctggaggcgcacggcatcacccccgacgacatcgaaggtatgtttcggttgggttgtcagtacagaccagcggttgtggttgatttgaaggattaagcatgaatttgagcgatcaatttgcgattcggatgatgaactaggaatgatggatattcgggaactaggaatatggattcttgactctcttttcttttcggttggcgatttggatgatgaactagggatgatggattttcgggaactaggaatatggattcttgactctctttttttaggtcggccgcggagaagggttcttgtctactgaattctttgtaaaattcgtgctatggtgttaccaacttggaagtgccgggcgtaacatatggtactcgggaaatgttctcagcaaattgaaaattttatatcatctaaaagttacttacggttttcgcaatccgtgcctacttttgagattggcaaggattcgtttttccgttgttctgaaatttcccgggaaggcgttattagagtgcgtctgcatgattgcatctctttgcaagttcatgatattccctctgttcttctgctgaaactgactggagtggatttgaatattgcaggtttactggctgagttgcaggtacatgtcgagtctattgacatggcaaacggtacgtctagccgtggtcctctagactctagagcatcaccattttgttccatgctttactactgttgttcatcatgcttcatctgtgttgtatgttcatcattcgaaagctatgatgcataatcacatatctaccattctatattagcataaccacaaaagaactgaggagccttcacattcacacaattcaagctagggtctggtccttgaacaccattttacaaaatgtacatcccaaacagcactagccgtccaatatatgtgcgcctttgttagaactctccaccaccatgagtttgtactctttgcataatctatgtttcttactattgtattgctgagttgctatatatgtgatctcaaatccattccttaagttaaatctacaattccatctgtaggaaacaaatgtagcacttggaggcatacattactggtgtcaaaatgagtactttcataacattggatgattcaaaggcatttgtagttactgttgaggtggctaaacaaatgggcggaggcaaccatagtgttttttgcaataaaacattgtttttcaggtgaattctcagcttccccttccaatacagcactaatacaacttccaaggggagctgacagatagttgtcggattcctagactcacttcacaaaccaattcaataagacaaaaaaaaagtttgaaatctggaaacaaggagcatgtgacagttaacaaccaaatgttaacatattgtcggtgtgaattgtttcatatgtttgtaactttgtatgcatcatctgttgacctattttgtttttctttagatcttcattctgttggtggcttggttccggttatcaagtacctcagaaattctaatgctcgtatccgagccagagcagctgatgtggtaactacagttgttcaaaacaatccaactagtcagcagctggtcatggaagccagtggctttgatccccttttatctaattttacgtcagatcctgatctcactgcccgcataaaagctcttggtgcactatcctgtaagtatgttgtctatctttttcagatggtgacaataataataataccttgatgttcccctcattgacattgttcccatttcatgttcagccttgattcggaacaacaaaccaggtgtttctgcttttcgtctagccaatggatatgcaggactaagagatgcattgacttcagaaagtgcaaggtttcagaggtactttagtatagttgatctgacctgagccatcttatttagtatttggcaacattgacttcagataagtgaggagtatttggcaatgcttatgtgcttttgactgacacgcatgctgtctcttccaggaaagcactgaacctcacgaattatctgcttagtgaaagccattccggttgctcggtgtttgcacagctaggtttcccgcggcttatgatgcatttggtgtccagtgatgacttgggtgttcgagaagctgcattaggaggactgcttgagcttgcaagggacacgacactgggaagtaggagtctactagcagatcatgacaggcttcgacggcttctccaggcacgtatagagagaataaggatgatggctccagaagaccttgatgctgcacgcgaggagaggcaactcgtagattcactgtggattacgtgctaccatgaaccgtccacacttcatgtggaaggtcttcttgttttgcctggggaggaatgtttcgaacaacctcctgacgtggctggtagattcttcgagcctctgcggcgaagttcggcaaggagagcaccttctaatgagagatcagatccaggagatggaactgggggaggaatgatgctgcttttaggtccatccccaggcagtagatcaaactcggggagtaattgatcactctgggatgtgaattacatggaaaaggagactgggagtctgctgtcctcttatgtacattgtgcagggctagtgctatagagtgttgctgttaaggggctagtaaaaagtaaataaataatttcccagtttcgaagaaatgtaagtggaaaatatgtgtgatgttcagcagtgtataatatgtctgatgtttagcagtgtgtagtctcatttatanncaatagaananntgcgaanactacttgnttgtggntacacgcaagcaacncntnacananctgcantggngntgcgcgngcctgtattacgttatgcacaattgtcaaactgtagcgggccctaaaatagntatagtcacccttgtacatngtttatgttgtcatgtnnggaaggagtaatnnacaggctgnacaattnnatctctttgcatctactatgttcactaganagctatgctgctgcatattcacatttcaacctctgcggggtgtaatagnatctattgtccttccggactatttctgcgattttctgcgttacccccaacctacaaaccttcttgtttctgctcgtctctggctgatcatccccattacaaagaagtctccacccaactatagctatcaagcttcttcagacgccgtctcttcaccaacctcttgatcttgaagacatcatcctgcttgccagcgttcgccagcgcactcgagagcaggaggcagctcgccgcattgtctggctcgactgcaagcaggcgcgacgccgcaagctccgcgagctcgatgtttccatggcttcggcacgctcccagcagcgcgccccagacgaagcggtcgggctccaggggcatcgccctgatgaaaccgtacgcctcgtcgagcctcccggcgcggccaagcaagtggaccatgcaggcgtagtgctccagcctcggctcgacgccgtactccacctgcatggctcggtacaggatcttcccgacctcgaccatgccgccgtagctgcaagctgtcaggacggcggtgaacgtcaggtggtcgggctttgcgccgtcgcgcagcatccggtcgaagaggccgacggcttcttggcagtggccggagttcgccagcccgaagatcatggagttccatgtcaccgtgctcctctgtggcatcttgtcgaatagccggcgcgcttcgagcacgagaccgcacttggcgtacatgtcgacgagggcgctgctgacggtgagctcttgctcgacgccggccacgacagagtagccgtggacttccttgccatgcttcacgtcagcgacattggcgaacgcgggcaggatggtactgatcgttgccgagcttggcaggacacggccgccggcaaccatcattgctcggaacagtgcgcgtgctctgccgtactgaaagttcagtacagagccggagacgcgcgatgtccatgtgaccacgtccggctggaacccgtcgtctttcatggcgccgactaaatcgccggccatcaggtcatcgcccgccagcgcgaagcctgagacgacgatgttccaggtgaccaggtcgggacacaggccgatgccccgcatcttgacggccagcgccagcgcgtgctccgggaggccgtggcgcgcgtagcacgcgagcagcgcgttccagacgaccgggtccccgcgcgacgccatttcgtcgaacaccttgcgggcgctggcgacgaggccgcacttggagtacatgtcaaggagcgcggtggcggcgacggcgtccgaggcgagggcggggcgggtgagcacgagcgcgtggatgaggcggccggaggcgacgtcggcgaggtgcgcgcaggcgcggagggccgtgggcacggcccccggccaggggtccaccgtgccacggctgccagcttggagtctgaccccggtgaagaagaggcggaggacgtcgccgtggtggccttgccgtgaagagcttgtgagctgcctcatccatgagctggttttcgccgggcacatttgccgctgatccgaaccggtgtaacgctgtggctgtgttgcatttcacttcaaatgaaggaaaacgcttcagtctgagctagaaccggacgggatgggagagtagaaccacaggggaatatctttccaaatttcagctaatcaatcaaaaatatacatgaactttgaaatctaaatttcactatagtagctggtcccgttcatttctacaacaagatttggatgaagatcaagatttttgtggcacgtttttttcaaactgctaaacagtgtgttttgtacgaaaactttctatacgaaagttactctaaaatatcatattaatctatttttcaagttcgtaataattaaaacttaatcaaccatatattaataccacatcgttttgcgtaaaacacttcatcttcatctacaggaaaaaagaacaccaagctgatgaggctttagcagctcgggaagggactgaaaacttggaacgacaagaagaaacgcttgacaccagtatgataggtccaaggtttgaattcagcggtgccaaaagattcagataaacaggtgaagctctgagccgacaaaatgcagcaacagataggagtagttaccaacttaccatagttcaactaaaatttatagcccgaatatgggacaaaactgctagaacactttatctaaccaaagcaaaagaacaaaacaaaaaaactctagcactgaaaatgacaggagcaagtacttctgtcaaagaagcaccagactgcgatcaaatcttgcttcctacacaatactaatcctgaaagctaacttctcactttggatggaagcaacattgcttcattatttcagcgggaacagaagttcctattcaagttgaatccagaaacatcaacggttcacacaacatgcantaggtgcttcaggattctatgcctgcaaatgagctaaacagccccctcaatgatctattatccactggtggttgactgaactgttttcaaaatctctcgccaaatctgaagaaaactgttccagtaccagcattgtgatctacgatgtactctccccttaccaagccaagcttgacgccaagaccatatgatgacccatgaccaacccgtcggaagaactctgtggggttccctttcacatccttggaactgccaaggtcagtgccatgttcaacaaatccatacacatatgtgttcctcacaggaatacgcaactcactcgcaacctgcaggattaaaagatacataagtcaccaacaaagcaaggatcactatatgttgcaagtagccatggtactggcatcaattatatctagtagttctttgttttataattctaaaatagagtaaatttaagacattgtatcacaaaactacaaatttagcaacaaatttatcacaaaactacagatttaatatt

SEQ ID NO: 59950 - DNA, 4718 bp, Oryza sativa
tcttctctccctccgatccggtgttgcgccatcgtgacggagcagcggcagacggggctcctgccggcggaggaagaaacttaacggcggccgccttgtggaagaagccgaaccgccgccgaccggccccttcccgtggcctttcccgcattatgggggcccccaaagaaaccttaccgccgccgggggccttgcacttgatccgtgggaaaaaaagaaaaaaaagaaaagcttacttatgggttccattcctgtttctccccttccttgccatgttggcatgccacgtgggtaaaagtggtaaaataattaaaatggcatttcttaagaggggaaaaatgtgcaaacctaaaaggggcatttggataattgtccaatctaaaagtggcaaatagttaaatttcccatgtccgcctagaaaaatgtaaagggaaattttgctacaccgcgccagtggacaccgtgccgattaaaataataattttcggttgagaaggagacagaaatcgcgtgaaatattaaaaatgcccttgggcccacatgtcagctctccatctctctttctctctttctccctcctttctctcttctcccggtcatggcttgctcagcggcggcagcgatgcccggagcgcgcggcctaataggcggccgaggacgccatggccgcctcgtcgcaagaaccgagcagctcatcgacacccaaaaccaaatagaggcgcgtcgtcatcgccagcgtcatgcgcgcgcgccagcagccagcatcacggagacttgcagcttcgccaagctgtgcatggagtcgcagtcatcgttgccactgacagcgagggcggcagcggacacgagcgtgctggcgagcgcggcagtgcttctcgtgaagcagaacgtgacggcgacagcatcgtacctgtcctagctgcatggcgccaccgctgccgccggcggcggcgacctagatggcacgccgtacgacaacgcggacgacggcatggtcaggtatggcagggcggtggctgcacggcttgccggagctgctcgccgcgcgcaatggcgccgtcgaacgcctctgcaacgtcgccatggacatcaccaggctgcgccgacgccaacgttcttcctcttcctcgtcggcctcgagctcgacctggagccggcctcgcttcgccgcaccggccgcaccgccctcgcgaacgtggcgctggcgttggtcgcagcagcgttgttggcggcgacggcacacgccttgccgctggcgatggcgagggaggtggtggcgcgagaagcagtgcctcggccgccggtgccgagtaagccgtgcgcgctctgggcgtcgccgccctcgccgagcaagccgtgaccgagagaagattgaaaggagggataaagaaaaagagagatggatagttgacatgtgggcccaagggtatttttgacatttcacgcaatttctctcttcttctcaaccagaaatcattattttaatcggcgcggtatccactggctaattactatgtttatagaatatttttcctcaaaagtgagtttgggctgtgtgctagggctaaaaccacacatcagcagtgttcagtagcaaaatttaccaaatgtaaatgaccttaaaaatcgggcccctgcacccaccactgcttcacctcaccccactccctcacctctcagatcatatcccctcccctctctccctctctcccttacctctcaggcagcttttgtctatagagtatatattgtctataaattcccaaaaaaaatacttcaactatgacatttgtttcgtttaacagcattagtatatattgtccggaaaagaatattttttttgatcgatgatcttgtaaataggaattaaagttatgcactacgtactgtatgcgtcaatacctgattcaaaagagaaacaattaggcctagatcacatcctaaaattttttagcctgtcacatcgaacgtttaaacacttgcataaagtattaaaaataggctaaaaaataactaattgtataaattgcgactaatttgcgagatgattttttaagcgtaattgatctatgatttgacaatgtggtgctacagtaaatatttgctaatgatggattaattaggcttaataaattcgtttcgcggtttactgatggattctgtaattagtttttttattagtgcccgaataacccatacgataccctatataatatatgatgtacagctttacgcaccttataaacacccctttatgcagaaaagctaacgcaccatgagatgctctgcgcgaacggtttgaccgtttgatgccctttcccatttcgttatctcagtgtggcaaaaaatcaaagcatgaaagagatgttccaaagtactctgtgttgggctcttctaatttcagggcctgttctcccttgtaagttttttcatcctatcacatcaaatgtttatatacatacataaagtattaaatatagaaaaaactaattatacagattatgtgtaaaatctgtgtaaattataagacgaatcatttaagcctaacttctccttgctttggcaatgtggtgctacagtaaatatttgctaatgacggattaattaggcttaataaattcgtctcgcagtttacaggcggaatctataatttgttttgttattagactacgtttaatatttcaaatttgtttccgtatatctgatgtgacacggtaaaaatttttacccctagatctaaacacagcctcacatcctctcttccctcgtttttcgtgcgcacgcttcctaaactgctaaacggtgcactaatccatcgctccgttttccatgcgggaggtgagggtgcccatccctcacgtaagaacacagccctgaacaatagcgttgaaacatactctctccgtcctaaaatataataagttttaatttttagaattgttctaaaatataacaacttctccaccgacattcccttttcaaccaatcacaaccatacatcattcaattttcccacctacctctacatcttaaccaatcacaatcttccacaatttaattctaattgatttcttaataatcatgtccaactctataaccggacgggtgtagtataaaaaggattcagtgtctaataacgcaaagaataaacgttcatggggcccacaatttgcagcagcattctagactgaggctgtgtttagttcacgtcaaaattgaaaagtttgattgaaattgaaacgatgtgacgaaaaagttagaagtttatatgtgtaggaaagttttgatgtgatagaaaagttagaagtttaaagaaaaagttgggaactaaacaaggcttcggattctttacaaaactaacatcacctgacagcaatcattatgaagcatccaacaccaaccaaattcttcaatgtttgccaaggaactcttctaagacacgaagtttttttatttagaaaatgggtaaaaacctggccctctacgtctgaatggatgtacacaataaaaaccataataatttatcacaagttaatacatattcagatatacgtacacacatttaaaatattaaacgtagactaataccaaaccaattacatattccgcctaaaaaactgcgagacgaatttattaagtctaattaattcatcattagtaaatgtttattgtagcaccacattgtcaaatcatggcacaattaggcttaaaaaattcgtctcataatttacacgtaatctgtgttattagttcttttttcatatttaatatggcatgcatatgtcgaaacattcgatgtaatagggtgaaaaatttttatttgggaactaaacagggcctcagtacaaatctgaatatttagagtagaagagggttgaagctaatcagatgtacataaattgtaagtttccgatcgattccggtttcccaatagtagcctcaccatattcctttttgtttttgagaaaagaaaacgaattaatttccggtcccaaaactttctgaaaaaattccatccgacgtttacctttccaaaaacaggtctgaacaacagaaactttccgaactgttttgatatgtaatcaaaagttttcagtttgtatcatctaatgtattttaatagaattgttttcaatctcctttggcagaagttgactagttggaagactgtaggagtctcactcagcttttgatatttgaagctgaattttgtttttcgcccggttcatactcagatgtaaaatgtaaagctaacaaaacaagtctactttgcattgaccagagaggtaaaggtgttgcataatattgacatagtccaaagtcccaatggattttttcgtcaacctgacaaattgactgatagctaaaatatttacaagaatcaatagcacactctgtctgaattgacgtccaaatgaggtttataaaaaatttgtactgccactataaattggttgtctatatattggaaaattcatcgtttaccacaagtttcctcactcaatctcatccatatccctccaaatggcccaaaggttttagctttctctatactttttacgaagctaaagcttatcgtgcaagcatgtcacattatcacccaccagaaattactatttagcatattttaaattctatacaagcatgtcacatcatcacttctagcgattactattctagtcattttaaatcccatacaagtatgacacatcatttat

SEQ ID NO: 59951 - DNA, 15558 bp, Oryza sativa
atatatacatatatatatatatatattaacatccctaaatttaaccattttctaatcttgcatcatgtcggttcttatattcttattaaccctcgtaaacctaggaaattataattagaggaacttttttaaaaaaactaactcacataaaacctctccttttatttaatttattttgtggttttcatttaaaattatcttgggttatttcttgatttgattttaatttaaaaacctcccttcgactaaaatttccttatttaaatttagtttgaaaaccctttttaatgttatgaattgtggtccaagaaaccctccaatttagctcttaaacctaaaccaaagcaattccaattttattggaattaattgttaaaccatccctttgatctcaaacctattcttaatatttgatccaaatatctgaaatttctccttttgatctagccgccaatttaatccccatggcttgatttccttttcggcacaagaatagtttattacaaatattgtgaataattgctcttgtgctaagaaaatagttttcaattatatcctttcatccaaaagttgtaaaacctcatttagctcataattaattttctcatccaaaattacctattagcctcaaataattatatcctccaaaattaatgccaaataatttgaggctaaaatcctatttatttctctccatctattttatcccacattctcaaattcaattttaggaattcatctatctctccctcctatttgagtgcatcaatataaattccaccatattctatttccaaaaatattgcactcaaataaactagaaaaatatctctttcagaaattatatccaaatataatttcctttcaaacttttctattcaaatctcctttaaattctatccctacaaaatttcctaaaaggtcctatcttttttgggccgaaaccccctcagccggcccatccctttttcctctcctttctctcctctttccggcccagttaggcccagcacgagaggcagtcgcctttctccttcccgtgggcgccgccaccaaccaccgtgcgccatgggcgcgcgtgccgcccaagccgcagccgccgcccacggcttgcgctgccgcctgccatcctccggaaccgtccttcgccttgcgccaccaccgtcgccgtggccaagccgccaaccgcctctggaaccgcctccaaccactgacctccatcacctataaatagccgacgaagtcgtccatattccccacactatccgagctcatcgagctctgtcttcctctctcttcctcaagaccggctgccaccactgtcggccgatctccctcatcagagctccactagccaaactctctcaccaccagccttgcctcactccggcgaacccatttttccacttttccccttctccttctctctctctcctgccggttcatggacttgcgctcgccgttccagccattcccctaaccccctctgccggccactgccctccctaggtgcgccgcccgggaacaccaccggccgccgccgtcgccgcctcccagccaccagagcatcggcgcccaactccctctctcttctctgttaaccggctggaaggaggagaagaaagaagaaggcgggaggaggaaggaaaagagaaagagaaataaaagaaaagtctgacaggtgggccctgcacagtacattttcgcaatttctagattttaatccaaaatctaatctttagaagcccatatctcctaaaccgtaaatccgatttcagtgaaacttggaccaaaattcatctaaattcaaaccctacatttttatacccaattttctattttcatattttatttgaatttccttaatctatttaaataccatttgaagttatatttgatttaatcctatatttgaatttctaatttaaacttatattttatttttcaaatatttcctttttatcccaaaatatcctttagccactaaaaaccgccggttagaactttacgccttctatggggacgttcgcggtttactggtcccgacgtcgaaccgttggttgtaaagcccaacaaaatcctaacacaagatcaaagtgctgctcttggcaccccacacctctacaacacgccgcacagttagctctcaggctctgtgtgatcctaacagctccgccaccactcacggttgtcggagtaacacttcctgcacaaacttcttatttctctaaccgttatactgtccattgacaccgactagagaagatataaaacctaatcgttataatacccaactttagcatcgactagcacatagccaaatcctagtcgataccttgctagtcaaattccagtcatcatccaaactccatatcagctacaatactacctctataccacttcccataatcttcctcacctccactatatattctctacctacctagaatctgtacataaaatatagagcctagccgatatattgtcatgctccacaatcggctccaatataattaaaccctaggtataatattacctagagtaaattccctgtgtacccctgaaaactcactcaatcccttccatacccctgaaatttacccgatcccttctatgcccctgaaatttcagtttgatcccttccatgcccctaccgttacattttccattatttcactgttacgtttggttgcaaatgtcctttttgcccttgatgctttaggtttaaatgtaagcttcaaaaacaattgaaaattttgtttgattgcacagcatgtgcattttataaaactaatgagactaaataattagtgcagaaaattttgacataaattttgaaaataaaataaatgtaataaattaaaatttttatttgaaattttaataggataatagattttttttatcgggagcatttataaaaaaaatgttgtgaacattggtagtcctatctttatttgaatgctcctcatttttatgacttttttataaaaaaaataaatatgtattttttattttattatctaaaaatattttttgggataaataatgcattgcacaacaaactcataagtataatagtctcatgcgagaagcttttatatttttaataatgtaattcatgaatttctttgttcatccaaggttaaaatggtcatttttatagaaaatagacggtcaactaatggtcaactgacgggaggggtattgtcgtaggctctccggaccttccattataattgagagatgaaatgtataattcaagtcatcaaacaagtataatgaaatatccgacgcctcgagagaggaatattggagacattgccgggcctttagcctgccagtcaacttcagcctgagatgtgcccgtcaaaccactcgaaggcggtgaccagatgtgttacacattcaggagacttgacaaaaatggctaaagatctacaacatctcaaatattcttaactcatactcatgtgaatctagttcccaggatgtgcactagattcacactttcatctcaagcatgattatacatagcaaacacaaataaaatgaaagcgattataaactacatctactttagttacattggccaactggccaaataaatatatagaacagcggaagcttgtctacccaatctacaagcacaccgactaggggtttaccccattaagttcaagtcctagaagaagcagtcgattacccgcatcactcaaagactaaatctaaaacctgcaagcaaaaggttaattcaatagcaagagtcagtacattattagaaataatgtactggcaagcaccaagacaagcctaagaccctacttgcaaggcatataatcaaggaaggcataatatggttctttttagcataaagcaagttttatttgcataaaacatttctaaatcaggtttactttcaaataaatttcagcaagctagtacttgacatattgggcatcaaggtaggcattaatcatgtataaatgtacacctcattgccatccatggcagcaaggagatcattctcaaatctcatcacaatttgaaggtaaatttcagcatttagaagaataaacacaagtctatactcaatacatatccacacgccgctcatgaccgcgagcacggctaatcgattagtttttactctgcagagtttgtacacttttcccacatgatgcgaagtaataatcatgcaagagcatggcacgcgatacataagtacccgatttattacccacaacaaagcttttccaaaattcatgatttagccttacaccagcacgatacgtgttactccatcctaagccatacacgttatatgacctagaaccgttaagtggcgggcccacgccttaaacttaacgccgtggtggcggacacaacgggaacccaccacgtggcacaataccgttgtattggacacgcttagtcacctaaactaccacttcggggtaaataggaagctcctctgaattatacgaactcatacacaccggcctaccagaatgtaaggctaaaccataaataatttactaagcttgggctatcccatactagcacatgtggttgcactgtatacgaaatgaactgacgttgagtgaagtccttaggtcggtttgggcacactctccccctatcggtacacaactaatcaccatatgtgcaccacttgaggcccaaacctaaaatccatgttttccatcattttatttatcaaaatcacaagtattaaagttctgtccagattatttcaaaatcaatttttcatatttgtaatgagcccataatgacaaggaagaccattctaagcatggctaagcattatagtaacctagtgaggttagtcatattgttcctaaggttaggaatgagggatatggatatatgtggggtcaaggtgaatgcaaacaataggagtttgtctaacaagtttaacaaaattttaatttattagtgtacaatcgacatgcaagatttgcaaacattttcaataacctccaaaacataggttcaaagtgatcaaagagagggaggtgggacttgccttgaatcaggaaaatgtcagcacctaaatcacttcttcaccgtttaagcaatcatctatacaaagtacacgttatgcaattaaacaccgaaatatgcgaaaaatccaaaatgctctaaaatggatgatttgtgcacagtgaataggtactggtctaaaattaatttaggtgaaagaatttctattttatctcattttatttgggagttatgaattttagaagtttcgtcggtatagtgtaggatttacttaggtactattgtgaaatgctgttgtaaggtgattcttattaagtttatgtttgctggggtgaagatatgtgttttctaagactaacacatttggtttcataatttttagagttaatatgaattctttatgtattttacaaattataacgtgttataggtgtatagtgttctataggttcatggctttagaggtttaggtctagaacttgcctcatctagctagtgatgtataaaatgagtattttagttaactaatctaaccttagttcataggcttatggtctttattatcatggttcatattttataaactaggggagctctagtccatgttagcaatttattatatcaacctagaaattattatatgagctaagtgctttaagttttggtggatgggaatggaactatgaattcactggtctaacaagttttatttgggtttcattatagctagagtgtatttctatgtacatttatatatatacatattgctcaatcgatactatgtgattagaacctatcctataaatttaaagtttagagctataacctgtacagaaggttccatattttattttactatgttgaagcccactgtttgctggttctatagatatttggttcacttcatttagactaaagatgaattttctacaaattttacaatttaaggttgctctatggtggttattacttacataagtatttagaggcttttatcatacagtaagtatataattttattttataacttggaagtatatgttttggtgattctacagaacttgggtttactcaaaaaggatctaagatgaattttatatgaacttctaaaattcagcttatctaaaactagtcatttaaaggtaatagttttagaggcatttgatgtatagtatgtatactatttcattttgctttataggagaacataagttggtggatctgtagaaactgagtttgctccaaaatgagttgtaatgaattttgtatgcattttataaatttgtgtgtgctttatgtgtgatttaacttggataaattttagaggctaaatttgtactgtgagtgcaagtttttattccataacatcaaagttcccaatttggtgagttcacggaaatttgaatcatcttaaaatgagctatatttaattttatatggatttttacaagttttagttactgttcttttataatttcagattttgtttccaaggggtccactgtcagtgagagatcaatatacaaaaagatccctgaggtttctaagaatcaacccgcagacctaggctcatatgtcagtgagttgaaaagttgcacattaaaccttatagttgtttaaattctcgaaacaaggtccctgacttcttttctcacgcagagaggcagaacagccatggctgagctcaatctcgagctcaccggcgacaaacgatggctcgtttgggggtgcgaccaaaagacaaaatgaagatcatgctattgcgattccattcctctacttttcttggtcagtggacatcggagtaacgccggcggcgagtccgaaaggaggatgttttcgggtggtgatgcatgtgcttctacaatcatgtattggttaattgggtgcatgcatgtatgttctataggcttctgggtgctcaccgagatgctagacaaggctggggatgtctgcagagtcacagcgacggcgaagctccatggcggcatggcacaactccagggatgacgtccgctgctcgatctgtatggggagtcactaatacggtgcatgcaagaggtcaaaggctatctagagaggccatgcatgcatggaatttgactgacgctcaccagagagaatggaatcgatgatggaagcggttgaacggaattggaaaagacgatgtcgacctccaagatcgctgcgccattggatgggtttcttgagggtaaatggagaggaggttgaggtgaagctggtggcgtggtggctcgctccgacttgatctagattgatggcaacggcgacgatgtcgctgcggcggtgcgcagctccagagctccggtgtgcacggcagcgttcccgccgattggctgcaccagagaggatgaaatcaaaaggagaaatattcggcatggtgaggagagtatggaacgcaagagaagaggaaacgaccgcggctcatcaacgattgcggccatcgtcttcttcgcagccggcgatggagaaccagtggagaagagcagcgaggatgctctccctcggatggatcggcactggaatggtgggtgaagagtggcgacgcgtctgggagaggcagagatggagctcagcgtttttagggcgtcgacacgtcgtggccacgcgtcgcgcggcgtccagagccggtcggcgctcgatctctccctctcagtgtttctggctagggaagttgcacagaggaaaggcaagccggagggactgacaagggggcccaggtcgaggtaaactaggtggaagagagatgtgtaggcagaaacatgggtgagcttggtttttggacgaatttccggaattattttctcctctaattttgtagcttcaatacttaatgtgttgatcagattaactagtgttgattttactggaggtaggtgtatgtacctagtttctattttctttggttgcactcaaaaattatggatagattacttacagaaattagaggaatatgggttctttggaaactagttcgaatttttaggagacctaaacagagaagataaattctggaaaaattatttttattcattataaatgacctagtatttgaataaattattttacttatacacttttatgcagttaaatgcacttttagacaaagtatggttttagccgattaagaactacagttaatctagtttttattagtttgactgatttatttgaggtaccaaatttagttattgaatcataccaaaattacagtgagttgtatgtgttgagtagagcctacatgaattttctcatgattttatcttgcacgaattattttagataattcgcaagacttatgtcttatatatgtttccctttcctaaatgcatgtaaatgtttataaaagttatatttggactctcattaacctgaggtgatgttgatatgttagaattacaatttacattacacaggtcataagctccttacctattatgcataagtttactttagtattaaattaagagaatgcttatagagatgattaagatagaatataccctatatgatataatttatttggtcacttccatgttcatgactagtcttcagatggatgaccaaaatagttttgtggggcttgacattggccttgttgatgtattttaaggtgtatggtttctattttaacttcctctagctagcactaggccctaatggtttagttgtttatctagatcttagttaatattcatgagacctattatgaaatgcaaatcgaaaatccaaatgcaatccaaatccaaatgcatatgaaggactcaagtcaaacatgtctatgagagtatgcatgcttacacataaatttatatttttgtcctaggttagagatgcaaaggttttaatttgttctaaaattttatcatgcaagagttagatcaacttcacctaggtttaaaatggaaatttttggtttacaaaattgaagaactttcctttcaactagttttgatagaaattccttaatcctagaattcgggtatgttacaggtatgcaagggatcaaaatcaaattttggaggtatacaaggaagtaaggaaaattcaggggtatagaagggattaggtaaaattttaggggtatacaagggattttctctattacctaacactagaacgtgatcgcttatctgtgatgggctgaaagcatcatcactatcgggtaaggccaccgtcactgggtaaaggtcactgatgtgaggaaaaatctcaattgagcaaaagcccgtcatggatggatgttatcttaatcgggccgaaaacaaagcccgtcatagatgagtatgaccagtcaaaccagcgtagttaggagcccgtcacggatgattaatatcaatcgggcaccactaagcctgtcacagatgactagtcatctcaatcgggcatttagatagagcccgtcaccgattggtttgaccccacgtgttgagtcaaacgagtcccggctcagatgacttatctctatcgggcttactctgaaagcccgtcacaaatgacttagctctttcgggcttattctaaaagcccgtcatggatgacttttctctttccggcattattaatatgcccatcagggatgagtttggaacaaaaaaaaaataaagttttataatttggctagcctcaagcctttgctagccatgcccgctgcaaaaattgacagaagcacatatatatagtcccattcccagcaaccccattcccaatatcacagcattcacagccaattcacaacatttatattcccagcatcacagcatttacattccatcacaaaacatgcattcacagccaattcacaactcattcacatttgtattccatcacaacacatgcattcacatcacatatactccctctgtttcacaatctaaggctttctagcattggccacatacatatagatgttaatgaatttagacacatacatatgtctagatttattaacatctaaatgaatgtggcaatgctagaaagtcttacattgtgaaaaggaggaagtatatgtcattcacatccatttttctctctaaaccgccgacatgcatcaaaacctgcaaaactaagttataaattggaacaattttatatgtaattagaaatgcaagtatatacagagacgagctacctaggactttactctaaagaatttaattgtattacaaagaatatttacaaaaatcaaatgtttgtcgcatatgcattgcaaatgttctgccattccgagacgagatacctaggacttcactctaacatccctttcggtgacaagatatcatctagtatgaattgtgctatctcctctctaatgatttcaaagttgatttccggaatccttgaaataaattcctgcatgttcggcgccaagttagtctacatacttgtaaatttgtcgtcctatgtgtgtataaacaattgaattacacacctctgggtcgagcaatgtcaccttgtctgcgaagctccttatgttatggcagacatggaacccgcactggtcgccaacttgttgacgtattgggaagtctttcttgtgaccgagtttgggatgcccatccttatgcctcccgcctcttgccacgtattggtcccatgcctcgttcaaggcagattcgatggccgaccaatcgtatatttctggcttgatattggagttaaggtagtgtaccaaactccacttcggcgttattactagaagaatccaatgttgcttgccaaattattaaattgccagttacatactacagctgtacgcgccgagtatttgagtataagtatggtacacgtttactgttgattgtaggcacacataatgaagcccttgtcttgacgggcaaataagcagtccttgatatagcccaccatgtttgctcgatcgtttttcagtgttgtctcattgacgacaactggatcgagtaaggcaacatggggtgctttacgatggacatgcttccaggttaacctacgagcaagacaagagtcagggtaagcgtaatttatagacagttactaccatatcgcgtaccaagaaatacttacgaggagtagcacttaaggaggttggtgtcgatcgctcgtaccctgtagaggtcccatagatctttgaagtctacgacgatgaaggcagtaggcccgaggaacgactgaccatcgtgctggcccaacatggaggtctctctattcttcctccttgcgttggacttctccatgtagtacccgtgcaactccttgcatgcagggcccatcttgaataaggcgtcgtctccgaccaatggtatgcccaatgtgaattcggctggaggctttggaggagctactggcgccttgccaagatcaagcttcgttggggctaatggcacctttacttttgctctccccattccagcagcttttctgcgtgtgtcaagcttgggtggagaagatttcgccctcttgctccttttggcaggagaggggaggtgcggcctgctgtcgacctccataccgtcgtccccaaaatcagtatcatactgtaattggagatcttcatctctttgttcaatggcaggagggagagatacaacagttgaatggggacgcgtcggcggcggacgagaacttggcgctagccttggagttatattgatctcaatgttgtgcttgggccattgaataaaggtcccacatgcagccccaagggtcagaatctcgtcattaggtgggtgtggaatagtgtagccaacccaatcgggcttcattaagtccacctgaactttggcattgccggctagcagctgcgtcccatgcactcgggtctccggggtaggctagaatgcttgaccctctgcggcaggaattgcaaatcctggtgtcaccctagcgaatagggtacacgatgtgggttcctgcgatagattcattagtgtccatagtatatgttgcaatgtattatggtgctaatacaatatatgcgttattaagttgtttttaccgttatgtggtccaccgcagcggggccttcaggctgttctgctagagcctcagttgatgcacagttgctactcctctgcgtggggcttacttgtactatgggaccgggagtggcattggtcgacctatccctgatgcgtgcctccatccgagcctccatacctaacagctcggcagtgagctcttctctaagctcttctttaagctccacccgaagttgggccttaatgcgtacagctttctgcaccttggaaagcttgtgcttcttgtactgccacgcgtattggggaaacccaaacttccatggagcattggagccaatgccccttgttcgtccacggtgtttttcatttcccaacgctttcgtgaggatgtcatcctcgcgtttttgtgagcagacctcttaggaggcatgtctctcagcattcagttcgacctggggtacagttaggacgcgttagacgaagaatacgatacaacataatgaaacttattctatgtgttcaacttacgattttctggtacaccgcttgatctttgggatttgggaacgaaagaattccgtcactattcttcttcacccttgcccttgcctagttccttgcccgctagaccgggatatcagcaagcacttgcggggtgttagattccgctgcagcttcatcctccttgtcccattctgcctgtttccccgcgtagcctccggtgccaagccggtgcgggtgaagtttccttgcctgcagttcacggtaggcctggctttttgcccgagactctttcgttgatttggcggcatggaactcatcccacatagttcgggtgattgtaacgcctcgattttcgctcgggattaaaaatcattcaataatgcattttctagaaattaaataaaagttaaatcaatttaatcaagtgaaataatgggagaatttaaaattttcccttaaaaatcattggccgggaatattttgtaatattctttgtgccttcaaatactctccggatttttcccgtgaattttcggagctcaagaaataattttaaagtcacaaagttcatttaatcaatttaaataaaaagaaaaggaaataatcttccccttcctccctttcgggctcggcccaaattccccccccctctcttttggacccggccgccctccacttcccctctctcagcccgtcggcccagctcggctctctctctcccctccctcaagtctacactgcctccctagcccgtttcctcctcctctctcaggccgacaggtgggaccggtgggccccacctgtcatccccaacctccggccagctccaaccgtcggccacgccgcccactccccccgccgatcccgcgcctcccctcgtcccaaccggcgtggacccgagtccccttccacctcgcgaccacatcccgccccactccccctctctccccgcgggaatcgacgccacgccgagccgccacacccgccacgatgccgccccactccgtcgccggttgccgcctctcccgggctcgatcccgccttccctagcctataaaaagcatccccgtgctcccctcgtccgtttccccatttttcccgagcctggcatactctccctcgctctccccacgccgcacccatgcgccgccacactccggcgaactccggtcgccgtttcccgcctccacagccgtagccgcgccgagccgccgccaccgccagcttcgccaccgcaaggagaagcccggccgcctcttatttccccctctccacccctcgagcaccaacttcaccaccaacccgagatcgccgccgtgtttgccgtctccatctgtgtcgccccgcctccccggtcgacgccggactgcgccgtttcctccctcggatcggcaactccgagccgcaccccggccaccacttcctcgccaccgggaaccgctgaaatcgccctctccgcgccccggtcgtcccggtcaccgtccgccgcctcgcgcctgtggtatgccgccggaccaccgttgcctccccgaggagcccgccaccggcttccctgttgtcgtctcgccgtcgccgcccttggtgagcatccctcctctcctccccgctccctgtcgccgccggtggccgtctggccggttcatcgccgccgcgctccgcgcccgcgccgctgccggttgtgctgggcagccggttgccacctccccttgccgcgttgcgccaccactccctggcgtgcgtcgccgctgcccgcgtgcgccgccgctccccgcgccgtcgccggccgtcgtcgccggtggccgcgctgccgcgcgccatcgcttggctgggccggcctgagccgtgccgtgccccagccgcgccgcctcgtggccgcccgatcggctttgggccgatccgggccgtcggttcccgtggaccggcgatggaccgcctcggtggtcccggtccacggtggaccggcgcccttgtgtcgctgaccggtggggcccgcttgccggcgccgcctctcccccttgatgacgtcagcatccccttctcctttggaagaataattattaattgtgtcataaatcgtatttaattctagaaattcatttaaatggctcaaaacttctaaaattcatatctaattcattggaactccgaattgagccgttcaacttgcaaaattcatctaaaattgagctctacatgtttgtttactttttatgtactgtttccttggtttttattagagtttttcctcgttttgtgtgccagcgtgtagaatccgtcgtttcggaagtccgcgatcgtgaggaaaagagttcggaagattgttttgaagaagcaaggcaagtcacacattccccttgagcatgttaatcccaatttataaatgttttaccgtttgcaaataaacatgcatgtcttgctaattacatgggattcgggtattacctatctgcttgcttgtgccatgtttacttgatatctgtcctttgtcaaccttgggtaataaatcgactagctcatgttacttatgtgacctagctagaattgtatgcttagccatccttaattaccactaactcagttgatgggataattacagtattagacctttttagtatcagaatgagctgcgtgctcgagacatctggccatgcttcatggtcgtaattatccaactaaaatgcgactgaatggtgggctgtgggtgcatggtttttgtcgcgaccgggaaaattgccttttcccgaacgctagtgtatcaatccccgtcccaggaaaagccggggtacaccacacaaacatgatataaaagacacatctttattatatcgataatatttacattattacagaggcgcttcaggcctgacaatcaaaaataaacagcagcggactagcgggcctacggctccatcttcacaggcgctcaactggggtataagccaggactccacctaagacttcttctccaaagcttctcttactgaatgggggagaaagatagagcaagaatgagtacaaccacagtactcagcgagcacaccggagatgc

SEQ ID NO: 59952 - DNA, 14054 bp, Oryza sativa
ataagcttctattcatttctgaagttggcccgaccaccaactttcttcaaagagactgatcctcaaccaagaaaacatacactgtggcaagttgcatcagatttcactggtgggcaagcaagcataaaaaggtaaaatattagtttgtagtccattatatatagagccatgtgcccatgtttcatacattaagattggttgcatgaaagttgtgagctatgagcctaccgtggtactttttgctgaacatgttttagttttgcatacatgattattcttgtgattttttatttagtgttacttttgctagttgttccacttatattattatttgtttttgctgggatgaccgaaggaggtcatctaatgttattaagataggaaacacttattgaccgtatattaagataggtcaaccatttatattattattattatctactgacctctttattttgactactaaaatgaaaatgattgaaatgcaggaggcatattctacagtgtcaatcaagtttattaagcaagaactttgaaaagcttattcagtgtgatcagcgactaaattatttaagcctccaaccatatatgatagactctcctgttttcagacctaaaacggaaggctctatattcgaaaatccaaataaatcaaagagctatcatggttttagttacttggaaggtgaacatgaatcccacttatccaagtatattgatcatgtatcaccatgtgattttcctttaatgtctaaaaaggatggaatgaaggacgatattgcgaaccaacaacagtcattttctcgaccaatcaattggggtaaattattctttcctccaagacatggatgatatgtttatatatgacctactatatctatctaattatctaatattaaatgttttcaggagccagtgatgtagatttgcaagttgatgtatctcaagaactaaagagccctcaccccaactcattgagtcaagctagatccttgtccatagatgacttgttaagccatctagatgattgcatagttgagcaaaagcctgcagggaataacccttcattgcccattagtgaggcatcatccaatgaattgttggagaagattacccagcagcttttgagcgactcacatgttgcaccagcctcagatgagaaacgggtgatggcaagggttggttctcttctttctctgcttcagaaagacgcagtgccagccaatttacccaagtttgagcccaatgacagcggcaagattggtgtagttgaagtgggaatcagctcagcacttgatatgggaatcgcaaatggcacaaaccctcctggcatctcaagaaaggattcctacgaggagcttttgtcaaacttgttcaacatatcagaggatttcgatgactgaagcaggttggctttgcggttctcattccaagaattagatatatgctatgcaaaacatgtaaatatgagtgataagttagctccttcaaaacaaaaaatatatatattttagcatctcctttgtaaacttttaaatgattcattagattgcgttgcgtattcgttagttcattgctgagtaattttattttgcaacaatgaactgccaacttgttcacattcatcatttcaaaagggcatgcatttatgtgatagtactgttctcaactagcacttcctagctgcatgtaggcttcaactgaaggtgatgacgagtgcatgtatgctgctacctgaaattacaagtttattatgtttttgttcggaaatattgcatgggttatctagtgtgggagtttgttgaaacaacatgaatgtttggaatacaagctatatttcctcagtgtctcctattataaaaagtctgactatttttttaaaaaaaaatgtgcaagagctaataaatgtggaattaactataaaataaattgtacaaactgttgatatggttcttaaattgttatcctaatttgaaatcatcttgttacttttaaactctgaacatcaataactaaccataaagtacactatttactgtagttctcatgactcatatctgaagacataagtttaagttgtgatacccatgaattagatttgaaaggattgcattggattcagaagcattacgctatgtagcaaaagagctcatgcaaggaaaaggagtcttgcaagagctcttataacatgtaaacacttgcatttaaatagaatacattacaagcatctcgcatacacttgcagcctagaaacaaataggtacagcaaacagaaccccttcatctacacacaagccataaaataaaataagataaattgaattttacacaagataaagacatctgggaatactcttaaactggtatccgaagatgtgtagaacttggaaccttgataatattacttaatctaagcctataaggtatcaggtggtggtgcttctccctcctcatcaaaggcttcattttcatcgagcatgttcatcagcatagatacctgctcatgaagcatggaattttccttctctatctccgttcgcttcttacgctcatctgcgagctgcttttgtagaagctcaagcactcgggagtcttcttccaactgttcattcaggccattgatctcacggtcctgccacagcatttccatgaatataggagtcaatgtatgcttcagtgagcaacaaatagaatcgcatataattcaactttgggtttaactagaccaacacacgtcgtaaattgaggataaagttagttttttcaagccttgatcatcgataaaaaaaaaggaaaaaagtataccaaatgcatcacgatattgtgctagtatgtggtattgtggtacggtagcaaactattaaaaagatcatgaacctttctgttcatttcttggattgctatcctcctcatgctctccaccacatcaacattcacaagcttgcgtttcttgccaaccagccatcccttgggatatgacgcgggctcaaagtctggtggtgggagcaacatttcagcagaactgcgcttgccgttgattggttccaaaggctcaaacagcgccttcctcttctcagataagttagcttttggatctggatgaacatcgtcgtcagtacttactgcatttgcatcatctattttcatggcctcttcatgagcctgattgttcagttgttcatcagcagcctctttgttaagttcttgttgcaagctccggccattggctggaacatacatattgttagtcagattcaagagtcagtgcacttctctagctaaaatctaatgcatacaggtgaacattataactacatgattatatggaagttctttaatttcagagtgtgttctgctatcatgacagcctgataacttgttagcatacatcagctcaagaccaacgaacggtctctcaatgtatttatattgacatatgtagaccatccttggtgatgaagcaaagtatcaaggtacaaaaacagcaactatttggaacatgcacaattaaacaaattatctcctgcaagttctatgcattgacaagccttacattttcaagagcaaaaactgattgatttactttggcctaaggcctaagctaactggtcaacaacacatgttcaaaaaaaaaaaaaggttcaatattgccacatgcaacgacaccctaaccttatttaacactgctaactgctaaggtcgacaacatgctatttaatctgacactctgaccccgggaaaaattattgcacgtgaggccataattactgtatgcgaccaagcaagttcgtctatgtctttgtcaataccaaaattatctagatgcagttgcaacttaattgggagttgaccaaaagagcagtgaaatcatagaggatacatgagcaacaaaagaagtagcagccagatgcaccaataaaaaatctcattccacaaagcaaggcagtaccaagttacggagaggaatatgatttgtttctgcaagcatattcgcactagcactggtaagctacctagcaccgacaggtgcagtttcagaatcttggcggtaaagacaagcaaattaagcaggccacatcctcttagtttagttatcaaggcgcctctaagtcttaatcctcatgagcttgcaccaaatggaccagccaaaccggtgcgtgattaacgtgtacggaataataattatatatcgattcagtgagctggcaataatttaatcccccacgaaacatctcactcagaaattattccatgctaccagctacagtacgtttagcagcaggaaatttcgaggatactaacttgtaagtagccaagattaccagtaattaggtgtaaaaccgtaaatcaaagtgttgtatggttcatacaatttttttaaaactgaaagaaaatgcagagaagcttcgaaagggactgaatttgaagctagcgagatttaatcaacaagagattatgagagaaggaatggatatctcatatctgagcagagcaagaagaagcaggagtcgaaatcagcatgatttacatttgaatgaagcatgtaattaacaaagcacctgaggctgatctcctcctcgacttccagaaaatccgcgggggatcagccgaggccggctcctccatggcttgctcttgctcctcctcctccttcactgcagcagagagaatcaaatcacacaaaatcagcttggcctttgatttctcctcacctccatgagcctcttgagggggtgaggctctcgactggggaaacaagaaccacaccaaagcaaaaacaaacagagagaaaatcaaaatcaaaatcaaaatctcacctcttcttcttcttcttgattgcgaagctacctggacccgttctatctgcttgcaacctgagctctatctctctctctctctgtccctctctctatcaatctatgggtgcgtgccttgtgagttgcgttatcttgtggttcttggctgaggagggttgctacttgctaggacggcgagaagagagaggagaggtgggtcaccgggtcgccttcgccttggaagcaactcccgtttgtttcttgaccgtctcgcgtgccttcgtctccgaccgcctttggctttttacttttgaagggacgcagagagcgagggcagtgtagtgtgggggaaaggctgaaacggcgttggcgcgcacggggggcgttggcgttggcgttcgttggttgcggtcgcgcttggattacccgccaacaacctcctctctctctccggatcctctgtggctgcttctgtgttgtttgtgtccaatcctctttcgatgagatactggttcttcgtcctaaaatataacaatgtattaaatgtgatgtccatcttatttaaaagaattttgtgattagtatttttattattattagatgataaaacatgattagtacttgatgtgtaactatttttttataaaaaaaatcataaatatttcaaattagataaacggacagtcaaatgttggacacggaaacccacaactgtacttaaaatgaggcgaatatagtattactgttatgaatctgaatactatgtccagattcatattgttaggatacgtcatcctttcgtttatgctcttcattctaggaaaaaaaataaatttagaattgaacttactaatactcctttcgtaaaaaaacaaaaaaaaatcaacttctagagtttgaattttgtcccacaaaaattttactatcctatctaccctcagcacgtaaaagaagaagttttataccttcaatactctttacctacctatcacatttattatttttttattgattaaggacatcttaatcactcttcattttcactaatttcacctcgggatattaggaatggatttttttttatacggagggatattaggaatgaattttttttatacggaggaagtacatctaatactaaattcgtttttagtcggaagcagtactgtactaataggataaaattggagacaggccaccagcagccgtgcaacccaaagctgctaatcatcatcaattccggtgtactggcagcacagcgactgacaccggcatgcatggaaggatgcaggctatcaatgcgagagctaccgcatagccatgtgaacactagcattggatttgtaccaagccgcgagtacgtagtactactaccgtccttctctccaaccttttccatcttgggggcccaacactcactgcactgggccatatctgagcccaatacctcaaatagtagttttgaggctttggctggcccagttaaagacatcagaattctcttcctcaaaaaataaaaaaaacaaaaaaaaaacactaagttatgcattgcccagtgcccacgctgctacaatgactggcaaccaatagagcggttttatcccctgctatggcaacaaaacaaggcacacggacatgtcaaacgatccatctcactatcaagacccagagattgctaattacatcatctaaagcagtcaggtaaagaaaaagggactatccaactccgacttgagccataattgacccagaaaatttctaccaacagattattgttgagacctcaacctcccaacctacattgtatcctaaaacgaaaacctgtaacctatatcatggttcatccggtacaaatcgatgctgctgctactgatcgttgatcagtgcaacgtcaggccttggcagaatcaaggcagccaatacactgggaaggctcagcgaggccgtaaatggcctcaatgcagctgctatggaatgcatggtggcagcccaggacggccgcgactggaggagcattgtcgcgagcatcgtcaccttgaggcctgaatgctatatcgagcttgcacagctggcaccttgtccccaatggctcaactggtggcgcctcatccttgtccgtcagagctgaaatcgcaacgaagaaaatgtgatttaagtcaaatggttaagacggacagcaaaaaagtaatctttgccttgcactgaaactgtgatgaagaactttacctggtcctttgatgtggacctgcggttgtgaatttgccgatttaaattgctgcagcagctgttcttgctgcttgatcaacaatgccttcacgttcgcgtaagcaggatctgagagaacattggatgacgagcccttagctttcccgatctctagtttcggtgagaccaatggagcagttgcaccagcctggccactgggctgtttcctagcaatgagtaacttagcaagcttcctttgaagatcatcttgcaagttttgtctgggagctgcaatgaccggagaaggcaacttattgtgtgcagcaacttgctgtgctctgttggcaatagctttggcattgactggagcaactggtttattaacaaggcttgttctgttgatcatagcttttatatttaatggaccagctgagtggttgacttggtgagttctgttgggtatagcttctgcagtgactggaaaagccgacagattgacttggcttgatccgctggcaatagcatcagtagtgactggagcaacaagcagatcagcttggtttgttccataggcaatagcttctgtaatgatatcattggaattattttttgtatcaagctgcagctgctgtgcaagttcagctgactgacaattgtcatttgtagtagcaggaccaatttttgaggaagcaatgacagaactctctccgctttcagtctccaacttaaccatagacagtggagcagctaatttaccgtccttatttctgatagttggtttcctttttggaagtacatcagaagggctcttgcccgtttgcagcttctttgatggagatgggatgactgccccatccaactgatcacctttgctcgcgctttcttcatttctctttttgcctggaataaaataatcaaaatttggattacaacatgaatgataaaaatgagttaacaaagcatctagtaagcacctctgtgaacagttgggctatcttcagcagcttgagacgaagcaactctggagcgcttggcagaaggattggttgaaggaacgcttgcccgcttcaggtcttcactcataacaataggctgggtaaggggcttccaagcagatgaagccactttatgaggggtgcggacacgggttacagatggtcttgcagcagcagattgggtgttaaagcaagggtctgtagaatctctacgcttgcttgtactagcagattctcctcccttcacatcagatgaagcagcagcagcagcagtaggcttacgggtcatagaccgagtaacagggcggaaaacctgatgatgagcaggtgtgctgcaagatggctcagcatggccagcatcgctactcactgaaatggaaaaggaaaatagaagtcagaataaaccatccagaatatcctttggatgtaatatcagcagacattaacttgaaagaaagtggccatttttaataaaacgggtaaatcttcctctaaataaaataacaaagattctgagaaattggaactctgatttaaaaatactccattcttaagacgatatagctgatcctctaacaaaggatgacactcattgcagattaattcagtcaacggcaaaatccagtgcgatgcagaactctacacaagagagaagcagcacacaaaataaagaaattaacccatctagtaagttgtaacatctcccgaaaaacaaatggccgcgtacaacaaacaacatgttcagaccaaattgttggccactcatgaaagtgtagcagagatatttatcagtggaagcaaaggcattgtagcaatgaaatctgactaatgatttgatggttggaacaaaaaaagttcccagtattctggcatctaaattatgcacatataatgcaccaacagaacatattacaactttacaaggcagggttacaatgttacaagcagagctgaattcaaccacaacattagggaggtttacacctaatatacaagagatacatgcacaattctatatcaggcaaaaaaaaactggggaaaaagaggagcacatcaacatatagcttccacatagcacgtgcacacttacatttcaacctaaacaggaccgaaccttcaagggaaaaagagcagtttgattgccaccaattaacagttcatacagccaattctcaaggaacagattacatttctttggaaaggaaacccagcagcatgatattttttcttttagtgaaacagaccatcaaaagaaaggcatttgattatgtagctccccaatccaacacaaataaagaaacacctgcccatctttacaagattccatagcataacaatcaaaacaacagcagttacttctgaattatccctacatagcggccgctgtggagccgcgtgccgaattcccaaagccaaaaaagaaaaaaaaattctggcccggctgcgtctttcctgatgacatttctctactcccagtactaaaaccactcgattaacgcgacatcaggatccgatcatggatgattcgagcaatccgtactcaagtcgcaactaaaccgtggggcacatctacgcgaaatcccccccgaaccaagaaccggaatctcccgaaccaaagccatcaacacaacccaacaatgcatcggaattaccaccagcccgcggccgcaacgaatccacgcgaaccaaacatcctaacaaaaaaaaaacacgaagaacccccacgcggaggaggattgggcgggggggttctcaccattctccgcggcggcggcggcggggggagggggattcggggccctggaggcgcgcggcattggattgggcgaatcgggggcggcgcaatcgcagggagcacgaggagaaagccctaatttattttttttttctcctcctcctcctcgtcgttttttttttttcttttcggggaggaggagaggggggaggctttccgtgtcgatggagaagggagagaggagggggttagaggagaggaagagagaagggaagagaagagaagaggtggcgggttatataggcttcgggcgtgaggcgtacgagatgggcccacacttcaggcggaggcggcggcggcggcgtggctatctgtgtgaagagacgactcgactcctctcactcctctcggctcggtgggtttgtgcaagtgctccttagagatggagcccggatgtttttttttgttttgtttttaagacaatagcccggatggtttttgaagtgtgttttggatgaaacaaactcaaggagggatttcggcctcattttcttcgcttatattttatacttaagaagatataatttgaattttcaattttaaatttgaagttgattttgagacttttcatcgaagtttattttcagcatttacttttagatcgctaagaacatatatagaaaagttttattcacaaattacttctttatttacaaatatgtcgtttgccttattccacgaataagctaaaccatgaggccgttttatcttctgcactgcattgtcactgtgtgttgtattttggtgagatcaaatattattattagttgttttacattcacatatgtaattatgtgatgtcactccggttgaaattctacgtcttgttacattttaataagatagattattatttttattatgagataattcaagaaatgctattgacaaacaccaaaatttaagagatgctatcaacgagtgcaagttctacaaaatgtcattgtacagtcaattttatcccataaacgccatcatcattggggtgccgttcatctcgcaccattaaatgaattgttcatcttatagcacttaatgagggctactaatggaaccctaatggtgatgttttttgggacaaaatcacttgtataatgatattttatggaactcataattgttgataacatttcttgtaattgaatgtttgttgatgacattttttggattttctcttttattatagaagatgcaattaaagttctacaacaattacaagtagtacaacatataccaatggtgtttaaagatatatgcaacaataaatgttctagttgaagtgaaggtccactttcttaaaaagaaacttctattaagcaatagaagtttgtttttgaataagtgtttaaaggtatcccaaacatctaattaattaaagaagtgttttcaatagatgtttgggataccaaatttaatattgggtagagatatcataggtaacatgatagatttggttttgcttttatttgttgtaggatggactaggtctattttacaaggcatgcaaaacggcaataaattataggctcatatttagctgcgaggcctataaaacaccttgagcaacgagccattttgatcctaagagtaaactgcattctgcatctgatattaaggctgtctttggttatttatcatttattacaactttgtttttcgcaatggcaaggattggtcattgcctaaaattttggtaaagattagcaaggcttttgtttggtctcctattaaagcatgcaatgggctaaggcaaaatagggcaaataatttaacaatgccatttaattgattccgactcccaaacctgatgagtaactaaattttttgtttgccaattatgagcatgttaagattgggttacaaatcaaacatatcctaagcctaccaatatacttagaaaatttcctatatagccttaaaattttaacctatccctttgatgcatcttgagttttgttcattttcttatctacattccaaaattagtttagacttccataccattttcattagttcactattacctctgtcccaaaataagtgcagtcgtggaaatccgtgtccaacgtttgaccatccgtcttatttgaaaaatttatgatttttttttaaaaaaaactagtcacacataaagtactattcatgttttatcatctaataacaataaaaatagtaatcataaatttttttcaaataagacaaattgttaaatgttggagatgaatagtgcaaaactgcacttattttgggacggagggagtattaactgacctaaaatttttaagagaagttcattatgtcctttggtacgaagagacatataattataatttttttatggagtgcgttgttggagtatcaaaatttgttgtatgggactattatattatatttatgagcttgtgtatgcgagatattatttatgacacaaaatagaggtggcataaaaataatatttatttttcaattactaaaatttgtatatttcgtattttgtacagcagcataactttttatatggagtatttttttcaatagtcatagaggcagggtgtgcgagtggtgcattcataggggtgagtgtgcacgcgttgcgagtgcatgcgttgtactgtgtttctaaaaaaaatcattacaaaaactctatatttaactattttcgagggacaaaaatgtaaaacgtaaaatcagggtcacaggcggaaagccagtgaactgttccgggccggttcaggcctgcactgggatgagatccggtctgcttgcacgcgcagcccaccaaaggcccatcaagatcaccaaaaggcccaaacatgactccggactccggagtccgtaggccccaacaggccgcaaaagaccaatcccagaagcggcccaccgaaaacgtggcgagtggagaacccagatcgccgccgcggccggccacgggcgcgaaaccgatcagccatggcatcttcctccggcgaatcgccgggttttcaggaggcctcgccgcgccgcgcatcctcctcgtcggacgcgatgccttctccgacaaccactaggtgagtcgccgctgttttttccccttaatctcaggagggagttggggttttggtagtgcgtgcgggttgcggcggcggggatcgcgagagggtggggggggggggtcggcgattgatttagggttcttaggctatcagcgctactgcctactgcacccgtcaagtatgattcccgtataaccgtattagttacgcacgtgacatcatttcaatctagtatgaactacctgtactagtacccatcaagcaaaagagtaccaagagttagctttttcgctggctataactaattcataatagagattgtggtaacttttatggcagttcttccaggctatctgtgggcttcatcaggactactgtaaaatggtccagcgaaatttcgctttatgtcaggttatcagggcttctttgagactgtaatttggtcatgagaaattcgctttatgtcaggttggatgctgcaaattatcgaccaggacattcattgtccctatctgttgcttgttgtctgcttagccgtgattttttaggttgtcaatgatgataactggagtatcactgaaggatgatggtaaagatcgttggagtgtcatgtacaggcccttgcagacatttcggtaaggtcctcctgttgctgaaaagaaactgtctgctcatgttattatctccctagtacttcgtatctgttggaaacttagactagggaagacctgcatacttataaataaaactaataattctgcattggtttgttggaatagaaaaagctgcagtgctccattccattattgcctttcagcctgttcataatatcccacaacaacgatcattaatgttgatgataccataggtgctcaaattgactaacaaagtcttccttttctagaaagggaagaactcctagaatataaaaaaagggcatgtttacctgtatgttgaatcaagttgtatttttctaccacagaatacgagcactcttaagattcagttaactatgccctggtttcagactgtcagttgagttcttcaagaaaattcctcaaagtaacatccaataaatttaccgaaaaaaaacaaggtaattgctatcggtccataactaaggtagttttggatttaagcttcaatagccacctcacatgatctttcgatctctgatggaaaatatgagagcacatcaggacattttgctatcatatttgatgtatgaaat

SEQ ID NO: 59953 - DNA, 931 bp, Oryza sativa
tgcgaatattggcacacgagggtgcgatggttttgacgggaatcaaaaagctcaaaaaatgccaaaacatgatttttggacatattggagtatgttgcgtgcgttcgtggcaaaagctcacttcttgattcgcgcggcggacttttgtgaattcatggcaacattggcacatgagggtgcgatgtttttgaccggaatcagaaagttcaaaaaacgccaaaacatgatttttggacatattgtagtgtattgggtgcgtacgtggcaaaaactcgcttcgtgattcgcacggcaaacttttgtcaattaatgccaatattggcacacgagagtgcgatgtttttgaccggtatcaaaacgttcaaaaaaagccaaaacaaagtttttggacatattgaagtatgttgcgtgcgttcgtggcaaaaactcacttcgtgatttgcgcggcgaacttttgaaaagttcaaaaaatgccaaaacatgatttttggacatattggagtatgttgcgtgcgttcgtggcaaaaactcaattcgtaattcgcgcggcgaacttttgtcaattaatggcaacaatggcacacgagggtgcgatgttttttgaccggaataaaaaagctcaaaaaacgccaaaacatgatttttggacatattggagtgtattgcgtgcgtacgtggaaaaaactcacttcgtgattcgcacggtgaacttttctcaattaatgtgaatattggcacacgagggtgcgatgtttttgaccggaatcaaaaagtttaaaaaatgccaaaacatgatttttggacatgttggagttattgggtgcgttcgtggcaaaaactcacttcgtgattcgcgcggcgaactttcgtcaattaatgccaatgttggcacacgagggtgcgatgtttttgaccggaatcgaaaccttca

SEQ ID NO: 59954 - DNA, 1107 bp, Oryza sativa
aaaaatcgtgttttggtgttttttgaactttttgattccggtcaaaaacaacgctccttcgtgtgccaatatttgcattaattgacaaaagttcaccgcgcgaatcacgaagtgagtttttgccacgaacggaccttttacgctccaatatgtccaaaaatcttgttttggtgctttttgaactttttcattcctatcaaaaaacatcgcaccctcgtgtgccaatgttgcaattaattgacaaaagttcgccgcgcgaatcacgaagtgagtttttgccacgaacgcacgcaacatactccaatatgtccaaaaatcatgttttggcattttttgagctttttgattccggtcaaaaacatcgcaccctcgtgtgccaatattcgcattaattgaaaaaagttcgccgtgtgaatcacgatgtgagtttttgccacgaacgcacccaatacactccaatatgtccaaaaatcatgttttggcgttttttgaactttttgattccggtcaaaaacatcacaccctcgcgtgccaacattggcattaattgacaaaagttcgccgtgtgaatcacgatgtgagtttttgccacgaacgcacccaatacactccaatatgtccaaaaatcatgttttggcattttttgagcttttttattccggtcaaaaaacaccgcaccctcgtgtgccattgttgccattaattgacaaaagttcgccgcgcgaattacgaattgagtttttgccacgaacgcacgcaacatactccaatatgtccaaaaatcatgttttggcattttttgaacttttcaaaagttcgccgcgcaaatcacgaagtgagtttttgccacgtacgcacccaatacactccaatatgtccaaaaatcatgttttggcgttttttgaactttttgattccggtcaaaaacatcataccctcgtgtgccaatattggcattaatttacgaaagttcactgagtgaatcacgaagtgagtttttgccacgaacgcacccaatacactccaatatgtccaaaaatcatgttttcggcgttttttgaactttttgattccggtcaaaaacaacgctccttcgtgtgccaatat

SEQ ID NO: 59955 - DNA, 14379 bp, Oryza sativa
tatatatatatgtatgtatatatatatatatatatatatatatatatatatatatatatatatatatatatatatatatatatgtatatatgtatatatatatatgtatatatgtatatatatatatatgtatatatgtatatatatatatgtatatatatatatgtatgtatgtatatatgtatgtatgtatgtatgtatgccagtgcatagacttgtgaggtgggtatgatttactacgtgaacttgtaaatcgtttattttggtgtataaacttgtctagtatgtgtaaatcaaagccaaaacatgtggtaactaattacactatgttggacgttgaataggatgttatattggcttacatgtcaagatgatattattgaatcaaatatataataagtcctgttaattataaaattaaaaatatatatagagggagtatataatggatagaaaataatagaacaaaataactacagtatgcataatggttgattttttactcatacgacatatctcatatcctcatgtgtgagtgacatataatcatactaagtcaacatgactggtcacaatataccgtttcggactaggtcgaatgcactagacaagttcgtgcaacataataagcattttacaaatttatatactaagctacgtctatgtgataagtttgtataccaccaacacagcatacttttttagatttgtatttatatatgtttgtgaggaagttacgaaaatatacgcggctcacagcacggcgatgcgggatagctgagccgcgtatattttcgtaatatacaggaccaacgacagagacggtcctgcgccctggtacggcagcaccgcatcggcctgcgcagtgcagcatcagggcaagtaccataataccacatatgttgcctctaagagtctcatattggattaaatgataagatgaaggagagaagtgaggagaaagaagatgagccacccctaaatcaagaaacaacctttacacaaatttcaagaagggtgtaagagtattaaagatattggtatttgtgtactatgggtgatatattgtataggttgtcttttagtttatgagtaaataaaatagataattttgaaggtagtagtcatatttatcatagtacttgtcctcagcatagcatcggtgccgcggccctacgcaggaccgataggagccggaaatgtgtgaggtaccggtacggtctcgtgtctcggcctcgtggaaccgatggtggaattgctgttttagttccggaaaatgcttctcatcgaacgcccgaaccaacgagaaaaatcggacggggagtctctgacacacatgcacctattcaacttgtatctctatctccaaacatgcacctttaacgatattcaaaacgaattttctctgaaattacttatccaatctacaatccgatcacaccgttgtattcgttgtaattaaatctttacaacaagatatcacatgattatattccgataaaaaataatcatatgtttcaatacgttaacactttttgtttcatacgtgatagggacatgtttcaatatgtgtcttcagcgtgtttcacaaaattcacaaaactaactgttactactctctctcctctctctctccatctcatgcatgcatacatgcattttagctagttttgaaaatgaattttctcttaaactaattatccaatctacgatccgatcacaccgttgtattctttgtaattaaatctttacaacaagatatcacatgattatattttgatgaaagaaaaatatatgtttcaatccattaacatttgttgtttcatatgtgatagcgatatgttccaacgtgtattttcatcatgtttcataaactttttaaatgttttagttgctgatattttttttcatcctatataacttgatgttccactcattagttaactggaacatttgattgactgattctttttttgagaatgctgcgcgccgggcgcccgatggcagaggaaaaatcggacgcctcgggctttctttcgctatttgctgaaacattatttttatataaggtgaaacaacacccgatttaaacgagtgaaacatttttgatctatttagtgaaacaattccgatatacctggtggaacatcgtgcaacatttaaaaataattcaataataagctaaaaaaatttcgtcggaatatatccatgtgtggttttgttttaaagatttaattgcaacgaatttaatgatgcaatcgaatcatgatttggataaataatttaagagaaaaatcagtttaaaatagtttttacacgtaaatcgggcgctgacgtcagcgtccgatttttcaccaaacatcggacgtccgaactggagttgcctcctttagttgtggttgcctgggaagtctttcaaggataacgggcggcagtactaaggctcttcacagtgcaatgagctggccagttgcttcacaactccacgcaggatggttgatggcgtggaggagagagggtgtgggccagagttccttcacatggttgctcggttccttggtgagcaacgagttcctcatcaaaaatggcttaaaaaatgcctgcaaaaaggactgagcatgcacaaaaccatcgggagacggaggggagaagaaaagcgaactgcaaagcgattccgtggtggggccggcctgaaaaaaattgagggtgggttacgcgtgcgtgcactgtggagagaggagcttcaaccacttttcctgggtttctttcatacgtggacatttgggttgcttgcccaggctcaccgcactgctactgccctaatgataatgcttgtcgcccgcgcgcgcccttggcccacgtgctacctgttggcccacccacttcttcctctctttttccacaaagatgttttatctagtgtacttataatgtttcactatttatagatctaatattgtagtgaattaaaatactcttttgcaaaaaaaaaacccacatattttggaaactctctattaagaaaatttggtttatttatgtatagatctaatgttgcagtgaacgaaatattcgattgcaacaaaaaacccacatattttggaaaccccctattaaggtaatttggtttattttttattccaccaaaaaatgttttacctagtgtaatcacaatgtttcactatgtataaatctaatgttacagtgaactgaaacattctttcgctatttgctgaaacattatttttatataaggtgaaacaacacccgatttaaacgagtgaaacattttcgatctacttaatgagacaattccgatatatctggtggaacattgtgcaacatttaaaaaaaatttaataataagctatttttttcgtcggaatatatccatgtgtggtcttgttttgaagatttaattgcaacgaatttaatagtgcaatcggattatgatttggataagtaatttaagagaaaaatcggtttaaagtagtcttgcacgtaaatcgggtgctgacgtcgagctgacgtcagcgcccgatttctcagccccggatcggccgcccgatccgtaggcgctccccagtactaatggtgtggcaactgatggcttggacgaaattccgcgtttaaacatgagaattgaatcgctgtgagatactaacctgcttccagcagtcccgagattgcaagttaggccctgtttaaacatgagatacgaatggtgtggcaaccgatggcttggacgaaattctgcgtttaaacatgagaattgaacagctgtgagatactaacctgcttccagcagtcccgagatctcaccttaaattttttttcgccatatcacatcgaacatttgaatacctgcataaatataggttaaaaaataattaattgcgaaagggcctgtagcctagtggttacaagagcctcagtagcacctgaggtcctgggttcgactccccataggagcgaattttccaggatttaacggcgctgtgctttcagtggtaggcgacgtacccgtcgacaacgaggcgcttatggtgacttcgtcagactccccataggagcgaattttccaggatttaacggcgctgtgctttcagtggtaggcgacgtacccgtcgacaacgaggcgcttatggtgacttcgtcaatctctccagaatttaccggcccagtcttcgaagatgctcagagggatagggtttgcgtgcgtgtgttcataggggtgagtgcgcgtgcgttgtaagtgtctgcgttgtactgtgtaattttcaaaaaaaaaagtttgcgtgcgtgtgttcatagaggcgtgcgtgtattcataggggtgagtgcgcgtgcgttgtgagtgtctacgttgtactgtgtaatttttttaaaaaaaaataattaattgcacatattgcgactaatttacgagacgaatcttttaaacctaattgtttcatgattttacaatgtggtgctacagtaaatatgtgctaatgatggattaattaggtttaataaattcgtctcccggtttgattctgtaattgggttttctgttagtgtccaagcacctcttacgacacgttatataatatccgatgtgacgcgctaaaacgttacatcctgaatctaaccatctagtaagttggaaacaagtgacctgttaaggctttttttcttctttgccgtgtggactgtcccgggccgtcgatcggtcccgtagctccacgtcgcgtcatgcaagctatccgcctatcccacgtctccacgccacgctatgaagcatgtacattttcgcaatttcccacaaacatgtactcactccatctcactttaagataaagataagaatgaagataaatatgaagattaagtgtttgacgtaaaataaggttgtaataacgtgtgattaattgagttttaattattttaaacttgaaaaatagattaatctaatattttagaacaattttcatatagaaagttttcgcacaaaacataccgtttagcagtttgaaaaggcgtaccatgagtgtcgacgtttgatgtcacgactacgatatttggacagtatagggatcgttggtgctaggatatacgcgagactgaggtaaaagagatggagacgaggatttgtatccaagttcgggtccctgagcggtcaggtaatagccctacatcctgttggccggagccgatgttgctttttatttaccataatcacaccagtacaatatgtgggtagcctatctaactgttgtcgacatgtcggtcggaaggtctgactcgtagtcgacaacagggtagccttcctcctcgaatccgtgcccggcgagatcagagatagcgctttcgtctctcctgacggtatccggagacaccgtaggggaatagccatgcctatccctaaagtcgatatccggcgtcttgtcttggagtatgttggcttctatgttgtggcttctatgtcgattgtgttgggtgttgattgtctcatatcatgggtgtcccatggtcggtgtccccctgtcctcctaggggggcttgtatttatacccataagtgtccccttgtccaagtagaactagagaaaccaatatagatacaatccgagtagtccttattgttttcatgtagtactctggttgtttttccttatcggaactcctcctatatccgaagattgtttccgtataggacatggtatgtggtgggtcctgccgagatttagtcaactattattaggtatgtggtatccaaaatttaatccaacttttgttggagaaaagaacaaggcctaagtgtaaccatgagttttcatgtccaattttgatcgtccgtttatttaatttttttataattagtatttttattgttatgagatgataaaacataaattgtattttgcatgtgacttatgtttttaaattttttcataaaaaatttcaaataagacagtaggcacgaaaaataacggctacacttaaaatgggacagagggagtatataaatgcaaatccatctattatatactaaaagtctattaaacttccacaaaacgctctcaagccagacgctctaataaattagaaaaatactagaaaatctgagaaaaagcaaaacaataatctcttaattttcacttaaatcgatgatccaatattataaaccgttagattaaatttcttaaaacaaattgatcgagttactcctcctcctccgctgcacaggcccacctttccttccgtttggtaagagtaagaacgtacatacatgtcattcctttttttcttttttccatttatatatagttgtgacaacaacaattattattattattaacgataataaattaaaatattggttactttacaaacatcaaatatatatatatatatatatatatatatatatatatatatataactcttttacaaatagacataaataaattacctctacaacatttggaaatgaaatttacacccattatattatattatatacccgttatattagactacttctaataaaagtatttatccattaattttttcttaaatcagcagacctattatttagaccatcatatgtatcttttgttaaaaaaacagtgcctcggaagacttctgtctgtctctctacgcaacgcaagtgggcacgtctttgccttccgaacgcatgacgaagcatcgtacctaaagcagctaaggtgatcacaatgctgcaactctactgctttgctaaggtaaagacataccaaatcatcaacggataatgattggtttttttttataacatggaaacaaaatcgaagatgtgatgtagagagaagaagaatcaaacaccgcgagttgaatataattgatttctctgtacatgtatataaatagagagaatacactcagtaccactgagtttatcgcaattctacagtctaccactgacttggttaagttccacaattaatataccatcgtgttttcttcaacttctgctctatgccatcaccatcacgagccgtcagttagaaacttagaattcgttttgtagtgttaattctctcgtaagagcaagtttaatagtatagccaactactagctctaattcatctatagccaatctaatagctcattcatacaatagttacatactacactattaatacctagtcccacctgtcatagacacactgcatcttggagtccgtgctacagctggctacaaatctgtagcccgctgctcttctctctcctgatttatctctttaaaatatatttgcagctggcttatagcttactattgtacctgctctaatgactgatatagcctttgtaaccctagataccactgcccctcgcctcacctaattccccatcgttcccctcacccccaccgaaatgcaccgccgcccatgagcctctccccatcgagatcccatggcgctgccaccgccgcgccgtcgcccaacggcgtctctactagcgacgacctggcactgccacaaccgggcaccacgcccccatcaccccaatcgcagacatcctggtggcgtcgtccccaggaccccagcaccgcagcaagcgtctgcccaccgcgcctccaacgccgccggcctccaggcgccaccgtccccatcgtcaccgatagcagtgccgcagcaaccatcgctcaccatgcctccaccaccgtgtcctggcacttccattcccaacgccgccgcaaccgccgcaatcctcccaccacgccccgaccgccccaatcatcgatgtcctggtggcgtcgtcaccggtgctgcggcaagcttctgccttccgcgcctccaccgccgatggtctcctggcgctgctgtccctagcgcagccgtccccatcgccgtcagcagcggcgccacaaccgtccgcccgcagcatctccaccatcgggacgcgccacttccgtccccaatgcgacagcaaccggacgtgggccgtgcctcccaggagctggacacagggaatgactccctggagctagctgtcgttgatgactgcatgccatgcctgttgctattgctgctccctcaattgtgtatgaactgcatgaacgtgtgttgactttctagttgactaatctaatgaaatattttggtattaaaccgtatggagttggctaatataatgaaatattttggtatgcactcctatatctataggagcttagtgtcatccatcatgttgaaaattgtttgattggatagctaaaatgagcaaaatgtgtgattttttttcctatctagttggctgaaaccatttgatggtttgcataccttttatgtgtggtgtggttgcttaaaagacaactaattaccccattgcgatggcagagagcaaaggttgaagaaaactcggtagtatattatggaacttaacaaagtcagtggtacattgtagaattacgataagctcagttgtactaagtggattctctcgtataaatataggacgaggctaaaacaaaaactaccatgtcacatacataatacacaggtaataatctaattagatgtgttaataaagaacttggtttggaaaaaaaaatttggaccccatgccccatgcatgagagaggagaagtgccatgttgcctaatatcactacaagataattaagatatcaccactaatttattacaacgaaaaataattcgtggtactatcgcaatgatatttttttttgcaaataactatactttgttgcaacgatatataatcgttgttttattcagtatttttgttgcaataggaaatgagctatcgccacaaaaaaacattactcttgcaaaaaaaacatgttttatcaccacacatttaatttttgtggcaatttgcatagtacatggtactttttactattttccattgccatgatcaacaaattcgttgcaataaaaaaaattatcatctcataatttaacttattcttttcatatggacacggattaggacaaattttatatgaaatttatagctctcgatgagatctacaacttaaaattttcatttgaaatcttttaaatactcgaattcatgattcaaatctcacttaggcagtctcaaatggaattgtatgtatttttaaacaaaattgatgcgtagatgagttggtcatggagagcgtgcgtgaggtagagatcttggatttgaatcctggtcatgacaagatatcaaaagaaaatagttaggatgagaaattaatattgaaacatttaatttggtacgtagaactaatgccacacatggagtggtggcaatagttatttattgcaacgatgtgaagtgttgcaatatatatattttgccacatccattttatggcaatatcaaattttattacaactaaataaaaatcattgcaataacctattaccacgctacttattaccacagctagcaacgattttaagattgtggcaaaatgtatctattaccacaattttagcatttcgatgctacaatttttttcatgaagataaattatttttctagtagtgatatgtaaattaaatatgatctatacgactatcattagatgatgggtgagtggaagatatataccaccgagaaataagcggagtgaaaataatgacaaatagtttacatctattatctatatgtgatggagtgacggcacgatgtgtcagcagtacaacaagtttttctttgattacgaataatgacaaagacatcgttaaggacaatatgtgcttatttgaatttccaaaagaaaaataaaagacaaatcattaaaaatgatattaattctggtgtaaatcatattaaatttattgattataatttaggcaaaattggttatatatcatcgaaagttcacgctttttgttttaaagcaccgaaagataccggttcactttaatagcacccaaagttcaccctgtttccatttttaacacttccattaattctcgatcgttttccgtccgccttgatcactattaacctagctacgcacacgatatgacatctctacccctcattgctatgcattctacttataattgtgaggggcagaaacatcatatcgcgtgtgtggctgggtcaatagcaatcaaggcggacggaaaacgactgaaaattgacagaggtgattcaatcacaagattttgagtttcttgatcccatcttttgtcttgtagctatatttgcgcggtatgcgtacaaatgatatgcatgataattcactggaggtagtttaatatttactcgatgtaaaagtcaaattaacttaatccatcttctattcggtgaatggattttgagatatgttaagaagtagaactcctaaactattttaaaatgatattgttgttcgctatctataagacaacttttgaacaaattataattttacttttcaatggtataaatgcccgcgtataagcgtgggccaccttcctagttctaaaaaaatgtatattttcgggaaaaaaaaacagattttctcccctaaaattgtcgcaagtattttagcgatttcgtattttagttgtttagctgattctagatatctccatgttgatgttttgaatcagcaataaatttttagggcttcgaaccggtgctaaaagcatatatatacggagacaaggatttagataggttcagactatttagataagaggtaataccctactcctattttagtgaattgtatccaccgagttgtattgattgtgttgtggttgttgccctggagaggctacttgggggatataaggttataataaggaaaacctggctggagtcagtatcagttttttaatctatgtacatagtagtatgcagtcggggttctatgccatgttttaagatgcaacgcaacatgacgatcaagtcctacttcattacatattgtatggatttgacctatcttctgcatcttagatatagatacgcagaccgtattgatatacgatacccatgttctctgcactccataaattaccatattaggccgcgaagctgtgagcaagttattccatcaacctcctttttttagcacaatggcaagctgctccaatgatgtcacggcgtcaccggaagacgtacgcgcctacaaatcgggtgtccaattttttttttaaaatcggacgctgtttcaccaagtagattgaaaatgtttcaatcttttgaaaagctgaaacacaaccaaatcaccttacgaaacattttgctacaacgtatgaaacaacagtttccaaaaaattgggcgttgtttcaccctatataaaaacaatgtttcagcaaatagcgaaaaaatgtttcaattcttagaaaaagtaaaacacggtcagatcgctagatgaaacaacctggttcaacgtataaaacaaacgatttaaagccattgcaacacttaaaccccgtgtacattaacaaaccacgtgtccagcaggatgaaataaacagtttcaaaatccactgcaacatttgatccatacatagtgaaacatcacgacactagctgaaacattgttggcggaacaaaaaaataaaacggatcctctttaatagagcgttttcgttatatccgggtggttgttgcaacgggcacatgcatgtggtgggggcgcggaggcgtagcgtggtgcggggcgcccaattttttctcctccatcaggctcccgacgcggaggattttcaccggatgactggtcgatcggttcatcctagagaagttcttcatcaacaatttaagctcgccttgtatgattttccagaaaccaaaaacaccatagtgaagaagaaatcctgaggtccgatccagttggtcagcacatgggcctgtttgcagttttcaggctttcaagatggtcttaaagttggtatgggaccttcaaatctattgtttcgcaattggagtcttcccaattttgtaagattgccgatagaggatggaataggcccaatgaagttgttgttttcaagaattagaacttgaaggttttccaacttttcaatccattctccgatagtaccagtaagaaaattataatctagtgtcaatagaattaaccgagaaagtttcccaatgcaatttggaactattcctgaaagtttatttccacctaatactaggttttgaagagttttcgatagattcccaatcgaatctgggataggtccagttaatttattttgtgctaatgatagagtttgcagagaactacagttccccaacgcatgtaagaatgcccagcttactctgtcgcttgcttcaaggtcattgttatcaaggtttagagcaagtagtcccgaaagcttaccaaaagaactgggcactgggccagtgaaaacattgtttgacagatctacctttcttagccctgaagcattgcccagggaagctgggatgctatcttcaaacatattatcttgcaagaaaatctgcaagagattggagagcttgtcaccaatgtcaggtgctaatgtcttgcctagcttattatcacgcaaagatagtacttgcagagatgagaggttgtagaagggatgtggaatttcgcctgagagattgttgtcagccaatgataagagctgcaaactggacaattggccaagctcactgggaatggttccctcgagttgattacttgcaatgaccatctgtcgaaggttagtgatgttcttgagggtcggaggaatggtcccagtgaaattattaacggaaaggcccagtttctttaaattggaaagcaaacttattttcggaggaattgcacctactaacgtattcttactgaggtctaaaaccgatagggtagagcaatttgtaagccaatctggaaaattcccttccaacgagttcatgctcatatcgaggatttcaagtttgtggagattgctgagaggaggtatctgcccagagaagtaattagcggacagatcaagtatacgaaggaaagtcaggtttccaacagagggggcaattgggcctgacaagccttggccggtgaggttgagcaccgtgactcgcccggggtgcttcgttgcgcatgtgacgccgttccactggcaatggggagatgttttgttccagctgttcagggctccagccgtatcgttaatggcttttctgaaatggagcaatgagagcatgtccgtgctgttttcggggacagttgcgcaacggatgccaccagctccgcgtagtagcactagcagcggcagcagctcaagaactacaagcatgctgtgtttcacagttcgctgcttagctgcaatcaaaaaagcataactcaatacatgtcagtcaaacggagggaagaatgcagtaggtcagccatacgattcccgtgcattttcttgaacgagcatgactcaaaattaaagtttttttttttttgggcgggggactcaaaattaaagttgattcgatctactgtgcatgcttatcgcctctaaagtcctataatatgttcatactgagaaaattgacaaccataattaaggcgcacgaagtgtaggaaatattaccgaagggaataaattaggttctaacctctagttggaggctgggagcaacacgctgttactgcctggaaagtggaaacgagtgtgagttgtatgtggttggctcaggcccgtggcgcccagaggtttaagaacagttgtgccgcagatttacaaccacacgcttaaattcgttctgcgattccttgtccgatatcatatacgttgccgtcgcctgaccgcaatacagaacaggccaaagctgacgactttggctttacaagatcaagcttcgttggtcgtgaactcgtgatctactccctctagacgccattgccgtccgagcaatcgtattcctgtctagactctgcattttgttccatcacgttgatgtggagctcgaagatgcaaataattcttctttttttttagaactaagatgcaaataattcgcatagacatttgggtcgccgttactaggccaacaagaggacacgaacaggcccaacaaaacgggctatgaatggagggaggcatgtggcccattgaaaggccacaggcccataatgtcacagtctgctactcatcgctaccagttcgccacgaagaaactagggctttcttctccagtcctccggttcctccgcaatgcacgcccgaagcgcggcggcgcgagccgtcgccggagggcgacggtgagacgccgcccgcgaccaaccagccaccgcccgaaggtattccgtggttcctagatctcatcagtctttactcgtagaacagtcagggtcgtcctggatgggaggcgggtaatcttttaccctggggcagctgcttgcggggttgatgttgtatttgtaaacctgtaacct

SEQ ID NO: 59956 - DNA, 705 bp, Oryza sativa
tgcagcccgttctttacacttagcttctcacaacataatatcctgaagagcctccaatttaaccatttatgacggttttcagtcatacttataatcgtcaaaggtggtcttctggaacatctcttttaggatagcacatactgatatacatttatgaaaaaaagtgctgcatcaaaattggcatcagaaacctctactttggactaacttactgtgcctttgagcttcttacatttaaaaagggcaagtctagtatatcttcatagtctacacgtaaataatattcaccaaattgacttagtagtacagactctacataattgtactgtttaattacctgatcatttttgctgaaccaaatccaagactgtcatgaaataggcttgtcatgtacttcttctatacaaagctcaaaagctctgagctgttgtatatatggggcagatatgcttccccattcccatctttgtgtttattccataattcgacaaacttcttataaaaaaaattccatgaatcttcaattgtcttcaagatccatttcttgtaagcctgcaaaatatgtacagacatacaacttattttatgcctggcgaaacatcatgaaaataccttctagaatctagatgttgcaattgcactttaccatatcataacttatcatttctgcagtgcccattaagtactccctccatttcatattat

SEQ ID NO: 59957 - DNA, 509 bp, Oryza sativa
tatgctttgacatctattactagatttgatagtactcacagagaatgatgagtaaagaaaatagaaactaaacaaccaaaatactcaaactaagctctatggttcatgtttatggtatgatgggttcatcaaagataacagacatgaccaggtggacatgagaagcttcaaatttatctcctgaagtcaccatgatgaaaaatccacttcatatcaatttactaatatacagtgaaatagctacatctatttatgtaagtaggtgcatcaatgagggatgagcgatagtcatatgatcaaatagatcaaatgtctcgtcatgtcaactggtgttgaccatgtttcagttgaaaatcacaagcaattgaagttctaaaagacttgactcgttacatgtatgcaaatgaagcatgacagcaatgaggaacaatattaaatacactttttataatatgcaatctaatgctgcagccagcactcacaaatagcaccgacctattagtagctgt

SEQ ID NO: 59958 - DNA, 774 bp, Oryza sativa
tccgatatctggatatccagttcataacaactgtcgtccatatatttcacataatatcgggctagaagcaatagaaaatgaagctaagacattgaagtttatacacttcttgcatagatagattttttttagacggaaggccagtggcccggcttttaattgaaagccaaaacggcagagttcagctggggttgccagcgtactgcatagatagatgccacctccagtcatcctaatcaagtaaaagtataatttgcatttgacaagatcacaagatagtcacaaaccttgtgcctacgatacctaatggactcgagcatgtgtatttgctttaacttaatctaactagccatgagttctcaagttatcttaaatgacaatagaagacgttgagcaagagtatagtttaattatgacaacatgttagatcgcttctatcttatcggaatgggttctgcaccacaaaacattgatccaagtaagatctcaactttgtagccttatttggttcttgagtagagaaattttatggtccttgaaaaggtatctcgatgtacctaaattttacactaaaaattttagcatctcgaggaacctagtagcatttccctattggttcttgtgattgttcatgtttggctatgttgattgttcctgcctaccttgtaccttgaaatgcgaccctcctattacctttggctttgctgtatcaattttgtcagtttggagctaactctctagttcaaaatttaggtgaaaccttcatattcttca

SEQ ID NO: 59959 - DNA, 9688 bp, Oryza sativa
tgaaacaagtcaatgtttcaaaatgatgctcacaaacatacagtactccctctgttccatactataagacgtttcgggtttgtcctaaatttgatcgagtttgtaaagaagtgtagcaagattttcaacacaagtcaaatatactatgcaaatatattgaatggtggatttaatgaaactataatttggtgttgtagatgttgctatgttttttttttctatacacttggtcaaacttgaaaaagtttgacttaagcaaaccgaaaatgtcttataatgtggaaggggttgtagtaaggtactcccaccatcccaaaatatagccttcagcacgggtatgaaggagaggggtaaaaagacttggttgccttcttgggatgggtcagctataggttaggttgaggctataataaagcaaaggggtagaatgggtagaaggggtattttagtggaaaaactcaccctttacaagtactaggtagcatctatatttgggacaaaattaactctaggaagttatattttggaacggagaagtagcaattaatgaccacagttacatgaaggttgattagaacagaaaatttccaagttcaacatttgatgcaagacatggttgtcaattaaaaacagttatttgaggaggttatgtagacggtttcaaaagtagacattcaagttttcatatgaagtaatcaaaccagcacgaaccaatattgtccctcttacaactgataacaccataacacttgtctaaacctacaaaaattatgtttatctaacagtaacaaaaagaaaaaaaaagataaccaagtgaagagaacattaatcacgaactgacctgagggttgagcaggttgctggatgtaacagaaccaacaatggatctgtttagaccatagatgttccggtgctcaaatgacacagttcctccaggttgaatggatgcctaaaataattgccatcagatacgtcatacgtgttggtagggatggattggaacggtgttgttaaaataaagattagagaagaataaaatgttggctccacagtaggtaaattaccagagttggtcggccttcacgtccaggtacgatgctccactctgtacttacttcagctgacttcggttctaattctttaagcttgatttcaaccacaatgcccccttcttttgtttcatcagggcgtggattcacctctatattggagaataaagcaagtgaatttatattcttcagagcttgcttccctgctccaatgttaaagatatggccaggtcgaagctgcaggatacagaggtacaagttactgaaaacactaatatatcacattcagaataagaaatatacttttttcttcaagacccacatatctgcaactaatcactaacagtggcaagaagtatgtagtaaacgtttaacttcaggctttttcatggcacaaaatcatcccacatgtcatgaaaggggtacatgctactgcttttctagaatcaacatggcgataaaattgtatagtggcactaaaagaattccgtgctacaaccagaatccaaagtaatcactatgtggcagggtattcaaattatcgcttataccttcctaaacacatgatctagttatatgaatcactaagaaaattcaaagatgggaacaaaattatattctcgtattaactatagcagctagcggtatttggtatacctgctgtgggagctccctgtctatgataggaatttgggtattcccctcaacaaaatttccaagcttatcctggaactggtactccactttggttatatccccctcgaccacctcgcaaacaacctcactggtgtttaggtttccaaagttcaccacctgggcgcagacgaacccctcattgtggtaccatttctggacatggtccctgatcctctgcaggagcctagcgctcaccttctcctgcttcttcatcattcctagcacctccccacgcacgttatctggcaatatgcacggcttggcaccacgaacacgctgctggtaatcacgctcctgcttccggaggtaatccatcttctccctctctgtcatgtcctggtcgaagtcaacctggcccgactgcgacattagccccacattgatgcacttgaactgcttagcagcgctccacacgctctcgacaaaagacacggtgaggccaagggtgccatcgggcttggccttcccctcgaggtcgaccctctcgaacatgccacaggacacgagcgtctcgagctccttcagaagctgcgacttggtgtacacgccgccgggctgcagcgtcaccatctcgaagaaggaatcctcgggccccgtgaacgcgcctccccctcccgcggcgcggtcgaagaacttgagctcggagatcttgtacctcttcagcccgctcagcttcgtcatcggcacgttgatgtttgccgggagcccgtgcgggtcccaatcccccgacgacttctcatccgcgtgcgccgcgccgccggagaagatccgcgaccagaacccgccgccgccgccaccaccaccaccacctcctcctcctccggcgccccatccaccgcctccaccgccgagaggacccccggcgccgcccccgaacccgccaccagatgacgcgagaaggaatgcaccagaggcggcggcagtgatggcggaggcgagggcgaaggttttcgagcccttagattcggatttggagctggacgacgcgacggcgaggggttgttgggggtggccgtggggctgcgagttgtgcgacgaggcggaggcggcggctgacacggaggtggagcggccccgcccccggactctccgggatgggccggcggccagcggggagaagaagaggctctgggaggtgagcgccattgcggccgccgcggatggtggcgaggcttcggtcttgccgccgggggaagcagaggaatttgggggaggaggaggaggcggatgggggggcttttctcgtctagccctgggtaagggttttcctcccaccccctatcttttccacgttccaccggcttcgcgtgttccggttcgagggtttagccgagtctttgcgtggcggctgaacgccttttttttctctttttttcacaacattttctgctttatattgccggacacaatctccaaatcaaacgtattttgtaagtttgtatggtcgccattacttgcaagaaatatatgcacgtctgtacgtgacaaaaagggagaactgcaactacatatcggtgggcgtttcagatgtgtatcctgccgccatcagaacatcagattcagatgtgagttaaatctgctggcttgatggccctctttctcttgaagcaactatgttgcgttctttgcttccggcaatagctataccagtatgttgttacaaaacaaatgtttggatctcctttctttacacgtgtgttacatactcatacgtaaggattaacagttactcgtacaggttaataacccttccaaaaagaagatggcaatgtggtggtaagtggtaactaggcagcacacgcatgcatggctagctaccagctctccacaggctgcagataatgctgcagcgactgaaccttcttcctgcccctgagcttccggaacgcgaccagctcgatctgccggatcctctccctgctcacccccatcagccgaccgatgtcgtgcagcgtccgcagccggccgtcgtccatcccgaacctgtacctgatcacctgcctctcccgcgggctcagcccgtccagcgccctgtccacgtcttccttcatcagccaccggtgcagcatctcctccgccgtctccgtgctcgtgtccggcgtgatctcctgcgatgtatgcggtgatcacttggattcagtaattggccatggatgaggtcgaggttttgtgatgtgttcatgttgctcgggcgaagggagcagactcacctggtatgtcatgtcagtgcacccgaccttgctggtgagggaaacggtgtattttgggaggctcatcgccgcctcgacgcgcctgagcggcatgccggtgtcggatgcgatctcttcgttggtgggtagcctcttcagctgccggcggagccgccgtcggcattccttcacccgggaacttgcttcggccatgtgtgcctacaagcagagcatcataattcataagaagcctttctggtgtaagatagcaacgcagcaaccgtcaaaaacagcggtagatggttcatgaggaaagacgcacgagtgaaaaatcattatgttataatcgttgcttggtttgtgttgttcggttgagcacttgttccatgatgcaaatgaaaatcaatgtgttaaatgaaatataacagtatcaactatccacttaactattgcatgtcagtgattgtagccattcccatcaatcaccgttcaccaatgtgcagacatcaaaaccaactacttgatctagtaatgatggatgaaaaagatggcactatgaaatgaccaaaagtacaatgcggaagtgaacataccggcaagcgaataatctgggtttgttctaaaacggatttgcgtattgcttgtttgatccaccagtgagagtatgtagagaatcgaaaaccctttgaagcatcaaacttttcagcgcctcgtacaaggccctgtattccttcctacaaaagttacagaaagaaatgtgagtcataagcataatcatagaagggctatacttaaccgtagaaaagggcaagcaaaatacctgaataagatcagaaaattccattccaggaccttcaaactctctagcaattgagattacaagtctcacgttagactttaccatcgtgttcttgcaggaaattccatagttcagacgttttcgcaaagtgttctcgtcagttccagctgcttctgcccactgtgagaaggttggttcaccgccgttgtagtgagcaagctccttttggatagcttccaacttcaggagatcctgtgtcaattcatggcaaccatccatagtaagcttaagttggtgaaaatggtgctaaacactaacactgtgtagtctgtactgacgatgatgccaagaacaacaagaataatattgggactagaaaaccagtgttcaagagatgatattggaacagaaaagcaacaattctctaaatttttcaccttaactgttaatagtctgttactgagccatattcagcttcttgttagcgagcaatattcaccttactgctagtgagcaatctaggatgggattttagatgctgtggaatttgctgcaataaacatatgctgctgcaacatttgtaccaaaacatgcatcctaaattttgcaagcataacaccacaaaaccaaaaaatgcaatctcacaaaatgcattcaatttgttagcctcacctgaatgccttgtgagaactcaacttcttgttttgctgtcagaagcctccggccggtcatcttgtagaagcagccgagaggactccggcaacccttcaacctcttcttcctcgccgacgacgacgccgcgacgggattccggccgctgaacgatttggccgccttcatcgccgccctcaccctccgagctctcctctcggactggcgcaccgatttcacagccacgccctggacgcactgctcatcgtcatctacctcggattcatcgctgaagatactggagaaccccgcatcctccgacagacaggcatcggcgtacctcgcccccaatcccgcctcggcgcggaggatctctctggccaagtagttgtcctccgtgtcgtgcgtcgtgacgaagtcaggccggtgccgttgctcggtttgcgacatccggacgacctctccggcgacctccgccgctgcccttgctagagcgacggcctccgccgctgcggccgccaccacggcttcttggttgagaatcgcctcaccgaaacctccctggtaattacgcagtccaaagtaagattgagggccatgaatcccagtgagccgcccgcaggattcgtttgaggaaacagggcatggtcgtggccagcattagcccggaacacagcgaaaggacgttaccggaagaggcggcggcgcgacggctccgtcgtagacgacgagacgcctcgccccgggggccaaggaatccgagctctcggcctctaccagcgcggtggtggacaccgcgcagtggagcctaacggtacggaacccgccgattccggcgccgccgtgctcccggaacgccgccgcgcgggtggaaaggggccacttgagctgcggcgcgaggcacgccatcggtggcgcgcgcgagagagcaggtaccttaggctcgaacgcgcgacgtgtatctacctagctgttgttgccgcgggcggtaacggtagaagtagaacgcgcggcggagccggagaaggggggcgcggtgaggcgtgcgtggctacgcgcggggaagaagcgggagagggcacggggagagaagcggataagagcggtggggacgggagcgtgcggaaagagaggtggctacctccgcacctgcgtcgtgggccggaccggtaattttggatttttatcgtgtcaaagaacgcggataggaaaaagtacacccaaggtccctcaacttgtcatcgagttacaaaattgtcccccaaccgtaaaaccatataccggacgtccctcaactaacaaaaccatttactttagatcctttgtcccccaaccgtaaaaccatataccggacgtccctcaactaacaaaaccatttactttagatcctttgttagttttgaccccggttttattcgacgtggcggctgagtcagcgtgggacccacgtgggccccacatgtcagcatggccacgtcaactcctctctctcccctcttctctcccttcctcatctctatcactcttcttctcctctacgacttgggcaggccgaccgacgggtcacggcgtcacgccacgcacgacggcgacgctggcgtcgcgcgagacgggcgggtgcgctacaaggagggaggggacgaggcgccaacgggggaggcgaagagcgcgggtggcggggggaggggcagtgcgcgggcggcggggggaggagcgactgccaacggcggaggagcggcaagccgggcggcggcagacgatgttggctaagcccaggaatactctcacactcacgaacacaaacgccggtgaggcagacgatgaacaatggattttacagcgacgaatgccgcggagccgatcgctcctgtatcttggctttattactcactgaaccttgcaaagaaacaacgaaggagtacaagggcctcttatagaccggggacacaccgggagctagcctccatgccggccattgcaccacgttccgcagaacccgctcaatgtcgccgtgagccgcacgctcgcccggacgacgcggcttcctccgcaagaaccgacgccacgcacaccacgcactcccacgactcgatcaacactgcaacggccatgcaaacaaccatgcagcagccatgcactcgcgatcacgactcaatcaaactaacagaacgcacacgacgcacacatgcagcagcacgacacacacacacactgactcaaccacgccaggaatacaccatgacgtgtttatttccaacaatctccccctaaacacgacatggcacacttcgttatcacagcagcgtcggctcctcatcgacgttacaaagcaacgcctgttccttcttcttccgcggacagttcctcgccatgtgaccgcgttctccgcagtcgaagcactttcctcggtagcggctcctaccgtgtcccgagcttgtgctgctgccatcgtcgtcgtcgtcgtggctgccgcccttctcaccaatgccgccgtgcacatgctccttgccacggcgttgacgccgcctcgcctcccattgctcctccgtgagcaggagttgcccagcatgctccgcgctagacgccgcttgatcctcagcgtccgcgtcctccgccacctgcaaccggccgacgagctcctcgatcttcatggtgtcgatatcggcgagcatctcaatcgccaccgcgacttgcttcagtctcttggggaccacgcgcagaactttcttcacgacgcggctgtcctccatctcctcaccaagctcgcgcaggctggcgacgagaccgttgatgcgcatcgcgaagtcgccgacgttctctccgtcacggaacgtcatgttctcaacctgcttcatgagacgttggacactcgcagccttcatgcggtcgtcgccggcgtgcatcttcttcaccgcatcccacgcctccttcgccgacttcttcacggcgagcccggccttcatctcccttggaacggcacagatgatcatggccagcgcgcgccgatccttgccccggtccttgctcactgcctccactgcgtcccactgctccaacgcctccatgctcacttgcatcaccaaagaccattcgtggtagttggtccttgtcaacagcgggagctccacggcgctggagttggccatgacgcgctcggcggcacccgagctcgatccttctccgatcttcagtgacgagctatctccgatcttcgtcatccggctctgataccaattgttggctcagcccaggaacactctcacactcacgaacacaaacgccggtgagggagacgatgaacaatggattttacagcgacgaacgccgcggagccgatcgctcctgtatcttggctttattactcactgaaccttgcaaagaaacaacgaaggagtacgggggcctcttatagaccggggacacaccgggagctagcctccatgccggccattgtaccacattccgcagaacccgctcaatgtcgccgtgagccgcacgctcgcccggacgacgcggcttcctccgcaagaaccgacgccacgcacaccacgcactcccgcgactcgatcaacactgcaacagccatgcaaacaaccatgcagcagccctgcactcgcgatcacgactcaatcaaactaacagaacgcacacgacgcacacatgcagcaacgcgacacacacacactgactcaaccacgccagaaacacaccatgacgtgtttatttccaacagacgacgccgagtcagggttcgtcgactcgcgcctccgccgccgtggccgtggacgacgtcgatgtcgacctcggcatcctcggcggtggaatgaactacatcagctagctcaccagctggcgtccggcatccacggccgcgacggcacagccgcccacacgtgccgagggcgacgtcgtccgcagccacggcgacggcagcccgggtcgatgaaccccgactcgtcgtcgtccgcgttgttgtaccgacgctggactacgagcagagaaccgcgctgcggtggagtagcctgtaccggcgcatcgtggtggggcacggtggccggccagtgaggcgcacactgaggacctgggatgaggacgagcgttgcctcggcaagtaggagctcgcccgccgccgctcaatctgacaatggataatcagagaaacaatcaacaattaggactgatatgtagacatgaattgaaattgccaacttgtagtgattcctggtacgttacaagcaaagcatgtgcaggatggccggagtggcaggagacgctgcagctggcgccggggatgccatcgctgc

SEQ ID NO: 59960 - DNA, 665 bp, Oryza sativa
accacataaaaatcttaatcttaagtggcatcttaagcttccaaataatcttggttatctcaatatatccattattaattaaagctagatacatcgacctaacagaaaatattccattctgatgataattccatctaaagctatcagaggattgattcaattgaatatgtccaatagaagcacacaattcataccaatatgcaagattctgaccaactaatgatctcctaaaggaaacattgagtggaacacatctcataacattagtaatagtagaacttttccttcggacaatatagtataaagatggatatttgtctttaaagccaagattcctagccatttatcttcccagaaccttatttgtttcctattatttacaatccaagaactcatatctaagaaggtatctttgatcttcatgagacctgaccaaaaatgagaatcatcccgttttttattaactcgggttatattataaactgattgtaaagatactttcataaaaccggatcaccgacctgatcctatgtttccctatggtggctcacaccaacgatacctaaaaatgccaaaaatctgacactgaaacggacggccgagatgacacgtggaccgcccaactgagcatccacgcaaggccatgaccccataaatgacctccc

SEQ ID NO: 59961 - DNA, 3838 bp, Oryza sativa
cttctatcgaatagagaagcactcaagcttgttatttgatctgcctcactttttttcttgggctttttgacggacctcgtaaccaagaactccacgttcggccacaagagttgtgcagttgctgagggtgtccactgccaatttgctgtttaatactgtttttcacgaatatggtttacctacatacaaattcggggcacggatcggtcagattccaaattgtcacagataggctaatggatagcatatggcatatgcataaagtaaaaaaaaaaaagaagaaaaaagatgcaacttagatgcttggatcacccttcacacaatgtgctcgacaaccatttatcactgttaatggcataaaacaggatgcgactatgggttgaatatctgatggattaatcccattagacactcaacatgctacatttgtgaatgtcatttttttacggaaatttgagcggcctgttgcaacaagaaaaacaaagagtttcaattgcaatgatgacaacaaaacgttcttgacagaaacgaaccaacatctttctgtttggtcaactgatgaccaaaaagaaacatgagatggctaataaatacatttatgacgaatacaacactacacaaacaaaagttaaattcaatccacgcaccagaaaatagaaaaacaaaccagacttaacaaggtgcaaaagcatttgcatttggatttgttattactcttccatccaaaaaaacaaatttgacctacatgtctgtggagtgacacgcgatacaattatctatgccactaattttttagaacttctataattatcttggccacataaaagatgtcagataacacttccatcatacaacttctatttactagcttcaatacccaagtaaaagagtttcaaaagtaacagacttgtatgatcaatacatgtttccagcaaaaagaaagaaaaatacagatattgtcctcgatgcaacacaggacacagacatcttgactgcaagagaaaatcaaccttttgttgggccacaaataccccggtaagcaaaacaatggaagataatttgcaacaaaaaatatactagttattactgagaaaaactgatgcaatcatatggagaaaaataaaaaattctgcgacgggactaggtgcctcgacagcagcgaagcttgggaatgccctaacctgacaaggccgggacccgcctcgtcggcggcgaagacgtctccgtccctcagccgggctcgatggacgggtggagcactggattcggagatttggaagagagagaggaagaaccaagggtgagtagataacaagtgaatggatcggactcttcagctacagaaaggtgaactagtgaatagtgggctttgattctgcaggggaggtggtccgtggtccgtgggccgtgggccgtgcacgcggaaaggagggcccaccaccgtgccgtgcttatccaccaaaaaatcggttcaccccgtgtgcgtgcgcgttcctctcaccacggcgaacttccagcctctcccgccgcggcttccgcgccgtccgctcggcagtggcgccgccgcctcgccgcgcaatggcccccgccgtgctcctccgcctcgccccctcgcctccgtatccccagaacccgccgccccggcggcggagccccgcctcggcatgcggcgcctcgcgccgcgacttcgccatccacaccgccatcgcctccgcctccgccgcggttgcggtctccgttcgtccggcaccgccgccgccgccgacgaggaggcgccaccgggggagccttcccaaaataagaagggctcccctctgctgggcggcatcgcgaacaccaagtcgtggtcgcagtactacggcagcggcttctccatccgcgttcccccttccttcgacgacatcttggagcccgaggtctctcgtctcctcccaatgtccccttgcgcgttcggtttcctcaggcattgtagtcgcgcgaggccgcgagctcaacattttggttttaacctcggaattttatcgacaaatcaggagttcaacgtcgggatgacctactacggcgacaaggcgaagcccaggacatacgctgctcgcttcgcgtctccggacaggtaggtaagtaaggtcccgtttgacttatcgagctctctagcatttcgagatatgcgtaatgattataaattttacaatactattaatctcaaattcgcctacgaaaatagctctaggaagaaattgggtagaatttgtatcactaaatacattcagcgagctaagatgattaccctgttatttttctgtaatgcaggtctgaacttgtaagcgtggtaattaagccatcgaatcagctcaaaatcacattcctagaggtttgcacagcaactagttatttttctgttactatagtttgattgttttgtgttctccctcccgaatttttctgtatgtgcagcatttattttgtctaaaagaaaaataatggtagagcaccggttcgttttttttttagttggtcgtgatgcaagataatgtgatgatttgtataatctgatgttctcaactctttggaatgaccaacgacccatttcctaatcattaaagcggcttagctttgcacactagttagtagttactataaattgatttacaatattgtgcagttgtctcactgtgttatgcaaggtagtatgattgatggcactttattttattttatttttttgataaagagaggcaggatcctcctgttttcattaacgaaaacgaaatgatgacaagtttgatggtgctttatatgttgataatttaccatcctttgataaacacccctaaacaataataagaattatatagaaataaatatagtattgataacacatgtcaagtcccaattaattatatttataatgaacaatagtagcattgattcacagagaggcgacaaacattactttttttgctccaactgactagtagaaactggtactgcactagtaggtgcaggagtgttcataatgtttctttatatcaacaattctctgtaatcaaggcccaaagacatgttttttattttgaattattttatgttgcacccaatcagccaaaaaatttatgttctgacacaaacattggtttgtaggccaaagatataacagacctgggcactttaaaggaggcatcaaagatatttgtacctggtgattactgttatcttagacttcagagatgtactttgcttttaaaataagtttctaagatgaataaggacacggcatattcacagttttcacttatcaaaggaaattgctaactcttgatctagcttcttgtgtgggcgctgctgtatatatgatgtttcacctgaatgacctaacatctaaaacatcatgtttacaaattgaaggggcatcttatcttaacaatgttcttatgatgttggttaattttgcatcatttttaaaataaatgtccagcaaggaagtgcactattaactgctttcttaatgagttgcacaatgtactcacatgcttactacattctattttgaactgtttctttcacattgtacaactttgtcgttatctactgttgtcttcgtaaaactttgtatgatcaatattgatgcttggttaaaatattcaaagaaatataaacttgtatccattttttgtttccatcacttcaaaaaattatatgaggaaacatgaagcaaaaatattctgttagcatgtagtgctagcataatgtactcatttggaaatatctgacttagctcttccaatttgtttgtaaattcttttgtctcatttcataggtggcgcaaaattatactcag

SEQ ID NO: 59962 - DNA, 2081 bp, Oryza sativa
aaatgtgtgcacgtatacttaacaaaatttggctgtggaactagacactgccactgcgaaaattctgacaggacattgaaccaaaccgacccacccatggctttgtgtgtctgaacaggtttggaaccgaggaaaattagagaagagtggttccaatcaacccctacctttccctttttcctgaaccccgtttttatcttatccccactcatcaatctctctcctccacacgtgtaccgaatcgacagatcatgcgatgagctccagctcaagcgggcacggcagcggctgcaagctcgattttgaatcgaattcccgtatcgaaatcatcttgtttcgatctactagtaactcttttggcatgcatcgggcaagaaagacactgtagcaaccaagattggtactagctcctgccatagatggaggaggaaaccaaagaagacgcaaatgcatccatgggagggcatacgagcgtgattgcggagcttaccttcggttggatcggttcttggtgccgcctgagcctgagctgcagcgatccgccatgagcacacaagcaccagccacaatagctgccagcaactgcaacgccgcatctctctgactctctctctctctctctctctctctctctctcccctctgtcagctcgcgttcgtccaaaacaacaccgattgagagagcgagggagttgttaaatagctgtcctttgtacttggaacagagaatggctcaccagctgacacgagaacatggaaataggcgtacttcttcgttagtttgactttaagttgccaaactttgaccgacaatctgtactgggaaatctaattatttactatctacgtctcggaataattatatttcttgaagattagctgcacgtttactgcatgcatacaatccatacgtaaacttgattaaaataaagattatgagatggggatggaaagatgagaaactagaagagctgtgttcggcagcaagttttcccaactctctgaattgttccgctttcaaactgctaaatggtatattttttaaaaatgtttctatacaaaaattgattaaaacaatcatatgatccactttttttaaaaaaaagttattacttaattaatcacgtgctaatggactgctccgttttccgtgttatcctggttcccaaccggtcctaacaaactcagcctatatcttatctaattaatttgttactccctccgtcctaaaatataacaacttttagctctcgatatttgtcccaaaatataacaacttatcgaccaatattctctttccaaccaatcacaatccttcaccattcatttttcccacctatctccactactcaaccaatcacaaccctccatcattcacttctacctattttcttaattaccacatccaactttaaaaatgcttatattctaggacggatggaggtagtacttcactagaatataatttttctggcataaaatttgaatgccataaatataattatgttgggggaggtagtaccataatagttagtatataccatcattagatttttaaacgaatctactttattattacatttgcctcatgatatataagagttttttaggttgacacggttattaaaaatgtactttctccatcccaaaatataagtatttttagcatagtgccaagtcaaccatttttaactttgactattaatagcaataaaataaaaagatcaatcatgtaaaattgatgttactagatttatcattaatcaaactattataatatgcaactctttttatttaaaacattttatttttatagatatttttggtcaaagtagcatctcgaagactgtgacgaggtccaaaaatacttatattttgggatggagggagtaggagttatcttcatcctcacaatatagcagcttagcatacgatgggacatatgctagtattaggattcatcccatccaaactatagttttgattattggagtacattttaatggggaatgttgtgattggttaagcaatggaggtaattggacaaattgaatgatgggctattgtgattggctaggaata

SEQ ID NO: 59963 - DNA, 4336 bp, Oryza sativa
aattcaacactgctataccgatttggatccaaaatccactcgatatatccaaagaaagctgagctgtaacctgcaagtcaaggtcgagacgttacgtcgagggacgccgatttctgcagcgagaattgagcatatatcaaatgggatgacgggatcggggtggaggatgtaggttgcatgcaatgcactcaggcccgagagggacccatccccgattgcggccacccgggcgttccacggccgttgctttcgccgatcgcaacgctccaactatcaagtttggacatgtgtgtgactgacaccaacacgaaagctatagcatctgcccattatcacaccaaccctagacagtgtagcccacaccgatgatcgatcgaccgatcgattgggtagccgcagccgcagctggctgctgggaaaatgaccgcacaaacagaactcgatttgtatggttcgttttaatcggtgtgcatttgtttactaacaaaagctccaagtttttaatagaaaaagaccaaaacttctcgttcgtgggagtgaaatttcagttgaaaacggaagggtgaagggggagagtagaatgatcgatcggtacgtgccggagtgtccaatcgatcaattataactttcgtgactggtcttttttaaaaacctgtaacgacaagaacatgtggctggcaaaacctagctattatagcacggaggcaaacatatgcatcggtatggcagcgcctctgtgccgctgtgtgtgaccccagcatcgatcagcaggcaggcagcagtctctatctcgctcattatctttggccttatcctccctatcggaaaaaagagctctgttcgaactgttcgttatttaatatagcatggaaaataaaggaaaaaagatagtgaacgaacgtttgaaccagggtacagctacgtacgcacgtataatctacttgactttggacaaaggaaaagaaagaaaaaggcttgacagatctcttccccgtgtgtacgtttatacgcgtgactaactccagcatccggaccggatgatcgatgcatgcattgatgagaagattagagcagcagccccaccctaccgtggtctgtggatacacagcgctgacgacgagggagaggagacgacgaacagtccaaaggcgcacgtgttccagcagcgccgtgaaaatggtgcaatgcatgcgcgaacggtctcatatgcagtctcgaccgatcgatctcatctcactactcggcatcgacggcatgcatgcgtgctagctactccctccgtcccacggtacaaggaattttgagtttttttttaactttggaccactcgtcttatttaatttttttaaatataaaaaacgaaaggttatacttaaaatactgtagataataaagtaagtcacaaataaaataaataataattttaaaaaaatttgaataagacgagtggtcaaacgttacaagcaaaaattcaaaatccacggaggagtagctagctaccagctgccctcgtctagcacctgtttgcacgacattttttcaaagcccacctgaccccgatcagagaggccacgccccgcgcgcgcccaccttccgcgcaccttcaccctcgcctctctctcaagtctcaacgtaggcagctacacgtggatcgcttggccactgatcagtgcaacgacggcgtacgtgtaacgtactaacgtgtacccgcgcgatggcgaggaggacgtttgcctcgcgattgggattgggccgattgggaacaagacgaacgcgcggtgtgtgcgtgcgactgcgactggttcgcggcttcgcgcggtgagtggatctgtggaaggggaagtctagagggaagctaagcataaatagccgcgaatagcaacgcccatcggtccgttctctaccataccagtagcagctaattaagtgggtgggttcgcttgcttgctttgcttttgcttggagacgggagcgacgctggcttcagcgattggcgtggagaagctagattgttggtgcgactttccgaccgcgaaaatagtagggctggcaaaccggtggccggccggcgatccggccgaggggatggggagcatcgacggccactcgctgcagcagcatcaggggtactcccacggcggcggcgcgggagggagcaacgaggaggaggaggcgtcgccgccgcccggcggtggctcggctacggggtcggcgggccgccggccgagggggaggccgccgggctccaagaacaagccgaagccgcccgtcgtggtgacgcgggagagccccaacgcgatgcgttcccacgtgctggagatcgccagcggcgccgacatcgtcgaggccatcgcgggcttctcccgccgcaggcagcgcggcgtctccgtgctcagcgggagcggcgccgtcaccaacgtcacgctccggcagcccgcggggactggggccgccgccgtcgcgctgcgggggaggttcgagatattgtccatgtctggcgccttcctcccggcgccggcgccgccaggggccacggggctcgccgtgtacctcgccggcgggcaggggcaggtggtgggtgggagcgtcatgggggagctgatcgcgtcgggccccgtcatggtgatcgcggccacgttcggcaacgccacgtacgagaggctgccgctggaccaggaaggcgaggagggcgccgtgctgtccgggtcggagggcgccgccgcgcagatggagcagcagagcagcggaggcgccgtcgtgcccccgccgatgtacgccgccgtccagcagacgccgccgcacgacatgttcgggcagtgggggcatgcagcggtggctcggccgccgccgacatcgttctagcactggcaccggttaatcaatgtctctctacctagctagttagccttccacttctttccctagttgtttgagtaggttaattaatcatttaccatgttaattaatgtgctatgtaatgcataagtactcgtgtgatcttatcgttccattttcttcagagtttgaagaatgtaaaattactgtgcgtatcaagatcggcagtggttgctcacttgctccttcactagctatctgctcgatcataagctcttgcatcttgttcttcgcaagcaccaattcacgcttgtgtcaattgcttggtcattttgcatactttggactactcgatcactacaaaatatttcttgagttttactccctgcatgcactgctcaatgcgtgattatgcctgaatacactaattgttttgttagaattgtgcatacatagctatgcttaattggatgtgttctttgtacatgcatgcatggttttgcttaaactttcctaattatacctcaattcaaatcctagctaggttcacccagagtctaattgtatatttcagcatattctaatgttttgttcttttaaaattctagcttgctcggtatgtttatttatgtttcggtttggtagaaaaagttcagttgattttggcaaatcaattattccctccgttgctatattttgggatggatggagtaatttaatttctagtttagtaagcttcgtcttgattattctctctctctcttgtcgcacaaacactcgcacatacagatgaattctttggttttgacttcttaatgccgcactacaacgaaactcatgcatgattgtctaatccgggcatgcgaatggctatcgattgcactacggtagagagtaacaacctgacagattttcatgttaagtgcgttacgttgtccagattcaattcatgcgtcacacacctaaatgcaaacccaagcatgctaaccttactatggaatttatgagtagacaagtgcagtacaactcaatttgccatttgtgatagtagtgtgtgtatatttggtagtgcatgcatgtcttagcatgacactaaaaagggagtgacaattccatggtcagcaatattccggctgctgggaatcaaagttaatttgcattcctgtctgccctccaaattaaaacactttcatgcataattccattctatcaagaataacccacactaacacagactaatgctcacccatcttttcattgtcttcttttgtcccaaattagttcggttgggcaggaaaaaaaatgctctcgtcacagaacaaacactgcaaagttagctgtgacttgtcagtgccgatttgaagaagcatggagccatggcgagacggcgacacggtgacactgtgcctgggccctacgggacactgccgggtgagatgatactccctccgtttcaaaatgtttgacaccgttgactttttagcatatgttgaccattcgt

SEQ ID NO: 59964 - DNA, 4011 bp, Oryza sativa
actctctccgtccgaaaatataacaacttttagcactttgtgtttatcccaaaatataacaacttctccaccaacattcccttcctaaccaatcacaatcctactttcacttttcccaactactttcacttctcaaccaatcataacccatttctatttaattctacctactttcttaataaccgtgtccaactctaaaaaaacttcatgtattctgggacggagggagtaaagtctttacgccgttaaaaagaagtaactaaaaaataacctcgctaatataaattagggagaaaagcattgttgttttatcatattcctgtttgttttactccttgtttatccttagctgcggacctcatctatggataggtaacatggataggtaatgttttacatagatcgccgtacgtgtcagagtgtatagatggccatgtgggccgcccggcacggcacggcccaggcccggccgtgcctgggccgaggcttgtcgggccggcacggcccgaccaacgcaccgggccgtgccgtgccagcccacgtgccgcactcacagcccaggcacggcccaacacgcctcgggccgtgccgggccggcccgaaggcacgatgggccatcgtgcttttcctcagaataagtctaaattttctccctcctattgggctgtgaattgtatagctaaaaaaagtctattttacctccctcttctttgtgctgtggtatataaatagctaaaataagtctatttaaggtccctattctttagacattgacatttatatgtctatttttagtccctatactttgtgtaccaggtctggcctgctagcccatcgtgccgggccgacccgaccgtgccgtgccagcccagcgtgctggtggggaggcccaggcacggcccgacggtcgggccgggccggcatgggcccgacccaagtcgggccgtgccgtgcttgggccgggccaaaaaggcgtgccgtgggccgggccttcgggcctcgggccttatggccaactatatcagagtgtgattggcgatgtgtcttttttttttctttcaacatgcatacccttccatgaaatgctaaaagtattttgtaattggctaactaaatccattaaaaaccgatttggtttggaactggtgcctggaatcagtagctagctagggtatctttttccctttaaatgacttaattcctatataatatcgttagagataatatgtgtttttctattcggtattttaattagatatcatcatgagggagattaatgttttatctcataacctcgagttttttttatattttctttgctaaatgactgtgtgcttggcaaagaccgatgatgtaaatcatttctattattaaaagaatatttactgtatcgattcagagagacaggtactcccttcatctacaaaattacatttttgacaccaagaccaagaaaaaattaaataaccttggatgttataaaattaagaagtgaatgcaagcatgtaaccaatgagtatttagatgactccttggttctaataaaatatttaatttatctcttcatttaagtcttgaatatataaagactataaataggaacaacttatttggaaaaactcaaatgtgaaataggtataacttttgtggatggaggtagtatattatatttgtcttttcagaaaccagagaaaaacaagactagtgcatgcataattttcgttatttacaataatgtaccttgagtagaaattatgtactatcttcatttaaagcctttaataatggacggagggtagatatcactggtggagaaaccatctttggttggtcgaccaaaatacacaatagtcccggtttcactaaaaaccgggactaaagatgatcttagtcccggttggtagctacagtgggcatatttgatctttagtcccggttggtaataccaaccgggatctttaatcctggttcgtatgttgtcaggggttgttaggccctcttgtgatctttagtcccggttgttaacaccaaccgggactaaaaatcctaactttagtcccggttgttaaacaaccggtaaaacaaaacctctatccaggcgcgcatgcaaagtctcctattaattccatccttatctcctcctctcccatctagccatctccatcttatcttcttctctcctctcctcctatccttctcttccttcttctctcaccccatctcctcctcccctctctcctccccctcctcccctcccttcccctccggcggggcggcgggatggaggccggccgcggcggccccgggcggggctacgggatggaggccgccgccggcagcccggcgcggggcggcgagatggaggcggcggcgggctgcgtcgggggtggcggcggccggttgcgtcgggcgggaggcggcggccggctgcgtcgggcgcggggcggcgagatggggcggctggcaccggttgagagggcggcggccggcgccgggcgggaggcggtggccggctgcgtcgggggcggccgacgccggtcaggaggcagcggcaggagaacttttttttctcttctctgtgctatctgatgaatgctaatgatgttgtagatgtgaactttctttttcctttctttgttctctgtgatgaatgctctctgtgatgagatgttgtagatctgaacaagtgtaaacaatatggatgatttgttgtttgattttattcattcaatctatgatttaggttttgttgttgattttattcattcgatccacgagcgaaagctaaacaacaataaaaaaggaaaaaggccaaccggatgaaaggaaaagaaaaaaaaaccaaaactttttagtccaaaatcgatctttagctccgattatttgaaccgggattaaagatttgcgatctttagtcccggattcgtagtcccggttagaaaacaaaggttacaaaccgggacaacaaagcatttctacactagtgtatatagctgaaaaacgacgttccaacatgcgataacattacaatgctgaaaatgggcacgttaacgtactttatcttcgcttctggaaagatagttaaagtcttaaaagacaaattaagcagtaggctaaaagacttgcattaatgcgaagagaaaataagtatattagaaaacgagagagatgaggacgtatggctaaaacgagaagaaaacaataaacgagtattacggaggctgtagattgctacttacccgtacggagcatgaggtgtgcaaaaggtgtcaattttttatgtgtgcgcgcaaatgcgcagccgcttacatggatcacgcacgtttcacatgtgtttttccagcactagcggctagccgcctacacgcgcaaagcagatcaaaaggttaggaagtccatcgattcagagtggtggagactagagaaagacaactcttctttcttcacatgcgcccatgttccctacttacggaagtactacctccatattttaattccatattatattttaatgtatgacgccattgatttttgtccaacgtttgactattcgtcttatttaaaaaatttatataattattatttattttattgtgacttgatttatcatcaaatgttctttaagcatgatataaatattttcatatttgcataaaatttttgaataaaacgaatggtccaatgttggtcgaaaggtcaacggtgtcatacattaaaatacggattaaaatacggagggagaggaaaagtacatgattagtactactgatccctcggttgaaagtgtatactactataatatctttgtgatttttatacgaaaggagattaaagccatgcatggaccaaaatgagaaagatcattggagataaatttaaaaataaatttattttattattaaagaaccactactacacataaggttttcccgtgcggtcgaacggattttcgcgtgcggagattcggcccgtctggagcagttcgtctgcgaaaatcgctatttatgcgtg

SEQ ID NO: 59965 - DNA, 8844 bp, Oryza sativa
gccgttgccatcgccgtggccagatccgccaccttcccgtcgtcgtcgccgtcgtcttcccatagtcgtcgttgccttcccgtcgccgtcaccacctttccgtcgtcgtcgccgtcgtcggaggcccgccgccgccgtcacgccgccggatccgtgcggggggtggccgccaccgccgtcgcgccgccggatccacgcagggggttgcctccgccgccggatccgcgctgggggcggccgctgccgccggatccccgcggggacggccgccgccgccggatccccgcgggcggcggctaccgtcacctactcccgccacgcgccgtcgccgcgggcagtcgccgtcgccgtcgacgttgccttcaccacgggcagctgccgtcgccgtcgctgcgggccgccgccctcgcctacatccgccgcgggaggagaggagagaggagagaggagtgaggagaggataggaggggcgctgaggagagataggagagagagcactgagagaataaaggagaggggtgggaccgaggcgtggaaaaaggaaatttttgaagtgggtacgaggaaaaggaggaatgattactttttgtgtgcggttgtctaaataggcccgcacggaaaaataggtttatttttctgtgtggttcatttagaaggaccgcacgggaaaatcgattttcccgtgcgggcgacggcccgacacccggtcccctatttttctgtgcggttccacttacgaaccgcatggaaataaaaggggaccgtgtccagaaaaatatcctctagtagtgaacttttcaagtagaagttctttttttctaaaaaggttatgttcaatgttttagaaatcttgatcatggtaaatgagaaactagcgctctctattaagctgaaaaaaacattgctgatacagaatggagataaagaaaattaaacgagagatgggcgagtagaagccgagggatatatagctatttcctccttttaaatgacgtaacttagtattgaattagacacacatattactatgaatacagagagactcatatccatattcgtataactagtttgtatctaatttaatattaggttgatatattttggaatgcaaagagaagtatttgaactgaggaactacgccacatcaattcagaatcagatggtgatctacgttgtaattgtttacacccaaatttagcacctaggattaaaataggaaatattgccaaaatttggaagtctaccggtttcctccgagtgggccggtctgaccgccgtgtgtggccggtctgaccggcaggtccgagtccgactctgtttcgtcgggtttcgaggtttccttgctcgggaaggcatgtttcgggtttcctttggtttctaccccgagttggacgtggaggagggcctgtagagggcaagaccaacccttatataagggacatggccggttcattgtaaaaaaccaatctacaatcaatcgaatcgttttttcatattgcttttagttttctcttagtttgtccatctttgtcggtttgcgccgtaaaccgtccgccgccgctgcgagagtgcgacatctctttgtaggtttgtcctgaaaaccttccgttttgcccacgagacgggtagctatctagaaatcagctccgctagccggtttaattatcaaaacccatctaggtttagctctttgctagatcgaggcggttggcgactctaggatcaccgcaaggcttaaggtgctgcgatcgtgcttgtcaacttgtcaaaaaagttgccaacacgatttttggcgactccgctggggaggagatccgttcatcgtcaactcaactttgacttcgccatgacgaagctgccatccaagacggaggtggagccatctaatgtgatgccggtcacattggatgacttcgaaggagaagatcgtaaagctatggaggagtacatcaacgagctcacacgggaggcgttgatgagagcaactactaggactcgtcaaggcgtgatcatcaagcccgggccacgtcccaaactcgctcccgacgtggtaagtaatgacaaggtatcacaatctatccaacaacaaattgcatctacaatagattcatctatggctaattttaaagatagattagatgtaatgtttaaggataaagttgatgggtttttaaggagtaggctcggttcttttatggatgattacacattaaaggataaagcctataccactgttgatcagcctcctatagatccaatgggtggtaaaaccgacggaacggcattcacggtcggtctgaccgggcctcacagccggtcagaccgcgacatagccgtcgatccgactggccagacggccggtcagaccgggcattaccccagcggttagaccggctctcaggccggtcctaccgcgcatcatgacgccggtcagaccgggccctaggccggtcagaccggcgcgattgtcccgattcaggctatagatccaatgactaatgctagttatttgtatcattttaaaacatttgatcctcctgtatctactgccaccactaatcctcaagttcccccacatattcctaatgcttataatgatgtttctaggggatatcctcccgatactaggcaaggccaatataatcatattgcgccacaaacgcaacctattaggccaccaaacccaccaccaaatccacaagggcctaatagcatggaggatatgattagtgatattatgaggaatagattcggaattgaaactaggaatcgtgctagagcttacaaaaagccatatcctgattattatgataatgtgacgtttccttgaaattatagagttcccgaatttgccaagtttagtggtgaggatggtaagaccacatgggagcatttaggtcaatttttggcgcaatgtggtgaggctaatagtgatacttttaaattgcgcttgttttctttatctttatccggtaatgcttttacatggtctacttctttaccggcaaattctattcatacttgggctcaattagaagaacaatttcatgattattcaatttcatgattatttctatactggggaaactgagcttaggttatgtgatttgacatcggttaagcaaaagtataatgaatctgtcattgattatattaagagatttagagatgttagaaaccgatgttatactttgaatataactgatagagatttggccggtcttgcttttaatggtttagttgctcctcttggagaaaaactagatggccaacaatttcttgatgttagtcaactcatgcaaagggctctggctcaagaaagccgggttaagaataataaaaaatttgctagaccatttgacaaaaagcctaatgttaatgtagttgattaccctgaggctagtgatagtaaggaggagggtgatcatgatatttatgttgccgaatggtcgtggactaataaaaataaaccttttgtttgttctaacctgatgccgactcctcgcaaagatcggcaaagtgaggttaaatatagttttgatgtggccaagtgtgataagatttttgattatcttttgcaagagaaacaaattagattacctaaaggccatgtcataccttctcaagaagagttgaaacgtcgagcatattgtaagtggcatgattctcattctcactctactaatgattgcaatgtgtttcgacgacaggttcaatcggccatagatgaaggtcgattgaagttcaccgatggctctaagatgaagcttgatcatgatccttttccggtgaatacaattaatttcaatgataagaaggtgttgattcggccagagcaagccaaatctactaagggaaaggaagttgtcattggtgaaccaagatccaagatgatggtgccaaagaagccagaggttggcctttggaaggagaataggagtggagcttcaacttctaaggcccctaggaagaccaaggtgacctttgatatgcttttggagaagtatgagaagtaaggtggtgagaaggttcgcaacaaagggaaaagaccaagatcacctcctagggagcgatttggtcattcaccaagacggtcgcattcgccttcatatcattatccacaagacatgtcatggggttcctatccaatgccgctgccgggttatccttatccttgcttcatgccatggggggcagcgccgccaatgtaccatcatatgcctccaatgtaattcaaccaggggtggggaggaccacagaggccaattcatgagcatttgtcttcaccaaataatagccgattttgtaagaatcgggctaatgaagaaaagagggaaggaaagcgcgtcaaggtggaggaaaggacttcggaagtgattactatcaaagtggggtcccatgatgtgcctataccttctggagatggagttggagagtccccaaacaaaaaatccgaagccggtgccagctcttcgcagtcggccggtgtcacgccctaaaaatcgcctaaattaataatgcatattttaatcatttttagaaattattttaaaagcctacaagttaaactctaataatctaggaaaattttcaacataaaattgagctagataaaattttattaaatactttgcttgttcctctattttctagatttttctgggaattatttgatccagggaagtatttttaataaatgaaacaacatttcacaaattattttaattaaaaaagtttcaaaaaccctcccctaagccgttgggccgaattcggcccaacattctctctccccgcgcgcgccaaagccggcgcacgccacgccatcctgccgccgtcccccctctctcttgcgggacaccgacatgtggggcccacatgtcggatccatccccaacctccagccggccagccggccaagccgagcccgagccgcccctttgcgccgccaaattcgtcgcacccggtcaccctcgagttcgattagttgaggggaaatactctcctccttatcctcttcctttccctaaagtctccgagaccaatttctcccggataaaccaaatcgagtccgtttaagtttatctctccaaaccaactcgaagatttttccagcttcgattcctctcggttggagtccgatctcttcaatccaagcctataaatagcatccccttggcgtcctctttcgtttgccccaactcctgagccctctcgtccctcgtagcgccgccgccgcgccgctatagtcgccgccgccgccggccgtcgtgcagccgcgtcgcgccgcttgccgccgccgccgttaggtgtgcacggcggagtgctagctcagcagccccctccccgccatcgccggacgccgtagcaccaccgccgccgtcgaccgagccgccgccgccgcgccatcccgccgccgatcacaatccgtcgtcgtcttttgttttggtgagcaccgttaagttcgtatcgttgccctctatgcgtaggtgccctctaatcgtccggccaaagaccctagcgccggcgaggtcgtcgcccgtgccgtggctgccgtcgatgacgtcatcatgacgtcataatccctctttttcagtttttttaatagatgaaatagattaaaacttcggaaaatcataactaattaaccgtagctccgattctagtggttcaagttgctaaatttttctaaaattgagatctacatgttaaaaatatccacatgtactgtttatgcttgtttttgtactgttttgttgatttagtctttttgctttagtttccgacgttccggaggagagcatttcagttgaggaaggttcagaggtttttgtggaagcccaaggcaagtcacacagatcccaaacaaccctttgagcatgttgaacccgtttaaagctattgttttatttcaacttatgcattattttcgaatgtcatcgggtggtgaaccttttttcgaataattaatggccgaagatgacttaattttcctatgggttataatttgattagcatgaaccttatatattggattggttcagctaaatgtcatatgtatgtttgcttagccatgcttagaaatattagctaactaaaggggattaaagatatattatattatattattattattaattgtggttatatttaatggtagctcacgatggttaatcgtgtgatgttaattaattgataattaaaacctggttaaggtgggttgtgagcatatggttttgatggttgtgctcatgacaattaaggaccggttcgcgagctactgttgtgaaacatttaccgtgccaaccacaagccagcatgggaaacgactttatcttttgtatagcatgattcattatagtgtgccagactgtgaagcggcgagaagtccgtgggggtcgctggggagtccattgcctctggttttgaggtggagattatgatccaggaacggtgcactatggtgagttgtgttgtgcgaggggtattgtcacagttcctttccaaggtatcgtggtggtactgaggcgcatggtgacatgttgtgggattgtgtcttgtgggtatagtggtacacctctgatcagagtaaaactattcgaatagccgtgcccgcggttatgggtgagttgagcaatgtttttcgtgattagtctcacactattcattaatggtaattgtgataattaatttgattcctggtttggaatggtatattcctggtatggaggtttgatttgtacaaccgggggttggttgtttagatgaggttgggcctatgcaacacgggagtgttgtatgttgtttatttaatattgattaattattcaactgttttactattctcttaaatatttatcaaatgctgtttacgcaaatgagatacattatgccatcctttgttatcctatgcacttgcatatttgctatgtggcttgttgagtatgtcatatgctcattcttgcaatattcattcatcagaggaggagtacttcagtgaaggtgatgatctggaggactaggcttggtccgggttaagttgcttgtggagtggagtcgccatagttgttccgtagtttgctttagtttatttttccgctgcgtagaatgttattctttgagaggaactatccacctctgtaataatttattatttgcgaatattaaatagctgtttatttgtactctattatcaatttgttattgcgtgcctcggctgattcctggacgagggtttaacacacatgtaagcgtttggaattttggatagaaattctgggcgtgacagccggtctgaccaggcctcctggccggtctaaccgcagccatgcggccggtctgaccgagccattaggccggtctgaccgccgaccagacagcggtccgaccgaggcttcaggccggtctgaccgtgtgcccaacgtcggtctgaccggtgcatctggccggtctgaccgggctccagcgccggtttgacaggaggattgcaaagggcgatttaagaacttcatcatcttcaaacaaagttaatagaggacattatttacctcctggaacagagccgaatcctaggtggatgcctaaggatttaacggctactcaaaagagaagattgcaacgtcttcgggcccaagagttaagagagaaaaaggccgaagaacacagggataaaaggttcaataaattgagaccaccaccgatttggaggcctaaatccatagagaaggcacgaccgattgatgtagaggagaaggaagaacaatcagttgctaaaagtgaatcatctccaaaagaagacatggataacaacatggtatgtatgttgcctatggagttttgtgctatggatgaagccgaggttgctcaattctcattaggtcctaaagacgcggtttttgagtagcccgatgaatcaaaccgtcacatgaagcctctctacctcaaaggccatgttgatgggaagccggtctctatgatgctagtggatggaggtgccgctgtgaacttgatgccgtactcgttattcaagaagttggggcgcgaggatgatgagttgaagaagagattctcaatggcttcaacggtaaaccaatgaaggcgaggggtatcttttcggcggggctcaccgtgggaaacaagacgctaccaaccgctttcttcattgtcgatgtgcaaggtaactacaatgttattttggccggttgtggaattcatgccaattgttgtgtgccttctaccttgcatcaatgttcaattcaatgggacggcgatgatgttgaaattgttcaagcggatacattggccgaggttgcaatggccgatgctacttttgagtggcgtcatgggaatatccaatgtttatcggagagggatctttctagctatgattttattagtatctccgttggcaaatttgtacctatctctgtaaagccggctagcgtagcacggctaagccatataaatttgtataatgagtaaagaggctagtttagaatggttacaaaaaagggtgcaagaatatcggtctacaaagaatgatattggagaaaccgttgaagattttaataaataaaaaaggtttgaccaaggtttacctcaaccgattccatggaaaaagttaacattagttaatggaattaaccaaggccgacttttggtaaccaaaacattaaaaccgattaataaggttaaaatattcgaggtacttaaaaagtatgttgattgttttgaatgggaggaccatgagacgccgggttttagccgtgagctcgttgagcatcggcttccaattaaaccgggttttaggccttataagcaaccacctcgtcattttaatcttttact

SEQ ID NO: 59966 - DNA, 20213 bp, Oryza sativa
tgttagatagatctctctccccttgagcccaacggctcaagggggccttgaccgcgccctgatcgggggcgcccagcccaatggctggtgggcccccgtcacactgcgccatataaaagaggggtggaggccggcacggcacaaggtacgagattcaccgccgccgccaactccaccctacaaaccctaatccgatcgagagggggcgcagccagtgacgggaagcgccaccgccgcgccacacctcatcgccgggacatctacgaccgtcactcccgcagccgtcatcgtcgtcgacctcaccggcgccgcatccacgacaaccgagcgccaacgacgacgatggccggcacttcttcatcctccaacacctcaaccggtcggtctatctaaaccctctcccgttttcaatctctacaatgtcattcatcaaacccaaatagaaccacccgactagatctaacctaggtgatcctagtgcaaagtctaacagttggaagacattatttctatcgcattttcactaaatttgtatttgtatatcagttttatggtgcaagaaagttttatcacgtgacatgaacttgtgaactaggactacccaaagaaaaattcctgcctatgccactgggcaagaggtgtaagcaccgataaaagttttcccaaagaagcagaaacttgtcccataaactgtttgctgataaagtgaactaactacgatatgctctctaattaactatttcatctactgtactgtaagacatatacaaatatgtagcgtctcttgttaccgtctgctcgttcggtaaaattgacgaccggaaacaagataagcagtgcttacagaaataccactcaccaatatgtcaatacggaacagcagggcgacttgtccttgtaattgattttgctcgagccgagtattacttgcttgcgttgtggtatgtacaattggctcgagaccctggactcgggcctttaaaacacagttctgtagcaccgttacatccacaggtcccgtttctcctactgtgaaaaatgccctgccgtgtcttgaccgttttgtacataataagaggataagacactgactcctttggtgtctactccgatttccatgtcctctagccatactcttcttattggcatcaccgcgtgctagagaatcaaagcaagcagtagagacttttatcttcgcagggcagtcgcggcacggctctcgccattgctgcgctgcagtccgcagctgtctgtctcttctcacgccttcaggcgatgaagcgagtcttcggcgttgctgcggttccgtcagggttcgccgtgcgcgcgaaagcgcacacactgacacacggagtttgtgcgtaagccagtgcccaagtgggccagaaggcctacaagtagtgatgcggcccagtaaaagaaaactacccatgtgggcttggaaaaagtacaccaaagatccctcaacttgtcatcgagttacaaaatcgtcccccaaccacaaaccagatatgcgggtccctcaacttacaaaactgggttgtcatttggcggttttggtcccgattttatctaacgtggcagctgagtcagcatgagacctacgtagaccccacacgtcaggacgaccacgtcatcatctctctcccctcatctcttccttccccctctctttctttctcactttcccctcgcgccggctgaccatcagggcgaggcgggatgggcggtgcggtggtgcggggacgcgacggcagtaggccgggcacaggtgggcgccgcggcggtgggcaatggtcaatccagatgtggctggggcaccgaagatggagatggcgtcatcaagatgtggctggcaccgaagatggagacgccgtcggccatggtgcgccatcaagagtggcttgtcgcggatgatggcgtagcagagcgtgcccttcctggggttcatggcgtcgtcgtcgttggggttggtgaccatgttggcgttgcggccgaagccgatgtcgctgttggttgttgcgcaagtccgggtagcaccgccagcaatggtgccgcacgacaggtagcccaaacgcctcctcgccgtgctgttcctgatccctgatgatgatgaattccagtgttaaaaaactccatcttttaatcacatcatgaatcaatcaaccaagatcgtgttcaccatttcagtgctaaaattttcagttttaattatcacatgaagcaatcaggcatcttgttcatgagtgacaagatgggatttcaattcaggcacagcacagagagtgtgatcatcaacgcgcacaattctaccagcaggtgaagaagatactactagtatgtttgcaatgcgaaacagccatcggatcgatcagtagtggttggcggtggggcagagaggtggaggcaaccgtcaatcgccctgagcaatttatcctccacctctgggtgcttggcgatgaggtagaccaccggggagatggtgaacgacgtcgtggctgacctgatgagggggtgctcgtaggtgagcatgctgatgtaatccgacgtgagcagctccctcgaggatttgttcgactctctcgccgcgagcacgacggacaggaagtccttgcgcttccgcagtgcgccaggtcgcgctccatcgccgccgcctgctcggcgacgagcggagggtccatgcgaagcccatcgccgcggcggcgaacgggatcccgcctccaccttcgcgcctaccgctgtggcctgcggcacccgacctgccaccgccgcatcgcccatcgccggcctccctttcccgccttgcctcgccccgccggccaacactatgagaaaagtgaggaagagagagggagggaggagggagagaaggggggggggttgagagatgatgacgtggtcaccctgacatgtgggacccacgttgactcagctgccacgtaggaccaaatcagggtcaaacccgctgagggatctactgcgaccggttttatatagttaagggatcccatatatcttttattgtttgaggacgttttttatcccgatgataagttgagggaccttcggtgcactttttcctgtgggctttaacattggctaaactatagctggccaaatgggccgggccaaacgggcggcccggggcacggccgaccctgtagcaggcacggcccggcacggcctgctacagtaacgggccgtgccggcacggcccgtgtagccgtgccgtgcttgggccgctggccgagcccgcgggccggcacggcacggcacggctactgtagcaggccggcacggcacggcccgggcggcccgtcaggccgaaagcgccagcggcgcactgacagggcgggcggcggtcgaatgggaaggcgccacgtggcactaacggctatttgaccgttcaaatttgaaattaactgttgggaggctaaaaaattcataaaaaattcgaaaaaattccaaaaaatctcaaatttcgccctataaatagggcatgaaccccagccatttctcctcatcccacactcctcatcttgtgctctcaagtgttttaagtgctctctttgttctcaagtgtgcatttttttttattttgacaaaatttgctcaaattttgtcaaaaatcaaaattagtttcgtagttcaacagtttgatcgcagaggtttgaagagctcgcggttggaaagatgtaagtaatattcaaatttgtgtattatttgtattgtgtttgtgaattcaataaatattcgaaaatttgtttatgtcggtttaaattttcagaatggatccgaactttccataccagtcgccgtcgttcaccttgggtgatttcgaccccaactacatgtcggggtttgacggtacctccggatcggctccaactccaccatctgtggaggaggtaccggttcatacgactgtcgttgaggaggtaccggttcaggcggagacagcttcggaaggattttccggaaccgcgagcggaagtgttttgacacacaccggctcgaagagatcgagaacctccggtgtgtggcaaagcttcgacgagataaaggaaacatgccccgacggaagggaggtatcgaaagcccgttgtagaatatgtaggcaaattttatctgctcgttcttctggtggtacaggtcacctcaagcgccatgcggagtcgtgtgccaagaagcaaggaatacaactccggcagcagcaacttatgctaaacccagacggtacggtacgcagttgggagtacgatcccatggttgctcgggaatctcttgtccggttaatcgccaggcaagatttacccctgaactttggggagtcccctgcttttgaacattacattcagcaatctcataaccctaggtttaaagctgtgagtaggcaaacatcaactagagatttagagaatgtttatcacaaggaagcaactgcacttaaggaactgtttagtacatgtactttctctgtttgtgttacttcagatatatggagtagtagagctagagaggattatcttagcgtagttgttcattttgttgatgatgattggcaattacaaaagagagttttagggcttaggttaatagatgtctcacatacaggagaaaacatagctgaaagaattagggaagtaattaatgaatttaatcttgctgataaaatatttgttgtcaccctagataatgcatctgctaattctagagctattgaaatattgcaacatttattttgtgtgtatgctcaatcttttctactccatcagcgttgtgcatgtcatataattaatttgattgttaagactggcatgaagagggtaggtgaccacatcgatgctgttcgtcaagcaatcgcgtggttaactgcttctaacccgcggattgctgcatggaagaggttttgcaatgcggccggtgtggaagctcgtaagtttgccaccgatgcagagcatcggtggaatgcaacgtatttaatgttaaaagttgttttaccttatagtagtttactttctgattttgttcagtcacgtggtggcccaagaaacagtgacgggtcttcagtactgaacgagcatgtttgggcaattgtccaaaaattttaccaatttctagaaactttttatgattgtactctaactttgtcacatgtttattatccaactgctaatataattttgcacaaccttcttgaaattgctactttatttaaagaatacgaaaatgatgacgttctaactgaacctgtctttcacatgaaacaaaaatatttgaaatattggaaaaatatacctatgttgtatgctcttgcttttgttttagatcctaggtgtaaattaaggggattgtctgctattttatcacttgttggagatactataggtgtagattatagttctttttatactgaggttagacgtaaattatatgaggtttttggaagatatgaagtaaagtttcaggaagttcgccagcggagaccccctcctatccccactacaggtaagaagaagatacagtggggtaggatttggggtggatcgtcttcaagttcaatccaaggtggtggcagttcgtcggctacaagtggagacgcctcttcgcatgttgtggccgaagagttgtccggttatttggacagcgacgccatccaccacgaagcacaagatttcaacgtcctcgggtggtggaatgaccacaagataacatatcctgtgctttcaaaactagcacgggatgtgttgacggtgcccgtgtcgacggtgtcctccgaatcggccttcagtctatgcggccgaatcatcgaagaccggaggacgactctgcgcagcgaccacgtcgaaatgctactaagcgttaaagactgggagcttgctcgacaacatgcccaatacactgcggacaaccaagaattggccgcccacttcgagcaactctacctggatccagaccaaccccagtagaattttgttagaagtagttctgacctttgagctgtactcttttctttgtcatggttttctcattttcccctatgagtttttacatgacaaagtttttaacgaggcagcatgtatcattgtatcctgtaatgatataaacattaataaaggtcattactatttttaacaaattcttttgcaatattttcgcaagtgtggatttacctttaaattatttcaaaataatgaatcacaatctatatttttaaatttttcaacacaacaaaaaaataccattttttctttttttttttaacattagcaaatcattacttttttaaaaaacttttatttccattttttaaataccattttttcattttttaacattagtaaatcattacttttttttaaacattttatttccatttttaatttttttttccttatacatttcctttgcttttttttttttaaaaaaacactgtgcacagtgcactgcaggctggcggcctgccttcacgggccgccgtgccccgaacggcccgtgggccgcgggcgtgccgtgccggcacgggcacggcccggccatccacgggccgtgcttgggccggcggctcggcacgtgggccggcacggcacggcccgtttcatcagccgtgcctaacgggccgtgccgaaacgggccgtgccggaaccgtgcccgtgccgggccgggccgtgccgcccgtttggacacctataggctaaaccagtccacaaggagcctaatagagccccatagcccatccatcgtcgtggcgaccagcaaggctgccctatctttgctccgcttccaccgttccacttcatggcaaggcaagcgccgcggcggcgcacgtcgtcggagggcagagcgaggaggcgcacggatcggcacccgtagtgggagcattgtgggtacaggtatccgagggttttctaaatctcatataatcctcgagttgttactgattaggatctgcaggttgggattgggatttagggatggaaccatctctggttgcgatattccttgcttctcagtgaaaagtgtggattagtagtattgttccatgaaatctgacattagatgtgtagattatgatttatgtgcttataaatcgccatgataagctgtgcataaacagaatcacctagcttagaaccttcacaatcctaaccagccaaactgtaaaaaccgtttaccaaaatggtgactccaaaatcaaggttagtgcgtagtgcacaccatccacatccatatgttgcaatacagaatagtagtttctcgcatctcccggatatacggagggccaatttatcatgttttatgcacatcgcattcaaagcctacaagagcacaaaattacacaacttccatcacacactgtaactctttcctgcaaagcaaatcctcccgcttggtcgcttcagcataggatgttctaattgcaagcaacttgatagctatttctctcatgttcattcgttcttttgggatcagaggagtgcaggaaagagccacttgcactacagacaacaagcatacatagaaacaattttctttcttggtcactgcttgattgaagcccttgtattcttcttggagtcgagcatcaattatctgtggtatctgctctgggaagttcttctccacaaagttgacaatgttgagctcgttctcaaacatagggtctgttggtcttttacctatcagcatctctagaagtactattccaaaactataaacatccccacaggtcgatgcatggccacattgcgcatactctaaaagaaaagacaaaatcacactaattaatacattattatgtataagtattaatgcagaaaacagattgcctttcatgaatttaaggtgtaacaagaagcatatatacctggagctatatacccgatggttcccttcaatccaatagagctatttggactgtaatgtccaagtgaggtgaatctagattcaagaatgaggcttgaaatgccgaagtctcccaaacatgcattcatatcattgtcaagaaggatattcgttggcttcaaatcacaatggacaatagacctttcacattcgtggtgtaaataggataatgcattagcaatgtcaacagctatatttactctttgagataagctcaaacattttgaagcaacactggtgttttttttatgcaaccacatgtccaagttcccattaggcatgtaatcataaatcagagctttgaaagcatttccgctatagtctattgttgaacatgcagttaggacaggaagaaggttgcgatgtcgaatgcttcttaagatctcacattctgatacgaaccttttgtctgcgcatctcatctctaggtcaaaaactttaattgcaacttttattttaaccagacttaacttcgctctatatactgaaccgtagcttcctcttccaattaagtttgactgtgagaagttccctgtagcttgggctagatccttgtaagaaaccctagggaactgctttccaaaagaaagcaacgatagatatgttcttcttggtgtcttcttcacaaggtatataaggcatatcagtactgtgagtgacaagaaaccaaatattggaatcaacaatctggcccaattgctcttcctttctgttctgtgagaaacttggtggcacgatggcatgtggagatccatcacacctccgcatagtgccctattgccttcaagataaacaaatgtagcatttctgaataatccattccttggtatttctccttggagattattacaagaaaggtccagcttgctgagtagaggtagatcccccaatactgctgggatggtgcccgataagcagttatgggaaagatttagtatgctcaagccttttaggttgccaaaagaaattggaatggttcctgtgaagaagttttggtccatttggatggtcactaagttttggcacatctccaaagcatcaggtattttcccagtaagcttgtttgatgtaagttttaggtagatgagttgtgtaagattaccaatctccagaggtatggtgccttcaagattgttgtaggtaagatccagctttaagagtagcggagggcttcccaaggagggtggtatgtgaccttcaaatgcattgttttccagatagagctctgtcaaatgtgtaagattaccaatattgtatggaataggcccagtgaacttattgtttccaagacacaaatactgcaagtatttaagatttccaatccatgggccgatggaacctgtgagattgtttacatctaacgtcagttgaattaacctggagaggtttcctatgctcggtggaactataccagacaggttgtttcctcccaaaattagaatctcaagatttgttggtaggttaccaatcgaatctggtatgactccatgtagctgatttctggctaatgacagtatttctagagtagtgcagtttcccaaagcattcaagaatgaccagctttcactgtcttttgctctaagtttgtttgcctggaggtccaatttatggatctttggaagctctccaaaggaggtaggaatcaggcctgtgaaattattaaactgaaaaactatttcttctagcattgaagcattgcctaaggaagctgggatataaccttcaagcatgttatggctcatgtagagtattttcagattagtgaaatgatcacccatgttatttggtagagtcccaccaaactgatttccgctcaactctagagcttgaagagaggacaaattaaaaaggcttgctggtataccacctgatagcatattatcccctagccccagcactgttatattggaaaattggctaagttcatcaggaatgtttcctccaagttgattcagctcaagatagacctggtctaaataggtaatgttacccagagattgagggatggcaccagttagattgttgttgttaagggccaaaaaaactagattgatgaggatacctatttgcctgggaatctcacctcgcagggagttatgatagagatgtaattccttcaggttggaacaattagtgagcgtatctgggataattccacctaacgaattgtagctcagattaaggacttgcatcttctggagattgctaagatcaggcatctggccggagaagttattacttgacagatcaagagtacgaacaaaagtcaggtttccgagtgaggcggggattgtgcctgacaagccttggccggcgaggttgagtgctgtgactcgcccggggtgcttcatcgtgcatctgacgccgttccactggcaatggggagctctcgtgtcccagttgctcagggctccagccggatcgttaattgcttttctgaaagtgagcaacgagagcatatctgtgctgttctcaggaacagttgagcaacggatgccaccaactccgtggagaagtagcaggagctcaagtacaaaaagcatgctgtgttaatttcacagttcgctgcttagctgcaacaatgaaagcataactcagtacatgtcaaccggaaggaagaatgcagtagatcagccgtatgactcccgtgcattttcttgagcgagcatgattcgttaaagttgattccatctacttatcacctccagaagtccagagtcctatagtatgttcatattgagaaaattgatacccataattaagccacacgaagtgcgtaggaaatattaccgaagagaagaaattaggtagtaacttgtagttggaggctggagcggaacaacacgctgttactgcctggaaacgagtgtgagttgagtgtggttggctcaggccccgtggcgcccagaggtttaagaacagttgtgccgcggatttacaaccacacgcttaatttcgttctacaattccttgtccggtaccatcatatacgttgccgtcgcctgaccgcaatacagaacaggccaaagctgacgactttggctttacaagaccaagcttcgttggtcgtaaattagactcatcagccgcatcccttctttgtagctgcaccccccccccatcccccacgcacccgctttatttttcctttcttattgtaatctcttagcctcttgggctattgaacagtttttccctctattttaatacaaatacaccctgcagggtttaaaaaaaaaagctccggagcgacaaagctacaggagtttggaattttgggagatatcacctagtgcttttttccgtttgcaggttggcttttggctgaccctgtacatattttctcttgtttttctgctcctctattaatataccaggcaaagcttttgccctcctttaaagaaaaaaaagcttcgttggtcgtgaactcgtgatctactccctctagacgccgttgccgtccgagcaatcgtattcctgtgtagactctgcattttgttccatcacgttgatgtggagctcgaagatgcaaataattcttctttttttttagaactaagatgcaaataattcgcatagacatttgggtcgccgtcactaggccaaccagaggacacgaacgggcccaacaaaacgggctatgaatggagggaggcatgtggcccattgaaaggccacaggcccataatgtcacggtctgctacgcatcgctaccagttcgccacgaagaaactggggctttcttctccagtcctccggttcctccgcagtgcacgcccgaagggcgcaggagcggaggcgcaaaccgtcgccggagggcggacggtgagacgtcgcccgcgaccgaccagccgccgcccgaaggtattccgtggttcctagatctcatcagtctttactcgtggggcagtcagggtcgtcctggatgggaggcgggtaatcttttaccctggggcagctgcttgcggggttaatgttgtatttgtaaacctgtaacctgaactatcttctaaatcttaataaacttcgaccggctttgcgccggtccggcaaaaaagagatctcatcagtctttactcactcgtgattagccgctgcagattctgaatttgaattaggaaattgattttagtttggttaaaattgtgctagggagtttatgtagaatagtggtaatgttccatccatgttagttggtatatggattaagatctttgttcatctccatggctacttgtacacctactattatggccacaccattacaccacccatctgagatacttatgtacttttatgaaatccttgatgatacatcaaatccaaatccatgatgtttaattcatgatagcagaaaaaatattttttcctcgcattaaagatatcaggttcatgcaaaaatcatcatctttgtgcatttatcgacaaacctggctgttacacacgcttcatggcacgctataaatcactttagcgaaccatgactagctctcttgcctaattgcatcgacatatgaagtttgaatcgcatgcaatctaatggctacttctctcatgttcatacgttttgttgggatccaacacgtacaagaaagggctaattgtgcaagagaaaccaagcattggtatgttgcattttctgttttagttgttgcgtgaatgaatcccttgcattcttcctggagatgaacatcaatgatatgtaatatatgatctggaaagttcctctccacaaaattggtaatggtcagctcattctcgaacatagagtctgttggtcttttgcctattagcatctccataagtactaccccaaaactataaacatcaccgctggttgatgcacggacactttgagcatactctgacaaaagggattaaatggtacttaactacttattagtgcaatttgaatctttatatagcaccatatgtggcaatgaaatttacctagagctatgtatcccatggttcccttcacagcaattgaactgttacaactagaattcccatctgatgtcaatgaagaatcaagaacaagacttgcaatgccgaagtcccccaaatgggcactcatatcctcatctagaaggatattcgtgggcttcacatcacaatggacaataggccttccacagtcatggtgtaaatagaccaaagcatcagctatgttgacagctatgcttactctttgatccatggacaaatgtttgcgaactacaccagcatgtccatgatgcaaccatttgtccaaattaccgttatgcataaactcataaattagagctttgaaatctttacctccattgtctatcgtggagcatgcagttagtacaggaagaaggttccggtgccgaatggttcttaaaacctcacattctgatacaaaacttccgtttgcacgcctcatctcaagattaaaaaccttaatagccacttctattttggcttgacttaacttccctttatatactgaaccatagcttcctcttccaattaggttcaactcagagaagtttcctgtagcttgagctagatcgctataagaaactttagggaattgcttaccaaaagaaaacataaataagtaggttcttcttgatgtcttctttccaagagttataacataaatcaacatggtgagggacatgaagccaaatattggaatcaataatctcacgatattaggcttcctttctattttctgtgaaattgaagcgcacaaaggcatatggaaatccactgctcctccacaaagcctccagttgccatcaagtgaaacagctgtaacattttcaaatattccatttcttggtatttctccatggagatgattgtgtgaaagctctagcttactgaggagctgtaggccactcaaagcagttggtatggtccctgacaaactgttataggaaagatttagtacgttcaagctttttagattgccaaaatatactggaatgtctccagtgagaatgttttggcccaattggataactaccaagttttggctttgccccagagcattaggaatttccccagaaaacttgtttgatgaaagatgtagttcgaccagttcttgaagattaccaacctcttcaggtatgctaccttggaggttattgtagctcaggttcaatattgagagttgcgaaagatgtccaatgttgggtggaatgatgccttcgaatttattattttgcagcgagagcattgtcaactgagtaaggtttccgatggagggagtaattggtccgatcaagttgttctcacggagaaatagaccttgtagatttttcagatttccaatccattctccaatttcaccactgaaattatttttaccgagggatagtctgattaagttaggaaagttgccaatacttggggggactacccctgatatgttatttaccgaaaatattaaattttgaagattgattgatagattacctaccgaatgtggtagggatccctgcagattattttcagctactgagagcgttgttagagcagtgcagtttgtcaatgaatgcaagaattcccatccttggtttccatttgcttcaagcttgttgtacgcaaggtttagtctagacaactctgaaagccttccaaaagacgtaggaatttgcccagtgaaataattcgatgacaaatctatataccacagtcctgaagcattgcctagcgaagttggaatctgaccttcaaaattgttataatccaaggtggcctgttggagcctagggaaggcatcgccaaagttctttggcaatgccttgcctagcatattcaactccaaacttagcaactcgatacgggacaggtttagggtcgatgggatttcacctgatagcgtgttattacctataagaagaatagatagatttggcaattgccaaatcctgttaggaatgctgccctctaaataattgtttataagcctgataaagtttaagtgggtgaggttttgaacagatgctgggatgatcccagtgatattgttagctgcaaggtccaagtattctagcttggtaagggagcctatattaggaggaattacaccatgcagcaaattaccagagatgtctaatgcccttaggttggaacaatttatgagttcattgggtatagccccctctagtgcgttgatactcaagttaagggtgtccagttgctttagatggttaaggagaggaacctggccaaagaagcgatttgaggacaagtcaaggatactaagagatgtgaggtttgcaagagaggaggtgattttgcctgccaagcttctgtcggtgagattcagacctgagacgcgccatggccgtgtagtagtgcagatgacgccattccaccggcagaagtgggtgctagtgttccaagagatcaagactcctcctggatcttcagtgatacccttcttgaaatctatcagcgattgtagatctgtgttgttatcgcggacagttgagcaatggacgacgacattgttgccaactccataacatagcagcagcaacaccagttgtatgaacacggcgagtttcgtgggttgctcttgctcggaacacatatcacctgcaaaacagtaagaatgaacagggatattatgtccattttcataagatgaacatcgctgagccagtgctgcagtgcatagggcatactaccaatgaagaatcgaagataaccggtactcagctcgaacaacgcgtggccaggttttggctaagatgaataccaccggcttgggcagttgggcccctggacaatggccttaaaaacacaagtcttcagcagtgtcacacatctagcgccttgctctgctctgccgtgtcttgaccgctcctactgatcagaatcgaagatgcctactcctccggtattactcggattttccatctccagtagcagtagaccagtattccgtccgctttccaaaattttactacacgcgatgcggagtgtcagccactcagccgtggcactccactgccgactgtcttcactcttcaggcgctgcccgcggttcactcaggaaaactggactttttcctagagaatttcagcatgcggcctgttgtatcttacggcccgtgcccggccgacgaacggccgactaagaatgggccagattaacgacaaaacggcccagaaaatcagaattaaatcaagggagcaacgctgcagcatcgcccagcccagaaggacactgcctaccttcatcgacggctttgcctgaccaagctccgccgccgaccaccgcactcgatctaggtttgcaggctgtgacgcgcgcggtcgccccgtcgccagatggcggagcgtgaggcctggactcctagatctcatttgtgatagccgatgcgtatctgcagtttgggatttggatcaggaacctggtctttgttcggttgaaattgtgctaaggtttttatccatgaaacttgacgcctggatggatggatcaggattatgatatttgtttagccccacgacagtttgtccaaaacaaattgcctatacttgaaacgatccttaacgagccattagtatagaacttttggattctgaatggggcaccagggagagcttagtagcttatgcaatcatagccagatgtagcagtaaaatagcggcgcaatttatctctctcaacgtgagagaattaccatgtttatgcctatgcctacgatactggctcagatcatggtatcactgcggtgattggtgaaacctggctagcttgcattcggttggccgttacatcatatgacattttaatcgcatgtaacctgttagctacttctttcatgttcattcgttcccttgggcataggcgtgtacaagaaaaagcaacttgcaggagggacagcaagcatgcatggataaacgccattttcttctactgctgttgcttcaataaatcccttgcactcttcttggagatgaacatcaattacgtgtgctaatcttatccggaaggttcctctcagacaaaattgagagtgttcagtccattgttaaacacgggatccgaaggtcttttgccgggcactatttctagaaatactattccgaaactgtagacatccccactaattgagcgaaaaaacgaaaaaaaaagaacgaaaattgatgttttacactttgagtacaatgtaaaagctcactttttagagtaaacaatagattgctttacatgatttcaagatgtgggaataacggagcaatatatccaaatagttcccttcaatccgattgaattgttaaaacttgaatctaaacctgaatggcaagccgatgtttatgtactagaatttttttctcgaaccacatggtcccgaattcccaattagtgaaacactgtagcactactgaatacacaagggtattactcctcggaatttattgtaagacatatctagtttagtgaggttcaaatcatttggagaaattgaaggggcctgacaaattgttatgggaaaactccttagaagatggtcggaatgtttcctatagaactgaaattagcaagggaccagacatattggtccatttgaatgatcagtaactactgagtactgacattggcccaaggtttaaggaatttccccactaaatttgtttgacgaaaggtctagtcgtgagagttgtttaagattaccaaactcaaaaggtatgctcccttggagattgttatagctaaggtttagtatcagcaagttttgaagacctccccagctaggtggtacagaaccagttaagtcatttttcgcaatagacaaaaacaccaattgtgtaagattgcaaatggagggtggaattgtcccgacaaagttgttcatttggagatttaagcgttgtagcttggtgagttttccgatccattcttcaattgtaccggtaagattactttcgtctagcgagagttgaattaaatcatgaagttttcctatgcttggaggaacaattcccgatagcttgtttccacccatcagtacatattgaagatttacagaaaagttaccaatcgaatttggtatgactccctgtagctgattattagataatgaaaacccattgagagaagtacaatttgccaatgcatggaagaattcccagctttcgctgtcatttgcttcaagcttgttattctcaaggtttagataggacacacttgaaagcttcccaaaagagcttgggacatggccacttaaatgattgagccttagatccaattctgttaactctgaagcattgcctattgaatatgggatgttacctttgaacatgttgtttcctaagtataggagttggatgtttggtagggcgtcgccgatgttagatggcaatgtgctgcctaacatattggacgtcaaggataacatcgtaagagaagacttgttagggagactttgtgggagttcacctgacagattattttggtttaggtacaacaccccgatgttttgcaactgccaaaactcgttaggaatgcgaccgttgagttgattttctgaaagatcgacatactgtaaactggcaatttttccgagggcttccgggatgatcccagcgagattgttctgggaaaggtccaaaccaagtagcatggaaagattccatatggtaggaggaatcctacccgttagattgttgctagagaggactaaggcggtcaggctggagcaatttgcaagtccatctggaataattccgttcaaactgttttgactcagattaaggacttctaggtgttgaagatcatttagaagaggtatgggaccataaaagttattatcacggagaagaagctttcgtaggaacgttaagtttccaagagaagatgagatctggcctgatagactttttctagtgaggttgagccccgtgacgcgccaaggcctcgcctggctgcagttgacaccgttccaactacagaagtggatgctggcgttccaattgctcaaggctccatttggatcgctggtgatgccctgcttgaacccgagcagcgcctgcagatcgacgctgtaatcatcatggttaggtaggcacctgacgttgccaaatccgcaagtcagtagcagcaatgccaacagtacaaccatgttgctttgcacacatgaagctttcgtcacctgcaaaagataaaaggcatatatgtataatcgttcaagtagattagcagaccttattatgtataataaggtccgaggaacttattgtctcctctgcagctgaccataatcgattgaacgatcatacggttcacatcgaccttatcttttttctttttcgaatggtcagccgttgccgacgttttatataaagaagaaggtgtcctattttaaagagaaaatgggaccaaacctggtagtgcacagttcattaaggaaaagtgggcaaaaaccacaactactcatatgtaagcaggatatgcgcctaccctaagtaatcttgcaacaagaaataagagaaacggcatgtatgaaatactaactgacaagagattagcagacctcttcctcgttctgacatgtcaaaatttcctcggacctgttctgctagaccttaatacagttgtacttggctcaggcaccagcgccatggggttgggtttaaaagagttgtatttcactgtcacgtccgcaagatattattctgttcatcatgcatgctttgccgtagcttgaccgcttttacagatgtgacactcgacttcatcagaatagtaaacgatttctcccaagcactttgtcctcgtgctggtgttgctatctagtaacaagatttacgaacaaggctccgtcgtttcgtttattcgatatttacaaataaaaaataatttttgaataaaacttttatatacgagcaaaggctgaaaaataaactttaatgaaaaaacccccaaaatcaacttcaaatttaaggttggaaattcaaattttggctgataagcataagtataagtataagcgaaaagataaaaccgatatttactatctagccagggacaaaaacgtccgcaaaaaatatttaaatgaaaaatgctttacaaatgcaagaaacaacgaaaatggcattagaactaatgcccacggtttgaaagtgggcattcgagcaaatatcatttaacgattacatcctagttgaaatttctcgttatttaccacctcttcctaacttatattcttttttgagtaaaatgcaccagcggtccttaaacttgtcaggaggtttcacttagatccataaacttgcaaagcgcacattgaggtccctaaacttggtttattata

SEQ ID NO: 59967 - DNA, 1423 bp, Oryza sativa
tgtactgactcttgctattgaattaatcttttgtttgcaggttttagtcttagtctttgagtgatgcgggtaatcgactgcttcttctaggacttgaacttaatggggtaaacccctagtcggtgtgcttgtggattgggtagacaagcttccgttgttctatatatttatttggccggttggccaatgtaactaaagtcgatgtagtttataatcgctttcatcttagttgtgtttgctatgtataatcatgctcgagatgaaagtgtgaatctagtgcacatcctgggaactagattcacatgagtatgagttaggaatatttgggatgttgcagatctttagccatttttgtcaagtctcctgaatgtgtaacacatctggccgccgccttcgagtggtttgacgggcacatctcaggctgaagttgactggcaggctaagggcccagcaatgtctccaatattcctctctcgaggcgtcggatgtttcattatgcttgtttgatgacttgaattattcacttcatctctcaaatataatggaaggtctggagagcctatgacagcatggtatcagagcaaataccgactacaggagccccttaagttgtcacttagaattgcttcttaaaaattattttgagtgctatgctctcagttacaaattatttgcaaaaatcatgttcaatcttatatctcatccttctttagagattattttactttatgtctcatgttttgattttaaaactcttatcttgctctataggaccgaaacattttggaaatactatttttgttgaattttatttgaaatcacttaataatcacagcaaaacagtaacatagtgttttgaaaagttttgaaatccatttgcaaactactcctatgtattagcacggatttctaaaatatcgggttaaacatagcccctagtaaatgggttttgaaaatgagtcgataaaacttaaaacttgctagacaatattggaattccatctccctatgttatctctgaaccaaaaatgaatttggtgggattttgtactttcctctcccgatatttcaaaatttcaccggtatggcctaaaatgtgtagttgggtatagaatagaatttgctgtgcttaaccctctagattgtttgcttagatggaccacccaaaattcatctagcctctggaccaccctaacataatacgactaaaaggtgataaaatttatacaacctaaaacttgattaaagtttcattttgtgccggttgttcttttttttttctggaatcttgagtcagtctgcttgttatttttgtctagactaaaccgtaggtgataaacctgagaattttttacatgcatcatgtagactaacccagtaagcatcatgaattttggcataatttttagacccgtgcatcata

SEQ ID NO: 59968 - DNA, 1103 bp, Oryza sativa
ggaaagagcaaaatcaccaaaacagcacataaacaagcatgaacagtacatgtggatatttttaacatgtagatctcaattttagaaaaatttagagacttgaaccaactaaatccgagctaagatgaattagttatgaatttttgaagattaaatcggattaaaacacttatatggattttaattgaattatgacgcaataatgaattatttttgaaaaggaaaaggggtttattgcgtcagcggctagggtttgcggtggaccgggcgcacggcagcggttcacgggaacgaacggccgagatcgatccatccaaaacggacggccgagatcgatcgggtctacggcggctcacggcagacggccacgatgacgtcagcggcgacgtcactccggcggcggctcggcggctcagcggctcgggcgcgcttgctcgccggcgaacgacggcgcgacgacgcggacggagggcaccaggacgtagagcgcggggcggcgaactcaccgatgaccaaaacgtcggcggaagatgaacggacggcggcggcgacgagaaagaagcggcggagaccttcggcttgacgacgacggcggtgctccggcggtctacagcgacggcgaaggggcggacgaggacggcggcgacttggcgaccacgatggcgacctccccgagcgatgacgacgaccggaacgacggcgaagcacggctggagcgacggcgacgactgcggctcgaggttacacggcgctagggcgcttccgacggcgagagacgaagacaatggtggtggcgggtagcggcgacaccggggatccttttataggggcaaggaggcagcggcgaaggcccacggcgaccggcgacgcgaaagaaacattggggttcggaggaaagagatcgatccgattcgacctcgaatccacgaacttccaaagcgatttagacgatgattccaaaagagaaaaggtagaggagatcccgaagattgtttcccctctattgatttcaccggatcgggaaagacgcggccgaatttggaaagcggcggcggcgacttggcgctagggtttcgggcggcggcggccggaggtagacgaag

SEQ ID NO: 59969 - DNA, 20511 bp, Oryza sativa
ctccatgtgtttctcatttatatgacccaagcgacaatgccaaataaaagtgggattcaaatcattagacgttgcctttttgcattaatgttatagactaaacatccatcaagattcacaatgtataagccattcatcatgggtgcatggaaatagaaaatgtcattataatagactgaacaaccattgtccacagatctaaaaccataaccctcttcttgcaaacaagaagcagagataacgttcttacacaaagctggaatgcaataacaattatttaattccaaaactaatcctgacggtaaagataatggcatagtgccgaccgcaatagcagcaactcttgctccattgcccacgcgaatgtccacttcgcctcttgctaagctcctacttcttttcagcccctgcaacgatttgcatatgtgagcaactgacccggtatcaaatacccaagaatcagtagaggaagtagcaagattaatttctataacattaatacctgaggtggaactctttccatcctgctgcttctgcttgagctgctctaggtatttcatacagtttctcttccaatgacatgtctccttgcaaaagaagcactctgcatccttagcgggccctgtcttttgaaccttggtcttagagttgctagtacttgtgatctcatcagagtttagctttctcttttgaccacttttcttgttgttgggcttgcacttatgcataaccatcacatggttggagtttttcttaatgctttcctcggcagtctttagcatcccatgcaattctgccaaggtcctgttcaggttgttcatgttgaaattcattatgaatggctcaaaactgggagggagcgactggagaatcaaatcagtagtcaactctcggctaaggggaaagccaagcttatccagactctcggtgtaaccaatcattttgatcacatgtgggctcactggattaccttctgcaagcatgcacgcaaacaaggactttgaggtattaaacctctcagctcttgcttggtcctcaaacatgttacgtagtttcgtgattatcgtatgagcatccaatgcctcatattgcctttgaaactcaggggacatagtagcaagcatgagacagcttatatcaaggtattcattgcatcacctttcatgctccctacgttgagcagcaggagcattgttgggcaagtcagctagaaaaggctgtgtaagcataaactctttgtgctcttgcctgagaacaattctcaggttgcgataccaatccatgaagtttattccagtcaacttctctttctcaagaatagaccacaagttaaaattggatggtgcaggagctgccatgatctataatagaaatatatgcatgcaaaatcagcaccatgtttacatttaacctttcattaaacaatttaacaaaagatactcccactatgtattgtgaaataaaattccctctagtaacatagtgagtcaagatcctcattttattagtgtctagtaagctttggcatcacagctagacaactatcaaaataggtaagcaacaccttgctaatcacatcatatgtgactcttgtgctattggggtgacatctccatgtccaacccaacctatgccccaaggtccaaaactgttttgataaccttgtcaagtaaaccaatgatctccgcatatagatgtccgatatctatcctattttatcatgataaaaagtgacactttgctatggcaaacccatcacttatgatcacaaccgtaataggtgcaattattggaagagcataaattacttaatttttctgagggaatctatcctaccatatcatatcaaatatataacagcaataaagtaagatagatataataaaacccaagcgaaatctaaggggcaacgcacacggcggtcccgctagccggttagcgggcagggggtcgaggggagagccgtcccccgcgggtgaaaaccttaacggcgtaatcaaattatgccgaaaccgagtcaatctcattggcttgtttttctcattggcgtgcggttccagtggacatcggactatccgatgaacacactcgcgctcggcgttggtgagtactaaacattctagtgaagtcaccaacatacataccgattgatctcatcaacccatgtggctatcggttcatctcatgttccgatcacctaagaactcatatacaacataatacatctcatctactacatccgcatatcaattatatgcaatgatctagatcataaactatacaaggcggctctgataccactgttgggatacgcgtaggctacgatagcataaatcaaaattttctatcgcgtaaaccaggaaccatgcaagtattagatcatagatcgttaccactcgatgcgctgtgcagcggaagaagacgctgagaagtcgaaggaactctcgcgaagtagcgcgtgtcgatgtagaggaagtagtcgatcgcaccggctcggccttctcctcctcgtgcgttctcctcgccgtgcagatgtgctagcacccgcgcgcggctagggttttgctcgggtagggaagtgacggctagggtttctcacctccaccggtcacacccctcacgaatatataggatccatcactcgggcctccaaggcccgtaggactactattcggatccctatccgaattaagctcatattggatctctatccaatcctcttattccggcccattaagtgtgcgaccctgtaggttcatgtatacttggctgtaacctgaaaactccttttcggtccacgcgtcaacagtggctcgtagcagaacttattgacccatcgggcatacataaagatcatatcggctgaacctctagtatatacttgtatgaacccctttgcctcacgatatcgattaagctcaaggctagatatgtgccatcctctaatagctcaatcattcactcgaacctgttgatagactatataacttatgattgactcctcaatcacctttggcatggccatacacttccataatctacaacatcgaggggtccagagatatctctccataggaggggcaaatcccatcttgattattcatatcccactacatgtttcatagcatacccgaaaactacttttataactacccaattacggagtagcgtttagcagtccctaagtaagctattacacatgttgagaaccatgataatctcaggtctaaggattcaacaccaatactcaatgagatcactgatgacacaacacatatggctcttgcagtgtctcatgttgggtctatccaacatgttcatcaacatgtgtccacattattaatttggtatctctataccatgatccatgagacatgatcatgaattaatacatgtgctgatcatataaacatatttattccacatatgatatttgatcagggatcccacttgggtctgcttttcacaaggcacaatctgtttttatggttttagacacatagtcatatcatttgtagttccagaacaatttctgagcacaatctgatagtactatgaccatttgtttactaaaggttgttagcttaactatgttagtatccccgcaataaaaagcttaactagttagtagattattactgcttttagtggtgtatcgagaaaagatcaatttctctcttactattaattagtgaagaattggaatcgtaatatcagtacaagcatcaagcatctacaaattcaaaagttggagtcttacactgatgaagggatgcaacgtctgctaaactcgtgttcatatactaaaacaagaaagctggagaacctgtggcagcatcaggaacaccttcttcttcaagtaagtgatcttacttgcattatccagcaaacaattaattttagtatctttctattgtcaacaagagttaatttcatgtaatctttaccattgaatattgttttaatcatcacagcttactagccttccaagtagtacaatgtcttaatgatcttaactaaagagaaccctaaaaaacaatagtggtataaaatttattgagcagcaaatgcttcatcatgtaaaaactattatgcaagataagatgacaagatttataccatgaaggtgggttgtgaggtgagctagttgagtcattagcttcagataaattcatagctcaatggcttttctactgaggatcttagtagcaattgggacaactcaagtttttagggaagctgaaagtttgacatacgtgctgctactttgaccaaattgactatattccagtctagtgtggtgaagaactatgatggtcatccgatgtaatcattgaaacaaaacagaatctcatctttcttatgaatttgagtcaacttttctgtctcaccaataatctccacaggaacagcttccatcgctgaaacaatggaaccgatgtgcatctctaacagtaatctgtctgaaagttatggcagagatgattatgatggcattatgacagtctccacgtgtccttagatttttcatcacaagtataggttctccttctactgtattaatcaaaccaaatgctagtgcaagcttcttgctattgtgccttagccttgtctcccctccggcagcatgatcctttgccaaggcccatatcttatctggaacataccctgcaagcttcatcttctctgacatcacctccaagaatttgtacacgtctttgatcctaggatgtgagatatcattggcaacgaaaatatgtactattctgccaagatctatccagctgcagccaggcttctttctgattccccgatttctcaatagtttccggatttgtgcagcctcctcccatttgccaacagtggcataaatatttgagagcaccacatgtgttgatgcactgtaaggagtcaaattgagaatctctttggctgctcttgctctaagatccatgattccatgtgtcctacaagcactcagcgaggaagtccaaccaattgaactaaggttaaaaggcatttctttagtcaactcctcagccttctcaaagttcttggcacgggcaagtacgtcaaccatgcaagagtagtgttcttcgcaaggttcgatgccatatttgtgcttcatttagtaaaaatactcccaacattcaccgactttcctagtgtgggcacatgctgacagcactgaaagggaggtgcgacttggcgtaccgcgtgtgcatggcggcgccgaggaacaggtcgcctgcggccgcgctgtcgctcaggacggcgatgaactgagccgcggccgcggtgcacagaccggaagtggattttgatcctcgttgtttggatgtagggggtgtttagaaacaagggtgaaaagtcttggcgtgtcatatcggatatacggaacgtagtctaataacaaaacaaattacatattctgtctataaactacgagacgaatttattaagcctaattaatccatcattagcaaatgtttactgtaccaccacattgtcaaatcatggagcaattaggcttaaaaattttgtctcgcaaattagtcgtaatctgtgcaattagttatttttttaagcctatatttaatacttcatgcatgtgttcaaacgttcgatgtgacagggtgaaaaattttaaggtgatatcaaaattttagggtgggatctaaatggctatgaaaaaattgagaagatatatttacacgtgatatatcactccacaaacatgcatgtaaaaatttaacttttacatctcgcaacgaaaaaaacaaatttgactctgaatatacgttaactagttgcggttaatttgttttttttgttacgagatatagaagttgaatttgagcttgcatgtttgtggagcgttatatcacagaccacgggagcagccaaaagcccatcattgcatcgccaagttgccgctagcccgcgacacactgtcgtggcatggcacgtccactgtttgtagtgtagcacgcctacgggcactgaagccaggatttggcgattggatttgggggtgttgaccatgagacgtgagaactcgctaatggcttgatggacagtgatgtggggaacgagatccagtgatgtgctattcatcagtagcgttggatgcttgggggacggtggatcgaagagctactgccctctgacgtagttttcccaacgtcagaggatcgtgacgtggacgtgaggtcggtatcatgtcacaataattagcaactagagaaagaacacaaaatctacgggcaagtctttctagatcatactaatatatgcaattgtgcatctctactccttaaaaattctggattggtgatggtgaaaccaaagcaaacataggatccaacgtacgtcgacatgattggagcgagagcgacgaaaaaaaaaaaaagtacatgcgatccggaacggaaaaaagcgtaaaaagcgtcgacgccccgcgacccgcgccccgtcccgcgagtcccgcgtcccacgcgtccctcgaccgcaccgcctcctagccgccgtcgccccttcctccgcgcgccctccatcgctgctgccccaagcaccctcctcgccccctcatcgccgccctcgaccgccgacgccccgcgcgccctccaccgccaccgccctggaccgccgccgcctcctcgccgccatcgaacgccgacgcccctcgccgccctcgaccgccgctgcctcctcgccgccctcgaccgccgacgaatcctagacccacgcccggcgtcccgcgtcgcgcgccgccctcgaccgtcgacgctgcgacccgtgccgcctcctcgccgccgtcgtcgcgccccgcgccgccctcaattgccgacgaaccctagacccgcgccccgcgccgccctcgaccgccaccgttgcgcctcgccgccgatatctcccacccgcgtcgctgctcgccggctgcttcgtcgatctgctccgcgccgcccgaacaactacgactgcgccaccgggagaccaacagccgccgttggctgcttcgccgatctcctccgcgtcgtcgggagaccgatgcccgctgctcttggctcactctccccaatccgcgccacctccgccggtcacgatcgccacggaggtctatccgtcgcctccgcctccgtcctcgacgccacagtctccctctataggtacaggtcccctcctgcctcaccccaacctccccccccctccctcttctctctctacccaaccctaattactcggcccgcagtccattgccggggtaggcctcgccgccaggccccctcccttctgccacatgaaaatctgctcaattttttttaccagtgaagcatgtatatcataaaggtgctgaatatagtagagaatcagatatcataattagtggaaaatcatacattggcctaatatatacagcagaggtcccaaattaacttttcagtcaaacaattgcaataatcgagtaccatcgctcattatctggagtggtttggcgatgtagaggccgggtttatcccattttctaaaaaaaaaatgtctggagtggtgcaatcttccccgaagcactataatgcttgcctggtgaattatgtgaagaatcctctgaagtagtggcacatcaaccttcttcgcttaactggaacaataaaacagcaatgggattttgtcagtttcttcagacatcggccaacattgttcacttctgtaaaattgctaatcatggtttattttaagtttattacttaggattagcagaagttaatttattggactgcttcaaagtgagtctgcctggtgtgtacaaatttgcataaaactgaatatgaaggagcgcaagtcatgaactgattgatgctccaggaaaacaataacagcaattaacagtttcactctccctaaaaaaatacagcaactaacagtttcagaggccctcctttatgttcatgaatcaaatcaaattgattatttatacaatttatatatctgcataatttgtctcacaatgatcatgacattcaagttattgctacttatttcagtatatttaaactgttgtcgcagataaaaatcagactttttgctctcatcatgcaaagaataatttcttttattctttactgctccaatgatacttcggttatttttctacttagtcaagttcttataaaatttgggagtgcatctctgttgaacccggccgacccgaccctgcaacaacgcctcaccaaccgtcgcccatctctgcttggacaacatagtcaactgccatctgctcatttcacggtataacccagcatttttcccatccttatttattttcctcctctcttctgatcttgtgagatttttttcttcatctttattgtgggtatgtctctgcaatattctttgagtacatctagattcacatagacctttgatccagtgtcctgtgacatgtccaattatatattttgggtaccatgtagatcagttattaattctacgatgccagaaaattactgggcttcacattgaaaggctataaatattattctatttcttccctctcatcttaattgtgtgtgacaaatactttgtgtcatgactggtccttagctagatataattaatgcatggaatgcttgattggttcatgaactggccttaaattgcagtcaagatccatccatgtgttacaagcagatgtttcgtgaatacttttgctaagctctgtactgttcttagctcgaagacttttgctatgctctgaatactttcactgtttgcatatacactatcgctaggagaggatcaactgtatctattgtttgcggaacagatatggcatagcgtgtagattttgatgctatcacatttcgtcttcagtttgattaattaaccattcccctgggaccattgctgactgtcctataaataactgtactgacatattctctgttgctgaaaagaaaaaaaattcttgctgatatggtcttctttgcaacctggaatggtcagtttaggaacctggaatgttgtccttgcacaactaacgaagtaatgatatggtcttgatttgcaggataaggagactaggagagtgattgggaggatctgctacttctttgtcggatctgccacttcttgcaatcagcaaacatacgtaagaaagtgcctttagctaattgatctcttcaaactcctatctaaacatgaacaataagtcctcggccttgagtgattagggaatgtcatatatatatagcatttgaatgaacttagcttcagtcttaagactcttggtgcgattacaaactctgaactcaaatggagaacacctctctttttaggtcaacattctgaatctgcattggcaacatgcaggcatctttgaagggtttctcaatgggtctatgagggcaccaattacacactaataatttagcatttaagctgtaggaagcctgtcgatctcctgtcatgtatacagaaataggagctttgaagtcttgtgcatctgaagcccagaatacatgaagctcctatgctgagtttttatcatcactatgaatttctaaagatgccctgtacacttgaaagtttactgctgaattttcgagcttttactattgttctaaaattcttgagatgtactatcaggactcgaaagttgagtgtctcactccattgcatcttgtttttaagatacttaaatagaggagcaattagaacaatgagatgccattcaatcgtttgaactattttgtcacgtgaggaaacctggggagtagtttgatattcttttttgttcactattttctctctatttttgatctatcaaacagatgcataataagatgctagcctcgtcatcaatgaaacgtgtgcactgcatatttctgttggttgtttcacaaattcataatatttgatctatcatctcatttattttcagaaatggttaagattgttgggggctccacaccatcaagtacaaaatcaggttagccatgtgcatgttattgactcaaatgatgcactctttgcatgctaatttcgcccatgtcttcctttcttatgccctcttgcaaatatataatttttttgagaaatttaatgatttactattaacaaacgcccgattattttttctttttttaaaacgtgatcattttgctcataaaatgtgacctattttaagcaagccatgctttagttcctttttaaaaaattgcattcaaataacagtgcattagcacaaaaatgtgccgttgtttgctgggctatttttctctcaaaggtttagaagtgacaaattaaaaatcttggactattgaagtcatatacttggaggatgatcccctggtcaacgacgtagtaatatgcccgtgcatcttgttctttagatacagatcttagctaggatttgggatgaaagcaaaaaaatatgcgttcacatgtataagggtcacagaggaccaattagaacaatcagatttatatccctgggattcatgttctgggcagaaattctgtttaaatctgcaaatattattttataccatattttgaaattagataggatgtggaacttcctgctactattggtgtttcagtaatctgtattggcaatacagttgttctcatggaattaatatgtttgcatctattcatataatctcttgtccaataattttctgtacctttctgcgatatattgtgatgtaactatagcagttgttcactgattaatacaccttctaggtctgcactttgaatctttatgtggagttccaccaactgaacttggccactaactgactaactatgattttgaatggtattgattggatgtgtgatggaatcggttcacatttttgtcctgtacaatatgagtgtgatgtgtgaactgttagatttctgtgatttgattactggcacaatgtgatgaaatcggttgaacttctttgtcatgtgtggaaacctggggagaatttgtttgtctatattttatacactcttgtaaaatttaattgtgaattgagattgtaaatatggtgctctggaaaaaaaaactacagttagctatggatttaaattaatactctcttcgtttcatattagaagtcgttttgattttctgcagtcaaacttcttaaaagtttaattaagtttatagaaaagtctatgtacttagtagctattcagcatttatttaataaaaaaatgtgggacccacctatcatactcttcttcccctcttcctctctctctcctctctcgctcttcctctctctctcttgcagcgcgcacggcaaggacgggcggtgggcgtgggcggtcggtgaggatggcgcagggacgggcgatcggtgaggacggcggtgcggatgtcggcactcaagacagcacgcacggtgcggcggcaggaaggcgtttggcgttgtggtccggaagggagcagcggcggcaagggacacggaggcagcgaccacacgggacgcagaggcggcggcggcgaactccgcctccagccgccgcctccgcctccgccactggtcgggatggcgctcgggatgagggtggtggctggtggcggaggaggctggaggcggagctcgggatgaggcgaggctacggcagcgaggtcggcttcgcaagcacgacagaggaggcgaggcgacaatggaagagcgtggctgcggaggaagcgaggcgaggcggcggcggcgatggcgtcgacttcttcattgacaacggcccgatcgaccactacgacgacctcgccaatcgcatccatgaccccaatggatctccgatgccgttgcccctgtccaggagcatctccgatggcttccccgtgctgtagaacacgaagtagagcacgaactggatccacgtcactcggtgcagtcgctcaccgtcacgttgagctccgggaaggtgtcggccatggcggcgacgaggccggcgcgtgtgccgaggtacaggggcacaacgacgcggaggaaggtgtcgttgggaagggacggcgccacgcgctgccacttgatgaggaggttggtggcagactagtttcttgagcggtggacggtgaacaccgtgacggtggccggaacggggacaagccggagcttccaggacaagacgatcccgaagtttccgccgcctccgcctcggatggcctagaagaggtcctcctccatggcggcctgtcgaggagccttcccttggtgtccaccatggtggcgtcgtggacgtggtcgaaggcgaggccgtgtgcttccgcagcatcaggtcaaagccaccgccgctgaggtacccgctgatgccgaccgtcaggctgacactttcggggaacccgaggcgggaggtcttgttggcgatggcgtagtacacctcgtcgagcatcgtgccggagccgacccatgctgtctggccacggacgtcgaccacccgctgccgccgccgctcgacccgcgccgacggcccgagagagagggggcgagagagagacaagtgatagagtatatatgaatttatataaatatttcccattgcaacgcatgggtacctaactagtaaatttaatatgtccaatgaccttttataattataaggattatatgatgtttcttgatgtggttctggacgtctttcaacacacattttctgttcatatatgtctatatgaacagtagaatatatctaaaaaataccattttaaaataaggtcgctatattacaccaatttaattgactaatcaatttaaacaagtaatctaagtaagaactattgggcagcttgtcaatgacatttattagatttttctcttaattaataatgtaaacaagtaatctaaggaagaaatattgggcagctagctagctgctttattttgcagctaatcccatgacattatatgctaaactggtggctaattacccagggtggggtggcattggggtgccatgccaacccaacaccctcgatggcttcaccactgtttacaggctacttgaacactctgatttttttttctcacaaatcagatgctcttccctgcaagatatgcatacgcacggtgagtgcccttagcgctattatgctcatacaaactcccataccatatattgtttagtagttatacccctacgtgatatactcctatctctctatcaactttctaaacaagcttttgaatcattttttttcttctaaagtatttatctaatatatattctgattgtacccattatatttattgtaaataaatctttacaacaaaatatcacatgattatattttgataaaaaaatatcaaacattataaaatacttactaaaacatcaaaaacatcgagtgcaacttttgtaaatgcattagtgaaacatcagaaagtgctattgaaacatcatcgaaacacatagagggttgttgaaagttgaaacatttctctctaacgtatgaaacatcaaattttaacatatgaagcatgtaattttctttgattagaatataataatgtgaggtcttgttataaaaatttaattataataaatataataatgtaattcgattgcacatcagataaatattttaagagaaaaaattatataaaccatactagcaagtagcaacttacatgcatgtatgcagaaagagagagtggttgtggctctgtgcatgcaaagaaagagagggagagggatggatgcatggcttttaatgctaacagaaagatgcttcgtgacctcgctccaagggcagcacccgatttattctccgggaatcaggcgtccgatagaaagcattgtcctcgagaaaaagggagaaatagttaaaaacatacgattgaattcaagctcaaaacagaagattgtttgattggattggaaaaatgtagcaattggatgggacagatagagtcataggaaactttccgtgaggtgggaccttatgttaaaaatcttataaaacttgtatggattgcggtattcctgaggaattttataggattcaatagttttcaagtttcaaaggatcatatagaaaaaagatgaatcttaaaaagaatcctatgttttccgttcaaattaaaggggcacgtattgttttgctggggtagtatcgttctgcaagaacaatgatggtgaggaaggagaaggatgactccgttttcaagtagtagaaaaataaaaaaaaatagaaataaaaaaaatctctctcacatcagatttggtggttgtagcaatttggactcatcctttccccttgccaaattttcgtaattggttactatacttgttttttaatataggacattgtcaacttttattcaaatttgactaataatatttattcaatcacttaattaataagtaactaaactggaaaagtatcactaaatttgccatcaaaagtattataaatgtgcattatatatttgtttatttgcataaatatttcaaagagaattaatcaaatgaattaaaaaatcaacttgcattatatgttaaaaacggaggtagtatcatttagagaaaaaaaatgtatagtatttcaattacaagtacaaccctggaaagtaaggaggggtaaatttacgaatacttgtttgagtagtcttacctctaaaacaaaatatttacattttccaattaagtaaactagtagagcattaatctaagtctttcaaacaatagtactatccaagaagttcacccacaactttttacagtaacacatcgtcctaaatgtctttcatttactgcacagacacatctttcatttacccctcgaatatttccagcaatcgagcctcaaggtgctcaacattgaacctcgcagacttttgcttcttgtccgagtagctctccaagtacattcggtacaatgggataaccttctgggtgatcttctcacgcagcttctgtcgaatcacaggatccgtgaccttccatgtcttctgcacattgtaggtcatctcaaaacgagaattgaacttatcgaacaattgctggggccataaaattttaggaattcgagttattatgaatgatgacatcacaggtgtccaagaagcttcgacatagcttgccaagaactgatcaagttggacatggcgttgcaagcaccagctttctcctagaatcagcttcagatcagtataattgttagcttgctcaagcacgaagtttatattgttcagaaggaacaccagttgctgcccttggagtgccaaactcctagagttcatgtccaacataaactccaaggatgagatcagttgagtcactacttgaccaaatttatctggattatcgtttagcatcatatggactttgtccttttgttcaaccagcaaccgcataagacccataatatgctgtgtaacatgatggacacccgtgttagaaatgaccaaatgttgtgacctgagcaaaccatttagttcaaccaacagcacaagaaaaactgctgacaatccatttgtaagcctttcaatttccattaaaatgggacccttagtttgacccaagaacaaatctaagatttccatcttggcatactccaatgcctggaacataatcaacagattgaccattttggatggaaaatgcttaactgatgcatgagtatccctgcaggaaggatcatttggacccacctgaatgcagattgcattagcatagttaagcagcttcatgactgattccttagcgattgcagagaagtagtccacctttagtgaactgaatgttccatggtctttctgattcaactgcgttcgcatctcatctagaacactaaagacagtccgcattgtcgatgtccagaccttcaatagcaattctgtggattcctccatgtggttacccaaaattttatcaatgtcaagaatttcaatgtacctgttccatattagtcaagatcacaaacgaaataaagtttacaaaacgtataaataatcaagttaaagaaataggtagtacaatttaattactgtatttgcctaggtacaattatttggggctgcaagaacttgtgcaggacaaacgattgctgcaatcaatcagctagcagaaacaaaaagatcaagcaaccgatcaacagaaatactgaatcaataaatatacgaacctgaccagatgctcactgtgttgatcgaaagctcctcggagcatctgttcgtgtccgaccccaatcatgaaatcagcaatcttgttgaggatggacactgacttgaggtcaatgtgactggccgtaactgacgaagcttggccacttcgcactgttctctcctcactgagtgccatgtaatatccgtcaaagctcacaccgtttgggccgctgctaccgccggagcaggagcgagaggtactcatccatgaggctgacgaggcagagccagaaccgtcgccgcctccgcggcagctggacctcgcgagctcccagatagatgtaggtgtgcaaccgagataacttgccagagcgtcaggtttccagatcttgaggtggcacaactccactgcaagggagcccatggccgtgacgaggagggattttgcgcggttgtgcagatcaccgtacgccaagacggggtgctccaacatctgcagcaggttcttggcggcggcgaagtagtcgtcgagccgtcgccggtggtcccggaagaactccgttgtttcggggttcttgcagattccgaagacgattgatctctcgatgtcttggaggaataagcgcagcgtctgctcctgctcgcgcgtcgccgccgccgcagacacctcttcgctaaattttcacgcgcagttgatttcagtgtttctagaacgtagtaatctgcagttttgcacgttggagttaggatcacgggaaaacctgctgtgctgcggcggcagatgggaggaggaggaaccatggaagcatggcgagaaggcgccgagaagagcggctccatggacgcggcgctccagatcgcagcggggggccgccgcgccgagcccgccaagatcatcagggaatacatggtagtcgagtcgtcggtggtcttgctgcgctggagaaccgcgtgacgaggctcgttcggctccccggcgccggctggtcgccgcggcgaggcctcgcctggttttcgcgtccgttgacatgtcaatctctcatgatctcatcgagcccagccttggtgatttttatttctgttacttgcacaagctgaatgcttccaccatagtttagccgtttagcacctactccgtccatttcatattatataagtcacttttatagtcggccatatgggccgtccgacacagcatggtctaggcccgcctgggccgaggttaattgggctagcacggcccaaccgacatgccgggccatgctgtgccagcccacgtgctgcacacatggcccagtcacggcccaatacgactccagccgtgctaggccggcccgaaggcacgacagtatatcgtgcttctccatacaataagtctaattttcatccctaaactctatgggctatgttcatatagctggaaaataagtttattttgtattcctcttttatttgggccatgccttctatggttatttaagtatatttttcgtccctatactattttcttctatcgtgccataccgggccggcccaccatgctgagggtgtagcctaggcacgccccgactgtcgggccgggtcagcacgggcgcgaccccagtcaggccgtgtcatgcttgggccgggccaaaatggcgtgccttgggataggccacggatctcgggccatatggccatctatagtcactttgatttttttttcccagttaatttttttaagtttaactaattttgtagaaaaaaactagtaacatccacaatataaaattaggttcaataaatgtaacatgaatatgttttaatagtatatatatggacctgcacaccaggaagggagagatgtttttttggcgaaaatgggggatgaaatttctcaatgattgtaccctttcttgatgggaggtgattttaacatatacatatatagctcagataaatctaatgggattgtagatgagagaaggatggaaatgtttaataagttcatcaatgatcatagtcttcaagagtttcatagggttggtggcaagtttacctggacaaataaacaaaattgtccagttatggtggtccttgacagagtctttgcttctaattcatgggataaaaaaaaatccactcaccttagtttgttctttattaagggtggggtctgatcaccgtcccattttgctggacaccagagaggaagacagatgcaaaagcaattcttttagatatgatatgggctggttccaacaatagggttttagggatcagctgaaggggtgctggcctatgagacttcagaaaggggttttagattactggcatctcctgatgccttgcatgaggagatggttaagagggtggggtgccaacatgttgagtgatacaaaaaagagaagaaaaaagattgagcagagactgattgaaattgattcaaaggctgatgaaagggatctatttgaacaggaatggatagaaaggtatgatctggaaaaaagaagtagagaagatttatttctaggaggagatttagtggcagttaagatgggggagagaaatggatcttacaggggatgctaacacactgttctttcatggggtggctaatgggagaaaaaaaggaagaaacatttttttttcacttcagaatggggaagatataatttctgagttctctcaaattcagaaacatatatgactattataagaatctgtttggaagggaaggatgcaggaatgtgcatttgagtgaacatgtatgggagacgggactgaaactttcggaggaggagaaaacaaacatgataagacctttcacaatgcaggaggttgatgaagtgattaagggaactaggggcgaacgcgcgcgttgcgcgcagcacttgtttggcagtgctggacagaactgaatgtgcagccactatgttgtatagtatgttgctagcgaaaggatgatggcctacctgcgactgcgcagacaattaggagagaggtgcatgggctttatgggcctgcgagtatggacatagaggctgtatatgggctttttaggtttctgttttgggatgccctatttctgccttttttgtacggctgatattcattcgttccattgttctcatcggaagttccgctgcctttgctccgctgtttggtggtgactggtgcgtgcaccgatgcgtgtagatccgaaggatttttgttgctggagcgtgatctagggcagttgaaggtggaggttaggctgcgattttggggaacgtacagggaggagtggaatctggggtgtcgcatcaccgcgtcaaggtttgtaaggtttttcactgccagtgaatgggatgataggatcgtttggtgttttcatgtagtttatttgcaacataatgtctcggtatgtagtatggctgatgtgtgtgttttttttaatttatttcatcgactgtagagagcaacttggattcacatagctctagcgctatggtactgactgtagcaacactagtgcgatgcgagtattagaaaaatgtaaatgcatttaaccaatcctatatccttttgtttaagtcacaagatggtgcgaagttgtttggtactaaggaggggtcagttccatacacaaaagattgccttcttagatgtagcaatgttgagtgataagtttgcactcaatagcagaggaaagattgaaggcatatggttttaaaatgtaatccggaactgtggctgggttataaatggctagatagatgttggtattttataagaagtgtttgttgatatgattggctatgtcttgtatgggctattgaattttatttatctatgatatcattgccggtagaatggagaatgcttcagttgttaatgctgatgtggagtggcgcgatgagtacggcatagacactgaagattggatgtccctgagcatgcgagccacccaacgaaaatggagagtctggtgtcatcgttctgcgatgcacaaacctataggtttgatgcagagaaaaaaaagaatattgcatttgtgggtttgcacgcagcatagaatcaatcccaagatataaatatcttaagctgaagtatgaaactgctgatggggttcgaatcaaattgttcatgctggagctagaagcatgtttatatgctgaaccacagatgggccttggcaacgaaggttagactaccatcaaactgtgaagctaatgcatatctaaatcaattgttaatagatctgtttatgcttttagaagtaatctgttgaaattataggtgaagaccatgagctatacgaagatccggatgttgtaagagaagcctttgaaaggcaagctagactgcaacatattgcaagtattattgatttgttcatttgccagctgatttacatctgaaatttcgaaatgtgaatcta

SEQ ID NO: 59970 - DNA, 31941 bp, Oryza sativa
acatatgctaaaaagtcaacggcgtcaaacatttcgaaacggagggagtatatacgaagagacgaggtgaggtgaggtgaaacgaaatgatgatggaggtggtgtctaggtagtgtttgtgcgtgtatctacacgctccgacccccacgaaacgaaagggatcttctttgctcattacccatctttggatgcccagagtacataccatatgtgtcatctctgtcacgccagaacgctgtggagacgaaccttcatgtacaaaacaaacttattcgctctgaattgccgccctactttcttcttgctagggacacgagagtgggcgcgactgtggtagtatgcgtggatgggcgaatggcaaaaacgttgggttttgatttcaagtgtgccggtggtgggggtgagtctccgggaaggaattgggatgcgatggtgtattgtgctatacaaagttggcgatcgatgccgccctgtcgtgttgacaagccccttggtcgttgagagagctagctatcctctggagtgcaagcatgcgttcacatccgacttgacgtcgtgccggccgggccctcctccccgccacggcaaagccagggattgaggtagcgagcgccgcgcggtgatatcggtgtgtggtaggtgcaacgcgcgcgaggccgtttccgccgttgtttttttttttcccaccggagcgcagtgtacgtacgcgcgcgggcgcctagctcccacgcgtcgggacgcggaggcgagcgaggcgcgggggcggggggacggtgggtggagcggtggaccgcgcgcggacgcggacgcgcgggcgggcggggcgggcccgtacgagcgattgccccgcgtgcgtatggccacgcacaggcccgacctccccacgtggaggcagtcgcgtcatttaagccacgggactatttgccgtcgcccagcgcagcgtgcgtgcacgcgccgtgcatgcatagtagggtaagcgagtgcatgggggcagctggtgaaccatctgtgtgccgtttcctttcggctttcggccggcgatccggtcgcactttgcgggcaccgattcgtcctacgttgggcagaagaaaggttcagatttcagccactacagctacaagtggtaaacttgcactactgtccgctgagaagcagggactgtagtggcgagaggagtggtggtagagtacaagctggtcagggagacttcatctccgtatggcgaaatttcatatcgcataagtctaacctgctccccgcctctcccatccgtaacaacgaggaggaatagagaaagccatcaccggtagccaataagtctaaccaacttgcgctgctaaaaggaagacggcgacaacgacggccggcgcgtagggcagtggcacatactcgcccagaggccacggcacgtgtgtcgccggcgcgacgcggccatgcaagtggcgcgacttatagggcgcgccacagtggccgcgtgaccgcggcgatcggctataacagtgagccggattaattgagatcgactatatatctatctctttctctctctcgatcagggtctctccggacaaccaaatcccggagacgttttgacggcgacgtcgctgccgtccgacgagccgggcggcgccggtgtgcgcggtatgatgccctattgccctgcatgaccgcatgcggcatgcttgtccagatctgagtggcggcaatcataacagtttcgcaacgccgcggccaaaaataggaccgggattgcaagatgcggagcaatcacggggacgtgcaatcattcggcgctcggcgacgcagtcacctgactgattgcgtgtaggaagcaatcacgagaaaccactataggccggcgcgggaaacgggagtgcaaattggtaagaggcctagaaggctaacaactaaaacaacggatcgagtaaaggaggctccactaatcctttccaacctgaaagtgttaagctgattctcccggggagaaaaaagtagtagttgaaacttgaaagcgttgcaagaaaaatccgggcgcataagacagaaaaaatgcaggtagggtgaattaaggtcttggatgaggacgactaaacgaaccatgagtgatgacagtaatttaattcaagcgataggactgtaaaatcagtaaatgacaaaccaggccataaatacatggaaaggataaggatggaccaatgaagcattaagaggggagcaaatgactttgtggacatcaaaatttggggggaatgttttgttccttcacatattattgtgcacttgaccatcggttttcgaacgtaaaatattatcggctttacctcgccaaaagaattttatttacgctgtggtaaaatttcgctagttgtcagtcatattcctatatgccagttcttccctccgtgccttatttctgacgatatcagtgaatctgtgattgatcttgaagggattatcctcctcgcaaagatttctcggaagccactatcatggcgcctctagagtggtgatatacttgctgtacacagagggcgagctagacgcctagaccgtgcgtcaaactcagcttttaaacggttaagcggagcgttttgcacaaaagtactttttatataaaagcttctttaaaaatcaaataaatatattttaaaatttataataattgatattttaaactccctgccgacgaatgattcgagtaaatttataataattaatattttaaactccctgccggcgaatgatttgagttgtttcgcatggcgctaaaactcccagctgaaacttagccgacgtacgaacatgttggggaatatataacacaaaataaacccaaataagccaatggggaatacgacttgttcggttattctcaactctgaagaaagacaaaccaaaaacacattgctcaaatatgttgggttatttaatagccacaaagttgctcgagtttatttcacttaacgaaattgttacaggcagtatattagtgcgtaatgatccgacaaggtcctaaaataggcaaataatcgaataagctaagtggtaatactgctactattgtgcagtacaacaaatgcaaccgatggaaaattcacctaccaacgaaaagccaaatgcacgggaaaacaatactggatctatccatatgactatgacagtaagttacgaccataagcaacaaaagactgcaagcagaaaaacaaacgagaacaatcttataaaagaaaatgaaagaacaccggtgctaaaaataaaagtaaaagttttgcagataaataacattgcataaaatccataaaaaaaatattcatgaaataataacagcaactcttcaaaaacgacgtgactggttgacaaagaaattggattaaataaagtaacaaaacctacaccaaaatcagaatataagatcaaattcgtcaggtgaattcggaaaagcggcatgctgtatccaaccgatgagcaataaatatctgcccgtatgccatcttatgacattgcatactgcaagcaaaaattgtgctcagattactcctggacacttatcaaatttgctttgtgcaaacaatggagcattatctaaaacatgaaatgtgagtaaattcgcaactcaaatataacgatttgctccatgctggaaccgcaaaataagagggcaagatgaagtgttctctcaacagtacaaaacatttgcttatgggcgttccgtctggtctcaacaacagtgcaccctaagcaagcatcagagaaatacatacatattttcattacttgatcagaaccaagtcatgaagggagtaacacaaacctcaagccaagaatcagtaactttaaacaggtactctgatactattcacaacatcaaagaggttaccaacttggttgttgttgaggtgtggattaaatcaccctgaggaacataaaaagcttgtgcacatggtgctaatctgccaataatccagatttaaattaacaaagcggttcattttaaattaaggtgcacactgaaaacaaaatgaacatgttaccattctaaaagcaaacctcatagcaccagtaacacttcctcaatcgtcattgcaagacatgattactaattcaccttatctaaagcttttccataatcttcagtacacatccaataccaggtttcaatacaataatcatctacggagtactaactagcccaatttgcacaattaattcatgtagtatataaatacaataaataatttaactatgtatttttcggttatattttttaaaaacaaattgctcctagtaaattcatctgacagatactacaacagcagattatgagaaatatattgtcactaattgagattaatgttaataacaactgggagcacaagataacataaatatttccttctcagtattatggttgtacagacttataaaagcaaacattaccagataactagcagctaagcctgaatacagctgcatcaagcaaacagctcaggaatcctcaattactcaggtcaactgccacgtaaacatacagaacattaaataggagtcatataagcacacttccagaacatgatataagcaaaagaaaagtttttaaaagatgtaaatgcatagcaagagattcctcagcctagtggttgatggctttctttgctctaagagattccagagccttctcgcgaagctcaatttcaagtttctgctgatccgattcgtctcttccattatatgaacctttcttcctagcatcagcatctgagtcagattcacgatccttctcaagatctgaagccatatcaacagtttcagcatgcttcagttttagtttgctggcctgacggtctgcctttctacggtgccgctcttcacgtctgcgccgtctttcctcttttcgcaacctcttctcttcctttctcctcctcttggactctttgtcatctgactccgaattagattcatcagaactgtcatcataacgtctcttatgcttacggctctttttatgctttcgcttctcagaatgggatctatgtttccctgattcttctgaacctgaactgccagaatcaatgttgttattaccgtgtgcttttctcttatcttttcgaaaaggacttccatcttctgactcagaatcatcatcgattttagcaggatacttcttagaagccataccgtcacgtaaaccctttattgcatcctcactgttcatgccatcctttgaataagagttgtgcattccaactctactaggagtgtgctgtttctgttgggaatcatcaggagaatcaaccgtgtgtttcgttcttctaccatcacgctcatcttctgatgactctgacagttgattgttctgtttcctccttgtctccttgccactagaacagaaaacagtgtcatgctagctgaggaaaaagaaatggtgcttctgacagttatagctagatgatacaaaatgaacagagtaggtattggtaattggtctattagttgacattacagtcattaggttctcaatctgtccgtaacaattgacaccactaccattatagtgtgtactttggtaagtaaaaacaatcagctaaatgctttcctaccaagatttaaaatggcaattccagtatgcatccatggactttgtctagaaataaccagtacatgaataagaaaagagaaacacactgaagtgctccaggcaaataggaaaagtgctacctcatgaacagtgctaagaaaaaatgctcataccaagaaaaaaaaatgaaagggggtaaaattaaagaaaactaagaagcaatttcatttgacaaccaaaatgcagcaaagaagcttacctatgttgtgatggagatttttctccagggctcaaatcatcatgtgctttctttagttccagatctgctgagaaatccttaatttttctgcgtgatgaatttgcttttcgtgcattctctctgaacataaacaaaagaaccgtttatatcaacaataagaaactcaaacaacccttttgaaagaagggataggtagaatggagactaccttgcacgactgccctcctcttctccactgctatctgttctgacctgactgggcaagtgcttatcagtgcccttcaaagaactgccaaaaaagatggccaagccttcagtatgcacatttgatcacaaatatgtggagaagaaatgaaagaaataaataaatcgatacggacgagtagatacctatcgcgtgtcgagttcctttctggcttgtttggagaattcaaggattttgtcagcttacgatgctcagaatccgatgaaagatggccactcacttctgtatcattcctattgtcatcgtgtgatctttctttgttcctgatgtaacagaagtaagagaacagcttttctgaataattgtactgaaagacaaacaaaatatgccatgcacattacctttgaagcacatctacatcgttactggagggaatgccgtttgttcctttttcaatgtctctactcaagctcctgcgagaatggattgggctcctatcgtgtggactggtactccttttaaacatcagcataaataatcgaatcagaaaataattacatgcaggaagactacaataggtgcacagcaaattcaattgctcggtacctccttcgttgtggagagggccgacggtttgcagaacgacttctgggtgaaattggcgatctcctagggcgttttggtgacctcaaccgcggagagcctcgaggagagggggatcttcgtcttcctggagatcgtgaccttggcctgcgtctacccggagatggagaccgtggcctacgtcttcctggtgaaggggaccgtggcctacgtcttcctggtgaaggggaccgtggcctacgtcgtccgggtgaaggggaccgtggcctacgtcgtccgggtgaaggggaccgaggcctacgtcttcctggagatggagaccaatgcctgtctagagatgacctgcgccgaggagatctatgacgtgcaggagatggtgatcttggtgcacgacctggagaccggcgatggtgtggagatggtgatctctgacgcacaaaaggtggagatttcctgcgaatatgagatctacgatgaggtgacggagatcgatgtcttggtactgaaggtgatcttctggaatacggtgatctccgcctcgacatcgaaggggtacttcttggagaacgctttcgtggagaaaaagaacgcctaggtgaaactgagcgccttgaagatcgttgctgtctcccaaaagaaatggaatttctggaaggagatggagaacgcctcctaggagaaacagatcgccgcctaccgcgaggcgacaaggagatgctcctggacctaaggctttccctgaaatgagaagtccaataacattgccatcacaaatttgttttggtggaatcagcttcttgccatgtacatgtgtaactagaacaacagtcaagtgaggtcatggatgaattacaggctcttaatccagtgttcagggtccaaaaagtttagtcctactaatttgctgcttaaaaaaagtgagtgcaagaaagagtgttgattctttttctatcaagggtttgtcagccttagaatttcaattttgatttttcataaaaagattcaacaaaaagaaatgctaaaaaaaaacagctggtcgtttagggtcaaaaacaaaatcaccaaatgatttgtgatcagggaaccttaaaaaaggcagaccaaaatgaaagaattgtgcacaaaaagtttcaaattattgtaacttcaagtgttccataaacaagaaaatactaactttagaatcatgttgaatccagaaaatctttatgagcatattctaaaattcaaatacaacgaagaacaaacaacggatcaaacttaatgcagaaaataatgacaagctaaacatatgtatgactggtaaatctttaagatggaaaataaaggcactccgtaacagaaaaagtggaatccaagatgtggttgttctctgagaatttgatctgatgtcacggatttaaaggtagttccagtttaagaaggtagaactaaccggctctttgttcttgagctatgcttagaatccagttctttttcctcctcagcatcagcacgatcaggacctaatctagaattaccggcatccccgtcctacagcagttttgaggtaaagaacgatatgaacccaaataatcggagaagctatctgaatgtcatcagaaacacaagaggttacaagacaacccgaaaattaacagcataacaaaattggtcagaatgaattagctcaccatcaatttttgtttctctagttcttgctcccttccatctttctcccgtttcttctggatctcctgagcaattctactttcctctgcctgcgcataagcccaaggaagttaatgggtaagcatcccctttaatgaaattaagccgcaataaagcacaaagatagtaacaacaccatgaggtataaagtgtattccagtttcacaggataaacggataaatcctaaaggctacaagaaattttgccgtttccataaatcacatataaaaagttatcaaaaacaaataggacctgtaagaacaaaaataataataatatgccacaaataggatcaattattattccatattccgtgacaaagaaaaacagaaagggtaatttaaaacttctagcttgcattctctccctcgagttcttaccaaaaaaaactttcattgtttttggtaagtcatatggattcatcaaaaacagatgatctaaaacatgcacccaaatatagcgataatgcagtatatacttatgttaacctttttctgctgaatctcagcttcctttgcatctaaaaactgttggggcaccccactagcattctgttgtgcactgagtaggaggctccacagctccttcatgaacttcactgtgttcttctccatgaatcctgtcagctgtatctgtatcttctttccatccgcctcctgccaaacaaacagaaattgaaaccaaaaccgtattagccccaccttctaatatcttgtacagaaacccacaaacgttaagcactaaacaaacacaaaacataattactggtttcttgagttttggttttgaccaaaaactagcctagagcagacaaaaaaaaattcaacaacatgcaaaaatgactgccgaaagaatatgctatctaaccataattaacggtacacacgacgctggtattgttttacaaatttgggaaaagtatccaataataatcgaaattcccaacattttacccaaaaagaccgttgtaggttttcaatttagttcctgaactccatgtataatttcagtataaatactgaactacaccatgtatttggttttctgtcatgttcagacataccctcatgtatgaggtttagcaattcaacgagcctatcttcgtcaaattcaaaagcagcctacgtaccacgcgcatagttcaacgagggcgtaacaaaccaacctccattgctcaagtcaaataaacaatatgtttaaaagcctcaccttctcttcgaggaggccgtagatgaagttgatgagcacttcgtcctcgaaccctaggagctcggtgacacgggtcgcgatccatggtttcatcacatccatcttcaccttagtcatgtccacctgtaaccaacccaacagagagaaaaaaaacaaacctaaatcagagtttgcgtcgaaacaaacagctggtagcacaaacgacacggcaaccagcaggtgcgtgagcagatgaagcacactgaccaggtgttcaagctcgggcgcgaacttctgcgtcttgagcagcttcgcctgcttgttggagaaacgggtgtcctgatcggccgacgtcccctgcgaaaaccccacggcgaatcagcgccgcctctcacagatccagcgagcgaggggctacacggcgaggtgctagatcggtacggaggatcggagctacttacccggaagaagccgcccgacatcttagcaggcgatgcagcggcctccgccgccgccgccgctttgagggggaagaggggtggctagggtttcggcaattcggcgtggtgtgggaagagttgaagacgacaagttgggggggtgtcgcaattgggaagaagggcgcaccggccacgggacgaagtgatgtagccgcctttagcccgatccagaacggtcactttttgacgtgggccgatgcctccggacaatgggcttctttcacaagcgacaccgccagcgggtagaattatacaaccagggcctagttttagttccaaactttttcttcaaacttccaatttttccatcatattaaattttttctacacacataaacttctaacttttccatcacattgttccaatttcaaccaaacttctaattttggcgtgaactaaacacaccgcaggtgaaacgccggacgttaccatgggagttcactacgagaacaataactaaaaataatactctctccgtttcaggttgtaagactttctagcattatccacattcatatactcccttcgtttcacaatgtaagtcattccagcatctctcatattcatattgctgtaatgacttatattgtgaaacggaggaagtagatgttaatgaatctagacacatgttataagactttctagcattgtccacactgctagaaagccttataacctgaaatagagggaatatgtaagatagtttaaacaacataagtttatataagttgatatgatttaaatttaaatagtcataagttttcgagccaactttcattatccatcttatttgaaataattttaaaaacaatatttttgttgttattaggcgataaaacatgaatatcattttatatgtgatttgtgtttttattgttttcaaaaaaaataaataagacaaacggttaaagttgaacttggaaactcataactacgaagagagtactcgaaaattcatgttgattggcgtgccatatattttatagtccgcatgtagcgtttttggcttatttgaaacttggttagtttccatgattttatttgacatttaagatttctatcatagacatagtgtacaaatattttcgtaagtattgaccatctgagtgagatttgggtgatggtcatacattcgtacgacatcacaaacaaggtactccctctgtttcaggttacaaagacgttttgactttggtcaaacttaaactatttcaagtttaactaaatttatagataaatatagaaatatttataatactaaattagtttcatcaaatcaatatatgaatatattttcataataaatttatctcgagttgaaaatgttactacttttttctacaaacttggtcaaacttaaatcagtttgactttgactaaagtcaaaacgtcttataacctgaaacggagagagtagtattttattgagtaaatttcacagaactataggtgctctgatcaaattattagaaaactacaaatttaacatgatgcatcacaaaactacagatttaacactaaattcatcacaaaactacagatttaaggtgaaatgttacaaaactacatatttagtaacaaagttatcacaaaactacatgtttaatgataatttaatcacaaaacttgaaaaattataagtccaacataacattagtgctcaaaatttaaaccctaaaatatgtagttttgtgataattttattattgaatttgtagttttgcgatacttagctttaaacttgtagttttgtgataaatttattattaaatctgtagttctatgctacatcatttaaaatctgtagtttttttgataatttgatcaaattatctgtaagttttatgaaatttactctattttatttttcaatttatcagtttttagaacacatgaaaaaatgattgtgttatactttctatgtttttttacgtgaaactttatttaggagatttcccatattctaatagaaatatgttctataaatcatcatatagaaatttaatatttgtctaaacaaaaaaaaaatctgaatattttgtcttgtctcttcacaatgttttacagcttcttcttttgaaaatgggtatgtcgttgaaccgcttgctagttaagccacatatgtgatgtaaaattcatacatttagtacttcaaacaatatattttatagcctcttaacaatattttaattttcggtgtggcatgtataatacattaaagtgagatttgttttaacataaacactcagaaaccctagtgtttctttttttcttctatccatattatttagtgtgtcttttgttgtaataccataattgaacaaaaacggttctatcgcttaacaaacccgcgataaaatatgtggcaatgtttgtttatatattgtcaaatatcattatttttcaattgttcattatctttttactcctagtgttctttatttttcatatattcacttgtttctcccataatggtagtattttttttacaaaaaataatttgttgcctttttttttctagcgacacaaaatgtgcaaatccccgcgtgcagaacgcgaagggtgagaatggcaccggcggccagggctatcgccaagtggactgtgcatgctttggcttaatttatttttgtttttttagataatggattttcattaatccggcctctatattcacgagggatatacataaccagaatgatacaagagcgcttagactcatgcctcattaaagaggagaacacacacaaaaaaaaagacgatcttgacacatccctatttcttgacatcctcaattgaaacgattatattcgatgagtggaggtcatgtagcttgtgcgttgtcgctacaaaactccgctggtgtcatcttcatccgcttcaagtgagttgatgccacgttccgctagtaagcccacctcatctgtcatcatccaatcagaactagccaaccagacgcgagctaaaggatccgcttccacttcactggattcctatgcctccgccacctacagggctgccaccgatgtcgaaatccacctctgcctctcaaacacccaggcctccgccgccgacgggatctgccttcgtctgatccgcctcctcctcaccgagatccttgcaccgacacttaggctgttgctgcctctagggcaacctccgccacagccgaggaggcgcttctgcctacgaaccacctccgtcggatccgccttctccatgcagagggctggttgtcgatgtcctccgctgccgcagttctctgtcgcacccaccgtcggcgtcctccgcagcgcccaccacctcccgaagaaacgccgccgccgacggctcaccgctacctgctacggcaccaatctcccgaccacctccgctaccgcccgcgccaggcgctagcccactaccgctgcccacagcccctactttctccggcgttagtgccgctagatctgggggcaaaccacatacctgactcgcccgtccatcgcaagtcccgtcggagtcctgccgtcgccttcctcgcagtcgcacgtcacactggcggcctgcttgggcggcagcaaggcaacaacgaggagatgataagtcgaggagatgaagagtcgggggagacgaggagatgatatgatctggtacatcggcttaatttaattttgtgatgtacggtgagctgttttgtttcctcaaatgaataatctagatttatctaccaatagagaactgacacgtggaccaatcattgccaacaaacacagcaagcatcagaatgataggtatgtacattacccaagttagcacatattttacagtgatgcctaattacatgaaacatgtgaatgtctcggacaaaatgtgtaacatgtgaaatactactatgataatttaatgtgcaagtttcctaaccacacacaaatgggattcaaaaacaaaatatttgcgatattttgacttatcaatccgctccatgttttctacccgatcaaccttctcattcatcattgatgagcttggtgaagtccgaattaaaattcaaggataggtgagggagtggagagaggagtatgcgggaagcatagtaagaacataccggtagagaaggtagttagcaagggcggagctgatagcaggggcaagttaccaaagacggaattgatacagcggatgggacaatgtagaggatcggtaaagatcacaggagaatgaaaagggaagtaacatgatccaacaagccttgtcggtttggggccgatgccacggatgatgctaggtggagaggcgtggcggagattggattgggtggagagaggaggtgatgatggtgaggggagggattgagaagaagaggagacacaatatatggtaaaaatatagagtaatctagacaattccatgaatccaatggtcacaaattcatacttacatgattttcaatagacatgtcctacccttgaataaacatatgtacattaccacgtatttacagtggtatcatattgttttttctcgctgggatgcaagaacatttagctagctagcacacagtgtcactcttcaaatcataacaaaaaaaattgtcctgcggtgtatccataatggtggatacaaatgctttatgcttatataccatgccaatataccgggcagtagagcgccagacccaacagtctagtcgtcgtcgtcccaatcggccggacggcgtcgctcatcgtcgtaccagcaaacgcagctgagcccgatgagcacctcgacgatgacattctctgccttgtgccggtcggcgaagtgcagcgtctgcaccatcagcacgcgcggccgcatgctgaaccgctgcgcccgctccatgctatgctcgtcgtgccaccgcaccgtgtcgtgcgccataggccccaaccaccgcagcatcctgtccaccgcgtccatcgacgccgccgccgcagcctcgtccactggctgccctctccagctctctctcagcttcgccttcacggccgtgcggatggtcacaggcagcatcttgtacagctcgtctctcttcgagagatccatcccggcgtccacctcgttgctgtggatcgttggccaaagttgcctgagcagcatctcggcgcacacgatcatgttcgcgtatcgcagctccatccccgagccgccaaccgtgctcgccgggggcttgatggactccgacgctgaaaaggcggtgtctttctgccgaaagatgggagccgagtgccggatcgccgcggccggtgacgccgcctgctgtaaggggccagacgtgcggcggagcgcccacgcgcgacctactgtcaaaagcggcaagcccggcacgtacgcaccgaatgttattgagatgcgcgcgagcacggcgagcaccgacttggccatgagcttggataccttgtgcgcggcgacactccagagcgagctctccatgagtcggcgcaccttctgccgctgcgagttgagctcgcgtatcagcttctcgccaggttcggggacctgcctcttggccgatggccccggctgcgccgggatcggcccgctatgcctcatccactgctccatccgccgctccgacgcctccagctcgctgagcgcgtccatctccgcgtacagcttcgccgtcgcagccacgtgccgctccatcttcctgaaccgcttcgccgcgcccctgtagaacccaaccgtcgcgtccagccgcgcgaggccgttcccgcgcttcgcctcggcgtagacgcggtcgaaatcgtgcaggaacggcgcgcccgcgcagcaccgcgccccgaggcgcgcggcagtgccggcggcatggtcgaggtccgccacgaactcgccgcacgcgagccggagcaggagcgactggtccgtggacgtgacgcgcgcgacgccctcggcgcgcagcgcgtccgcgcggagcctcctgacctccacgtcagacagcgagcggtggagcgacacgagccgcgacatggccgccgccgcctcgaacgccaggatcccgagacccgcctcctccctggcgccgccaccgaaccgcgcgcgcaggtcggcgagccatgacctcgcccccgcgggcatgccaaaacctcacacccgacacggcaccactttacttaccaagctcaagaacacaaggaaatactatcaaataacacccaacgtaacgagcagccgcgcagcagatcaaatatcatcagtatgaaatcgagacaggattgttcatgcggattacgcgtctaaacagcgaaggagcagaaccagcacgcgaccggacggtatccaagcaggattagccattaggagaagaaatacgtgtgctcggcagcgcgacccggagcgggtcaagagaggcgaagtcgtccacgcagccggcaaatcacgagaggccatgtgcacggtctacccgtccaccgagccagccgtccacttcgatctcccactggccaccaccaccactagctagacatgtcaacgtgccatggaattcctcccatcctctcgacccaaccgggcgggcgctgcacggccggagacttgcctcggggaagtcttgcatcgacggcgacgcctgtcgactgtcgtctcttcccgctgggacacgaccgatctacgtaggatcgcgagatgagaacgcgcgagcgtaaggcgccgctgctgcaacgccgctcgcttagtttccacatgtgtcgacatgtcgatcacctgtcgtgggtaattgcacgagagagatactggacgtccttctcattctcaatttctcactcgattaatacgtgtgttttgaacaggtagcaagacctccaataccatccttgttcccatctgaaacagtaattacataaaacggtacggtgcattaacgcgtgataaattaagtattagccatttttaaaaaaaatggattaatttaatttttttaaacaactttcgtatagaaacttttttaaaaaaatgtaccatttagcggtttgaaaaaaagcgtgcgcacggaaaataaataagaggggttgggaacgcacccgagtgcctgatctccacggatgtaatctatggctcattcattgctcaattacgatccgtttgctgcaaatgcacaccgcctgattctgctcagctatatcgtatacacgtatcccaaacaaggttacaccgtatacgtatgattagaaggtacgtatatacgtaaggctgtgtgcctgtgtccatcgatcgcctctacattgcgatcagatgccactactctgtagtattattgccacgtacatataggtacgcgtcgtgttgtcatcgatggcgcaatgcacgccaatgcgactagctaggaatatataagacggtgtactaaccaaccaatgctgctgccgtgctgcgtcattgcgaatgggtggaggagaccaaaggagactccgcgatcgagcaaattaaagctgcgtcacgtggaaaccacccgggcatacgcatgcaatgattatacaccatcgatcgatcgatcgatcactcgcacaaaaagaagttaaaagtgccgcccacttttgaccgcaccactgtccaatgcacgtaccgcgcgcggcgcgacgctagggcatgtaccatatctaaacacgactccctaaatctataactaatataaatatttaaattttttctatcgtcacaagtcggacgaagggtgccttcgtccctcgcggtgcgccttcgtccgcagcccctgaatcccaatccctctcagaattggatacaagagaaacaatttccaaaatcggcacaaccaaatcactcagctacaataatcacaaaatcacaaaataaacatccaagaagaactacaatatacatcacaatcacaaaactacatcacaaaatttcactcgcctgccgccggatccaaccttgaccgtcgccactgccgccctcagccgtcgccacgatatccatccatggccgtcgccaccgccaccggagggagaagagaggcggcggaggagggagcctccgccgctggatccgcccgctgccgccggatccgctcgcggctgccgccgccgccgccaccgccgccggaggaaggcgagagggggcggagggagccgccgccgctggatcgaccggcgcattaggtggcggcggggaggatggcgaggcggcgcagctccggagcctttcctcccgctggatctggtggtgggagggcacctctgggcggccgccgctcttcccactactgccgcggaggggagggcgcagccatcgctgccgatgctgcctcctgccgccgctgggccgcaccgtctccacctgccgccgccacccctcttgcgccgccgcctgccgcctcggctacgagagagaggagagcgagagagaagaccgagaggaggagggcgccgtgcgagggggaggggaagcggcgcactggtgaggggagaggggagggcgtcgctggctgcgacggcagtggagaaaacaccgagaaagaggaaaatgaagggaggagagagagaggataagggaagtcgggaaaaacgagaagatgaggagatggaaggatcgaggcgccgcttgctccgcttgctcgctcggggataaggattaggtctggcgggccttatatcttttttttaaaaaaaatgagcactctgtatttgagaaaaaaacagcacaagtatgccatataaccggcacatatagagatttatagagttggtttttaatttttgttcggttttaagtctaatgggcctttcttttataacttttttatttctataagaaatatattttttaaagggctcatatcataaaaactaaatcctaacgatctaatattttttatatttttgataattttagtttacccgttgcaacacacaagcatctatttattaaaaaattttaaataataaaattttcttgacctgttcttgtccgctctttttttattatgttttttttttattttttcccctcaccatctaatcttctttcatttctttttaatgtctacttattaatatttgacctcaaatacaatttgtaaataaaaaacaatactcactctcacaaaattaataagactgttttttacgatttgttgaactccacacataggtaacaatacacaagtatattcccactattgcaaagtgggtatagtttaactggataggtttcttgtggtggaaccagtcaatctggattcaaatctttgatttgacacgggtgctcgaggcgttcatggttacttcgtcaatctcaatactcgtgttgtgagcgcgtttgcactttgtgtttctaaatatatatatatatatatatatatatatatatatatatatatatatatatatatatatattctcgcaattcaaagtacattgagtacaaaaattccactcatgttctacataaaaaataaatatttttgttcatgataccaattttcatctgtcgccttttcggcaaagacaatcatattattcgtccatccattttctcccgtgctacaaatcatccaaactaaacatcatttctacaaatatagagcagattatttatctaaaagcaaacaatttttttgagtagattagttgtctaaaccaaacaacactattttcactatacacactacgtaatcacccagtgcaacgcacgagtatttttgctagtatcatctataaattatgagatgaggcgagaagagaaaagagagaataagtcacctctcatacaagcatcaatctctttacaaacttaaggaaatagaaaaaaaaaggttgattggatgagagtggataaaataaaataattatgttacattagggctagtgtattaaatgcgatgtggtgtatgagatggccgctaataaattaggtggtgtttggatccagagactaaactttagtccttgtcacatcggatgtttggacactaatttggagtattaaacatatactaataataaaaataattgcataaatgagagctaattcgcgagacgaattttttaagcctaagtaatccataattagcaaatgtttactgtagcatcacataggctaattatgaattaattaggctcaatagattcgtctcgtgaattagtccaagattatagaatgggtttttgtaattagtctatgtttaatactccaaattaacgtccctacatccgatgtgacagggtctaaaaattttagccccatccaaatagggtcttagttgatgatgtggataatattttaaagaggaacttgtaaaccatcgccgggaagacgccatcgacgacatggatgacagatggggagggagccacctagattcgcgccgatgcagctaaggatgctcattgacggtcgaagaagaagagcaggcgatgacggctagggaggaagccgccttgatccacattggcgttaacggctagagacgagcgctgacggccgaagaaggagaggatgcggcggctggggagggacccacagatctgtgccgacaacgacagttagagagggagctgtctcaattcgtgctaacgatggtgccggggacgcgcaccggctgctgaagtaaaggatgtggcaaagaggacaaagccgctcagatccgcactgacgacgacggctaagagcaaggctaataatacagccagctgctgacggtatagatctttatagcctatctctcagctcactcatatagtgattaactcttcctataaatatatggttcacctgtctgtctcacatatttttattttggttcttgtgtctaaggcggctgtaagtttacaacccatttcttatctctctcctctcctcttttatctacatcagcatttagccttcttgcagccctctattattcttgctctaaggcggaagccgcctcgattcgtgcggacgatgacggccggggggaagcctcaatccacgccgattacgttgatcgtgcctggtttggagtctttcgtctgtcgtgctagttttaggtcaaggtcaattgcccgtttgtattgccagagtggagcgcttggagacgagcacactgcgagaccgttgcaactcgccaaggagttttggtcgcaacgtcgtgtacaaaaagagagtcaatatagtaagacaagattagtttcttgatcatgattagggcatggggcccaaaccattggaggagaaaagaagataaatgggagctatgtgggtttttctttccctttactttttcatgaggaaagcccttcgtacaaaacaaaagcttgacaagggtccttcatagggtgtattcaattcacaccaaaattagaagtttagttaaaattgaaacgatgtgacggaaaagttggaagtctgtgtgtgtagaaaaattttgatgtgatggaaaaattgaaagtttgaagaaaaattttgcaactaaacacggcctggtatattgtacgcgcctactgaacctgtgggccaaaaggactgcttcattgcatgggcctttatggccagattgaccacggcgtaatgaaattgggcaaagcagagcatatacaactgcacgaccaccgtaacgtggatgatgatagccatcatgatgcgacgataatagttgtgaggaccatattagacgataatgtactcttgctgtgcatgattatacgcttgggttcaataacgaatgttggtgttatctgtatttggctgtagccctacttcatttgataatctgtccgttcggcaccattattatcgtttgataaggcgtgagcggaggaccattaagctcgctcctgtatcatcatgtgatgatgtccctaatactcgacgaaagcgctgcaaaaagaaaaatccgatgaaaaattaggctgcttttgagagttgaacaaagaaaaaaaacatcatgtttttacgcgcacacttacctaactactaaaatatgtattttttaaagtgaagttgtggattagcctaaaaccagctctacttttattttagttgaaggtgaaacggtttggttggactacaagagtgatacagctagagctagagttgtgctagataaaccattggtaattttcaccgactcaaccaataaaagttacagcaccgtgattctgtgaaggagcagtaacctgcagtcgtgaccggagcagcaagatcgcagccgccgaccgcgagtgacggcgagggctttttccccgtgacctcacctgatgagcgtgcggagcagaggcagcacagcagagacgacgagtcggacatgacacgttcaggctcatttccacccgtcacgggcaaatcgtggcgcccacggaaggaaaagggaaaaaaaagaaaagaaaagagaaaggaaacgaggaaaaagaaaaaggcgaaaggggagaaggcccccgtacatctcacgctcagtcgctcacttgcttacatatctctcgctcacttgcttgcttgcttacgtctctctcgcacactcccactattctcctgctcctcctccctgatcttccctctctcgctgccgctcctcttctcgccggccgcctcagcctgcggcgagctcttcgtccagccagtgcacccgaggtacgcgccgtgctgcacgcgtcgccccccgcggggtttcgttcgccgtcgctcgattttggttctcgcgtacgatttccatccctttttcgagctgccgggctgatgaagggatctgggggtggtggtggctcctcgctgctcttgggtttatcttgtggtttccggcattactcgtgcttgatctgcgtggctggagctggattcggggagtgggaaggggatcttggggtggatggcgtttgagcttaggcatttcttcccctggccgaatcgttgcggtttttggagtcaccatgggaaattggggcgtaattaagcaaggcttttgtggataaatgattttaatctagtaattttgagctatattcctctgcaagttttggagctcactcctatgtttttttaaaaaaagaaaaattaccctgtatttttcctggtgatctcctcctccgtcccgtactgcaattaactatgcttggatgattagatccttactgcgtgtaatttctcgtccaggagcttaggccggatcctgggatccgtaggagaaaccttgctcgggttccggagaatgtgaccggagcaaccgcggcttcaaatcagaaaaggctacagcaggggagcaacaggggcggtggtggcgcgcggcagcagcagcaccaggccggccaatggcgcagttgccatcaatgctgccgcgccggcggttggctcggcgccggcggaggtggccagattccactcccaaccaccacaacaggatagggtatatggctctatatgctctgtgttctttctcatggaataacttattatgctttaacttcaatcttttgtgttgcttttttggtacgtggattagtacgtgcaattgctaggccttggcgaccttagatgggcacagacctttttcgtagtactgagtacgaactgtactggcctggtggtggttgcaactttgcaattggggcatctgtaccccccaaataatttttctacccccaaataattagggtttagtatgcattaactacttgctttattatgtgaacaatttgtttaattagcctttactttatgttagttggtgttgaattgcatgcactttgcaagtttccttcgctctgtaatctttgcctagaccccacaacattttctctgaatagcatcgtatggaccgttttgtcaacctcttttttcacatatactatagacatagctcatggatcttgccttagatatgcatagagttgaaattgggagttgggagcaaaatatcttttctctttggctgtattggatgatacaagtataaactcactgtagcattctatgttatttggtcgtttgaggacaaattgaggttcctgccaattacatggtatgatgaaaacattgtctaacttttgttaaccacacacttttatgcttatttgttgttacatcaagttcactgtaagtgttgtttccatggttaagaattagctagtaatattctttgtctatacagatcataaaaagtggagaaaagttaaattgcttttgaaattatagccttcacacagattagcacgctatttcttaactcttattcattactgaagttgactttagtatcttcataaaaatcaaactggatgacttttatttctgtttcttgcaacaactaataattttagatgttctaatacatgtctctctacatttaacagcagagtagatgggctggctgtttttctgccttgtcatgttttggatcacagaagggtggaaaacgaatagttcctgcagcacgtatacctgatggcaatgcgtcaactagtcgtggaaatgcacaccaatctggtagcaattccaaccaaaatgtggctctgaatttatctcttcttgctccaccatcttctccggcgtccttctcaaattctgcaattccttcaactgcccagtcacctaatcgcttcttgtcaatatctgcaaactctcctggtgggccaacatctaatatgttcgctgttgggccgtatgctaacgagcctcagcttgtctcacctccagtcttctcaacttacacaactgagccttccacagcaccactgacccctccacctgaactaactcatgcaactactccctcctctccagatgttccatatgctcggtttcttttttcagctatggatcttaaaactgctggcaaggatcacaacatgccgtacttatctacagcatattccggaggttcaggactccaggcatcttatccgctttacccagaaagcccttctagcagcctcatatcgcctgcttcagcaactccaaggactggtctttcatcacctatccctgagcaagaggtgcctactgcacattggaagacatctaggtccgcctgtgacacaccatattccagggcttcaccaatacctgagcaagaggtccctacggcacagtggaagacgtctaggtctgcctgtgacacaccatattccaggaattcaccgtccaatatttttgggcttgattcagctgcttctagaaactacatgttagataataacttctttcggccagctgcatctgcccagttctacctggatcaggctcagcagtcatttccatataataatggaggaaggattagcgtctcaagggacaaacaagacgctgaggaggttgaagcatacagagcatcttttggatttagcgcagatgaaatcgttacaactcaagcttatgtggagataccagatgcgcttgatgagggattcagtatatctccatttggaaacaatgctcctgctaccgaggtagataaaccactcttcaatgtaaaagtgaccacaagcccaaagaaatctgcagaccagctttccaacgactctccacataatgtggtgcacttggacatattcaaaggtaattaccctgagctttgcttcaaccattcatttgtattttggcataatagaatcaagtgtttggtttatcttgtgaattgctggaataaacagttgtttcaacgcaacttgtaagcctgaagtctactgttttttatcttatcaccctgtgcccagattttgatgccacattcttcaatgctcctttgatgcaattttctgtttctacgcttttattgcaggaacaaaaggaggggatctatctgaggatgaaggggtcgtgaaagattgtcatcctttcagaaaggcgatggatgaaatatctctaaaacccatagaagtcaggaagaaagttcagcctggacagtcatcttcctcagatgcagaaatcgagtacagaagggctaggagtttaagagaagccaatggagttttgtcatggcgcagcaccctggcaaggcaactacagtaacgatgtggtaatacgcaggataagatagaatgcagagttcccttggcctagcgttcatcaatttgagctgttgttagaagtaaaatctttaggcgaagagtagcccgtactgtatttctggggatttctactgccagatcatgctctggatatgtgactatcagcctgtattctatttaaattccaagttcgtcttttgtagacactctgttcgttagctgaatcacagaatcagtgaaatggaagtgcattttgaggagagatggagaggttgctcggctcccaatccatttcctcctgtactgctgatcaattggataacttgatagctcagggcttctgcgtgatgggctgttctatgaattgtgacgggtccttggacagcatgtcgccgtggatcttacgactttgcagccttgcaggcttgcagcattgatgatgatggcaacggtgaactctgcaatagatcgtgaaagtgttattagcaagtcgggtaacgactaattagtcaagtgacaagccctttcagaagaccgcccccaaaaaaatccaaccaggccgtcgatcaaactgatcaaaagggccgccaagtcgccatatacacaaggaatccgattcatacaggccaaagctaaaacggacaaggaagagtcgcgcgacacggcgcggcgagaccgcgagacggctcacggcgagcgctcttcgatcctcattgcggcgcgttgtgcacctcgagcgcgcagtgcgactggaagaacgacaccagggaggccggctccgccaccggcgtcgacagcgccgggtgcagccacccaccaccgcagggcgcgggcgcgggcgacttcgcggcgtcatccgccgcctggcggtcaccgccgcacacgggcgaacgtgcggcggcgccgctactaccttctcgccaagctcctccctgcacgccgccctccctccttggcgcccctgccgccgccgccgcctggtcgtccggctcccacgccgccgacggcgacacgacgagcggggacagcagcggtatcggcatcctcccgtcgccccacgcgccggtgggcgacggcgtggacggcggctccagccgcagcgtcgcgggggcgtgcttctggagccggctcggcgggcgcttgaccttcttgtcggaggcggacggcttcatctccatcggccggcgcgcgcgcgcgtggactcgtgccccctccctccctctctctcctcccaaccgtggcgacgcctgctcgttctcggtggacttgtgcgggaaacatgcgtgcatgggggctggggggaggcgcgcgcgtggagcttataaacgagcggcgcgtggggagagggcggccgcgtttggcggacgagaggtggcgcgaggcgtggacggtcgtgagggattcgtgcgcggttcgttccggttttggcttttacacttcgctctcctcccttcacgcaacgcaagcgtagccgcttcccatcggagcaaagatgtgcgctgcaacgtgcgggggacggttgcaatatcaagtgcatttatttattatagagtttgcgtgacgtgtctgcgtggagagattgttgccagagcgtgttcatttttggcggcgccctatcgatgtttgaggttttttttccctttttttataggcatcgatgtttgagttgtttaagaatttaacagcaatttaacaatacttaatgagccgaattctttgtttgctgtcatgttgatgacaaacaagaaaattaaattggacagttatcttccatctcgttacccgctgcccttccattcgttacgtaacagagtgtacagtagcacaagcagagatccagagaggatggcttcctatcctaaagatcatggtgacgaggtgcgctgaggccgaggtgcgcaggtgggtcgcggagatcgggccatcggggtggagaacgtcgggaggaagctggtgaactcggccgagccgccgaaggtgacgctgagtaggctgatggagtaccgagtacggcgtaacgctggtggagcagcaggagaacgtgatactcgtaggtacgtactttcgctgagcagcccagaccttggtgttgccaacgaggaacgatgaagacaaattttcttttccaaaactgaaactaagaaaggagcaaaaatttggaacttcggcaaatctgacaggcgtttgtgaaagaaataagttcattataagtctctcttttttatgttgagtttgaatacatctttatctctttgaaccgtagtattagatataacacgtccctcaactttcaatgcaggatcacccaagatctttaagtagtatttgtacccagttttagctaacataacgagttgacaatgatcaaccaagccaagtcaacatggggcctacgtgagcctgacatgtcaatagcatagatgcctaatcttcttcatctctgcccatcttccctctcttccccatctctctctacatggcctccaggacgcgcggcgggtgggtgggcgtcgttctcgcaatgcacggaaatgtcgtcgatatccgctttcttcggcaagtgaacgaccacggtgaaagaccccagccccctttggagacctcgccttccacctccccatgcataaattcctcattcttgtagtacaacagaagcctgcatcggaaccgtagccaaaatcgaagcaaacaatggctggcaggatttactggcgacatgggaagggagaggagagaaggagaatgtcacagagctcggcgtcttcctcggcccgctagccccaccgcctagtgcccgtctccgccgctgtgggcacgttgcaatggccggtagaggaggggatgcggcagcggcgatcttgtctcctttcaagcggcgacgcccttgacacagagcttgagtagccgcatcgtctcctccatcctctctcttgagcggcatgagctcgacggcactgcctggtctccttttctcctccactgctgcgacgtctgtgtacctagcaggaccggctcttgccttcgtgaccgctaggggaggacaccgtcaccgtgttttgtctcccgttcacaccgttgacgcatctgacctcggctacctcccctacctcgatcgacagcggagacgcgaggccgtagctgtggcttggaacggataaggggaaaacggacgccacgagggggttggacgcgcgcacccagtggtggtgtctccgccgccaacgctgatgccctcatccacgttgcgcgttggtcaccactacccgcgcctgccgatgccctcctttcgcactgatgctgccgagagagagagaggaggaggggaaggagatgatgtgtcattgacatgtagagccatcattttttattttttatttaaagtgaaatgctgactcaaccgtcacgtcagccgaaacgggacattttgctgccctgggatattaagtacaccgtttttgcaaattgagagacacgttatatctggtattgcggttagggtcgaattttaaactcagcgacgaattggagggaccataagtgaacttattcatttgtgaaacaagtcgagaaatttaaatggctgcgaaggtccctcaacttatcatcgagttacaaaatcctcccccaaccgcaaaaccagatatcgggcgtccctcaactaacaaaaccattcactttaggtcgttcggtggttttgacctcggttttgtccgacgtggcggctgagtcagcatgggacccacgtgggccccacatgtcagcttggccacgtcagctcttctctctctctaacctcttctctgtcacgccctgaagttcctctttccagctttaaaatttgtaaaataaatcgtccgaagaaattgttctttttaacctagagctaattcctcaaattaataaatgcaaataataatcggaatcggcatgtggaatttttcttggattctacatgtcaaaatatgctaacaggatttttagtggaattttcagagccttggaaataattttaaccaattaaaatgagcaaagggcaatattaaatccctgggaaaatcctttttcctttttatcttttcttttccctcctttttccttttcttgggccgccggcccatttcttcccgcgccaacccgctcctccctcccactcccaaagttcacccggcctccctctccctctcgggcgctgacaggtggggcccacctgtcagtcctttccccttcctccagccgcccacgccggcaaccgccgaaaccgcgcacgccgccgccgtttcccgcccttcccgcgcccactcctccccactccgtgccgcgcccacgttgtcgccccctctccgctcctcccgctctcgcgcgcgccccgcaagggcggggttcggtttgaatcccccctccctctctctctctccacctcccacgtcgccggcgaaatcgggagcaccccggccacgtccgccactcccgagccccaataaagcttccccgcactcccctccacctttttcctctttccgccgctctctcccgtgccctccatcactccagcgccgctacacccatcgccgccgccctcctgccacgctccggccaccgctagccgtcgctagccaccgcgccgagcctcactgtcgacgccgccgcgttcaccatcccgtgagccggcgcgtccgccatccgcccggccaaatccaccgtcggggcccgcttctccccgcgcgccggtgagtaccaccattgccgccgccttcggccatggtttccgcccgccgtagaccacccctctccctctaatccttcccattttgttccctaggatgtcccggagatcgtccgcccgtcgccgtcgtcctcccgtcgctcgtcgtcgtcgttcgccgtcgtctccactcgcgctggccaacctcggtgagaaactccctctcctccctctttccctctctctcgtgtgcgccgctgttgtcacgcccagaaattcccgaatagaattccaagcagaatgtgcattaaaatccccgtccaggaccggccggggtacacaaacgacaatgttgacattcagatccacgtcttacaaacatcataaaagtcttacataaatgcagcggaagaaaagaaagacaacaggggctaagccttgactagaactgcagcgggaacaccactccacaggcatcctcgacggcacggacgaagcctactcctcagagacacctccatctgacacatactcgtactctggggttgggaaaaatagagcaagactgagtactacccactgtactcagcaagtcataccggaataggggtatgatgcagggaattatcacagaagagctagagtggttcatttgcataaagcgagcatttataaacagaagttgaaagatttaaacagttgtaataattaattaatattaactatccactgtccaacgctatcccacgttgcaacaggcccaaccatccacttaaactatccaaattcaaaagattacactagggtgaaactaatcacggtgaatctggttgaccgcccataaccgcgggcatggctattcgaatagttttactctgatcagaggtgtacaactgtacccacaagacacagccccacgacacgtttccgtgcgccgacatgccaccacgacataccggaaagaggccgtgacaggacccttcgcataaccccctctaaccaagcacaccacacctcaggtttcacccccactcctcgcaaggcagcgggcagtcccctctcgtgcctaggtgaatccggaagccgcataggccgtcgcagggcccatccaaactccatcacgcccacccttgcctggatgcgtcggctagaggaaagctacgctacaagctccagctgttgcccacgctggctagtggtaagtactataagtttcttccaggggcattccgcgaaccggttccttaactaccatgggt

SEQ ID NO: 59971 - DNA, 1128 bp, Oryza sativa
gatcgtaggggtggatccagcacgggggcggcgtgatcttgagcccccactactagcgtgaagactatgagattaccatatatagatgaaagggggactgtaattctatctagtttgctcagactctaatgctatttctttttgaatccgtcacttcatagcgcataagttcatattctgtgcaaacgtgagtacctcagttttggtgctcggaaacctgcagaagatgtagtcgccattaatgttagccaccataatttgaccaagaggattgattttaattatccgactcgtgtggacaatgtaaatgtcagcgctaagctagcctcacataactttagtggctagtgtcttcgggaaggcatgcaggcatgcacatgctgctgacccgccgtagtaagtcgagacgaggatgacggcgcggccgcccgagctgcgggagccggtggcgtagcactccaggccgccgtagccgtggacgacgtcgccggcctccccgcccgtgttctccgtcatgttcggcgggttctccaggcacgggtgcttctgcggcgacggcgccggcgagtacacttgccatctcccacggccgccgttattctccttggccaaggcgaggcgcccagcggcggcggccacgacggcggcgagggcgacgacgaggaggcagcggactagcatcctcgtgaatccggcggcggcgcgtcgcccgtggcgaattcagacgtgttcggtgatcggtgtgtgtgtgtgttaacgcttgagcccgttgattaatttgctgatgtgatccaggcactcgagatggagatatatataggtagcgggacggagggagctagcgagcggtgctgtgtgcacggaactccagaaccatagagcctgtttgatgtcattttcaaccataatatatttgtttcgcaaagttaaaaaacaatatctacgtttagtttattaccaaatttagtcaatacataagaaatcttgccattgccaaaattttagcattgacaaaacttgttaatgtttattttagttacaatctaaacatgcccatacatatatatttaacttttttttctattatgaagtcgcatcatttcggctatttttagcttttaatgattc

SEQ ID NO: 59972 - DNA, 1124 bp, Oryza sativa
cgtcccgtgctaatattttcattctaacgtatgagtagtgtataatttcggggaggaaagaatgcatgatttaatttctactttctagtaataggaaatctcagatgaagtcatgaaacctacatggttcatctagaacttgcgtggaattttaatcataagaaagttttggttttccatctccagttttcctctttctatgggggggggaaaaaaaaaaaaaccccagccccagccccaacccagctacgttatgtttgttccaattctcaccaaagcagcaaggtagtataaaacggcaatctttccgtgcaatgcaatgagctgaatgctttacacaagaatggaatttcggaacaagctctactaaggcctctagctcacctctcttcgcttccaatttcaaaaaccagcttcacaaaacccctccaaaatttatgtaattacctcccatctctccatactgccatatctaacgcaaagccccaaaagcacaagggctaaaatgcaaaaacaaatagcagtaaaattgtaaaaagcttggcagtacactaatcatgggtggccaggtctttccctttacaacccaaaatcaactcaaatcaaatctccactgcttaagagcttcaagcatcagcaaccttctcctcctcttcgcttggagaagcaagagcaggagagcagaagcagagtggagtttagctagcgagcgcaagccaccatgcgcgggccaccgcatgctgcggcggtgctcctcgtcgccgccgccgccctctgcctcggcggccgcgcggaggagctcgaggcgtcgtcgccggagttcaactacccggcggtgttcaacttcggcgactccaactccgacacgggagggcgcgtggccgccgggttcgagtccatcgcgcctccctacggctccaccttcttcggctccccctccggccggttctgcgacggccgcctcatcatcgacttcctcagtaagctcacctctcttgttctcacccatttccttgtagattcttcatgtgggtggcagtgcgtcgttcacattgcttgttgcaatcttattcccacatggtaaccgggggcatcggcgatgtggcttctgtatgcatttgatg

SEQ ID NO: 59973 - DNA, 13061 bp, Oryza sativa
atcatgagtaatctaagcataaaaaggggcagtcccaaatcctatgacataggacatcgtacgcaacttctggaacaaatcccttaacaaccaaacaagtactcaggcttgtaccccgcattttaaaaacaagtggaaaggaggaagttaaaacttttttccaattaatagcacaagtttttggattaattggaataaagttaaaaaatcaaagtaaaaggtaagtaaataaagtaaaccaagcttgcaagataagttgaaacagttgaaatcaaggtcacaaattttgtgcttttgaataactggttccaaaagaaataaaagaaagttataaaatcaacatgctaaatttattttattgcagcaagattaaataaaacaatgttgtaaaacttttgctggtaaatgagccattagtacagtaatagatgtacagtactaataacactggaataaatttcgaatgagaaccactaaaagagattatgaagtgcatgtgctattagtgtggtttaattaaaagagaaggggaggagaacagttctacttttccaatatttttagagggcttctatgggtaaccatttggcataacctagggtcaacttggctctgataccaacttgtcacgcccggaatttctatccaaaattccaaacgcttacatgtgtgtgaaccctcgtccaggaatcagccgaggcacacaataacaaattgataatagagtacaattattactctaattaataagcgaataaaatgtcattacagaggtagatagttcctctcaatcaataaagatctaagcagcggaaagataagataaacggcgcagacgactccactccacaagcagcttgaccagggctacacctaatcctccacaccatctgcatcactgtagaactcctcctctgatgaatgattgcaaggtgagtatatgacatactcagcaagccacgcagcaaatatgcaagtgcacaggataacaaaggatggcatagtagggtttcatttgcataaacagcatttaataaaaccgttaagtaataaataaacaatattaaaccaatgctatacaacataccctgttgcataggcccaaccattccgaacaaccatcccggctgcacagttctaactccaaaccaggaatataccattccaaaccaggagctaatcaaattattgccagttatagcatcttttattatgatgagaagtgtgagactaatcacgaaggacattgttagacccgcctataaccgcgggcacggctattcgaatagttttactctggccagaggtgtaccactgtacccacaagacacagccccacaacatgtcaccatgtgcctcaataccaccacggtacctcggaaaggagctgtgacagtacccctcgcacaacacaatccactacagcgcacctttcctggatcataatcacccccttataaacaaggcatggactccccagcgacccccgtgggcttatctccgccacttctcagtctggtgctccgcaatgaaccatgctatacaaaaggtaaagccgttgcccacgctggcttgtggttggcacgattaatgtttcacaaccgaaactcgtgaaccggtccttaattgtcatgagcacgactctcaaaaccatgtgctcacaacccactattatcaagttttagttggcaagtaattaattaaccaatcacgattgaccatcgtgaattatcattaagccatcattaaataatagtgagtcataagttatctcaataatgtgctaatgtttctaagcatggctaagcaatcatatctaatatctagctgaaccaatatataaagcccaactagtcaagttataataacccaaggtatcaaggaataaagtaatcaatgcaaacaggccataacaaaggaatagattcacaccacccagtgacgttcgaaaataaatgcacagttgaaataaatagagaatttaaatataggatcaacatgctcaaaggattgtttgggatctgtgtgacttgccttgctggccttggaactcctcaaattcttctcctgcgaaaacggactctccggaaacgtcggaatctaaacagaaaagagcaaaaacacaaaaacagcacataaacaagcatgaacagtacatgtggatatttttaacatgtaaatctcaattttagaaaaatttagagacttgaaccaactaaatccgagctaagatgaattagttatgaattttcaaagattaaaccggattaaagcatttatatggattttaattgaattatgacgcaataataaattatttttgaaaaggaaaaaggagttattgcgtcagcggctagggtttacggtggaccgggtgcacggcggcggctcacggaaacgaacggccgagatcgatcctatccaaaacggacggccgagatcgaacggtccatgaccgggccacggcggacggtcccgatgacgtcagcggtgacgtcatctccggcggcggctcgggagcacaagctcgccggcgaacgacggcgctacggcacaaacggagggcaccaggacgtagagggcgacgcggcgaactcaccggtgaccaaaacggcggcggaagatcaacggacggcgacggcgtcgaggaagaagcggcggcaaccttcggcttgatgacgacggcggtgctccggcgacctacggcgacggcgaaggggcggactaggacggcggcgacttagcgaccacgatggcgaccttcctgagcgacggctggagcggcggcgacgacggcggcgctaggctgcacgaggctagggcgctacagacgtcggcgagcgaaggcgagggtggcggcgggtagaggagacaccaggggtccttttataggggcaaggaggcggcggcgaaggcccacggcgaccggcgacacgaaggaaagtttagggttcggaggagagagaccgatccgaatcgacctcgaatccacggatttccaaacaatttagacgaagattccaaaagagaaaaggtagaggagatctcgggaaacatttcccctctattgatttcaccggagaaggaaagacgcggccgaatttggaaggagacggcggcacggctcggctagggttcgggcggcggcggccgaagaaagacgatggccctgacaggtgggacccacctgtcagcgggcggacgcgctcgcgcgggcggctgcggctgcggactgggccgacttgggccggggagagagagaaaaggttttgggccgactttcggcccaaagccaaaagagacttttaaaaacctttttcaatttaaattattcatgaaatgcaattccatttattaaaaatacttccttagctcaaataaatcccagaaaaatctaggaattatagaattaagcaaagtatttaatgaaattttatctggctccattttatattggaacttattaattaaaattagatcttctcttctaggcttttaaaataaattctaataattccaattaaacaacaatttatatattttggatttttagggtgtgacaaacctaccccccttaaacagaatctcatcctcgagattcggaagaactggcgaacagatgcggatgggctgacttcaattcatcttctcgttcccaagttgattcttcttctgagtgattactccattgaactttacaaaaacggataactcgatttcgggttcttccctcatcggtttccaaaatacggattggtttctcaacatatgtcagatccttttggatttctatctgttcataagctgcatcatcatgttcataagctgtgcctgttgagccaggacttgggcaagtgtgggattctctccattggtgttggtaatggtgttgttggggccattcccgttgctgggagtgagcaccatctggcatgggcaggagcacaagaagagaaaccggggaaaactacttaggacagagaattaatttaacttttattgatcttaagtgagtttcattattacaaaactgaagactctcacaccactaaactcaccaactacctaacactcgaaagcaaacaaacgcatgcacttacatcccaccactgatgtaaatcacatgcgagacacacacaaccaaacttaaaacaaacaaactaacacaacgatctaagacaacgacttgacaaggcattctagttcttccgagcatcggagttgattgaaggctcgttcggctcgtcttcatcatcttgagtagctccccaatcgacctttgaaggggtgcgcttcgattcttctccttcatcatcacttacattgacgaccggaggatccgctagggctggggtaacttctttctccaccacacggacctttggcgccaattggtagcgagggacaaatagagctctcttccttgcggtaagacgaatcctggccttctgctatggtgcttctcccttcaacgcggctagttccttctccaaacgatccactttgtcctctagcttgcaaatcttaccacgattccggtcttcacgatcttgagctgctaacacagtctccgcacgggtttcattcatagcccacagcatctcaaccaaatgctttgtggtagcatcattctcaattccttgagtctcaaggtagctgccacgaccacttccctatggttggcgaggatggtagcgatactcagtgtcggccaactgatcactatagcgatcgcggagctctcctatggcgatccttgccacctcctgacatgcatggatgtagtttcttcctccagcttcgaacatcactgaggggatatcttcactattactgttcaaggtgacgatcatgaggaatctgggcataaaaaggggcagtcccaaatcctatgacaaaggacatcgtacgcaactcctggacaaattcctcaacaccaaacaagtactcaggcttgtagcgcggcatctaaagacaagtgaaaggagggagttaagacatttatccaattaatagcacaagtttttggattaatttgaataaagttagaaaatcaaagtaaaaggtaagtaaattaaagtaaaccaagcttgcaagataagttgaaacagttggaaacaaggttacaaattttgtacttttgaataacaggtttaaaaagaaatgaaagaaagttataaaatcaacatgctaaatttattttattgcagcaagattaaataaaacaatattgtaaaacttttgctggtaaaataagccattagtacagtaatagatgtacagtactaataacactgaaataaattttgaatgagaaccattaaaagggattatgaagtgcatgtgccattagtttggtttaattaaaagagaaagagaggagaacagttctacttttccaatatttttttagagggcttctatgggtaaccatttggcataacctagggtcaaggaggctctgataccaacttgtcatgcccggaatttctatccaaaattccaaacgcttacatgtgtgtgaaccctcgtccaggaatcagccgaggcacacaataacaaattgataatagagtacaattattactctagttaataagcgaataaaatgtcattacagaggtagatagttcctctcaatcaataaagatctaagcagcggaaaaaaaaataaacggcgcagacggctccactccacaggcagcttgaccagggctacacctaatcctccacaccatcagcatcattgtagaactcttcctctgatgaatgattgcaaggtgagtatatgacatactcagcaagccacgcagcaaatatgcaagtgcacaggataacaaaggatggcatagtagggtttcatttgcaaaagcagcatttagcaaacatttgaaaaaacaaggcatggactccccagcgacccccgtgggcttatctccgccacttctcagtctggtgccccgcaatgaaccatgttatacaaaaagtaaagccgttgcccacgctggcttgtggttggcacggttaatgtttcacaaccgaaactcgtgaaccggtccttaattgccatgagcacgtctctcaaaaccatgtgctcacaacccaccattatctggttttagttgccatattaattaattaaccaatcacgattgaccatcgtgagctatcattaagccatcattaaataataatgagtcataagttatcccaatagtgtgctaatgtttctaagcatggctaagcaatcacatctaatatctagctgaaccaatatatagagctcaactagtcaagttataattacccaaggtatcaaggaataaagtaatcaagtacaaaagggccataacaaagaataggttaattccacccaatgacattcgaaaatagatgcaatagttgaatagaaacaatagctttaaataggattaacatgctcaaagggttgtttgggatctgtgtgacttgccttgctggccgtggaactcttcaaattcttctcctgcgaaaacggactctccggaaacgtcggaatctaatcagaaaagagcaaaatcaccaaaacagcacataaacaagcatgaacagtacatgtggatatttttaacatgtagatctcaattttagaaaaatttagagacttgaaccaactaaatccgagctaagatgaattagttatgaatttttgaatatttaatcggattaaaacacttatattgattttaattgaattatgacgcaataatgaattatttttgaaaaggaaaagagatttattgcgtcagcggctagggtttgcggtcgaccgggcgcacggcaacggttcacgggaacagacggctgagatcgatccatccaaaacggacggccgagatcgatcgggtctacggcggctcacggcggacggtcccgatgacgtcagcggtgacgtcaccaccggcagcagctcgggtggcgcatgctcgccggcgaatgacggcgcttcggcacgaacggagggcaccaacgggtagagggcgacgcggcgaactcaccggcgaccaaagaagcggcggaaaagcaacggacggcaccggcggcgagatcgaagcggcggagaagatcgggtcgacggcggcgacggtgctccggcggtctacagcgacggcgaaggggcggacgaggacggcggcgacttggcgaccacgatggcgatctccccgagcgacggcgacgactggaacggcggcggcgcacggctgaagcgacggcgacgacggcggcgctaggtcacacgacgctagggctctacggacgacgagaggcgaaggcgagggtggcggcgggtagaggagacaccggggatccttttaaaggggctaggaggcggcggcgaaggcccacggcgaccggcgacgcgaaggaaacttcgggttcgggagagagagaggaatccgattcgatctcaaatccatcgatttccaaaccgaaatagatgatgattcctaaagggaaaagatagaggagatcccgaagattgtttcccctcaatagatttcaccggagaaggaaaggggcggccgaatttggaaggcgacggcggcggcgcggcgctagggtttcgggcggcagcggccggaggttgacgacgacctgacaggcgggccccacctgtcagcgagcgagggcgcgcgcgagggcggctgcggctggactgggccgacttgggccaaggaggagagagagcggttttgggccgactttcagcccaaagccaaaagaggattttaaaaacctttttcaatttaaattatccatgaaatgcaattccatttattaaaaatacttccttagctcaaataaatcccagaaaaaatctagtaattatagaattaagcaaagtatttaataaaattttatctggccccattttatattggaatttattaattaaaattagatcttcttttctaggctttttaaaataaattctaataattccaattaaacaacaatttatatattttaggatttttagggtgtgacatggagtgagacataaaatatgtttcatttagatgaaaccttgttttcatgacagtttgtttcttgcatgtatatattacttgtggaaaaaaaataaaaccatgtaatatatgagctactttaatcatcaattaaatgtcatgttgcttatgtgtcaaccttttggaaacataaaaataatgcatcccattaggaatggccttcctagtagatttttattttggattgccctcgattttacaatattactgttggcaacttttttgacaagttgacaagcacgatcgcagcaccttaagccttgcggtgatcctagagtcgccaaccacctcgatctagcaaagagctaaacctagatgggttttgataattaaaccggctagcggagccgatttctaaatagctacccgtctcgtgggcaaaacggaaggttttcaggacaaacctacaaagagatgtcgcactctcgcagcggcggcggacggtttacggcgcaaaccgacaaagatggacaaactaagagaaaactaaaagcaatatgaaaaaacgattcgattgattgattgtagattggttttttacaatgaaccggccatgtcccttatgtaggggttggtcttgccctctacaggccctcctccacgtccaactcggggtagaaaccaaaggaaacccgaaacatgccttcccgagcaaggaaacctcgaaacccgacgaaacagagtcggactcggacttgccggtcagaccagccacacaacgccagtctgaccggccctcaaccggcagtctgaccgcccaacacacggcggtcagaccggcccactcggaggaaaccggtagacttccaaattttggcaatatttcctattttaatcctaggtgccaaatttgggtgtaaacacatgcccccctgcctttttgatgaacaacgtgaatctaaaagcatagaacatgtttttggtcttaggaagataactcaattaccggccgtagtacctcctaagtgtcttgccaaatgctcgggaagtatttcttcaagtatttcccgttgattgctcgctgaaaacgctccccttgaagtgtctccaaaaagtatgcgctccctcgaacaatgtcgcacactcgataaggaccctcccaactaggagaccacataccgaactccttggatcgagtacccaaaggcaaaattgtcttccaaaccaagtctccaacttgaaacaattttgctttcaccctcttgttgtacgccttggccaccctcttcttctctttctctatctcttccaatgccttcaagctgtcgcgtcccaaatcgactctaaaattcatcctcaaaattgtgcaaaagaataagtaaaattcaatgtgaaagcctccaacaattaaaatgtgcaaagataaaagtcaaatgaggcttggaggatttttgtatatttcctaaaagcctaaaatgcttaaacaaattttagtggaattttcagagcacaaataataattgaaaagaaatgaacaaagttgaaaaggttttataaaaagaaaaccctaaaagaagttcttttccccccccttccttcttgggccggctcggcccattccctccctctctctctctttccccccccggcccatcggcctccccgcgcgcgcgcgccgctgacaggcgggcccgcccgccactctcgctgacgggtggggcccacctgtcatcttcctcctcccgccgcgtccgtcgccgcccgtgccctagcgccgccgccgccgccgaatccgccgcatcccgccttccccgcgcgccttaatgaggggggaattattccccgcgtttccctctcccgattccccctcttttccctctctctctccctcggattcgctcggatttaatcccgcgaagttcgccggcgcatctatggcggccgagatctccgcgagcggtttcctctctccccggccgcgctctccccctcccgttgctatatattcgttgcccgagctccgctcttccgtttccgccgctcaccgctcgctctcgccgtcggaatcgtgctagcgccgtgctcctctctctccgccgtcgccgtcgaccttcggttcgccgccgccgtcgctccggtcttcctcccggctcggcgccacctccctcggcatcgccgcatcgccgtcgacctcgtccgcgcctccgtttcgctcgccgaccgccggagcaccgtcgccctcgtcatcccgagccgcgccgccgtcttcctccgctccgtccgccgtttccgccgccttcgccgtctcggggtgagccgtggaccgtccccttcgtttcccccttccctcctctctctcgggtgccactccgccgcgccgttggtcgccggcggcgaccatcggggcgcgggtgcgcgccgctcccgtcggccgcgccggcgaggccgccctcgggcgcgccctcgcggctgccaagtgggcccggccgtcagccgcccgcgcccgcgggtgcggctgacgcgcgggacccacggcgccgaccgccgccagccgcgtgcgcccaggccaccgtggaccgagcggctgacgcgtgggccccacttcccgtggacccggtccgcgcgcccgcccctaggctgacgcaataatccgtttattaattgaaaattaaatgaagaaattcgtaaatatccatttaaagagcatataaacttaaaatggccatatctttgccattttgaactcgtaattggaccgttcaagtctctaatttctccttaagatgtaaagaacccatttttgtgctttgtttctgctgttatgtggagttatttagtgttaaagcctttttcttttccgttggtcgtgtagacgctgcagcttcggaagatccgctcttcgtggaagtcgaagccgtcgattgggaaaacgagcaaggcaagacacatcatcttgatcatattgaatcccattttataaaattatgttgatttaaattattgcattatcgctttatttaaattcccgcgttatcactgttttacttagccatgcctatttacctttgttatgaccatattattattgtcattgttattattattaccttgttcaccctagatcaaacaaaaccccaactagtggacactctactcacgacaccactagtttaattctaggtagatgcttcgcaatttaattaggtaacattaggaggttttacaactttagactttgggaatgctcatatcatttggacactatggaattgttggtttatggtggaattggacatacacctctcttcccctttcaaaacccctaaaacctgttttcggtggggtttgggtgcatgccagttgtgggaagtagcaccccggccactataaggattaagctcgggcctctgttgcaaagcactaccgtacttccacatgtctaatgggtaaggcttagtttgtggctcagtctagtcataaacaaaagtacacggattggagatggatgaagtcgggcgtcgatggacattctccagggcaaatgaaggctacacgagctgcggcccggtagtcgagatgtcatacggcggagggttggtgcccaatgctaggggctcagttctgcctgcctgtcccgggtatcccggccgtaggtaggattgggtcggtactcttgtctaaggctaggatgggttggaaactatgtcacgtcttccgtccgtataccgtggtggtatgtggcacgtggcaacacgtgaggaagatgtgtcttgtgggtaaagatgtacacctctgatcagagtaaatctattcgaatagccgagccctcggatatgggcaagccgagcaatgtacccaagtcagtgttttaattcttaaaatttgctcaacaactaaaatatggaatggttggcctgggttggcttgggacgagctggaacccaggtcgggttgccagttcggtccgaatcatcgtaggccttgggttaaggcaggttcgtgagggttcacggccttgtttaataatattgtgtagttctaagatcgtgtttacaaaatagccctgagtaactaaatgtctttaaatgctgtttactgcaaccctaaccctttatgttataattcccttgtactcccttgcatttattctgcattcgtgggtgtgtcttgttgagtacggtggttgtactcagtcttgcttaattttcccaagcccagatgaggagttcctggaagatgaaggcttcggtgtctagctcgtgcctgccgtcaagcgcctgtggtcgtcgccctagtcttccgctgtttttcgttgtctttgtgtgctgggccgttgttgcccgtgtaataattatatttacgcttccgcttgttaaactctgaattgtatcaacttttggtgtaccttgcctcctgggacaaggaataatacacgcacgtcaggaacgcctgttgggtgatttccggtcgtgacacaagcgcttgtcgatgacttcatcaaggttgtctcccatcaacatgttgtaatcttcacttgacaaatcatcttgcttgatataacgaagagaaccaagatttacctccaccagtaaaacggcttcttgaccataaaccaactcaaaaggagtgactttagtggcaccatgtttggatatcctatgcgtccacaatgcttcagaaagcacctcatgccacctctttaggtattcctcaatcttcttctttaccaacttcaacaatgtcttattactcgactcggcttgtccattagcctccgtatgagtcatattcttcaaaggcatggcttcggcccacttggtgaagtaatccgtagcaactagcacgaacctatgcccctttgatgacaaaggataaatttgaccaataaaatccaaagcccatcctcggaacggctatggtttgattatagggttcaacacggcggcgggcgccaattgaacattgccgaaccatttacaagcctcgcatcctctataatatttgaagcaatcatcaatcatcttcggccaatagaaccccgctcttctaagc

SEQ ID NO: 59974 - DNA, 10870 bp, Oryza sativa
tttgtgcggtgttctacagctaaaaccacaaagtcgtgatgtcctgtagcaaaatttgcctaagaaaaagtatacgaagtacatatacggggaggagagattttttggatagatccaatcgaccaaccaaatttatctacgacagatctaatagccaaaataatgggtccatcaatttaactggaaatcaaaggttggatgtttttttttttgaaatttctaggattttttaatttagtgccacatggtgatatagtaatgtttggaggatgtccatgtggtggcttgagagagtttttaggaaagtatggacttttagtatataactaggaaaggtagcccgcgcacatacgtggtgttttcgctaataatttgtttgggattaatttttctctgttagttatgaatttcctatagttatccttgcaacatataaattctaaacttaaattacctacaattgagttggttcctatgtatcatttgtagcgtgcacatatcttttagaatatttttggcatattttatttttggagttccaaaactttaagtaacattattttcttgtatacaatagttgtcattgtggatttaaggatatattaactaaagatattttgtgttgaaaaatatggttaatagcattgtttcatataataaaaagattaaagtgcactggcggtcatttaactttgcgcagctgtgtcaagccggcccccaaactcgcaaaacgggcatttaggtgcctaatcactgttcgggtttcactctagtccaaccgggcgctgggacatgcatcattttgcagtaagccccttgactgttcgtgtggctctctcatttctccccccattagcccacgactgttcgtgttcctcggcggcggagacgaatccgaggcgaggacggtggagctcagagaagcggagtgcgggttgaagccagccacgctggagttgtccgcagcggctggttagaaggatgttgccgcgattgcgagggaaaacagaagggccaccgtcatacggtgagtccatcttccctttctacttgttatttgctaggtttgtggatagtcgtcatagttgcagggcttcaatttgacgaaggaatggatcttagggtgtggattgttgtttatgatgtgatttgttagggttctccatcttctgatgaactgtgttaattcctgtcgataatgtaggtcctgatagtgatgcattcaccattgagttgcaccatggaggtttttttgctgggtgcggtcatcttaggtcttatgttgatgaaaaaattgactggtttgactggattgattgtgatacatggtctgccttatggtttgaggatatgtttgaacaactgggctacgatagtgtgacagacattaagttttattggttgtttaccagggaaagatcttagtgatgggctgagggtaattgcaacagatgaagatactaatgtaatggtcagtgtagttcgcaaggtgagaaatctggttgtgtatgttgatcatataggcagtatgaacagtgttgactgggatgactatgttgctaatcctgttaattagttgcctaaggttttaagtccacagaaagttgtgtatgagaaaaacccagcacaaaagagtagaccaagctggaccaggccaacaacctgatggagatgaacagcaagaatctgatggagatgaacaacaagaacctgatggagatgaacagcaggaattgtttgacagtgactatgatcttagtgatggagatgatgacttattagaggatgctgttaacttggatatgccaaaggttagaggcaacaagaaggcaaagcgaagccatttgaaggctattgagatcagagtacctactgcagtagatgatgatgcagacacagaggatgatgccctggatcttcctgagtctgatggtgaaggagaagagagaatgagattcaattcttggaaccaagaggacatgaacaacccagctttctctgttgggcttgtctttccttcagttgagagtgtgaggaaagcaattacagagtactctgttaggaacagagtggaaatcaagcttcctaggaatgataagaaaagagtaagggctcactgtacagatggttgcccctggaatctatatgcatcttgggatagcagagtgaattcttttgtggtgaagacatattatggaaaacataaatgccagaaagagtgggttctgaggagatgcacctctagatggctggcagacaagtacatagattctttcagagccaatgagaagatgagcgttactagttttggtagagtcattcaaaaggactggaatttgacaccttcaaggagcaaggtagctagagcaagaagactgatcatgaaagtcatccatggtgatgagatcaagcagtatgactatctctgggattatgcacaagagatcaggaggagcaatcctggcagctcactgtatctgaacttagcaggaaatctgtttagtacttgcttcattgctttggatgcttgtaaaagggggtttttggctggttgcagacccctcatatgtattgatggatgccatatcaagacaaaatttggaggcaaactgttgacagcagtgggaatggacccaaatgattgcattttcccaatagcaatggctgttgtcgaggtggagtcatttgtttcttgggagtggttattagagacattgaaatctgaacttgggatagataacacatacccttggaccataatgactaataagcagaaggtaacccatttgctacttgaatatctcttgtctgtattgtctgcaagtgtactgactaactgatgcttgtttctctgcagggactaattccagctgtcaagaaggtattccctgacacagagcataggttctgtgtgagacacctgtactctaactttcaagaaaagttcaaaggcgagattaggcacctaaatgcccgttttgtgagttaggggaccggcttgacacagctgcgcaagttaagggaccgccagtgcactttactctaattaaaaataaacttctatttactcctgctcccactttttttatatgcttagttattttctatgaagaaatgaattgaaactaaattaagagcacaattataataatataattagtatgtgtagttaaacatcatagaccaaagtacacttttgttaggtcaactattattatatagtatatttttattgcatgaattttgtttattattatttgtacttgttcctgaattaatcaaacttagtatatggaatatcacataccatgtgtatttaatagactcatgatgtttactcattctgttcttttacttatttagggcattaatgaaagaacacacagcagagaatttcccaaacactatagtcaaagcctctagccagatgtgtatttcggatcacacctagtgtttggtacagattggtacttcaattcctaaggcctctattttcagattagaaaacttttgggtggagcttgagggattttttgagctactgaattcttcatggataaattatggttgctggaatgatgaagaagaaaggcaaattttgctacagatatcgcgacttcatggttttagttgtagaacaccgcacatactcacttttgcgggaaaacactttttaaacatggttatttgtcactggacgcatctattaaaatattaatttttggttgaacaggagagataaatgcagtgaaagattaaaaatacccctgagcccacttgtcatattcttcttcctcctcaattccccttttctcccatatccacgctgccgccgccaacggcgtcctaaccacgggattccgtaacgacgaccgtgctaggctggtgatgttagagtcgacaggatgtgcggcatcttgaggcgatgcggcccactgtggggagccctcaccgccatgggaggaggtggtggctgctgctcctgctgcgattgcgccgcaccatgtcctcctgctccaccttggatgtgcaccctaccgacccccgcaaaccggtgctgctattgccaacttcgtcccctgcattgcatgctgccgtcgatgctccctgcatcctcttaccgcgcttcacttgatctatgccacaactgccaccgccgatgtcatcgcttcgggcatgggcgacgtcacgcggtgtccccgcaccgccgccgtcctgaccgtcctcatggccgcaccgccacgcttttgtcatcgccgtgcactccacccgctggtcgcgacaccactcatggcttgcagtcctcatcggagaagagagaaaagaggcagacagaggatgagatcaagaagaagagagcggatgaggaagacaaaggatgggcattttggtcactccgcataaaattatgggccccctatcgcctcgtcagcacaaatgcattattttaatcagtgcggtgtccgttgtaaaataaccacgtttagagcgtgttttccctcaaaagtgagttcgtgcagtgtcctacaactaaaatcacaaagtcgtgatgtcctattgcaaaatttgctaagaaaaaatatattacagttaaacttaagtgtttgaggaaggcacttaagaagtggagcaaaacattgtcaaagctaaatagcttgataaaaaactgtaattaagtggtggattctgttgacaaattaatggagtcaagatatttaacagtaaccgaatggaacttctgaaagctgatcaaatcaaaagctttgatctacatacatgaagtacaaacagatctactaaataaagatgtaacatatttttgtatatggttgccatgcaaagaatggggtctatgtccaaaccacatacgtctaggatgataatgcataagcacgaagcagaaaaccaatccaaatggctaaagtcatgtatggaaaagaaataaaatataataccaatccaaatggctaaagtcatgtatggaaaagaaataaaatataatgtattctctggtacctcggccttacgctaacgctagattccgaggcttcgggtttcctcaactttgaggttgagtgagtccctcgtcgccaagaaaataagagcacaacgactagggcccaactattgctttttttactaatagttagcggttgtcctcgtacctaatcttattccgtttaactacccgagattagactcgagggtgggtaagatccggagcgaggttgtccacgagctgaggcctctcgaagaatactttcgtgtataacaaaatatgagtaatattgatctcaatttatttgtataattataaattaaataacagttttaaaaattaaaaactggagattttgtttaaaagttatgctcatttaatttaactgtttatagaagtgctagctctaaaatagaagtgctacgcactttagtacttacgtgaccactttgatacgtacacgagggagtgaggtggaggtgatcgtacgtacaggaggaagggaggtgttggtggaagggatttatttttcaaaagatttaatttaatggttaaaaatattgggtccactaaattgaaaatcaaagctgagatgttttgcttttttcttagattttttcggatttcctctaatttattagagtgacacatgatggattatgagcgtttataggatgtgatgtggcggtgtacactggtggagaaaacgtttgtagtcccggttcgtaaccccctttagtcccggtttccaaaccgggactaccaatccgggactaaagatcgctatctttagtcccgggtgaaataaccgggactaaagatcgatctttagtcccggttggtactaaagatgtctcagccacgtggccggctgagccatctttagtcccggttggtgactaaagatcgagctgacctttttttttttgcatggccctgttgctgcaaggtttatatatatatatatatatatatatatctttcttatatatgtttcaatacatatgtacatgaataatatatatgtatttatacatatatatatatatatatatatatatatatatatatatatatatatatgttatgcaaatgcatatgtatatatatatatatgaccaaaatatatatttacattatagaaaatgtgtacacatgcatattgaaacatagtcatgtattaattacaatccattatatgtcctagctagctatgatttcgacgtagtagtagtcgctatctcagaagataatgacctatgaattgtatttctgtcgtagtagaatttacccttgggatcaaggatttattcgttgatgaatcccatgagttgttcttgaaccgccgcgataaattccttgtgtgtgatcaagttatccctcatgcgaataaactatataaatgtatgaaattgattagtaattaaacaaaaaatcgatacgtaatgaaattttgaatttatttgtacgtacatcgagctctcttgtggtgatgatttggtgtgcaaggcagtggcaatactcgcacacatagtagtcgcacaagttagttccctgcttttgctttgcgcactataaataaatgacaaacgacgagagatctaattaatatacacttgtatgtatttgaatcggagaaatataaatgtagagcatgtgtactcacaggaaatttgaacttccgcctaagtctttctctccatttgccacggaccaaatgacggaaccgataccaagccctacatggagtttaaagctatgattcgtagtagcaattaactataacaagattcttaattaacataggaacttatgacagtacctgtctataagttcgaaaaccttgtcaaacgtagactcttttttatccattgagtcatatacgttgacggtgcaggcctccaggtcgaagagtaaaagcacccagtggaatctgcaatgtgcgtgggatgcattacatatgaaacacttagaatgttcgtatgggaatgaaatttggtattggaagacagtaaaattaaactaactctctgttgtacggcaacagtatgaacgtcttgtaatgttgcgccttcaggagatggacgagattgtcctctgtggcttgcggatattggtcgagcattgcgacatttacttttcgagggtcgatgaatccagtatcgaaaacccccgccgtcgggccctttgaatctccattctacaacgataaaagggaagatatattatatatagtctacttatatacaaggacctaattaattaaaggaaacgtagtaagaaatctaattgaacgatatacttacaaaatccagtaactcataatagagacgtcgagggcgtccagctggtatatttcgtagattcccttgaaattgatccagagaatgtcatctccttgcaagaagtccgtgtccctgatcctcgctctgatcatctctctaccggtggcgctcatctccatgtacagctgatggaacttgtacatttgtgtgggtaaggactgcagcagctcaggcttgacaagcggtttaccgagttcgtacatgtatttcacttccgccttttcgattggtgcgtctcgtagcaattgatccgtagttagcccggtgtcattaataaagtcttgtatttcaaaatcttcaccggtcaccaacggctcgatctcctggtttggttgctctccaagctgagggactggtttggactttctagaagatgctttcttgaatgttcgctcatagtccgatagctttatggcctccttggcaggtgcagacatacccctgaagaagttcttgacactcgggtctataggaatgttcttttctggacttcgaggcttcaattgtctcctgacttctgatgccacgtaagcgtcaagctcctcttgcgtgcaatcgtaccctgggtccttgttcttggcggcgtcaactttcgccttctttgttgcccttgtgggggcaggcggtggagcttagggggcccttgacttggaaggtgccaaaagaggagcttgcggaggagtcggtgtaggagcctgaggaggagtcggtgccggagcctgaggtggagacggtgctggagcaagaggaggagacggtgcaggagcctgaggaggagatggcggagctggaggagatggtgcacgagacgccgcttatcgcctagggaggatgatgtaccgcttgcgccatagaataatggcgtggcttgtgtctcgtagatgcgtctcaccgtctcctccagggtaatccagctcgaggtcctcgtacgcgccttcgaccaactcaacttcgactttggagtatcctgctggaatcggcctgtagtggtaagtacttgaagggtccgttaggatggccatgcccgacgccaccttcatgtggtgagaggttatttattagtaatcaacatatataagaagcaactagcggaatggccaaatctaaaatctataaactacgagcttacctttattgataagttcttgaagggaatatgcagctcacatggtgtccgctgagtgatgtcatcaacggggcaggtggtttcgtcctgggtttgcatggcgtccatgctctgtgatcctacctgccccgttgaggcgcagctgctacgatttcctcacgggctcaccattgcaggaggaatggtcggctggggatcatgggactgatatgcggccatgcgttcatcaaccttccttgccacctcctcttgcatgccgagctcgtagctcgataccctgaactcaagatctgcaatcttcgcctcggtatctctcttgctcctcatccgactcctgtacgtgtggatgtcctccttgaacccaatcttccaaggaatcacccctttccctcgtgttcgtcctagatgctctggagtctgcagggcgagtgacagctcgtccttctctatgtccggtcagaacgtgccctgagaagaggcttccactgcgtctgttagtcgacgcgcagccttgcgtatctaatcgccgaagaccagggagccatcagctgggttgagcgttccaccatgagcatagtaccagaacttcgattgttccggccaattagcggtgaccggttcgatacccctctcaagcaagctagcctccatctcctcccacttcggcatcgcgacgctatagccgcctgaccccaagtggtgatggtacttcttcttggcggcattttctttgtttctttccatcatcgcctgcccttgttcacctgtcttatatgcaacgaactagtcccagtgatcccttagctttaggaatgtgtcgaagttcggtgtctgccccttcaggatatatttctggtacagatctcccttgaagctctgaaactgttctgccattttcttcagagtccacctttttactttgtcctctgtacccgcgggaagggtgaatgtctcgagcattgtggtccacggcatctctttctccgaatctaggacaaagctctcatgatctccgcgtgcccttgttctgcgccagtacaccgtactgacaggcacgttatcccccacaacccaaccgctgtgacgtacatagttcttggtggcttctgccagggcactaggtcggccgtcttagtccacttccgttatgatgtgccgaccctcaagcttcttcgcggcacctcgttgcctgcgtgccctcttctgtccagcggagggttgacttccactagcctcctcctcctggttcccctccacatccctctccatgtgcccctcctggttcccctccacatccctctccatgttcccttcctcattcaaatactggtttggatcctcgttcccctcttcttcgttccagtactggctgcttcaatccgctattgtatcgtacaatatatgttcctcatcgcgattagccatctgttcatacaggaaacagttgctaagtcatgagacatttatgttttaataatcttatatgctaataatcatatatgctaagtcatatatactacgtctaactgtcgtatatgggaagtcataaatgcttagtataactgtcgtatatgccaagtctaactgtcgtatatgctaagtctaattacaaatctaataatcgtatattaaaacaataataatcttatacgaaaactcaaataatcttatactaaaactcaaatagtgatatatgctaagtctaggtgacgtatattataggaccctagctagtcaataattatatactaagtctaattacaaatataataatcttatattaaaactcaaataatcttatactaaaactcaaatagtcatatatgctaagtgtaactgtcgtatattagaaccctacacaatcttatatgctaagtccaattacaaatctaataatcttatactaaaactcaaatagtgatatatgctaagtctaggtgacgtatattataggaccctagctagtcaataattatatactaagtcttattacaaatctaataatcttatattaaaactcaaataatcttatactaaaactcaaatagtcatatatgcgtagtctaactgtcgtatattagaaccctacacaatcttatatgctaagtcttgttacaaatctaataatcttatattaaaactaagtctaagtgtcatatattaaatctaatagtcttaattgcattacaaatataacaataatatatataattacgtcacttgcctgcgcgaattccttcgagggctagctaccactccggcttgagggacgacgacgacaacgtcttttctgcaacatacaaaaagatgtattaggataaacgcgaagtaacatatattgcatttgacgttcacgtttcgttcacaatcgttcacattcgcgttctcgttaaggtcacg

SEQ ID NO: 59975 - DNA, 511 bp, Oryza sativa
cttgcaagattatgatcatgtaccttatttgcgtcatgttggtcacttgccatgtgttgtcgaaggtgaaaatgtccacattgagcacgaacagctccaaactctttgtgtaaccctgccatagttagtagcaaacaagaaacatatacaagaatatatacgttcctatcaactactaggtagtggaagctcacaaatcacacacactcaagctttttatcgagctcttacaagttcttaccaatgcaaactagaatatggtgtccacaccgactcaaccaaacactcgatggagttggatgtatcgacactttggcacacatgttcacaatctgtatagctgcagtcaaatctgtggagctctgggtaggcttaaatatgtagcaagtatggcaaatggttaaatcagagaatgcaaagttgaataatcgttcaaagtcaagtatcgtgctggtcctaggctagaacgaactagagacgcgagcctagaaacaaacaataccacaagata

SEQ ID NO: 59976 - DNA, 947 bp, Oryza sativa
attccatgaacggtacatggaaatgagcgccaagggtagagagatgttcggagcgaggatcagaaactccaacttcttgcaaggagaagatgttctctggatccatttcaaggatctcttcgatctgtaccagttggacgccatcgacgtctctcttctgagcgcatggattttgtgagtatctttgagtcgatttgtttcgttcaataattagctcctggcatatatgtaagcaataatactttcttttcattgttgtagaatggagatcaaagggcccgatggcggagggtctgcgatactgggttcatcgaccctcggaaaatcaacaccgaaatgatcgacaagtacgagaaagacacagaggacaatctcgtccatctcctaacgcagcagcatttcaagacgtacatactactgccgtacaacacagagtgagtttttattgtcgctcgaacaaatttcgttcccatacatatagcatgtacattttcaatcatatatatctcatctcacgcatattccagattccactgggtcctgttattcttcgacctggacgcatgcagagtcactgtgtacgactcaatgaataaagagaagaagatttttgccaaggtcttcaaactgatagacaggtaatataatgccatctattccaaagtggcggggaatctatggctattatgttgatctcaggtaataattaattataatagcttgcaattacatattaagggtttgggatgggtccgttcaattggtcgcgggacttgaaaaaaaattggcggaggtttcattttccaggaagtactggaataatccaaaataaaattgaattgattttttaataccggttaaaataaatagaaacctaatcttttcttggtttttcaatgaagtgtgcaaagcaggaccaggaaactaacttatgcggctactacgta

SEQ ID NO: 59977 - DNA, 1910 bp, Oryza sativa
aaagatattttcccactatttcgaaatttttttaaacccggttagggttaagaaccgggactgctgacaagcgcactgaatattaatttccattacatatgtgtttctaaaatagaaaataatgcattaaaattatttgaagtagaaaaattaatgacaattacttcgaaaaattattgttgtctgtaataaattaagtggataaaacgtaataagcaaatatatgatttaaaagtaataaaaattctaataatcatatatacttagcatatgaatgatattaaattgttaaaaactctaattaacatatgtatatacatacgccatgcatgatttagaattaataaaaattgtaataatcatatataattagcatatgaatgatattaaattaattgttaaaaactctaattaacatatgtaaatgccacatgcatgatttaaaaattttaaaaattcgaatagtcatatataattagcatatgaatgatagtaaattaattgttaaaaactctaattaacatatgaaaatgacacctgcgtgatttaatacttttaaaaattataattatcgcatataactagcagcatatacatgatataaaagtgttaaaacctctaataatcgtgcgtaattaacatatgccatacaacaattgatttatatggataatcaatacatccaaaatagtttacatcgtgtacacaataattacggcaatacatcggcggtgacggttgaccgcacgtactttctcctcactattgttccctccttgtgatcgctacgtgagtaaggggtgtcttcatttgataggaggatgatagggtcaatcgtcaccgtgaaagggggttgcccatccaactgatcgtaatccttgtctgtcttgtcctcaactccgacgatttttcttttgcttgggagaaccacgtgatgcttaggctcgtcaggccctctgcccttctttcctttgctagacatgtccttcacgtaaaagacttgcgttacaacattggcaaggacaaaaggttcgtccgaatatccaaccttgttaaggtcaaccgttgtcatcccactgtcatcaatcattacgcctccactagtcaacctaacccattggcaccggaacagagggaccttgagaggaccatagtcaagttcccatatgtcctcgatggcaccgtaatacgtgccagttgttccatcgtgtcccatggcattgacacgaacagcgatgttttggttcgtgctcttcatgtcttgggctctcgtgtagaatgtgtacccattaatctcatatccctggaatgtcgcgatcgacccagacagtcccctcgccaggaaggcaagttgttggttgatcgactcgttaaacatgagatgttgccgtagccacgcggggaaagaatcaatgtgatgccgtgtaatccatgcatcggacttaccgatgttcctggcacgaactagagccaagtgctcctcgatgtaaggagctaccaatgaagattgttgcagaacagtgaaatgggctttacggaataaattgttgtctaccgtcgttattgctttccttccgagagttccctttccccgtagtctcccttcatggcgtgattcaggtaccccgattgggcgaaggtcttcgataaattctacgcaaaattcgatgacctcctctgttccataacccttggcgatgcttgcctctggacgagcacggttacgaacatacttcttcagaacgcccatgtacctctcgaaaggaaacatgttgtgtaggtacataggcccgagaatacggatctctttcacaaggtgacaaagcagatgcgtcattatattgaaaaatgaaggtggaaatatcaactcaaaactgacgagacattgcaccacttcattctgaagggct

SEQ ID NO: 59978 - DNA, 4737 bp, Oryza sativa
atagaggagaagtagttatgcttgcaatgcatatataggttagaacaataatattccactagtattgggtatactaaccttttgcagagaataaccataaagtggaggagaatcgacatcacacagacgataaatcaatcggacgatgtcgagaatcagagttatgtatgaatgggccaagaactcagaaatgacacgaccaattgggccaaaattcacaagtctgcaaagagaagaagtccaggaggtcgccagccgaagatgggctggtttgggccagcccatggttcacccccatctccactgttgaagccagggttcggcgtgaacgtctaggattgcatcctaatgacggttggagggcacttcggacaattccccttccacaaccatcataacactggtggagaaaccctttgtagtcctggttcgtaacccccctttagtcccggtttccaaaccgggagtaccaatccgggactaaagatcgagctgacctttttttttttttgcatggccctgttgctgcattgtttatatatatatatatatataaaccatgcatatatatgtttcaatacatatatatgcatacatatatatatgtatatatatatattatattatattatatgtatatacatgcataatatatatgtatttatacatatatatgttatgcaaatgcatatgtatatagatatatatatgaacaaaatatatttacattatagaaaatgtgtacacatgcatatagaaacatatgtagtcatgtattaattacaatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtctgcaaggcagtggcaatactcgcacacgtaatagccgcacaagttagttccctgcttttgctttgtgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgatgagtaaaagcacccagtggaatctgcaatgtgcgtgggatgcattacatatgaaacacttagcaagttcgtacgggaatgaaatttggtatgtaggaagacagtgaaattaaactaactctgtgttgtatggcaacagtatgaacgtcttgtaatgctgcgccttcaggagatggacgagattgtcctctgtttcttgtggatattggtcgagcattgcgacgtttactttacgagggtcgatgaatccagtatcgaaaaccctccgccgtcgggccctttgaatctccattctacaacgataaaagggagtatattattttctatggtctacttacatacaaggacctaattaattaaaggagacgtatagtaagaaatctaactgaacgatatacttacaaaatccagcaactcataatagagacgtcgagggagtccagctggtatagttcgtagattcccctgaaattgatccagagaatgtcatctccttgcaagaagttagattggtgcgactcctagcaattgatccgtagttagaccggtgtcagtaataaattgttctatcgtcatttctttaccggtcaccaacggcttgatctcctggtttggttgctctccaagctgagggactggtttggactttccagaagatgctttcttcagcgttcgctcatagtccgatagcttgatggcctccttgacagatgcagacatacccctgaagaagttcctgacactagggtctataggaatcttcttttctggacttcgaggcttgaattgtctcttgacttctgatgcaacgtaagcgtcaagctcctcttgcgtgcaatcgtaccccgggtccttgttcttggcggcgtcaactttcgccttcttcgttgcccttgtgtgggtaggcggtggagctggggggcccttgacttaaggtgctggaagaggagcttgcgggggagtaggtgtaggagcacgaggaggagtcggtgcaggatcctgaggaggagtcgatgctggagcctgaggtggagacggtgctggcggagcatgaggaggagacggtgcaggatcctgaggaggagatggcggagccggaggagatggtgcacgagacgccgcttgtcgcccagggaggatgatgtaccgcctgcgtcatagaataatggcatggcatgtgtctcgtagatgcgtctcaccgtctcctccagggtaatccagctcgaggtcctcgtacgcgccttcgaccaactcaactttgaccttcgagtatcctgctggaatcggcctgcagtggtaagtacctgaagggtccgttgggatggctatgcccgacgccaccttcatgttgtgagagattatttattagtaatcaacatatataagcagcaactagcggaatggctaaatcttacctttattgataagatcttgaaagtaatatgcagctcacatggtgtccgctgagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgagttcgtcctggatgctctggagtctgcagggcgagtgtcagctcgtccctatctctgtctggtcggaacgtgccctaagaggaggcttccactgcatctgttagtcgtcgcgcagcctctcgtatctgatcgccgaagaccagtgagccatcagctgggttgagagttccaccgtgagcatagtaccagaacttcgatcgttccggccaattggctgttgccggttcgatacccctctcaatcaagctagcctccatctgctcccacttcggcatcgcgacgctatagcctcctgaccccaagtggtgatggtacttcttcttggcggcattttctttgtttctttccatcatcacctgcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacacagtactgacaggcacgttatcccgcacaacccaaccgctgtgacgtacatagttcttggtggcttcggccggggcactaggacgtccatcttcttccacttccgttatgatgtgccgaccctcaagcttcttcgctgcacctcgttgcccgcgtgccctcttctgtccaacggagggttgactaccactagcctcctcctcctggttcccctccacatccctttccacgtgcccctgctggttcccctccgcatccctctccacgttcccttcctctttcaagtactggtttggatcctcgttcccctcttcttcattccagtactggctgcttccctccgcgattgtatcgtacaatatctgttcctcatcgcggtcagccatctgttgatacaagaaacatctgctaagtcacgagacatttatgttttagcaatctaagtcatgtatgctaagtgtaaatgtcgtacattagaaccctacacaaccttacgtgctaaatctaattacaaatcgtgatataagctaagtctaggtgacgtatattatacaaccctagctagtaaataattatatactaagtctaattacaaataaaataatcttatattaaaactcaaataatattacatgctaagactaaaatagtcatgtatatgctaagtgtttcgtgcgtatatgctaagtctaattaagactacaatagtcaactgatcgtaatcctcgtcagtcttgtcctcaactccgacgatttttcttttgcctgggagaacc

SEQ ID NO: 59979 - DNA, 525 bp, Oryza sativa
taaacacttttccaattgcgacacatggaacacattatggactcctgccaaagattgaggtaactctaactgataagcaacctctcctcttctactgacaatcttataaggtcccacaaaacgcggtgccaattttcctttggtgtgaacacgatgaactcctcgaagaggcgtgacacgaaggtacacataatctccttcttcaaaactcaaatctctgcggcgattgtcggcatactcttatgacgagactgggccacacgcaatctttcttgaatgatctttaccttctcttctgcttcccttaggatatcagtcccgaaaacctgacgttctcccttttgatcccacaaaagcggagtgcggcacttccgaccatacagtgcttcgtaaggagccatctgaagactagcttgataactgttgttatacgaaagttctgcataaggtagattcttatcccaacttccaccaagtctaaagcacaagctctcaacatatcttccaaaatctgattcacccttt

SEQ ID NO: 59980 - DNA, 9494 bp, Oryza sativa
ccggcagcgtggcgagctagaggcgggggcgcggcagtggcagtggtgacggcgtcgtcggcggtggcggccacgtcgaagtcagtcgtcggcggtgacggttcaccctggtgtggtagtggcgtcggcaacgaactaggcggcggtggtttggagagagagagagatcgagatcgagagagagagaggcagcagcggcgtttgcggcggaggcggcgaggaccgccaagcaacggcgagagacgacggcggcgtcggctcggggttgccctaggcagtggtggcgaaggagaagccgatatcgatctcaatggaaaaacgtctaagtgttggtggagaagacgagggcgcaccgggaatatatatacccccagatctttactcccggttctaagaacaaccgggactaaagatctctttagtcccggttgttcttacgaaccgggagtaaagatatctttactcccagatgttctcaccaaccgggactaaagatcttttcccgctatttccaaattctttttaaacccggttagggttaagaaccaggactaaagataatagcactgaattttgaatttcattacatatgtgtttctaaaatagtaaataatgcattacaattatttaaagtcgaaaaattaatgacaaaaccttcgaaaaattattgttgtatgcacatgaatgatttaaaattgttaaaaattctcataatcatatataattagcatatgcatgatattaaattgttaaaaattctaattaacatatgtaaataccacatgcatgatttaacattaataaaaattctaataatcatatataattagcatatgcatgatattaaattgttaaaaattctaattaacatatgtaaataccacgtgcatgatttaaaacttttaaaaattctaataatcatatataactagcatatggatgatttcaatttgataaaaattctaataatcaaacataattaacatatgccatacaacaattgatttgtatggatattcaatacatccaaaatagtttacatcgtgtacacaacaattacggcaatacatcggcggtgacggttgaccgcacgtactttctcctcactattgttccctccttgtgatcgctacgtgagtaaggggtgtcttcatttgataggaggatgctagggtcaatcgtcaccgtgaaagggggttgcccatcaaactgatcgtaatcctcatcagtcttgtcctctactccgacgatttttctttttcctgggagaaccacgtggcgcttcggctcgttaggccctttgcccttttttgctttgctagacatgtccttgacataaaaaacttgcgttacatcattggcaaggacaaaaggttcgtccgaatatccaaccttattaaggtcaaccgttgtcatcccactgtcatcaatcgttacgcctccaccagtcaacctaactcattggcactggaacagagggaccttgagaggtacatagtcatgttcccatatgtcctctatggcaccgtaatacgtgccagttgtaccatcgtgtcccatggcatcgatacgaacagcactattctggttcgtgctcttcatgtcttgggccctcatgtagaatgtgtatccaatgatttcatatccctggaatgtcgtgatcgagccagatggtcccctcaccaggaaggccagttgttggttaatcgtctcgttacccatgagatgttgtcgcagccacgcggagaaagtatcaatgtgatgccgtgtaatccatgcatcggacttaccgatgtttctggcgcgaactagagccaagtgctcctcgatgtaaggagccaccaatagagatttttgcagaaccgtgaaatgggctttacggaataataaattgttgtataccgtcattattgctttccttccgagagtcccctttccccgtagtctcccttcatggcgtgattctggtaccccgattgggcgaaggtcttcgataaattcaacgcagaattcaatgacctcctctattccataccccttggtgatgcttgcctctggatgagcacggttactaacatacttcttcagaacgcccatgtacctctcgaaaggaaacatgttgtgtaggtacacaggaccgagaatacggatctctttcacaaggtgacaaagcagatgcgtcattatattgaaaaatgaaggtggaaatatcaactcaaaactgacgagacattgcaccacttcattctgaagggcttctaatctatccggatcgatgaccttctgcgaaattgcgttcatgaatgcacatagctttgttattgttgcccggacattgtctggaaggataccctttattacaactggtagcagttgtgtcatcaacacgtgacagtcatgagactttaggtttgtgaacttcttctccttcgtgcttattattcgcttgatattcgtggagtatccagacggtacctttatgctctccaagcattcaaacatactttccttctctgccttgctaagagtgtagctggctggactcaagtaatggcttcctttctcctttggttccggttgaaggtcgccgcgttgttccatatgcttcagatcattacgtgcttccagtgtatctttcgactttccatatacacctaggaagccaagaaggtttacgcaaaggttcttagtgaggtgcatcacgtcgattgcatggcggacgtccaagaattcccaatagagtaactcccaaaatatagagttctttttccacatcgccgtgtgaccaccttcgctctctatgggctggctgccaggcccctttccaaacactactttaagatctttaaccatagcaaacactgttttcccgctgcgatgtttaggctacgtacggtggtccgccttatgttcaaagtgcttgcctttcttccgtaccgggtggtttgctgcaaggaatcgacgatgaccccatgtacacaaccttcctacaatgcttaagatacgtactttctgtttcatccatacagtgagtgcaagccttgtaccccttgttggactgcccggataggttgctaagtgcaggccaatcgttgatggttatgaactacagcgctcgtaggttaaactcctcctgtttgtcctcgtcccacacggggacaccttccttcttccacaacagtttaagatcttcgaccagtggtcttaggtacacatcgatgtcgttaccagtttgcttgggggcatgaataataatcagcattattatgtatttcctcttcatgcatagccaaggggggaggttgtagatacacatagtaacgggccaagtgctatggccgctgctcatctctccaaaaggattcatgccatccgtacttaaaccaaaccatatgtttcgtgcgtccttttcaaagtctttaaattttctgtcgatgtttcgccactgcgaaccatcggcggagtgtctcagcatcccgtcctgttgacgctcttcaacgtgccatcgcatcattctagcattccccttgttcctgaacaaacgccttagccgtggtattatagggaaataccacatcaccttagcaggaattctcttctttgttagctgcccgtcaacttctcctggatcatctcgtctaatcttgtatcatagcgctttgcaaatagggcatgcttctaggttctcgtactcctcaccacgatataggatacaatcattcggacatgcgtgaatcttctgaacttctagtcctagagggcagactatcttcttagcctcgtacgttgtctcgagcaatttgattccctccagaagaatgttcttgacgagtttcaagaaatcgccaaatgccttgtcactaaccccattttttgccttccattgcaataactccagagtggtatccaactttttgtgcccctgctcacaacctaggtacaacgaagttctgtggtcctctaacatcttgtccaatttatgggcccccttttcactttcgcagtcctccttggcgtcctacaacatctgaccaagatcatccgcaacgtcgttaccatcagcatccctttcctcctcgcccattcgatttccttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaataatgcacgccgtcaataaactctttggaccgccggtcagcgtacatccattgccgatccatctaaataaaatgaaaaaaaatcatacacaaataattattcgtataataatgacagtcatacaataattataaaataattacaaactctttcaacagtcatacaataatgacaaatcattattcatacaaaaattatgaaatattacaccaaataattcttatttactatttctaaagttttaaactaatattaatgtgttgtactgcttttaattttcattttagtttgttttctattgtttaagattaaccttcactatattttccttctcaactattttataaaaccttctttagcaaataaactaaatttctatatattctttcttccccacacaaattttctctctcatcaacttacaacaaaattttggagacaaaaaggtgtgcaaaacatagctccaaatgtaatatgacaaaaaaaacattggaggatgaagttgctaactttttaggcacctccgatttgtatataatcaccaaaataaattcactagaaattttggcatgacctcccctcttttctgaagaaattttgaagcttgctcgggctggaggaggaagaagacatatatatataggggtgggactttagtcccggttggtgttatgaaccggggctaaagatcgccgggatctttagtcccggttggtactaaagttatgatatttagtcacagatcccggggggcctgacaagccctgacagcatttgaaccaggactaaagatgatctgttaccaaccgggactaaaagatcaaatatgcccgttacctttttttaaccgggactaaagatcatctttagtcccggtttttgttgcaaccgggactattgtggagttcggccgaccgatgaaagatggtttctccaccagtatgttacgggcaacatatcacagtagtaataataataataataataataataataataataataataataataataataataatatatgagagacattattattttcatatgtataatagttagttgtatatgagatatacgtacgtacgtacataaaaaaacgtaatggctgggtggggtcaggtttcggtattaattttttctttaagataaatataatgagtactctaaatctaatggttgtaataaataaagggttcaccaaatttaatgaaaatcaacagttatttcttagagtgctacatcgcgacttacaatcgattgtagaaagtttcattgagttttagtatataaaaaaactaggaaggtagcctagcttgcgcattcgctcgggcatgcatcgttgtttatctttgagatacttataagagttataagagtgaagtattaactgcataatacttgacacgcttaaaaatacaatttctccataatttttcatcagcattgcttacataattttttaatcctattagttagctttacaccgcacaatattttattcaatttaattcatccatataagaaattataattttgaccatctaaaagaaggtagacttggttgtttacacaacatatatataaaaaattaagtgtaaattatatgtaaggtgttttttaaaaaaaaacaaatgctctctgcattcgtgtcacatcctgatttttgtttcaggatttataaattatttaataaattaataatagaatttatattaaatgatctttaattttcaagtgaagctaaatgtgggaaataaaatttcctaaatataaagcatggatggatttaatttttattaaattctccatgattaagtatactctctgaaatattctcggatttttcagagctcaattcctaaatgatacaaagaacagttcagtaattatttgatcattaatgatctaattatatttgttaagagcttttcttgtttaaaaatccttaaattataaattgttgtttaaaaggaattattagaaatgatcttaaaagcctaaaagagaagatctaattttaatttgttaaatctcaatataaaatggggccagataaaatttcattaaatactttgcttaattctataattcctagatttttctgggatttatttgagctaaggaagtatttttaataaatggaattgcatttcatgaataatttaaattgaaaaaggtttttaaaagtctcttttggctttgggccgaaagtcggcccaaaaccctctctctctccccggcccagtcggcccagttcgccacgccccttcctcctctctctcggccgctgacaggtgggtcccgcctgtcagacttgtcttcctcctcgcgccgccgctgccggccaaaaccctagccgagccgtgcaccgccgctttccaattcgctcgcccctttcccgatccggtgaaatcaatagaggggaaatgatcttctcgatctcctcttccttttctcttttggaatcatcgcctaattcggtttggaaatccgtggattcgagtttgattcggattcgtttttctctctcgaaccctagctttccttctcgccgtcggtcgccgtgggcctccgtcgccgctcgctagcccctttaaaaggatccccggtgcctcctctacccgccgccaccctcgccttcgtctctcgccgtcggaagcgccctagcgccgtgtgaccacgtgccgcagtcgtcgccgctgctccagtcgtgcgccgccgtcgttctggtcgtcgtcgtcgctcggggaggtcgccatcgtggtcgccaagtcgccgccgtcctcgtccgcctcttcgtcgccgccggagaccaccggagcaccgccgtcaccgtcgacccgaaaaccgccgccgtttcttcctcgtcgccggcgccgtccgttgctcttccgccgccgttttggtcaccggtgagttcgccgcgtcgccctctacccgttggtgtcctccgtttgcgtcgtcgcgccgtcgttcgccggcgagcatgcgttgccgagccgccgccggtgctgacgtcatcgctgacgtcatcgggaccgtctgctgtggcccggtcgtggactgtttgatctcggccgttcgttttggataagatcgatctcggccgtccgttcccgtgaaccactgccgtgcacccggtccaccgcaaaccctagccgctgacgcaataaaccccttttccttttcaaaaataattcattattgcgtcataattcaattaaaatctatataagtgttttaatccgatttaatctttaaaaattcataactaattcattgtaactcagtttaatgtggttcaagttgcaaaaattatataaaataaagatctacatattaaaattaaccataaattgaattaagtttatttaattctttttaaatgggctttaaatagatttaatcttgtaaaattcataataaattcatatgaagtcagaatgaggccgttcaagtctcataattcatttaaaattatgatctacatgtttgtttactttttatgtattgtttatttggtttttattagtctttttctttgttttgcgtgttagcttgtcgtttccgtcgttgcgaaggttcgtgagtacgccggaagtattcaagaagattaattgaagaccgattattgcaaggcaagtcacacagatcctaaacacaatactttgagcatgttgatcctatatttaaattctctatttatttcaactgtgcatttagtttcgaatgtcactgggtggtgtgaatctattcctttgttatggcctgcttgcattgattactttattctttgataccttgggttattataacttgactagttgagctatatatattggttcagctagatattagatatgattgcttagccatgcttagaaacattagcacactattgggattacttatgactcattattatttaatgatggcttaatgatagttcacgatggtcaatcgtgattggttaattaattacttgccaactaaaacttgataatggtgggttgtgagcacatggttttgagagtcgtgctcatgacaattaaggaccggttcgcgagctactattgtgaaacattaatcgtgtcaaccacaagccagcgtgggcaacggctttaccttttgtatagcatggttcattgcggagcaccagactgagaagtggtggagataagcccacgggggtcgctggggagtccatgccttgtttataagggggtgactatgatccgggaacggtgcactgtggtgggttgtgttatgcaaggggtaatgtcacagctcctttccgaggtaccgtggtggtactgaggcacatggtgacatgttgtggggctgtgtcttgtgggtacagtggtacacctctggccagagtaaaactattcgaatagccgtgcccgcggttatgggcgggttgagcaatgtttttcgtgattagtctcacacctctcacaataattattgatgctataactagtaataatttgtttagctcctggtttggagttagatctgtacagccgggtatggttgttcaggatggttgggcctgtgcagcatgggtgtgctgttcagtgttgattaaaatttctgattaactactccactgttttatttctcttaaatgttttgctaaatgctgcttttgcaaatgagcctatattatgccatcctttggtacccttgtgcacttgcatatttgctgtgtggcttgttgagtatgtcatatgctcattcttgcaataatcaatcaacctcagttgaagaaaaaggatctaaaaggagaagacgtttggcttataccccagttgagctgcctgtgggagtggagctgaagccatcgctagaccgttattccgctgctgttttcttttcttttgtaagtgtgtaacgttattattatgatggatttgtatattaaattgtcagtttgtgtacctcggctgattcctggacgaggattttatgcacaaattagttcggaaattattagtgaatttccgggcgtgacaattcgcgagtgcatgaaaggaaaaaaatattggttagttttttgcgggcgcatttctaaactgataaatggtgttttttttttcaaaaatgttatatagaaaagttgctttaataaatcatattaatccattttctagt

SEQ ID NO: 59981 - DNA, 3977 bp, Oryza sativa
ctcttgacaatagaaagccatctcttcatgcttcactttcttcacaacttgactcttgcttcttgttttgccttcaaagcaacttcttgattttagatcatggcggcattcttcaccatttgcctcacttcacgagcttcctcttcttgcatctcatgagacacaattcttccaagaatgtcacttggggtgagtctcttgaagtctttcctttcccgtatcattgatacaagagtgggatatcttggaccaaatgcacggagaagtctcttgaccacaaaatgatttgtcatgtcctcactcccaagtcctttaatcttgttgacaaggatcatcatcctatcatacatctcttgtggtgtctccttgtcatccatcataaatcttccaagccttccttccaataattcaatcttggcctcacgaacggcgggtgatccctcatgagccaattgcaaagtatcccatatctccttggcctcctcaagcccatcaaccttgttgaactcctccggactcaaggcggagagaattgcattggaagcttgagcattgcggtggatgagttgctcttgctccgaagtgagctccatgtcatcatggggtacatcaacacctgtacaaacaactttccaaatacttggatgcaaagatattagatgcaacttcatcttgtgcttccaagcggcgtaatgtgtcccatcaaattgaggagcacgcccggaaggtacggagacaaagttgtgagggggaatggtaagtttgctgtaatcaaaatgtatagtaactcccttgggtgatggagttcccttgcttcttgctccatcttcatttctattttccccgttctttccccctaagtccgacatcgtggatcactcaaagcggttgtcacgcccagaaattctcgaaccagaatttctaagctgaatgtgcattaaatccctgtccaggaccagccagggtacacaaacgacaattgttgacatacagatccacgtcttacaaaaatagaaaagattacaaatgcagcggaaaagataaaagcgagctaaaccggggagcttgacttcagcagcgggcgactccactccacaggcaatccttgacggcagcgacgaaaccaactttgacaaaacagctccaactaggaagatcttcagctctggtgtgggggaaaagagagcaagactgagtactacccactgtactcagcaagtcataccggaagaggaggtatgatgcaggatataaccaaaggaggctagaggttcttttgcataaagctagcatttaaaagcagtagttgaaagcagtaaaacagttgtagtaattaatcaatattaaccaaacactgtccaacgctacaccacgttgcaacaggcccaaccaaccacctgaactacaccagttcattaagctaaactaggggtgagactaatcacggtgaatctggttgatcgcccataaccgcgggcacggctattcgaatagttttactctggccagaggtgtacaactgtacccacaagacacgattccacacatgtcgccatgccccgaagtatcaccatgatactgcaaagggggaaatcgtgacaagaccctccacataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccactcccgcttgtggtaagcacggtaagtctcccagggtttcccgtgaaccggtccttaattgccatgggtgcgaccagcaaaaccatgcacccacaacccaccactcagtgtattttaattaactaacaccattgcggtggcacaaatctaaagctatgccaatagtcagagtctatgtaataaggtgatcccttttgtgtactagttgaactaagcatggctaagcatttcctaaaccaacatctaatcattttgatacccaggttatcaatggcatatggtaaacaataaatggctgagtaaaaggacccatccctcattacattgtaaaagaatgcaacatttaatagaaatgcgggatatttgtaaattgggtacaatatgatcaaacgtattgcatgacttgccttgctctcgaactgatgagacctcagcaacgtcttcgagaaactgcggatcgacgaaacggccgaaacctacgcgacaaacaaagcacacaagcaaaacatgctataagactacagaaaaaggaaacaaaaccatttttaatggattctttgcatttttcttgatttactgagacttgaatggacttaaacggagctcggatgaattacttatgaattttagaagataaactgtgtttttactaataaagaaaagtccttaatcaatttattgcgcaataagtcccagggctgacgtcagcggaaggggggcggctgcgccgacatgcgggccccactggtcagcggctccaaagggagggaggtggcgactggcaggtgggccccaccaggcggtggctcaagggggaggcgagggaggcgccggcatgtgggccccacgggcagcggctcaagggggagggagtgggcggcggcatgctcggcacggctcaagccggccggccatggcgaggcgacgacggcgcacgaccgccggcggtgcggggagacggcggcggacgacgcgaaaggcggcggcggacggccggagcggcggcacggccaaaagcggcggcgcacgcgtgaaggggagaaaagggagggggagggaggcatcggccgggctcagctcggcctcaagaccgagcggggcgaggcggcggcgaggcacgaccaccgacggcggggaccggcggcgcgggaagcggcggcggcggccgaaaggtggcggcgcatggccgaagcgcggcgatgcacgtgcggagggcggcggcatgcacgggagagagattaaagaaagaaggagagagaggtagtcctcaccggcgatgtgggggaatcggggtccggcggcggcggacggaaaacgagcggcggccgaggtgcgggcgggctcggtgagcgcgacggcggcgatggtgcggcgcggcggcggctctagcggcggcggctcgcggccgaaggcggcggcaagcggcggagctcgggtgtgacggcgcgggcgcggtagggggcacgggaggagacggcaaatgggggaaacgagagagggagctcgggagagcgatgtataggtgcgggagggggcggacgtggccggggaggtggccgatttggccggcgacgtggggaggagagagagaaagtgggggattcaaatcccccaccacttgcgggcgcgcgcgcgcgggagatgtgggggggggaagagcggcgacgtgggcgcgaggtgcgggcgcggagagggacggagaaggcgggcggcgtggggaggtggggcgccggcggttggggctcggctccaaccggctagaggaggaagacgaccgacaggtgggccccacctgtcggcgcccgaaggagagagggagggagggaggacttcggggaggggagaaggaacgggccggccccaggaaagggcgccgagcgcggggagagagatgggccgacggcccatctagagaaaaaggaaggaaaagaaaagaaaaaggaggaaaaggattttcctgggattaaaattgcactttggtgatttttaattggttaaaattatttccaaggctctgaaaattccactaaaaatcctgttaatatattgtgacatgtggaacccaagaaaaatcccacaatgccaattccaattattaattgcatttattaattaaggaattagctctaggttaattaagataatttcttcggccaatttattt

SEQ ID NO: 59982 - DNA, 614 bp, Oryza sativa
ttgtgattccaggaatacatactaaaccttcagttattggcaagtagttaggaataatattcagtcatacacttagttgtgtggaattttggaaaagatcaactaccgaggcagacctttggtactattgatatgtcagtttgatactttcatacattgcataaaatgagggttcaatgttcggaaaatattcagacacagtttagtgacaacttgtgatattaacccttttggtcatagaattcaactatttctgccaatatttcaattgctttgtaaatcgtttctgtatgtttgtgcaaattagtgtttaatgtaaatcctttgatatgttttttttttttggctggctgcagttggatcaaggtcttggcattggaagcaaaaacccattcttcaaccgtcaccaacttactttgacaaagtttgttaatttaaacaagcaggagaaaggtgctggcaagccacttccagctgttttggttcttcatggtcattatgcaggttgtgtaggagatctgccaagctatgatgcatttacacttggaggaccttactcagttaggggctatggtatgggtgaactgggtgcttccaggaatgttcttgaggtg

SEQ ID NO: 59983 - DNA, 541 bp, Oryza sativa
acagatggagtatttgcacaaaaaaaaagaactcctagggaaacttgacacttggttcacactaagagcacttgatatatctcagagcatcacctggaacccctcttaatagtacggtttttcctaaaaactcgatttcagaagataaactatcctatgcacttctcgagtccggtccgttttgattttgtactttttggggggtctccaagcatccatcttccacaccttggactaatgcacctgaaagctactcaatgagctcattagtcctttaaccacatttgtcattaatcaccaaaacccactaggaggattaatgcactttcatgcacgagcgcaacgaataaggcggtcaaacgggctcgcggtcagcccatgccagtgaaaatggcccacaaacatcctcattgccgtgcgccgccgtttgttgctctgtttctggagggaaaaaagggcgccgttatactcggatggagggaaaaaaaagaccattcggctgctgttcttacggcgatgaagatggtgagcgagcaacaag

SEQ ID NO: 59984 - DNA, 728 bp, Oryza sativa
ttcgtggcacgttgcacctcttgtcagaaagctaagtctcgtttgaatccacatggtttgtatatgcctcttcctgtaccttctattccttggacagatatttctatggactttgttttgggattgcctagaactaagagggggagggatagcatttttgttgtggtggatcgtttttctaagatggcacatttcataccatgtcataaaagtgatgatgctgttcatattgctgatctgtttttccatgagattgttcgcttgcatggtattgtgacatcccggcctagggcttaataggattaatagaatactcatatcaacaagttgcaacttcttttccggaagccaatctccaatgaactccagggtggcctggagcaatttgggatgggtgaccgaccgggaaattcttcccgggtgcacacgagtgaggacaaagtgtgcagaaaatatatgtattggtctgtgaggacagtctattacctatgaaagctatcagatgtaagcgggcccggcctaggggaaggcgggacgttacaaaatggtatcagagccgactctcgcggtttcacgggcgcgtgtgtcgcagttgcgcaggcatggtgcgcatggctggtgtaggccgggaatggttacacagcatggcacatgcgctggcactggacacatggacgtggccaagagaggacgttcctagcctagggttgatcgacgggggcgtcgat

SEQ ID NO: 59985 - DNA, 683 bp, Oryza sativa
atggactttggtagtccatggttgatgatgagagcgccgtttgggctcatttgcttatatatttcagaattatatacttgctgtccataaattaaaatgatgctagagtaacttgtccttacttattttactcattaatttctcaataaaattagctttatgcaaacgttgaacctagagacccactataggctagaaagcttgcatacttctctctcccttatgtatatataattttgggtaagacttgcgagtacaatcttgtacttaacccggtgtctgcaatttcaggagaggattccggttatgagttatgcttcttgtgtggtcattgctctgctgagggtggcgagggcaatgagtgatctcttgcagcttggctcttgcccggttggtttgccctagtggggttgtggcaccaccgattttatcttttgcctatgaactctaattgagacttctgctgctatatttatgtgttgtatgttgggatcttggaccctattatgtgtcatgtacctgctgcactttaaccctattatggtacttgctatgtttattaattgcttgcgatgaaagtgtgaggctagtcgcattcctacggactagctaagcatgagtaacgggttttgatcgcttgagataatcggggatagtgccttggatcgagtcactggggtatg

SEQ ID NO: 59986 - DNA, 3069 bp, Oryza sativa
tctaaaagcataaacagatctattaacaattgatttagatatgcattagcttcacagtttgatggtagtctaaccttcgttgccaaggcccatctgtggttcagcatataaacatgcttctagctccagcatgaacaatttgattcgaaccccatcagcagtttcatacttcagcttaagatatttatatcttgggattgattctatgctgcgtgcaaacccacaaatgcaatattcttttttttctctgcatcaaacctataggtttgtgcatcgcagaacgatgacaccagactctccattttcgttgggtggctcgcatgctcagggacatccaatcttcagtgtctatgccgtactcatcgcgccactccacatcagcattaacaactgaagcattctccattctaccggcaatgatatcatagataaataaaattcaatagcccatacaagacatagccaatcatatcaacaaacacttcttataaaataccaacatctatctagccatttataacccagccacagttccggattacattttaaaaccatatgccttcaatctttcctctgctattgagtgcaaacttatcactcaacattgctacatctaagaaggcaatcttttgtgtatggaactgacccctccttagtaccaaacaacttcgcaccatcttgtgacttaaacaaaaggatataggattggttaaatgcatttacatttttctaatactcgcatcgcactagtgttgctacagtcagtaccatagcgctagagctatgtgaatccaagttgctctctacagtcgatgaaataaattaaaaaaaacacacacatcagccatactacataccgagacattatgttgcaaataaactacatgaaaacaccaaacgatcctatcatcccattcactggcagtgaaaaaccttacaaaccttgacgcggtgatgcgacaccccagattccactcctccctgtacgttccccaaaatcgcagcctaacctccaccttcaactgccctagatcacgctccagcaacaaaaatccttcggatctacacgcatcggtgcacgcaccagtcaccaccaaacagcggagcaaaggcagcggaacttccgatgagaacaatggaacgaatgaatatcagccgtacaaaaaaggcagaaatagggcatcccaaaacagaaacctaaaaagcccatatacagcctctatgtccatactcgcaggcccataaagcccatgcacctctctcctaattgtctgcgcagtcgcaggtaggccatcatcctttcgctagcaacatactatacaacatagtggctgcacattcagttctgtccagcactgccaaacaagtgctgcgcgcaacgcgcgcgttcgcccctagttcccttaatcacttcatcaacctcctgcattgtgaaaggtcttatcatgtttgttttctcctcctccgaaagtttcagtcccgtctcccatacatgttcactcaaatgcacattcctgcatccttcccttccaaacagattcttataatagtcatatatgtttctgaatttgagagaactcagaaattatatcttccccattctgaagtgaaaaaaaaatgtttcttcctttttttctcccattagccaccccatgaaagaacagtgtgttagcatcccctgtaagatccatttctctcccccatcttaactgccactaaatctcctcctagaaataaatcttctctacttcttttttccagatcatacctttctatccattcctgttcaaatagatccctttcatcagcctttgaatcaatttcaatcagtctctgctcaatcttttttcttctcttttttgtatcactcaacatgttggcaccccaccctcttaaccatctcctcatgcaaggcatcaggagatgccagtaatctaaaacccctttctgaagtctcataggccagcaccccttcagctgatccctaaaaccctattgttggaaccagcccatatcatatctaaaagaattgcttttgcatctgtcttcctctctggtgtccagcaaaatgggacggtgatcagaccccacccttaataaagaacaaactaaggtgagtggatttttttttatcccatgaattagaagcaaagactctgtcaaggaccaccataactggacaattttgtttatttgtccaggtaaacttgccaccaaccctatgaaactcttgaagactatgatcattgatgaacttattaaacatttccatccttctctcatctacaatcccattagatttatctgagctatatatgtatatgttaaaatcacctcccatcaagaaagggtacaatcattgagaaatttcatcccccattttcgccaaaaaaacatctctcccttcctggtgtgcaggtccatatatatactattaaaacatattcatgttacatttattgaacctaattttatattgtggatgttactagtttttttctacaaaattagttaaacttaaaaaaattaactgggaaaaaaaaatcaaagtgactatagatggccatatggcccgagatccgtggcctatcccaaggcacgccattttggcccggcccaagcatgacacggcctgactggggtcgcgcccgtgctgacccggcccgacagtcggggcgtgcctaggctacaccctcagcatggtgggccggcccggtatggcacgatagaagaaaatagtatagggacgaaaaatatacttaaataaccatagaaggcatggcccaaataaaagaggaatacaaaataaacttattttccagctatatgaacatagcccatagagtttagggatgaaaattagacttattgtatggagaagcacgatatactgtcgtgccttcgggccggcctagcacggctggagtcgtattgggccgtgactgggccatgtgtgcagcacgtgggctggcacagcatggcccggcatgtcggttgggccgtgctagcccaattaacctcggcccaggcgggcctagaccatgctgtgtcggacggcccatatgggct

SEQ ID NO: 59987 - DNA, 6488 bp, Oryza sativa
agagggcagtagctcttcgatccaccgtcccccaagcatccaacgctactgatgaatagcacatcactggatctcgttccccacatcactgtccatcaagccattagcgagttctcacgtctcatggtcaacacccccaaatccaatcgccaaatcctggcttcagtgcccgtaggcgtgctacactacaaacagtggacgtgccatgccacgacagtgtgtcgcgggctagcggcaacttggcgatgcaatgatgggcttttggctgctcccgtggtctgtgatataacgctccacaaacatgcaagctcaaattcaacttctatatctcgtaacaaaaaaaacaaattaaccgcaactagttaacgtatattcagagtcaaatttgtttttttcgttgcgagatgtaaaagttaaatttttacatgcatgtttgtggagtgatatatcacgtgtaaatatatcttctcaattttttcatagccatttagatcccaccctaaaattttgatatcaccttaaaatttttcaccctgtcacatcgaacgtttgaacacatgcatgaagtattaaatataggcttaaaaaaataactaattgcacagattacgactaatttgcgagacaaaatttttaagcctaattgctccatgatttgacaatgtggtggtacagtaaacatttgctaatgatggattaattaggcttaataaattcgtctcgtagtttatagacagaatatgtaatttgttttgttattagactacgttccgtatatccgatatgacacgccaagacttttcacccttgtttctaaacaccccctacatccaaacaacgaggatcaaaatccacttccggtctgtgcaccgcggccgcggctcagttcatcgccgtcctgagcgacagcgcggccgcaggcgacctgttcctcggcgccgccatgcacacgcggtacgccaagtcgcacctccctttcagtgctgtcagcatgtgcccacactaggaaagtcggtgaatgttgggagtatttttactaaatgaagcacaaatatggcatcgaaccttgcgaagaacactactctgcatggttgacgtacttgcccgtgccaagaactttgagaaggctgaggagttgattaaagaaatgccttttaagcttagttcaattggttggacttcctcgctgagtgcttgtaggacacatggaatcatggatcttagagcaagagcagccaaagagattctcaatttgactccttacagtgcatcaacacatgtggtgctctcaaatatttatgccactgttggcaaatgggaggaggctgcacaaatccggaaactattgagaaatcggggaatcagaaagaagcctggctgcagctggatagatcttggcagaatagtacatattttcgttgccaatgatatctcacatcctaggatcaaagacgtgtacaaattcttggaggtgatgtcagagaagatgaagcttgcagggtatgttccagataagatatgggccttggcaaaggatcatgctgccggaggggagacaaggctaaggcacaatagcaagaagcttgcactagcatttggtttgattaatacagtagaaggagaacctatacttgtgatgaaaaatctaaggacacgtggagactgtcataatgccatcataatcatctctgccataactttcagacagattactgttagagatgcacatcggttccattgtttcagcgatggaagctgttcctgtggagattattggtgagacagaaaagttgactcaaattcataagaaagatgagattctgttttgtttcaatgattacatcggatgaccatcatagttcttcaccacactagactggaatatagtcaatttggtcaaagtagcagcacgtatgtcaaactttcagcttccctaaaaacttgagttgtcccaattgctactaagatcctcagtagaaaagccattgagctatgaatttatctgaagctaatgactcaactagctcacctcacaacccaccttcatggtataaatcttgtcatcttatcttgcataatagtttttacatgatgaagcatttgctgctcaataaattttataccactattgttttttagggttctctttagttaagatcattaagacattgtactacttggaaggctagtaagctgtgatgattaaaacaatattcaatggtaaagattacatgaaattaactcttgttgacaatagaaagatactaaaattaattgtttgctggataatgcaagtaagatcacttacttgaagaagaaggtgttcctgatgctgccacaggttctccagctttcttgttttagtatatgaacacgagtttagcagacgttgcatcccttcatcagtgtaagactccaacttttgaatttgtagatgcttgatgcttgtactgatattacgattccaattcttcactaattaatagtaagagagaaattgatcttttctcgatacaccactaaaagcagtaataatctactaactagttaagctttttattgcggggatactaacatagttaagctaacaacctttagtaaacaaatggtcatagtactatcagattgtgctcagaaattgttctggaactacaaatgatatgactatgtgtctaaaaccataaaaacagattgtgccttgtgaaaagcagacccaagtgggatccctgatcaaatatcatatgtggaataaatatgtttatatgatcagcacatgtattaattcatgatcatgtctcatggatcatggtatagagataccaaattaataatgtggacacatgttgatgaacatgttggatagacccaacatgagacactgcaagagccatatgtgttgtgtcatcagtgatctcattgagtattggtgttgaatccttagacctgagattatcatggttctcaacatgtgtaatagcttacttagggactgctaaacgctactccgtaattgggtagttataaaagtagttttcgggtatgctatgaaacatgtagtgggatatgaataatcaagatgggatttgcccctcctatggagagatatctctggacccctcgatgttgtagattatggaagtgtatggccatgccaaaggtgattgaggagtcaatcataagttatatagtctatcaacaggttcgagtgaatgattgagctattagaggatggcacatatctagccttgagcttaatcgatatcgtgaggcaaaggggttcatacaagtatatactagaggttcagccgatatgatctttatgtatgcccgatgggtcaataagttctgctacgagccactgttgacgcgtggaccgaaaaggagttttcaggttacagccaagtatacatgaacctacagggtcgcacacttaatgggccggaataagaggattggatagagatccaatatgagcttaattcggatagggatccgaatagtagtcctacgggccttggaggcccgagtgatggatcctatatattcgtgaggggtgtgaccggtggaggtcagagaaaccctagccgtcacttccctacccgagcaaaaccctagccgcgcgcgggtgctagcacatctgcacgtggcgttccgtccctgtacgtgtggatactggtagaggcgccgctggtttgcggtgctgattggcgtgggagtacggcgaagagaacgcacgaggaggagaagccgagccagtgcgatcgactacttcctctacatcgacgcgcgctacttcgcgagagttccttcgacttctcagcgtcttcttccgctgcacagcgcgttgagtggtaacgatctatgatctaatacttgcatggttcctggtttacgcgatagaaaattttgatttatgctatagtagcctacgcgtatcccaacagtggtatcagagccgccttgtatagtttatgatctagatcattgcatataattgatatgcggatgtagtagatgagatgtattatgttgtatatgagttcttaggtgatcggaacatgagatgaaccgatagccacatgggttgatgagatcaatcggtatgtatgttggtgacttcactagaatgtttagtactcaccaacgccgagcgcgagtgtgttcatcggatagtccgatgtccactggaaccgcacgccaatgagaaaaacaagccaatgagattgactcggtttcggcataatttgattacgccgttaaggttttcacccgcgggggacggctctcccctcgaccccctgcccgctaaccggctagcgggaccgccgtgtgcgttgccccttagatttcgcttgggttttattatatctatcttactttattgctgttatatatttgatatgatatggtaggatagattccctcagaaaaattaagtaatttatgctcttccaataattgcacctattacggttgtgatcataagtgatgggtttgccatagcaaagtgtcactttttatcatgataaaataggatagatatcggacatctatatgcggagatcattggtttacttgacaaggttatcaaaacagttttggaccttggggcataggttgggttggacatggagatgtcaccccaatagcacaagagtcacatatgatgtgattagcaaggtgttgcttacctattttgatagttgtctagctgtgatgccaaagcttactagacactaataaaatgaggatcttgactcactatgttactagagggaattttatttcacaatacatagtgggagtatcttttgttaaattgtttaatgaaaggttaaatgtaaacatggtgctgattttgcatgcatatatttctattatagatcatggcagctcctgcaccatccaattttaacttgtggtctattcttgagaaagagaagttgactggaataaacttcatggattggtatcgcaacctgagaattgttctcaggcaagagcacaaagagtttatgcttacacagccttttctagctgacttgcccaacaatgctcctgctgctcaacgtagggagcatgaaaggtgatgcaatgaataccttgatataagctgtctcatgcttgctactatgtcccctgagtttcaaaggcaatatgaggcattggatgctcatacgataatcacgaaactacgtaacatgtttgaggaccaagcaagagctgagaggtttaatacctcaaagtccttgtttgcgtgcatgcttgcagaaggtaatccagtgagcccacatgtgatcaaaatgattggttacaccgagagtctggataagcttggctttccccttagccgagagttgactactgatttgattctccagtcgctccctcccagttttgagccattcataatgaatttcaacatgaacaacctgaacaggaccttggcagaattgcatgggatgctaaagactgccgaggaaagcattaagaaaaactccaaccatgtgatggttatgcataagtgcaagcccaacaacaagaaaagtggtcaaaagagaaagctaaactctgatgagatcacaagtactagcaactctaagaccaaggttcaaaagacagggcccgctaaggatgcagagtgcttcttttgcaaggagacatgtcattggaagagaaactgtatgaaatacctagagcagctcaagcagaagcagcaggatggaaagagttccacctcaggtattaatgttatagaaattaatcttgctacttcctctactgattcttgggtatttgataccgggtcagttgctcacatatgcaaatcgttgcaggggctgaaaagaagtaggagcttagcaagaggcgaagtggacattcgcgtgggcaatggagcaagagtgctgctattgcggtcggcactatgccattatctttaccgtcaggattagttttggaattaaataattgttattgcattccagctttgtgtaagaacgttatctctgcttcttgtttgcaagaagagggttatggttttagatctgtggacaatggttgttcagtctattataatgacattttctatttccatgcacccatgatgaatggcttatacattgtgaatcttgatggatgtttagtctataacattaatgcaaaaaggcaacgtctaatgatttgaatcccacttttatttggcattgtcgcttgggtcatataaatgagaaacacatggagaagcttcatagagatggacttctacactcgtttgattttgaatcatttgagacatgcgaatcttgtttacttggcaaaatgacaaaggcacctttcgcgggtcaaagtgaaagggcaagtgaactattgaaactagtacatactgatgtatgtggaccaatgagctcaactgccagaggtggttttgggtacttcattacctttaccgatgactttagtagatatagttatgtctacttaatgag

SEQ ID NO: 59988 - DNA, 1541 bp, Oryza sativa
tctttataaagtaaagttggttgcaacatttttccatctgtaatactaaaaaatctttaaagttgaactttacctgttcccctcttgagttcatcggtacatttgtggtttgttgatttatactagagttgtactaaaatgtactaaccaattgttttcgtgcttttgctgtactactatatgttactctaaatataagtcatcttagtcttgtgcgtgaatttaggaagtgacttatatggccttgttaccgttcagttattacttattacactttggagaggatacctcatttattcgtaacagtgataacattcagtcattcaaaacataagagaaaaaaaaaaggttggacgattatacatgtgcctagatgttgctttaagggatgtataaagttgaagttaatagtttcgatttaatacatcatcaggccctcttttacatcccccagtacaagataactgattggttttaactagtaaactaatatgttttattttgcatggctctgtaatctttcttttgaaccttgaattttctttattcagttagccatataagatggctggtttcactctttctacacacacgatgccatcttatgtgtcaaccaaccttaccctttatttgtactcgatatcatttgtaatatggggtatcatttatatcaagatttgtttgcattaaacaggttgctcttgcatctgggaataaaaagaacattgaaaaagtgaggaaagctcagcttggtatcacctgcccaatgttgtaactgtggacgcatttggactgtcattaaatgaagatcatctgcatcttaccactgaatcacaagtaaagcttggtgaaatgctcgcacaagtctacatgagcaatttttgccagcaacatgctaggaggagtcctgtcaggtgaaataatctgtttaactctggaagtttggcacctaaatatctttctctttaaactgttattataattcttcattttctcgttggttgaaactatctagaggtgaaccaaccaattcatcttgcatttcttgcacagtagcattgatcctttcatttaacaagacatcaacttactggtcaattatgggttggatctaaatttaacaattcgagaaccaaacattacccaaaagaaataattttcttcttttcaacattagttggccatgtaaaaaaaaattcaacttcaatgccttttggggtccttcaatatataaatttcttctttattttgaacaaaccaatttgatgggaaataaaaacttctggttgggttcatggcaattatactattgggggcatgtttccttcacatatatttgctaggcctggtagattttaagctcaagcacttcaaaagaaaagttataaaacttacaccaaccctattcattaaataaatagaaaaaatatattagtatttttctttattgcattcccatgttttcagggtcttctcatctgccgtccacattattgcaagactgtcaagtattggtttttaatcattaaaaaaccgtactt

SEQ ID NO: 59989 - DNA, 7418 bp, Oryza sativa
atctggagcgccgcgtccatggagccgctcttctcggcgccttctcgccatgcttccatggttcctcctcctcccatctgccgccgcagcacagcaggttttcccgtgatcctaactccaacgtgcaaaactgcagattactacgttctagaaacactgaaatcaactgcgcgtgaaaatttagcgaagaggtgtctgcggcggcggcgacgcgcgagcaggagcagacgctgcgcttattcctccaagacatcgagagatcaatcgtcttcggaatctgcaagaaccccgaaacaacggagttcttccgggaccaccggcgacggctcgacgactacttcgccgccgccaagaacctgctgcagatgttggagcaccccgtcttggcgtacggtgatctgcacaaccgcgcaaaatccctcctcgtcacggccatgggctcccttgcagtggagttgtgccacctcaagatctggaaacctgacgctctggcaagttatctcggttgcacacctacatctatctgggagctcgcgaggtccagctgccgcggaggcggcgacggttctggctctgcctcgtcagcctcatggatgagtacctctcgctcctgctccggcggtagcagcggcccaaacggtgtgagctttgacggatattacatggcactcagtgaggagagaacagtgcgaagtggccaagcttcgtcagttacggccagtcacattgacctcaagtcagtgtccatcctcaacaagattgctgatttcatgattggggtcggacacgaacagatgctccgaggagctttcgatcaacacagtgagcatctggtcaggttcgtatatttattgattcagtatttctgttgatcggttgcttgatctttttgtttctgctagctgattgattgcagcaatcgtttgtcctgcacaagttcttgcagccccaaataattgtacctaggcaaatacagtaattaaattgtactacctatttctttaacttgattatttatacgttttgtaaactttatttcgtttgtgatcttgactaatatggaacaggtacattgaaattcttgacattgataaaattttgggtaaccacatggaggaatccacagaattgctattgaaggtctggacatcgacaatgcggactgtctttagtgttctagatgagatgcgaacgcagttgaatcagaaagaccatggaacattcagttcactaaaggtggactacttctctgcaatcgctaaggaatcagtcatgaagctgcttaactatgctaatgcaatctgcattcaggtgggtccaaatgatccttcctgcagggatactcatgcatcagttaagcattttccatccaaaatggtcaatctgttgattatgttccaggcattggagtatgccaagatggaaatcttagatttgttcttgggtcaaactaagggtcccattttaatggaaattgaaaggcttacaaatggattgtcagcagtttttcttgtgctgttggttgaactaaatggtttgctcaggtcacaacatttggtcatttctaacacgggtgtccatcatgttacacagcatattatgggtcttatgcggttgctggttgaacaaaaggacaaagtccatatgatgctaaacgataatccagataaatttggtcaagtagtgactcaactgatctcatccttggagtttatgttggacatgaactctaggagtttggcactccaagggcagcaactggtgttccttctgaacaatataaacttcgtgcttgagcaagctaacaattatactgatctgaagctgattctaggagaaagctggtgcttgcaacgccatgtccaacttgatcagttcttggcaagctatgtcgaagcttcttggacacctgtgatgtcatcattcataataactcgaattcctaaaattttatggccccagcaattgttcgataagttcaattctcgttttgagatgacctacaatgtgcagaagacatggaaggtcacggatcctgtgattcgacagaagctgcgtgagaagatcacccagaaggttatcccattgtaccgaatgtacttggagagctactcggacaagaagcaaaagtctgcgaggttcaatgttgagcaccttgaggctcgattgctggaaatattcgaggggtaaatgaaagatgtgtctgtgcagtaaatgaaagacatttaggacgatgtgttactgtaaaaagttgtgggtgaacttcttggatagtactattgtttgaaagacttagattaatgctctactagtttacttaattggaaaatgtaaatattttgttttagaggtaagactactcaaacaagtattcgtaaatttacccctccttactttccagggttgtacttgtaattgaaatactatacattttttttctctaaatgatactacctccgtttttaacatataatgcaagttgattttttaattcatttgattaattctctttgaaatatttatgcaaataaacaaatatataatgcacatttataatacttttgatggcaaatttagtgatacttttccagtttagttacttattaattaagtgattgaataaatattattagtcaaatttgaataaaagttgacaatgtcctatattaaaaaacaagtatagtaaccaattacgaaaatttggcaaggggaaaggatgagtccaaattgctacaaccaccaaatctgatgtgagagagattttttttatttctatttttttttatttttctactacttgaaaacggagtcatccttctccttcctcaccatcattgttcttgcagaacgatactaccccagcaaaacaatacgtgcccctttaatttgaacggaaaacataggattctttttaagattcatcttttttctatatgatcctttgaaacttgaaaactattgaatcctataaaattcctcaggaataccgcaatccatacaagttttataagatttttaacataaggtcccacctcacggaaagtttcctatgactctatctgtcccatccaattgctacatttttccaatccaatcaaacaatcttctgttttgagcttgaattcaatcgtatgtttttaactatttctccctttttctcgaggacaatgctttctatcggacgcctgattcccggagaataaatcgggtgctgcccttggagcgaggtcacgaagcatctttctgttagcattaaaagccatgcatccatccctctccctctctttctttgcatgcacagagccacaaccactctctctttctgcatacatgcatgtaagttgctacttgctagtatggtttatataattttttctcttaaaatatttatctgatgtgcaatcgaattacattattatatttattataattaaatttttataacaagacctcacattattatattctaatcaaagaaaattacatgcttcatatgttaaaatttgatgtttcatacgttagagagaaatgtttcaactttcaacaaccctctatgtgtttcgatgatgtttcaatagcactttctgatgtttcactaatgcatttacaaaagttgcactcgatgtttttgatgttttagtaagtattttataatgtttgatatttttttatcaaaatataatcatgtgatattttgttgtaaagatttatttacaataaatataatgggtacaatcagaatatatattagataaatactttagaagaaaaaaaatgattcaaaagcttgtttagaaagttgatagagagataggagtatatcacgtaggggtataactactaaacaatatatggtatgggagtttgtatgagcataatagcgctaagggcactcaccgtgcgtatgcatatcttgcagggaagagcatctgatttgtgagaaaaaaaaatcagagtgttcaagtagcctgtaaacagtggtgaagccatcgagggtgttgggttggcatggcaccccaatgccaccccaccctgggtaattagccaccagtttagcatataatgtcatgggattagctgcaaaataaagcagctagctagctgcccaatatttcttccttagattacttgtttacattattaattaagagaaaaatctaataaatgtcattgacaagctgcccaatagttcttacttagattacttgtttaaattgattagtcaattaaattggtgtaatatagcgaccttattttaaaatggtattttttagatatattctactgttcatatagacatatatgaacagaaaatgtgtgttgaaagacgtccagaaccacatcaagaaacatcatataatccttataattataaaaggtcattggacatattaaatttactagttaggtacccatgcgttgcaatgggaaatatttatataaattcatatatactctatcacttgtctctctctcgccccctctctctcgggccgtcggcgcgggtcgagcggcggcggcagcgggtggtcgacgtccgtggccagacagcatgggtcggctccggcacgatgctcgacgaggtgtactacgccatcgccaacaagacctcccgcctcgggttccccgaaagtgtcagcctgacggtcggcatcagcgggtacctcagcggcggtggctttgacctgatgctgcggaagcacacggcctcgccttcgaccacgtccacgacgccaccatggtggacaccaagggaaggctcctcgacaggccgccatggaggaggacctcttctaggccatccgaggcggaggcggcggaaacttcgggatcgtcttgtcctggaagctccggcttgtccccgttccggccaccgtcacggtgttcaccgtccaccgctcaagaaactagtctgccaccaacctcctcatcaagtggcagcgcgtggcgccgtcccttcccaacgacaccttcctccgcgtcgttgtgcccctgtacctcggcacacgcgccggcctcgtcgccgccatggccgacaccttcccggagctcaacgtgacggtgagcgactgcaccgagtgacgtggatccagttcgtgctctacttcgtgttctacagcacggggaagccatcggagatgctcctggacaggggcaacggcatcggagatccattggggtcatggatgcgattggcgaggtcgtcgtagtggtcgatcgggccgttgtcaatgaagaagtcgacgccatcgccgccgccgcctcgcctcgcttcctccgcagccacgctcttccattgtcgcctcgcctcctctgtcgtgcttgcgaagccgacctcgctgccgtagcctcgcctcatcccgagctccgcctccagcctcctccgccaccagccaccaccctcatcccgagcgccatcccgaccagtggcggaggcggaggcggcggctggaggcggagttcgccgccgccgcctctgcgtcccgtgtggtcgctgcctccgtgtcccttgccgccgctgctcccttccggaccacaacgccaaacgccttcctgccgccgcaccgtgcgtgctgtcttgagtgccgacatccgcaccgccgtcctcaccgatcgcccgtccctgcgccatcctcaccgaccgcccacgcccaccgcccgtccttgccgtgcgcgctgcaagagagagagaggaagagcgagagaggagagagagaggaagaggggaagaagagtatgataggtgggtcccacatttttttattaaataaatgctgaatagctactaagtacatagacttttctataaacttaattaaacttttaagaagtttgactgcagaaaatcaaaacgacttctaatatgaaacgaagagagtattaatttaaatccatagctaactgtagtttttttttccagagcaccatatttacaatctcaattcacaattaaattttacaagagtgtataaaatatagacaaacaaattctccccaggtttccacacatgacaaagaagttcaaccgatttcatcacattgtgccagtaatcaaatcacagaaatctaacagttcacacatcacactcatattgtacaggacaaaaatgtgaaccgattccatcacacatccaatcaataccattcaaaatcatagttagtcagttagtggccaagttcagttggtggaactccacataaagattcaaagtgcagacctagaaggtgtattaatcagtgaacaactgctatagttacatcacaatatatcgcagaaaggtacagaaaattattggacaagagattatatgaatagatgcaaacatattaattccatgagaacaactgtattgccaatacagattactgaaacaccaatagtagcaggaagttccacatcctatctaatttcaaaatatggtataaaataatatttgcagatttaaacagaatttctgcccagaacatgaatcccagggatataaatctgattgttctaattggtcctctgtgacccttatacatgtgaacgcatatttttttgctttcatcccaaatcctagctaagatctgtatctaaagaacaagatgcacgggcatattactacgtcgttgaccaggggatcatcctccaagtatatgacttcaatagtccaagatttttaatttgtcacttctaaacctttgagagaaaaatagcccagcaaacaacggcacatttttgtgctaatgcactgttatttgaatgcaattttttaaaaaggaactaaagcatggcttgcttaaaataggtcacattttatgagcaaaatgatcacgttttaaaaaaagaaaaaataatcgggcgtttgttaatagtaaatcattaaatttctcaaaaaaattatatatttgcaagagggcataagaaaggaagacatgggcgaaattagcatgcaaagagtgcatcatttgagtcaataacatgcacatggctaacctgattttgtacttgatggtgtggagcccccaacaatcttaaccatttctgaaaataaatgagatgatagatcaaatattatgaatttgtgaaacaaccaacagaaatatgcagtgcacacgtttcattgatgacgaggctagcatcttattatgcatctgtttgatagatcaaaaatagagagaaaatagtgaacaaaaaagaatatcaaactactccccaggtttcctcacgtgacaaaatagttcaaacgattgaatggcatctcattgttctaattgctcctctatttaagtatcttaaaaacaagatgcaatggagtgagacactcaactttcgagtcctgatagtacatctcaagaattttagaacaatagtaaaagctcgaaaattcagcagtaaactttcaagtgtacagggcatctttagaaattcatag

SEQ ID NO: 59990 - DNA, 806 bp, Oryza sativa
tcccaatcacttgatttaagtatatatcaacataagaattatatattgttagtatctacagctgatcgaatagatttagttctttcttacgtattcataactgccgatcgattcaaatatgacatcggctcagagataaatgatatatcatcggcaactagccgaacggctatcatttatggatttaaccacgatttctttgtctttatttcttgttgattgcaggatcaaatcaactggcacgctcagatccaaaagcaatattttttggatctgcactggagttaagtagatctcctaggcctcgtgtttttctcatcaacacgcttttggcacgcccggtgggacccctaattagaagtcagagatggcactagaaaaacaacctccgccattaacagacaagtcgtcagagcctcaaaccaagatcctgaagctaactggggctgaagttgatgacggaaatgatgttccaatcactgtagacaagctgtcaccagagcagaagaaggagtttgaactgatgatgaaacatacacaacaacagttcatgaattcattcacagagactcggcaaggaagagttgttcagaagtacaagttgaaactagttgccgacgtccctggaacaggttcttctaaagatggtgaggtgcaaaaaacttaagttggtacagatgattcaggcaataaaggtactgctggtgaaccaggcgacaagggtgatggttttcaggagggagcagttgaagatcttggtccagatagcaaggactgcagccacaatttaacaattttcaggatcg

SEQ ID NO: 59991 - DNA, 2226 bp, Oryza sativa
cttctgctctagctgcacgagctgcaccatcatcagcacagacaaatgaccaatccacgattgcagatcagagaacagccacagcatagctggcaaaatgtcaatcggatgactcaggagcaggttgctgctatgttcttaccaaatccaccagcggctgatccagcacagtcgttgccaagtcagcagacaccgtaaaggaagctaatggttcagccgattcaacagcagaacttgcaaaatgcatcggctgggttaagaacacctgataatcagctaacacagcacgtggcaactcaggtttttcctgaacaattggttcataatgtacaaccagatcagtcggttttaccacaagttattcctaagcatttggtgcgtaatattgttgatgtaaaaacacgaggcctgggagatctgcttaactccagtgcaggtccaaaagcttgcctttaggttcgtgagcatgccagttgatttgttcttgcaatcaacaagaaataaagacagggaaaccgcggttaaatccataaatgatagccgatcggttaattgcgatgacataccatttatcttttagccgatgtcatatatggatcgatcggcaatcgtgaataagtaataaagaactaaatctactcgatcggctgtagttgttaacaatatacaatccttatatcgatataaatttaaatcaagtgattgggatagatcggtcgccatgccgagacagtataaatcacttagatcgaaatatatattaataaccggattatatatgtttataacatagccgatcagatagatctagcatgtatcggctaatactccgataccactttatattaagatattaaagcaagtaaaatacgtcaaacataagcctaacatatctaattacaacaagatcttgatgtaaagggcggatttaacatgttaatcaatcatgtaacgtaaaattagttaaatcaggtaagattggctgaaactccgatactactctaatgggcaactagaaagctggctagagattaatattctaagcacgacttagtagatcaaacttaactgatgcagcactaagtatgaaaagaagaacaatatctagacaatcaagccgctggatgtttcaaagagtggtggatatcctataaaatccaagccaacgttgctatttaacctaattggcttccttccgatgatagatgttagccgattgtaggttaaataatgatattttcgtggattatatagaatatatgataactcgatgaattacatagacaagattagagtatcataaagatggaagcactaatcccgagaacgcaagccgccataacaagttttacctctagttgaagatcgaaaccgatgtagctcaacccgaaagcaagaactcgtcgaaacaaagtgaaagtaaaagggtggcgatgcgccgagattgtattgaacgtgtgttagtttgattacatggggcttggggtctatttatacccgagattacaaaatatgtccgtgtcggacatgactcttatctctaacaaactctaagataccataagtctttgtggcagacttttgcccaaacatatctctaaggaaattacatgaaatatcctaattaatagatacaattgccttctcaagactcaatccgtgcatggcaatcctcatgaagcgcattaactatcctcgacaacgtgtaccgcatcacattgtcagactcggctcaatcggctaaccttgtccaactcggattccgccgatcctggtcacatccgattcggactttagccgatccttactctgtttccgaaacgatttccatcttggattccgcctcagttttatctccatctccgatactgaaattaccaaatttggttgttaacaaatttacatagtatacatacattctagttaaccgatatactagctaataccctctatccgatgccctccttgtacttcgagaagccacccatgactgccgagttccttatgacagctcgtcatgaccataaaaccagggctaaatacggaggaatactctccagggaattaacttaggattatatacaagcgcggaggaatacccgtactgagctgtcaccattagcagcccacctcatcatcagcatataaccaaaaataatgatatcccgtaatttagacacacgtcaaaactaccagatactaccctaataccatcgtcattacata

SEQ ID NO: 59992 - DNA, 1608 bp, Oryza sativa
aatgctgcttggtattttcttttccacaatgctcaagtaatttgctttagagtggataatactctagagtagttatgtttgaggaattatgtagctctggaattatatgatcctatttccgaacatgcttaccttcttgtttgatataagttgtgcaataagctggtccacaaaatgtcaataatgataaggaataaggtcaatgcaataaaaattgcagatgacccttgttctaggataattttagaacctaaatcaataaatggcagaatgatcctcctttttccaaatcgtaccttggttggtgctttgtcttaaactaaaatatcccccttgtgtagttttgcttggcttgaattggtaagccacagaagcttcatgccaaagctattgctgtgcaatgcacagaagggctggccattcttccagaggttgcttgtcgatttgttcaaattcatggaaccatatttaagaaatgctgaactgggacaacccgtaagtattattcctgcatattcatttgtggctgtctggtacatggttcactgcattctgattttggtacactattatgttctttttttctattgtagatacacctgttgtacaaaggaactttgagagtgttacttgtgctactgcatgacttccctgagttcctttgcgattaccacttcagtttctgtgatgtcattccccccagctgcattcaaatgcgcaatgttattcttagtgcttttccacgcaatatgagacttccagatccctctactccaaatttaaaggtatttactggttgtgtttatgtaacacttactctaatgcttttccacgctattgtatgtttgatcaacttaaccatttttttgcaacacagattgatcttcttgctgagatttcaattcctccaagaatcatgtctgatgttgatggtgccttaaagtcaaagcaaatgaagacacaggttgatgagtacctcaaggtgaatgacaattgccgccgctgtcatttattttatggacttaccaattctcactcatgtatttctttaatgtaatgatggtttagtgtgtctctattactcactcattcagcaattatattgttgaaaactacttgaccgaaggtggtatatttaatttctcaccttcacttgtatccgcgcagaggccagatggatcctttttaactgatttaaagcagaagttacttctgccgcaaaacgaagcaaatattgctgggactcgttacaatgtacctcttgttaattcacttgtgctctatgtgggcatgcaggtcagtttctaaatctgccatttgcaagttgcaactaaggtgttctgttaatgacatggttattatctaatgcgtctatgtttcatccaactaggcaactagccaagcaatataatatcgtttgttcaaccagcatttatctataattttcatggtcctttttgtgtcctccttttttagtgcaaattcagatttgtgttcgccttctactcatgtaatatgctcatacttggtattctatcgtatggcctgaccatgtttaactggatgcatcatatgatattgattcacaattatagtcgtggcgtggct

SEQ ID NO: 59993 - DNA, 518 bp, Oryza sativa
cagtccaaattcagcactgacagactccagtagcttttcctcccattttgcatctgcaagtcagactacagaactggtacatgaagaatcagatcgcaatgcacacctttcaaggtaaagatgcttggacttcttgcatttatttacttctatcggagcactcattcttaagtcttctgcagcctttcttcaaaaattggcgcgagtgacacatctacccaagttattggaaccacaaatgttgcatctgtttttccgcctatggttcccaatgaccttccagtgggtgaaccaacaaccacgaataaagtcagtatcttttactcttgtatttaaatgaggaaatggtgctgaatgcgttctcttatacctgccaaactctgttaccaggatcttgttacttcggcaccactttcacctacaactgctgttgatcggatgggatctgtttttgtggaacctttgaatactagtgatgcgctggagatgtaccaacaagtttcacaaaaggtacaaat

SEQ ID NO: 59994 - DNA, 2244 bp, Oryza sativa
ttgatatgtacagatcctaagtaacggaaagttcagaagtgttgagcacagggccgtgataaacccaaataaggagcggatttcagcatcactgttccactatccgtgtgagaatatggtgatcagacctctgacggaatttgtgaaagatggtaaagtgaattacagatcaattagttaccttgatttcatgacacaattcttcacacaacagcttgatggaaagaacagactggagatgttgaagttggaatagcagccatgaccacgatgcctgtagtagtgtagtgaaatactgagatgaagctgcttcaaggctgtgtccttgagatttgctgcttattatatctagaggtgtccaataatcctgtgttatgaggatgatttacctgatattttgagtcttgtcccatatatcaggaactgcccgtactcaggttatgatgcaaacatccaaaaaataaacattgatgcctagaagaattaactgtacgataatagaatttcagttcagactaacaaattaggtacaccatcttccatgctaaattttggcacactttggcattactacatttcggtagcgttggctttgtttagtttgatgtctttaccaaattctagtagagttttaagaaaagaagcttctagagctgccaaaatttaataagatagtaatggttgaagtgtgtttagtttgttgccttaccaaactttggcaatatcaaaatttggtaaggttgaaaacagcaacaactaaatatgcacgtaggatgtcatgttctcttatttagaattaagagagaatgattgttatgtagcatgattcaaccttttcttctttgaagaggaatggtagagctgttcacatcagttgaagcagacagacaaggtgattggaatttgagaacatcaccctgcttttttccatggttagtcatcgctgatggcaggcgagtcacacttgatggagaaaattccaagggctcttttgacgtgaagatggaagatagtgtactacaatgaagagcttgaagccatatcaggataagagactctgccttccccgtctctgatactgtatgtgttgctttcagttggccatctatatccaccagtttttctatccattatctttaaaaaaaatcccttttgacatagatgtgttcctctaatgacatagatgtgttcctctaatgccataaggtagagactctctaccttttacttcaaaaaaaaaaggcatgatttagctagtgtaaacacctggatacctaaacagtaaaccataaaatcaagtgagtgttcttctgaaggtctataaatatggtatattctacacgttatatgcagtatacagcctagaacaactgcttgccaaaaaaggaaaagaaaagaaaacacttagtgcagaaactgggaattgcaatggcgggagcaagatccgttggttctctcccagtgcctaatgtgcaggcgcttgcagaaatttgcaatgatccagatgaacacatacctgaaaggtacatcaaccagaggctagttctgaggaggtcatcaacaactaccaaggtgacatggcgattccgatcatcgatctcaagaaattgctttgtccgcaatcatcagaagaggagtgtgtgaagctgagatctgcctgccagtattgggggttctttctggtatgtaactttaggttcttggcatttcatcttcggaaagcaacagatacctatttgcaaatgcatactgtatatacaaatgtttgaattgattaaagacgctacagataatcaaataaagttgtgggcagaaaatgaataaattcatgtcctgtaaggtagctctagctcagtttgagctgtgcaactagtataatggaaacatttacttttggaataaactacagctcattaaccatggagtgccagatgaagtgattgcaaacctgaagagagacattgttgatttctttagccagccactggacaccaagaaggagtacacacagctaccgaatagcctagaaggctatggacagagctttgttttctctgaggaccagaaacttgactgggcagacatgctgtatcttcatgtccatcctagcgattcaagggacctaaggttctggcccacttctccagcatctttcaggtgatctaccaaaaaaaaaaaaaaactgtgcaatttagcttttgataggcatctgtctcttcttaactggagatgtctggaaatagg

SEQ ID NO: 59995 - DNA, 1322 bp, Oryza sativa
acccaggattgggttttttttgggacggagggagtatgacataaatggattagaaggattttagccattgaaagtggaaaccaataggaacaacatgaacagcatgttacacatcctaattcacgtatttgatggcaaatagaagccattgtgtttcaggcagctcatgattctggggaagcaaacatactgaatcaaacacacctgtagttcaaattctgccttcctctttccccatcattgagcaaacccctataaagcaatctctgtgttcaatatcactgagattggcatgcaaagaacataacacaacctgagatagcaatagagaggggaaaaatcatggagcagaatgtacgggcagctggggaaaggataatatgatcaaggcaacaccttgaattttagactaacatgaaacctcatagtcctgccagatactgtggttaatgatgcatcatgcatgtcagtatgatattactaagctatgtgaatcttttatgtggatccttattacccgctgctcatctaatcattagatttcgaaagaatttagatttcttttccaaaaaagaaaaaatgttttaagcaaaacatttttctttaatgagattgaatatttctatgcaaacagcaaaatcaaagctggaaagagacaaattacaaattgcagccataagttgaagagcaaaggggcggaatggtggcagaatacagaagaaaactacacaacgtaaaacactgcatcaattttcaccctcagataaataatcctcaccggtatcagcaatgacaatgtcataagcagtccatttttttgtaccatggtttggcatgacttactaaattaatgtccgaacgactgcgttgctcgggaaaataaaatctaagcggttcttggaagggaaatgtcaatgcctcatatttctgctgcaacctgtattttgtaacaataccacttcattttgtctatcaataattgcaatcattttgtggaatacaaatgtaggcaaagacatgtagccaaggagtgtgcatgatctgaataaaattatgcctctcttggtcacatgtagccaaggaccttgcatcttttctggacaacagttgaaccgaacttctcatcctgttctcaaagtttctcataaaatatcaggttcacaagtatataatcttcagattctgttgtacacacaaaatcagcgagctcattattggaatcattttttccttctgtgtgcatgttgtttggggatggtctgtattactttttgtgtccctgttctgaggaaagggcgtgcaccgcacgtacacttattctt

SEQ ID NO: 59996 - DNA, 1377 bp, Oryza sativa
gtgcatgatcggtaaggcctcatccatctccactagacgttgggagcttcaagtgcgagcagacttgccactttcctgtattagatcagcagtcgatgaatatgataatttcaactaagaaagttcgattaccggtgtttatttatgtctttggcacaatgggggacctctgatctatcatcataaatgccaactcactgaaattttcgcacggctacttagtgacagtcaatttgatcctaatgcaatatgtcgcccaaataatcttctaaagtttattttgatcactaattggcagatgatttactgtatctttttaatggaatagatgatttactgtatcataataacatctaatggttatttccactctctcagggcttaaaggtcactgcatacgtgaggtgcttgagcagtaggaatctgcatctaccatggatgttgttgctacacaaacaaaacaatataattgctggtattattttcaaattttggtccttttgactctatattaaattctttatccattactgtttctcgatagtttgctgtgaatgattgcctgcacattcaaatgatatgtgggattagtttccagtcagaagtgcaaaacttagctagatctctcctgatgcacaaatctcactttttgtccggatgaattctacacatttcagaccagaaaaatcttggtacaagtcttaatacaagccatttagttatcagcatattcactgcgtggtagctatactctaaaaaatattccaagaaaatatggttatgctactgtttaataatttgctgaaggaaatagcaacattgcaaagagatgcaaatggtgctacttgatgctgaaacctgagtaccagtcattttaattgtagctgtttggagcaaagttttggctagatgtagtgcataaattaaatttatttttgccgcttgaaacttttatatacacaggcaactattttttttcttttcatttccaaaggcttccttccgtattaaccttgttttttttatcaaactactaggtaagttgaacgagtgtaaggattttctttaccctttgtatagttttatctatgttctagacacctacttgaagccgctctaacagcatggtcttgaactttttttaaacctctcatttagttttcatttttggctataaaattgcacatttccttttgttgtatagattgccattcttgacagtgtgaacatgggtggtggcagaggtgtttccatgcatacaacattttctattgccactgtcaaaaaaattcgcatttcacaggactgctattgcatgatttatcttggattagaaaatactttctgggttatctctcgtgtgttttgtaataattg

SEQ ID NO: 59997 - DNA, 26936 bp, Oryza sativa
agaatgagaaattgaagaaaaagaattacgcaatcaagttgcaggagttcaatagtatatgcagtacttgtcatatgagggctgaaaatgcttgccttggaactgaggtttgttaaatgatctctccaaactcatgctagaattttttgtggtatgttttttctacatagaatccgtattttagattgtgaacgtttccaccaacttgataaatttgagcatcggatattgggaacatatttctttcggtattccccatatttctttcggtatttcctactgtccatcttggcttctgagctgattttttcatgccggcaggcaaagggtgctcttcggtaatccctatcccaaaagttacctaatgatttctaaaataggaagtacattatcttgttcataaggctcacatcaactcgtataaactggttcctgtttcacagcaatccctactagtacagtagacttcattttttttctaattcaataaatcacatatatttgtactatcacttaaactactagttagtacaatattttttatagtgatagtagtactcgtaaattaagaatcgagatcatttctaccggtaataatactgatagtagatatattattagtagagggctagaggccacagcagaggtacttaaaatctacatataacctatcaaatagccccatccatttccatgcgtgtgcgttacgactagctaggaacacacgtgggtggacgtggacctgcgctaacacaattaaccgggttctgcgctgggataggccactacacaatgtcaaaacattacagccgggcggtagtcaggcaatatctttgtacagataatcggatgatataacttatcgacgaaccaacattcggcaattccaattttgttgaccgaaaagcagtaggaaattgtctaaatttttcctgataagctatcgatcggcatttaaacttcacattaatagccggttggcaaaaacttgtcgacaccagctcactcaacaaaaaaataactatagtcaatgggggcaaccgttggaatttctgtttcatacctaattcattccctgggcatatgatctaaaattcatagaactacactactattggaaacatatgacaagtgcggaatgtaggatcaataattctatagatatgttcatctcttatttcccaatcactgtgtctaacaaatctgaacaactgttcagtttgtttgtagtgatgtatacttttgcattgcagttgagtcagtacacaaagttctagttcattccctcatcattcctgctagagatttgatgccatgaaatgtgaacttatgtgcagattcaacgcctttatgcccgtgctacaaaccaggagactgaagcacaacctgaagaagtggaccttccattcccccctacagctgggtctcaggaaggagcaccactcaaccaagatgaaccagcaccaccgtccaagtaggcctcgttggcatggcttctttgatctctcctcttatgtccctgtggtattcccagtgctttttaacaattgtggctgcgtcaatatgttgatgaactatggaaataccaacaggagcagaagtgtgggggatcaggaggcttggccggccttagcctttatatttatgcaatggaattaaaaactagcaataaattcagtactatgtgtgtgccaatcccaaaataaaattatgtactacagttgagcacctaaactctgcttaattggaagatggtatatcttctctattaattacatttcggacatgctatatggtattccattttgctcgttcagttgaagtcgttttttacttcttttgctattgctaagtttttctttcgaggactattgctaattttttttttagctagctatgtgctaaagcgtttgctcttgagaattacagtagtccaatcctaccaaattatcactgcttgtcttactagtgttggcaatcttcagagataaacccagcgctgatcatcttcaagtttcagagtcctgtgttgtcacttacggcttgtttggtaacttgagggaaggggattgagagtttccacgagggaatgagattaagatgggaatttgatttttcatcctagactcttgtttggaagaggtggtggaaattgatatggagtttagttggagattaggtcattaatgaaaacggatggctgagatttatttaggcgaagtaaaggaggaattccctcccaattaccaccccctacccaggtattgaaaaggagggagttcattcctcaattcctcatccccagcccactaaaattcccatgtctcccaactaaacaaaagagttaataacttcatccctctaaactcccaatccctcctaaaaactcccccaaccaaaacgggccatgcgcgtctgttgtcgttccaattttttcgtcgtgtcagtttggagtctgttatcttcgtgctagttcacgccgggagtttgttgcgtctttgtagcgttgtacatgcaccacaatcgctcgtgtgggatggcatgaagtcgaagtgctcgatcgtgtgcgcgcgatcgttggccacttggcctctcggccacttcttcattcagtaacaaataaaaggagagaaaatcggtaagcagcatgcaagtttgctgcataaaacttcatcgtgagttggtaattcctctctcgcgtgtgtttgttttcgccttgggaattctccgctccaggtcgccggcatcaagggacgctggcaagatttgggatcagagccatgacggcccgacgccgaccatctagaggagctctcctcgacggcagcgtccgtatctctcgctctcctccacgccatggtcgccgcctcgctgacggtgatcagcagatggtggtccagcgcattttgaaggaagtgagtggccgactcaatgatgtgaccattactactattgatacaactattcctcacatcatagttcaaccgaaagacatcaagatcaaacagtccaagttcaggaatccaattcagcttcctgctacagtgctgaattcaaacggccatgaaatgtgcatacgagctccgttttgggtatctgagtacttgatggtaagctcttggagttctcttttcaacgaattcaaccttatctccgaatcatagaaacaatgtgttgcgtcaacattgtaatgggactatggacttataacttcgtctgggaccctggcccatgtagggtgtgccccaaccatttagttaagaatcgacacctataattgtggacataggtgccgataaattggtgtcggctaaaaaaatcattacctaaaataaattcccaaacagtacctatgtctgtttatatagtagtgagaggttgttcagcaactatgcctgtttctgcagtagtgagaggttattgggcatgctctagcaacggcaaagcgatagggtgtgtatacggttcaattcgaaatgaatagtgtagggaataatagtatacttcctctaacggtcatcaccacaattattttatcactaactacttcaatttaaaacttagggtgaatagctcaagtggtcctccaagtttcatccaaggctcagtttagtccttgatgtttcaatctattcatattagtccttcaagttttcattttagttaaacttatccttgaacccacttagaagccacatggccaaacataaccaataattcttttgataaatgactcttatacccccacattcacatatataagagaaaaaattgcatgtaataaatttttttatagataatgcatagtaatttatgtaaagcaaaaataaattacgaactcgcaagtgtatatgatagtcattgcttaagtttcatatgcacatattgaaataatgggaagtacatatgcgatattgtttgttcatcttagttttctcttttctagtgtatagttgtatacaaattaagggtaaaaggggcattttctaatgtaaatattgacaagaaatagacatatgacttattatgtgggtccaagatgattttaagccaaaacaaatacttaggggatctatgtggacaaaatgaaacttaaaggaccaaattgagccttaaatgaaacttgagggactaaactagctattcaccctaaaacttataaaaagcataggaaagttataatggttttaaacgtattttgaagaaaaattgaataattgatcatcaaactttgaacacatcaacttcacctattccaaagcatcacttattcatgatttcatggtgtaacactactggaatcagatttaatatgaatttttatcaattgccaataaaaaagatacttcctgcgtaaaaaggtattttcgaatggagggatggaacctgtaccgtaacttataacgctcccgatcaacactttggtgtggtaggtgccagcgcggcagcacgccaacgtaccaccaaccgatttgacgcagggactaattaagacaaatataattcaaatgtgtacgccagaaacacactacttaaaaaacgatttttttacgagaacccataatttttataaatggagcataactcttaagacacctgtataaaaaaattgatttttccatacaaaaatgaaatgagcccatttttgcatgcggatcacttaagagcccacatatgaaaatcgatttttccatacaagcgtcataaggagccatatgcaaaaataaaatttgaaactagtttatctcactcatatgaacttcaaattggattattctttttcctaattttttctaaaatcatgctatatcatgttattgtgttcttactgctattattttagccattttttcttgtgactttgtttatcaattaaaaatttgaatttcaaaaaataacaacttctaataatattttgaagcagtaaataatttcatttgaaaaagtcatgaatataaaagttgtagaactcatcaagatatacaacttttatttttatcatttttatatccaataaagtgatagtaagattgtttacagaatttgcatatctctcttttagtttataaaaccatacgagatatacgtaaaattcgtgaacaatattactaccactttgtaggatgaagaaatgactaaaataaaagttacagatactgatgagctttgttgttgatgactatttcagttgaaattatttagtattcaaaaatatagtttgaagttgtcatattttgaaattcaaattcaaattgttgaaacaaagtcatatagaaaaatgaccaaatcaaaacttgtagatattgttgtgttatacaactttgttgttgataatttttccatttgaaatcatttactatccgaaaaactatttgaatttattatattttaaaattcaaattttatatagttcaaccaaactcggatggagaaatgaccaaaagaaaaattggtagatctcactgagttctacaactttgtttttaacaactttttcacatgagttcatttagtattgtaaaattcgattcgaagtctaaagagccgcatgattttttttgcatgcggaccacttaagagacccgtatgcgaaaatcgatttttacatactagcctcttagagagtcttctacaagtccaacttacctcctatttccctctcaatagttcaaaaattttcaactctcctctctcttcgccggccaaccttatattctcgtctctctgactcgcctcttcacctactatcctttcttctcgatctaagccggcggtgggcagtggggcgcaacagcgggcagttttggctgcgagcgacggctgtgccccgcacggaggccggtggaagaggtgcccgacgactcccccgcgcggatctggggacgacgggccttcccagcgcggattcggggacgaccactcttcccccacgcggatccggcggaggtgccctcccccgcgacgacgatgacctcgacaacgatgacgacctccggcgacgcggatttcggcggcagcggtgggcgagggccacattgagggcgggcgtgggcgacggcggcggccctcccccgcccggaaccaccgaccaccgcccttccccgccctgattcgccagcggcggtccttccctgttctaatctaccggccgccgccctgccttgcccagatccgcaggctgtcgcccttccccgccccgattcaccggcggtggccctcccggtgccctctcgccatgatgcgagagaacgatgacgtcgacgatagcggcaacggctcgaggacgacggcgaaggcgactgaaacttctatttttttcgcgatttttcccttttcgcatgcggccggcttaagcggccgcaagtaaaaatcgtgatttttgcagaccttttcacgcacgcgggccgcccaaccaccgaaaatgcttcttgcctgtttgcaaaaacggttttcattgttgtgatgagaagctcttttgatcctttctatcccacgaaaaaccaacttaatactgaatatgacacatattaatactatgaatctgaacatatttatctgaacatatttttatctagattcgcgttgtatttatcacgttcggttaaaaatgagtatagaattaaacccggctctatcaatatataacacaaatttcttgccttctctttaaaaaagcatatatagaatttactttagacttgtattgtacataccaaagggatccctaccgtatacgcgtaatatactcgtactgtatatgtctaccatgtaaaatgtaaaatactatgtaattacatctggtcgccacataccgctgcgctagctcattctacaccgccgtcgtccgagctcacggccgccgctgttacctgtctgacttgtctccggccacacaataaaactgagccggtgacctcaacgcgcgcggccgcgccactcaccacgaggctagtcagaactaccatacagctcatatgctaacacaagaacagaaagggaacaaaacaataagcaagagaagcacggacgggagcctactactactccagccgcagcatgcggcggaggtcgcgcgtcgcggcgtcatcgacggcggctgtgacggcggccttcctgaacgggaactgcggcagcggcacagagctcggctcgggggacacggagaacgccggcccggcgtacacctccaccgctacaggcctcgcggccgccttcctggcggcggaggagcccctgccctgacgtctccggcttcccgccgtcgtcggcttggtcctcgcatcgctctgatggttgttggccgtcctctggtgcgtggcggcggtggcacggatcctccgctgcgccggggaaggcaggagcacgttgtgcgggcgcagcacctcggtggccatatcaatggaggacgaggagaagaaagaagaagaggaggaaaaggttgggagtacagaacttggaagttgaaattggattggaggggtggaatggatgagaagaagaatgggtcttataggatggagaagaggattggagtggattcggtatttcggtggacgcgttgttgtggtggtgggctccgcctccgccggtgtggtggactttgacggtttcctcctcatttcgcctcagcagaaagctggtggagtggtgggttgtgggataacggcaggttcgcgtcggtttcgccggtcaaagctggaagccccgattgctctgcgtttcttggtgtacccgcccaatttgcacaccagattgttacattttctctttttgcgtttgtactccctccgtttcacaatgtaagactttctagcattgcccacatttatatagatgttaataaatctacacatatatagattcattaacatctatatgtatgtgggcaatggacaatgctagaaagtcttacattgtgaaacagaggaagtaggttagtcctagaccataagagcatgctataggttaactataatgacatatcgagaagataaaagaggagagaaaaatagcgagctacaaatttatagctagctataacacagactctaagacgcaatatgtatatgataggtagggtcaggtattaatagtgtacaatatatttatatgtaactagtgtatgaattagctacaacatcatccaaattaaaaaaataagtggcatgaataataattagctataacaacatgcttaccaacctcgaacatatctgttaaagtcattgttaaagtcatttttagtctgtagtgatgcacgaataataagtatcagtagaaaaatgactttaacagctgtgtttggggttggtaaacatgctgctggggaaatatgaaaaggctggtttttttagcttttcgattctaatttattttctgaattttgcagttattgattctcataatcatgtaagaacctatatattatttggggaagctggggattcttatagaaattatagctggaaaaaagtacaaataataccataaaggttgcacacatcgattgagctactaggttttaatgtgacttgcactttggaagctcgctccaatcgaaaaattttcgaaggaaacaatcgaaaatgatttatgagtgaagtttttatatggtattaataatttaaaagttaatgctagaaaatagatcatgataaaaaaaaccacccaaaaatcaaagaatttaaagggatcccactccttcggacattgatccctattaggacaatatttgcagttatgtgccattctgttacatatatgtcccttaagtactttactagcattatagttgacaaagacaataaaacacatgtaagaacaccatatataatatgttaaaactacgagtgaaatactgtattgtcgagtagtcaaccgtgcatgtctgctggtgtgtacgcattgcaaattgcagtgctagtgcaagcaaaagccccagccggcatgttgtaagctgtctgctggactgctgatgccgcggtccggcgcaagttgggtcaggtcggcttcggaataaacctcgtgcctcatcagcagctcagcgccgtgcatccctcccggtcaattcaggtcatcaccgcgttatagattggcatcacgcgtcaccaaccttatcgacgatggttcactgcttcactgctgccgtgcctatacttccatgcatgccactaactccgttaattactctcaatactgactctgattctggaggaaactttaactggacaactaataattttcgtataataaatctatagatactttcctacatgtatattagatcggtcaaacttcaacaagttttaatctcgtaggatatcaagtagagaagaaatcagacgtgcataaatatatatcctaaaagaaatttgagaacaagtaacatcaacatggacgttttttcaagataatagaataacattcctgcctttactcaatgagttacaaccaattattacagcctaacactcaaatgaatgcacttcaaatataattataaaaataaaatggcaccaatcataaaaaagaaacaaaccaaatactaccaacccaagataaagagtacacaattattgaattatgtatatgaacctccatccgaaattgacaaacaaatgcataaccattgtctcaaagattagacatgcaacctttaaaagctcgccatcttcatcatacctttgtagttgtgtctaagatctgagccaatatgttgccttgaaaattacctgaatatataaaatagatggtgttttgttaaaaatcttatcattcctacttaatcatagagcctaacatattgcagatgccctaataagtataagttttctacttttcttgtccactccccgaagccaatcataaaaaatatgagatatgctattaagagggtatagaccaaaagaaaattgaactactttctaaataaattttgcataatgacattccaaaaacagatgttgaatggacccctttttcatacagaaacaacatatcaaacttccattccaatttctcaacatggatgtaactacacagttcttgctttcgtaatagtctaaacacgtgacacaattatttccataattagtatcatgttcaaccgagtacgctctccgaaagcagatgtgtctaattagtaatccatctctttttcacgtgggaatatgcaagcatgcaacaggaaaagatactactaatagctaagttttgaataaacttttctttcaaattaaatatccaatctacaattcaattataacattctattcgttttaattaaatctttatagaaagatcttacatgcttatatttcgatgaaaaaagatatatgttataaattagttttattatacgtaaattacttttaggttttcttagaaatttatgaaaggaaatttaataaagcctaaaagtaagtcacacaaatcatatataattacttctaaatttcattctttttttaaaatcatctagcaatatcagattgttacttttaatatatgaaaagttacttctatttctctacatagttacttccactactagtattttgttataatgtaattatttttctagagttattttacttctaatcatgaagggttacttctatttttgactttctatacgatgaaattactatttttttaaaaaataatatagtgattacttcaaaaataaagaaaataattttatttgctcgtgaatattctttgcattttacttcacatactttcttatttcaacctcgtccactatgtttactttcaatgcaacgaaaagttactttacttcttgggtttaagtaaattacttttgaatgcttatataaattcaatattagactcgttttgtgatatattttgagtgaagtgcgatggttagaacggatttaaaaaaaataatacatggtttaaaacatataagtgttcaaaggttttgtaccaaaatatgagctaatgcaaaggagggctagtggagttggtgttgcacaaattttgacaatttgaccctttgtaaaaactatttttacaaataaaccgctgccaaaacttatttcaaatctgacccttttgctcaacgccaaatcgtgtggcgctgaatttacacacctcaatgccaaatagtatagcgctgaatgtacgttggcatacggacttagtctcctatccgtcgtggtacggcattaagtgccagctgacgtggcgctaaggtgtctaagttctacgccacatgatttggcgttgagtaaaagggtcagactttaaataagttttggcagtggttcatttgtaaatatagtttttacaaagggtcaaattgtcaaaatttatgttggtgttgcccccaaaacatgaatagttgtcctttttcgcgctaaagcctctcggtaaagttgatcagatggccctgcacatatgcgtcacttgatcggatggctcacacatatgtcgctcgataggtccagatcaagagagcgcgcacgcaatagattttgcctatcaaacatgtcaggaggtgcattttattagagcctaccattattatttgtcagagcatgtatctctaacattattatttttgttaaaattttggaacatcatccgtgtttgattaggtttcgagtatctcctattttacttccatatgttttttgtccgacaatagcgctaggtcgcagcctcacgcgggatcggttccgtttccacgcgacgccccgcacaggaatacacaatcactccatcatcctggacaagattgtggtggtttcagcatgggaccaactgaaacagaacaaagtagtaaaagctaatccagttcgtttaagttctggccgagtcatcttcgagacaaatcatcactaattgacatatatatatatatatatatatatatatatatatatatatatatatatatatatatatatatatatatgcacgagcgaggagagcatatcgatcacaggccttcatatggctgctctttgattagctgaggaaattatccgaatagtatatattattcttagcgataaatatgtcggtgcagtgccttgcaaaagtgtacgtacaacatcttggatcttgaggatggtataactaattaaaattgatctctaaatctcactagtacagatccttctatctgtgacggtctctaacatacctgaaaatagcaggccgtcacaagaaagtcatctcaattgggccgaaaaagtacctgattgagatatggtcgcacatacatattagatgggcataaaacttaagcccgtcacggatgacacctatcagtgacgagccgtagtttagatccgattgagataacattccatatctcaaacgggtttgaagttggggcccgtcacaaatgaccatcatccatgatgggcaccaactttatgcccgattaagataacattccatatctcaaacgggacttaagttggggccgtcacagatgaccatcatccgtgacgtacaccaacttaaggcccgtcacagatgactcatcagtaacgggctacatactaattttcggttgacatgacttaatctctatcgggcattaattaaatcccgtcaccgatgagtatttttttcatttttcgtatgaaatgtttatatttgtaagttgaattatagcaaaataattaacttgcagtataataatttattttacgagtcaaaataattttacgggtagtaaataatatcaaatggaaaagtgatcaacaacaaagttgtataactcatcaagaactataacttttattttggtcatttttctatataacattttttgaacagcttgaattggaatttgaaaatatgacaacttcaaacaacattttcaaatactaaatgatttcaactgaaaaagttatcaataacaaaattgaataactcatcaagatctataacttttattttggtcatttttctatataacattttttgaaccgtttgaatttgaatttaaaaataagataatttcaaacaacatttttaaatactaaatgatttcaactaaagaagttatcaacaacaaagttgaataactcatcaagatctaaaacttttattttggtcatttcttcatctgataaaatgttagtaacattgttaacaaattttacatatatgcgtatattttataaattagataggagatatgtcaattttgtgaacaatattactatcactttatcagatgaataaatgaccaaaataaaagttataaatcttgatgagttattcaactttgttgttgataactttttcaattgaaatcatttagtgtttgaaaatgttgtttgaagttgtcgtattttctaattcaaattcaaacggttcaaaaaatgttatatagaaaaatgaccaaaataaaagttatagatcttgatgagttattcaacttggttgttgatgactttttgagttgaagtcgttcactaacaaaaaattctatttgaatttctcaaactttgaatttcaaatttcaaattttttaaatagagtcagatggagaaatgaccaaaataaaaattttgcacctcgatgagctctacaactaactttggtttcggtgacttttccatttgaaatcatttattaaccctaatttttcttcgaagttgtcaaattttgaaaattcaaaatttgaattgttcaaataaacttatttgtacaaaggaccgatagatctcgatgagttatacaattttgttgtttatgatttttgatggttgtgtatgtgaatgaatgtatatgaatgggggatgttggggtatgacatatcccggcctaggacttaataggattaatagaatactcataccaacaagttacaactactcttccggaagccgatctccaaagaactttgtagtgaacttcccgggtgcacacgagtaaggacaaaaaaaagattggcctgagaggggcgggacggcatggcaaggctagccaaaaataaaatatttttttttgggattatactcatctgtgacggacattaacttaggcccgattgagatgactcatctgtgacaggctatagttaatgcccatcacagataaggatcatctgtgacgggctatagtttaggcccgattgagataggtcattcgtgacgggctatagtttgacatgtcgtctgggtcaagactatcactccccgattgagataggttcatccatgacggccatttgcccgattgagataacttttcacatagtgacttctaacctgtgacggacgccgtgcccgattaagatgggggttgccgcccgattgagatgatggtatccgttctagtgtctatatctctatctattctattctctactatatctatatctatatctattctctatccgtgtatgagtcgatttttaagttcgttcgcttttgaaaatatatatccgtatttgagtcgatttttaaattcgttcgcttctagaaatactaaaaggaatcgtataagaaatctatttaaaaaaactcacatgctaactggagacgatcggactactaactacagctcatgattatatgtatatatcgaagcgaattcccatagtgaatttcaccttaactaaaccgtttaaaataataagattaaaatagccttcacccgttgcaacgcaccggcattttttctaataatatacatatatgttgatatattgtcacatattccaggaaaaaaatattgtcgcatgctaaagaaataatccctaaagcatttttcttaaagaaaggtattcctagactgccttccgtatttgcttgtaggcaaaatttgccataggacatccaaaatttgtgtaattggttggaggacaccgtaagccactgctgaggaacaccaccaaaggtctaattggctataggacgctggaagcattattttatgatatttgggaaaagcttatagagagaaatttaaaagggacaagtttgccctgcatgctctttctccacctggccacggcgcagcggcacgctgcacagggaggccggtgcaggtgcgagcacgcaccgagatggggaggcagtggcagcgagtagagataaggaggaaagggtgggcggctcgggatgggggcggagatggagcaaagctcaccaggcacaacggaggcgcggacgggatgcggacaggttcggcaaagtcagtggtggcttcgctggtactttgagaggtcctggctaacgcctagcgatggcggtcaggaggagaggggggtcccgagcgctgtttataagccatcgggggagaggagccgtggaggagctcggccggcaccatcaatggccccgatttgccggcggccaaatgacaaccaattaattcgcacaacgccgttcgtggggaaattatggggaaatagagaggacggaatgggagcaaaacccgccaatcctttcttttcttcctatataattggaaccctttaagtgcaatgattgctataaagaatatctctcagctagccacgtcatcagaatcatctcagccattaaatcaacgtgtctttgatgctaaaccattagatcaactaacctccgatgctaatagaaataaatcaggcctgatcaactcccctacacagaatgtgagacagtgcaagacacctgctgattgtcgcacctgaacccattctgcgtgacgtgatattgtctcaagactaaatcatggttctcgatgtttttagtcatcagaacatttcgcatacatcttcgcagccatccagtagtatctcagtacaataaaacgcaagtcagtttgggaatatacctgggttgctttgctcattgaatcgcatatgttcgatacacattgaaatgaaaaatggacgtttaggcacaattttatgtcagcatcatgaatctgccccctttttttcatgcaagtttgttcaccatcttatatcaacattatggatccattttatatatttttagaaaattttccactatgcccggcgcaaagcgcggggtatcaactagttaattcagtgaaacggccggcggcgcgagtgaatcagcacctcctcctccaccaaatccgccgtcagagtggcttcttcctctccctgaccctgacgaccccaaccagccggcgacgtgatcattagcctcgacccctaaagagtatgcaggggtacatttgtactttccacaatttttctctctccatttgcatcaaatataatataataatacctctggtgtccaacagccaattatactatttttgcggtgtccctcaacagtgacacgacattgctgtgtccttcggccaattaaaaagttaaaattttgaatgtcctatagcaaattttgcattgcccgtgaatgctcatctaatgcgtggaaattctgcaatatgtaagtttcacatgacactttctttcagtgggtcaagtcgttccttctgaaaaatgggtcactcaacaggctatctttttcaacaatattattatacccgccgaaataattaatttgattgcaaggcatgtctatatacataacacctggcaaaaaaacaaaatttatgcagggttattattggaacattgcaacagcggagactacctgatgcagagttttttatttgaactattattttgaaaataaaccgccaaaaattattttaataacacagaaaaggtcaatttattcttccggactatttcatcgggctcaaatttttattgcaaattatataccacctccgtctcaaattatacgggatgtaatgtatcctaactaccccattgtttcgcttattcgggggataaacaaaacggcatatttgcgaacgaaaaataatttgtgaataaaacttttatatacgtgtttttaacaatctaaaagcaaagactgaaaataaacttcaatgaaaaaacctcgaaatcaactctaaatttaaggttgaaaattccaattttggctgataggcataagtataagctaaaagatgaggctgtaatactatgaatctcaacaatttctatcacatgtcacatcccgtactagattaacttaatttgggaccaaagaagtacgagttatatagatagaatcaaatagaaaattagtgttaaggctgatctaaacatcaaattaaatttcaaagttgaaacaaacaatcatcaaaatatatggaaatatttttcaacttatgataatagtgccatctattgctaaaacaaaattaatcttaaaatataactagtataaatagtaaaaatgataaatattattaaggcagcggtgacgatagccgcctcgacggtggggccgccactggtggcgagttgtcggcggtggaaagaagataagaggagaggagagaataagaaggtgctcgtgctgctcgcggagaggcacagtgtttggctaggcgctgcctccccattcgcctctctctccgatgtcctcctcgccgcccgccccatcaggtggagagggattggggaagagagaagaagggaggatgcaggaagataatggaattgacacgtgggtctcgtatctagtggtatttttgtctatataatgacggaaatcgtggcgatgatggcatgcttccaatttgtgtgtatccggatggcatggatacaaatagaatacgaatgatagtagcatttatctaaaatgatacatttgtaaaagagataatccaagaaataccattgacaaacgtccaagtcccagaaattccatcgacaagtgtgagttccaagaaatgccattgtaaagtcgcagaaatgccatcgacaagtgtgagttccaagaaatgtcattgtacaaacgattttgtcccaaaaatgccatcgccgttagggttccgaccattttgtgccgttaaaacactgttcatcctatagaacataacggcgcggaattgacggaaccctaacggcgcggaatggacggaaccctaacggcgatggtatttttaggacaaagtcatttgtatgatggcattttttagaactcacacttgtcgatggtatttctgggatttggacgcttgtcaatggtatttcttggattatctgtttctaaaagcatggatcaaatttacctaaaaaatttaggcgatggcaggtcttttgctgtcaacataaaccacatgtcaccaaagtaaaccatattctgttccctaaaaaaaaagtaaaccatattctctatcttctaccgcggcgacaggtcttctttatggtcaccatattctttggctggatttgcataaaccaatgacgggtgatggttggagtgatttgcggaaaccataatgacacaatgatgttaaaatgacatcgatgcccttctttcgagtttatgcgcattgcattaagccttgatacggtgggagggggtacaacctcgcaggcgtcggatgtgaacacgtggcaacatctgcacttgaccacatctaggaatgaacaaaattggaaacatggttatataagagtgaaaaaatggaaatgatagtaagataagactatttttctgagttaatggttaaagtctttgttctaagagaccatacttgtctctatcgttgaacaagcccttagttgcccttaatttgtttgacagaattgacgtttaccaaaacatattatgatgtgatatacttacacattacagtttataacatctgaggcctagtttggaacataagaatttcatacaaaatatttaatacggttagtacaaaaatagttcagttccactaaataaaatatatcgaccacatagtacatcaaccataggtataaatttgttacatcaaaaataaatatgataattcatccttacattattccaaatagagctactgctggcagcgcaaaatgtgaataatttctttttttaagataatggaaataaacccggcgtttgctcaaaaaaaaggtacaaccacttattagttattacacaaaatcgctgaactatattcacacaccatagagttcataggagacaatcagaatttaacaaaactccaacacaaactaatagacaccaaaacaagataaagaaatcacaattattggctcctatttgtgaatatccacccgaagttggtgaaaatatgcatgaccgatgactcaagtttgcgacatgcattctttattagcgtgatgtcgtcatcgtacctttgtagttgagcccaataccagagccaatatgtttccctaaaaagtacatgcatataatattttaatgctgatttgtcaaaatccatatcattactagtaatccatagcctaacatatagcaaatgctcctacaagcatcaatttctttgtttttgaatcaatccccacaagccatctcctaaaaatgtgacatatattatgtggtggaaataacccaaaagaaatatgtattactctctagagagatatagcaaaacggcaatccaagaaaaggtgatatattgtatcattttttatacaaaagcaacacctcatgctaccattccaattcctcctagccaaattatgtatttttaccaccgccccttcaagcagataccacataaaaatgttgatattaagaagtgcctttaagctcccaaataaacttattcctctcaatatacccattattaattaaggctaaatacatagatctaaccgagaattgaccattttattgaaaattccatttaaaaatgccattgttatttgataaatgaatatgcacaattgaagcacacaaattgtgctaattggccaagtcctgatctactaatgctctcataaaagaaatattgagtggaacagagctcgtaacatttacaacctaacaatttcttctacgaactatagggtacaaagatgggtatctttccttaaaggaagtattatctatccgcttatccttccaaattctgacttgttaaccgctatttattatctaggaactcatatttgagaaaaatacttttaactttcaggagacctgaccataaatgggaatcccttgtttcctctcaacttgagttattgattggttattaaggtattttattttcaataagtcttgtcaaactccttgctcatttattaacttaaacaactatttgctcaataaacactagttttaaatttcaaaattatgtcccatctcgtcagtctatatttttttgtgtgatcatcatcttgccaaaaaaagtgatatataataatcaattttcaaagaacccctctgagaatcttaaaaaaaaatattataaacgtagctagacttaagagcacataattaatcaaaaccaaccttcctcctgcaggtgtatgtttacctttccaacaactaagtttttttttaattctttgtttaatctttttccaatctttattacttagctttttaaaatacatagaaataccaagatattttaaaggaaagtctcccggtatacaaccagaaatgtttgaatattgttcataacattttgtgtctgaccaaagcaaaataattcactcttgtgaaatttatctttaggcagaaagcatttcaaaagttgataataacaactatgggtgtgttcgtgcccctttttccaacccctctctctcgctttccacacgcacgtttttcaaactgctaaacggtgtgttttttgcaaaaagtttttatacgaaagttgcttaaaaaatcaaattaatccattttttaaaaaatattttactaatacttaattaatcacatgctaatggattgctctgtttttcgtgcgggagggattagttcccatcccctaaaaccgaacacagcatatatatttttcgctttctctaaatcattgtcaagaaaaatgagagtatcatctgcatattataaaatgaaaaaccatcatcgactagatgaggaatgaccccactaatttaaccatcttcctttgtcctcttaaataatatagatagcatattaacaaatatattaaaaagtatgagggataaagcctctccttgcctaagaaccttatatatttgaaaattagatgccacttggttatttacttttataccaatatatccatcttggataaaagaaactatccaatcacactattttttgaaaaaccttttatctttaatgtttattgaacaaactattacttaactttatcatacgctttctacaaatcaatcttaaaaatctgtgaaatggtcgaaaatgctcgcgtttagcacgtcgctctcctaacgtgaacaaaactttccacggttacgtcatttgcatcatgcacgtgtcctcgtcggtcctgatcagttcgtacgtgcaactaaatgccacccctttactatgcatcttttgcccttgcaaacgcagcatatctcaggtttgatttggtcggcaaccaccattaattatgaagatgacttatgcctgataaacactaattgcataacatccgtcacatcgcatctccaagcaaacattatccggcatgctgttacccggttgatgatggaagatgacctgaacacacagtaattggacggcagtaggcacgggatggtgattcaagtcgttgctctagtaatttactaaactccaaatgctgatgcagaacaggccgaaattgtgacaatttgaacttttacaaaaacttattaccagaatagaccatgccaaaaacatcaacaaaaatacgttggaaccgaaaatctgatttggaagtggctcaacgccaagtatttgttgaatttataagcacataataatttaatgtatttcataaataaatcatgacgttacagatgtaaactagcgtaaaaccattataagatttaaacatataaactaggtagtaaagcatgaataaatcgaatatgcgcaacatgctgaacacgaactaagggtaccggaagaccagttgctcaacaggaagtactcgcggttgcgggcgttgatgacggcgctatagatggccaaaaggcccgatggcccggcccacggcacggcgttttggcccagcccaagcacggcacggcccgtcaagggtcgggcccgtgccggcccggcccgaccaccggcccgtgactgggcctctccgccggcacgttgggccggcacggcacgatgggccgcatgccaggcccgacacataaacaatagggaggaagaatagacatattatatgccacggtcgaaagaataggaacgtaaaatagacttattttaactatatatatgtcagcccaaagaggagggacgaacaatagacttattttcactatatatatgtcacaccccaaagtggagggacggaaatagacttattttcgctatattatgtcacatcccaaaaaggagggatgaaaaccagacttatttaaaaaattgcacgatgggccacccgcgccttcaggccggcccggcacggcccgacggctggtgggccgtgcctgggcgggaggcgcagcccatgggtaggcacggcccggcacgaagtgtcgatcgggccgtgtcggcccgatggctggtgggccgggccgtgccgggcgggccttttggccatctatagacagcgcgcagcacgcacgcgaaaaggaagacgacccgttgtggtcgaacagggagcagtcgcgcgaagcgcttcccaaaaaccttattgctgtcttctcccggtgcaggacgtcgaaggcgaaggttctagagacggcgtagtaaagaggaggaggcaaaccctattgatttcgcgtgtgttgcgtggaggcggtggctcaacttatataaagatatcaggacgcttgatcaggacgtctgcacgatctccgctccgcgtaaccgaaccggataagtcatgtgtaacttatcccgactctacggcgtttcacgcactagattattcagagtgtttccagtaaagaggaggaggcaaaccctattgatttcgcgtgtgttacgtggaggtggtggctcaacttatatagagatatcaggacgtctgcacgatctttgctccgtgtaaccgaaccggataagttgcgcgtaacttatccggactccacggcgtttcacgcaccggattattcaccatcatgccaggcgaggcgagcgagcacgtgtattccccctcttctctccacttcacatgcttcaagtggttatgagagcatcctccgttataagaaggtctccctctcctagagtaggcaaagtagtactaaactccccatccatgccgtcacatgaggtgggcttttgtgatttttcgaagaattaatcttcgtatgggctaagacccatcaattaattccaacagtactgtggtgctgaactcggacacgcattaaaacgagtatgatctgtgaactggtctggtggtagttgctttcacggtatagcttgaggagttgaggccttgggttgatcctgcgcatagccaaataattttttggagttttttttaacagaaaataacgctggccccactagcaaggtgcggaaaaaaagtaagtgaagatatttttttcgaagtatttgtttggaacaaataggagtttttttaacagaaaataacgttggccccactagcaaggtgcggaaaaaaagtaagtgaagatatttttttcaaagtattttttggaacagataataacgctggctggaaaaaagaaaaagaaatacagcgcttcaaggattcaagcttgggtctgcagattgagagagaggtgcaccaaccactgtatcactgtagacctttttgctaaataggaacaacaatatacttcacaaaaattcagcgccaggcagtgtggcgatttctggtattgacgtggcaaaatctccatgccaaagggtatgtcactgatacgtttggacctcagtgccatcgatggcgctggcgctaaggtcgaggtttgttttttttttaagtttttgacacggtctattattataataagattttataaaaagtcaaattgtgaaaatttgggcagaacagaccccttctcaaacggttaaacccactcaatatcaccatccacgagattttgaaccatttgccatcttctttaatggcgcactctcaaatgccattttcttttcttgaataatgttgattatttgccatccgactctttatattctttctattttaccattctttcctaccaactcagcaaacttgtgtgacaaatgacattaatatccctcatctcctttcccatctgcagttcacggactgtgccatcaccggcctcgtcaagtgaagaagctattgctttcctagtttgcttggtcgattggtaatttggtatatatgcaagtaattaatttggagggctgaatgagtgccactgttgattgctttacttaatgcagcgctcaatcgaaagcttggtcttttttttctgtagtgtgttttcttctttttatcttcgatgcttcatgttggctctacgcgaagatgcaggacgaaagcgctttctgccatcatgggaactttgtcgctacgctagcttgacagttcgatttacctcataactgatgagaattgctcgtccgagcggttgcccacgaagcggataaaagccgaggtagcggtcactggtcaagggcggtacgcccttccttataggcagtcgccaactcgccatcgccgtcggatcaagaagtggcgaggtcggcttgaagacggcaccgttgcacgttgcaggaacaatgcagaggaagaaccgaagagacgggggtagtgaagttatttgtcacacaggtttactgagttggcaagcaagagtggctaaataggaacaatatagtgggtcagatggcaaatagttaaagtcatttgagaagatggcatttgagaatacaccattcaagagaatggcaaatagtccaaaatcccgtgggaggttgtgcgcctagagcgcgtgcgttacaatggaaaacaaataaagtttgtaacttattaaatcaattaataatcacttgtttagtctaactaatactatatttttttattgaacaagtaggtgatattgaaatttagagaaccaatagagaaataggaaagaccttggtaaaagttggtgtaataatatagattgtagggcccaaatttagtgataggggtggtgtgggaccaccaccaccaccaccactattattattattattattattattgactttgtattttacatttcaattttatgcttcccaactcccatgcttgtaaactgtccatatcctaaaagaaattctctaaaatttaatcttagaacacatttcgaaggaaactttttaacttcgtcgcagaagttaattcattcatttataccctgaaatagctgtcacaaaattacataatctatcaatttgttggcaccagtacccgtagtggcatccacagacgtgccaccaaaggggatagatgttgtcaaacgatcacctgggagggacctcatcacagtgaacatgcacaggtttgtcctaggctcgataagccagttaggacgccatcaaaagtcgcagatacgagagacaatgagtaatctggaaattggtgggtgaatatatgtaaattggtgggtgaatatatgtaagatacaggacgcaataaggaagggcaggtgattggttgatttttcaatcgacattggccactatatttaagaggggtggtcttacgtctataggatcttctccacggttctattagtcttagagaaagaaccctcgtaccaagcatggaaacacgagaaataccaaaattgatcagactcgcggttgcatgacggtcttaggtatactaagactgagttcgtttgtagagcttctaacttttctctctcgttttccgcacgcacacttttcaaactgctaaaaggtatgtttttcgaaaaaaaatttataggaaagttattttaaaaaattatattaatcaatttttcaagttaattttagctaataattaattaatcatgtgctaatgtgcctcttagttcttcgtgctggaagggaaggttcccaaccaccacaaactaacacagcctaaggtcagttcatattaagctgctagacagtccggcattataacaccggtttatccagttgtagtcatctccaaaggattttgcaaccctttgtctcttactcttacgagtatctacaatgttttcctgctcaggatttccctcaggcgtttgatcattgtgttctatcggtgcaaagtgctcatagggtatgacagtttcttgactagaagtgctatgtgtatttttcatgtgaaattcattctcaaagaatgtagcatctctggactcaataattgtaccaacatgcatgtcgggtactccagagtttactattaagaatctataacccacgctgtgaatagcacaaccaaggaacactcaatcaacagtattcggtccaagtttacgctttttggctatagatacatttaccttggccaaacagccccatgttcgtaggtatgagagatttaatttcttcctttcccattcctcgaatggggttacttccttatgcttcattggaattttattcaggacatgacacgcaatcaaaactgcctcaccccaccattccttggaaagtcccgcagtgtctaacatggcattcaccatctcagttagagtacggttctttctttcggctaacccatttgattggggtgaatagggaggcgtcctctcatgaataattccaaactcttcgcaaaaagatgtaaactcattggaaaaatactccccacctctatcagacctcaaccgtttgatttgcctttcaatttggttttctacctcaactttataggtcttaaagtaatgcaatgcttcatcctttgttttcaatagatacacataacaaaatctagtgcaatcatctatcagtgtcatgaaatat

SEQ ID NO: 59998 - DNA, 3942 bp, Oryza sativa
cgataccactctatattaagatattaaagcaagtagaatataataaacaaaagcataatatacttaaatgcagcaagatcttaatataaagggcggatttaacatgtcaatcaaacatatagaataaatattgctaaatctggtaagatcggctgaaaccccgatgctaccctaatcggcaaccaaaaagcaggctagagatcgaaattctaagcacgacttagcagatcaaacataactgatgcagcactaaatatgaaaagaataaccatatctagacaatcaagccaccggacgcttcatagagtggtggatatcttatataatctaagccaacatcgctatttaacctaaccggctgccttctactaacagatgttagtcgattgtaggttaaacgacgatattaccaaagattatgtaagatatatgataactcgacgaattacagaaacgagattagagtatcataaagatggaagcactaatcctgagaatacaagccgccataacaagttttacctcttgttgaagatcgaaaccgatgcagctcaacccgaaagcaagaactcatcgaaacaaaatgaaagtaaaaggtggcaatgcgccgagattgtattgaacgtgtgttaattcgattacatggggctcgggtctatttatacccgagaattacaaaatatgtccatctcggacacgactcttatctctaacaaactctaagataccataagtctttacggcagacttttgcccaaacatatctctaaggaaattacataaaatatcctaattaatagatacaattgccttcttaggactcaatccgtgtgtggcaactcacgtgaagcacattaactcaacccgatgatgtacaccgacgtattcttggaatcgactatatcggctagtcctgtctgactcgaactctgccgatcctgaccgtagccgattcggattgcagccgactcttgctcggtttccgcaacgatcttcgtctttgattccgtttcaatctagtctttatcttcgacactgatattaccaaatttggtcgttaacaccgccataacaagttttacctctagttgaagatggaaaccgatgcagctcaacccgaaagcaagaactcgttgaaacaaaatgaaagtaaaagggtggcgatacgccgagattgtattgaacgtgcgttatttaattacatggggctcgggtctatttatacccgagaattacaaaatatgtccatatcggacacgactcttatctctaacaaactctaagataccataagtctttgcggcagacttttgcccaaacatatctctaaggaaattacataaaatatcctaattaatagatacaattgccttctcaggactttatacatgcgtggcaatcatcatgaagcacgtcaacctaacccgacatcatatgccttgtcatattgtcggattcggctcaatcggctaaccttgtccgactcaaacactgccgatcttagtcgttgccgattcggacttcagccgaccctcactctgtttccgggataatctctatctcgaactccgtctcgagtcctccttcacatccgatccttggattaccaaatttggtcgttaacgcatgccccccaagtctggaatattggataatgtttcggatttgccatacgtcgactccaagagaatatcgcacttgccgttttccgaccgttattccagcgctttaaatactaaccgttgtccccgacaaatctcacaccgtttcctccattttcatcgtcgaagcaaactttgtcctctctctctccggcgatccccttggtgcacgaagcgattcccaggcgatttcctctccagccaactttccgttcacagcgatgtcgatctccgccagtccatccgccacatcttcagcagagtacgcggaggtaagttttcatatgatagatcctctcctttcacatcagattggttttccctctccttatcttgttttcttcttctctgttcttttggattcgtagcacctctccaatctgatcgcagttccgagtttgttgcatgaaaatcactactttcttggtccaatcggcaatcccgatcccactgagttcatcattggtgaaaccaataggatccctttcagattagccaacccgaatctaggtcactaaaataataccattacatcttggccatccctcgagaaaacttcacccgagaaaagctggaccacatggtataagcgtgtatcggctagcaagcaaacacattgggatgagattggaatcggccaagcacttgccctcactatagcgaattcggttaaggatgaacccctaatagctgccgccacctatttctggtccaataccatcaacgcctttttgttcaaccaagggccgatgacaccaaccctgatagatatcaccatgatcactggtctggatgtgacctcatcggctaaccctatgagtctgaacaccaagaatcagtatgacttcaggaccaagagcataggtggttggtctagttatgtggcagcatacatgggccaaggatctgtcactcctcgagagcatgtagcctttctactgatgtggctggagaaatttcttttctgtggatcaagttgtggccccataaccaattggcagtttgtagccgaagccttagaatcaaaaaggcaattccccttaggaaaaatcctcctcggctatctgtaccaaatgctgaacaatgcattggctaagatagctgtcggctcagtagttggagcaggtggaccatgggggctgttacagacctggctaaatctgtgatagaagccaaattcccaagactggagctgattgtagaagatgatggagaagaacagcacccatcatagatgcatgtcatatggagaatatgcatccacaccagccgatgctggagcaaagttatcagctgagctgctcaaagattgtttctgcagcttttatgagggctttcaaaaagatgctcgagtttggtttccttatgaagattcagtgcatcttgatctcccatcagacttcagattcgaggatatcaaccatgaaagatatcaaaaatctagagaagtcttcttagctgtgattagcccatgcattcttcctgtcagcattcatcaagggaggaacattcaagtttcttatgaattttatcacctgatgagctctgccagacaacttgggatgggtcaattaccaatcggcctgttctttgccgataaaatccaatgccgaggagaaatctcatcaaccttgatgatggatcggctgctgaatatccaaggacctcctttgggtagtattgaaaatatagaactagcagctttcaggagcaaagcatttgacagatggtggggtgaatggaagctgcatctgttccatcaatcggcttctatgtacatggcagatctctttccagacatcatcactcaggtacaccttagctttaatctcgcttgaataggtgttagccgatttacaatttgactaattttcttttgacttgcagacaacagaattcccccctcctcatcaaagcaatagtggtagagacatcgaatatgccccaggtctaattccaaatggaggtgggccatctcgccctgtcatcggctatcatgcccccaagacttcaaatcttctacaagggctcattagagaaccagccaatgctggtaaaaagagaaaaaccaaagcatcggctatatatccatcggctccggcaccaaagaagaaagctaagtcaaagaagaccaagccaaccgatgatctgcctgccctagatccatccattgaacaagccctggatgaagaagagattggagaagatgttgatcaggctgcagctgggataagcgatactgaaagaacaccatcgacttcacacaaacaaactcccccga

SEQ ID NO: 59999 - DNA, 11042 bp, Oryza sativa
  unsure (1)..(11042): unsure at all n locations
tcggcttgattagctccaaactcacctggtaacgtgaaaaccatgttaaccgacgcaggacaacacttttccctttagccaacctttttgcttcgtcggcttgacctcatcggctgtagcagcttggttcttaacacgccactcctgcctcggcttcgttttcttcagccgatggttaatctcttgctcgacttcttggaagcgttgtctgttcctcaatctttgaaccctcctttcctgattctttgtaaaaataccaaaagggcaccattgattttttccgccctcatcatccccctgatcttaatttactgggcccacatctttcatgaacagggaacccttggttgccctaacccaatggctctatattagaatggccttgaaccttctgcaacattactgcgttccggacaaatcttcaatagatggcagcctcatcccttcaggccagcaaaatctgaaaaactcacaaccccaatgaggatcaaaaccaccatcatcttcttcataatacctctcctgctgctgcttgtcatatttcctctggtacttgttgataattctagccgcattcatctgaaagttctattctttcccccatctgctgtccttctagatgtgtgcaccatgttaacagggaaaggattaccatcaaccttcattggcttctttaagtcatcaaatgtaatcttccctccttcaatagccacctagatttgctgtctgaaaactttgcaatcattagtagaatgagaaccagagttatgccatttgcaatacctccttttgcctagctcctcagctgatggaattatgtgaccagcaggaagttgaatttgtttctcccgaagcaacaaatcaaaaatcttaccagccttggtgatatcaaagtcgaatctttcttcttttccagaacttctcacccatgggcatggcacaacctttttgctcctgacccactcggctgctgccacttcggaatcatcttcatcatcagaaccatacatataagccaaatcggctggctgcgaatatgtcaaagataagctgtaacatctgttcctcatctccctgaatctctggatataatattgaacagattcattgtggagataatgggttcctcatacccacacggtatggttatcccactagttataggagataactaatatcagggaaatatgtaatggatcatgacttgggtattacgtttccttgtgtactatggaacggcctaaagtcctgttttgataatattgtaaagtagatttaggaaaccgataccgtattggttaaggtttctatcttgtaatcctgccccccatcctatataaggtgggcaggaggccctctatggggcatgagacaactagatcgtcagatctataatacacccggcggattcaaatccccaaacaggagtaaggtattacctctcatcgagaggacctgaacctgtctaaatccttgtctctgcatccatctacttttaggtctcgtgcgctacccccttttattattgccgaattcatgtttcgacagttggcgcgccaggtaggggagcgtcgagttttccattgataagtgcgatggaatcaacttcagaacaaatgctgagatcaatctcatcgagttcgatggcttgaatcttcaatcccggtttgtttgttctaatctgatttgttgttattagattgattaatcgcagattaaactctgggtatcttttgtgtttaccttatgcatgattgttgagatcaaccgtcttcgccggctcaccttcatgtcggtgtccgcatgatcttcttttaatgagatccgccggctacctccgatgacgacgtcgtgctgaaggaccatcaagctagccatcggctacagggccagatacacatatttggtgatggttaatttttttgaattaatcacccctagcaagctggccgacgccgacttcttctgcaaatcgatgaaatagcagacaacatgcatcgattaatatccttaatcatctatatcttctatacttccctagtcctaatcactcttgttttgcatggcaatctgtccgactggccggccaatcaggaggagccaataggctacatgcaatcatgcatgtgctttagtgcttattacggtcatacgacctctccatcaagttgcaaatcaagccatgtgtttggatctgttaattatatatcaattattttctttttacaaatatctaaccacaggttgatgtgcaatttcttgtctttgcatgtaccatcgcctgtactccatcactgaccggctgcctcatagccgccgactggtgcttttgcctatacggtttgatggtcacatcaccgttcatgggcatccacgtcttcaccaaccggctggccttcgccgccgcatgcacggctggcctattatgccgccgttgttgggcgtctacgacttcaccgccggcctgcctccgtcgccgccgactggtgtgctcgcctatacagttggttggtcatgccaccgttcgtgggcattcacgtcttcaccgaccggctagccttcgccgccgccgactggtgtttccgcctgcacggctggcctattttgccgccgttgttgggcgtctacgacttcaccgccggcctgcctccgtcgccgccgactggtgtcctcgcctatacggttggttggtcatgccaccgttcatgggcatccacgtcttcaccgaccggctagccttcgccaccgccgactggtgtttccgcctgcacagctgacctattatgccgccgttgttgcgcgtctacgacttcaccgccgacctgcctccatcgccgctgactagtatcctcgcctatatggttggttggtcacgccacagttcatgggcgtccacgtcttcaccgaccggctggccttcaccgccgccggctggtgtttctgcctgcacggctagcctattacgccgccgctgttgggcgcctacaacttcactgccggcctgcctccgtcgccgccgactggtgtttccgcctacacggctggcctattataccaccgttgaggggcatccacatcttcaccactggctcgccttcgttgccgccgactagtgtttctgcctatacggttggcctattattccgccgttgatgggcgtcttcactttcattgtcagtcgtctcaagctgcttctatggctggtgtattcattgccattgatggacgactttgttcccacatcggccgtcaccaagggaaagactagaaagctatgtcatcattaatttttttctttatatgatattttccttttcctctgcctcactacatcaactggttcgccgttgactagtgagttgggggctacatatgttatatcatattttttttaataattttcataatatttatcttgattgcttgcgacataatctgagtacaaaagtgcctattgagttatggagttctatcttcctatgctttccgtttggtttgtcgatggatagttgcctttgggccgattcctagcacccggcggctcgttggatgaaccgagtaatgcaaggtgctaagtattattcggaataaatcaaaagcatagagataagataaatttattgtcacgtcctgataaattcatcccgaaataaaaaatcatcctctaaaaagaataatagaattatataaaattcgaaaagaaattggcaaacactaaaatacgtgccagaaaaattcgaatgtggtccgaagaatttttgttaaattctccttggtctaaaaagagccctcaaattttacttgaattttcagagcaccggaaatatttattaagcaacaacgactatgatcaaagtttactaaaaagaaaagctaaaaataatcctccttcctccctttgggccaagtctggcccaaagtcctctctctctctctcggcccgcggccaaagtcctctcttcctccctctctttctctccctctcctcctttccctccttctcttgggcctcctctccttcccctcggcccagctccctcctccctctcttccccaggcctcctctccctcttctcctcctgggccggccgcccggcccaagccgcgccacccagccaccccatcctcccgagccgcccccccccctcacgcgcgccgcacgcgcgtngcacgcgcgctgaccgtgtggggcccacgcgcctgtcggtttcctcccgcacggcctcctccctctcccgtgaaccctagctcctttcctccctcaaatccgtgcgatttaatcatgggattccaaaattaaatagggagaattaatccccattgattcctctttgatttcccccgttttcccccttgaatggcgcccccaatcgcctggaacggccacgccattcccggccgcttccatggccgccggccgtgtttcccatcgccgttctgccctctctcatgcccagctccctcccctcacctataaaatggaacgccctctgtgtgttctctcgttttagccccttcccgagctccctcgtggccgcaccacctctccccgccttctccttctctctctccggcgccggccggcctccagccgcctctccctcctcgcccgagcaccgtccggtcgcgccgtcgccgccctcggcctcgcagccgcctcctctcccccggtcagccctccgtttcgcagggaaatcaccggagacgcgtcctcgccggcaaaacagtggcgttgccgccactgtactgcctccagcctcccctgccgcgccgctcaggtgcgggccggccgcgccgtctcctccctcggcgtcgccgcgtcgacctccaccccggcctaccctctgattcgtccagagaccgccgtcaccagcgccgggctctccatcctcttcgtcgccggcgtcccttcggccgccccaccctcctccccggctcgtcggctcgctgcgacaccaccacctccggcatcgcagcggcaaggtcgccctcggcctcgcctccccttcgaccgacccccgccggtgttcgtcatcgtcgtcatcgttcctcctcgccggctcgttgtctcgctgcgccgcctccatcgtcggattcgcagcggcgtgttccacgccgtcctcgtctccgtgcagccgctgccggctgccctcgtcgcctcctcgccggccccggtcgtcgtcgtcgtcatcctctcgtcgttcccggttgtcgtggcgttcgtccgtccgtcaagccattctcgttcgtcgtcctcgttccgtcaagtgccgcagccccgtcatcgtcttcgtcctcgcctccgcgtcgccaagcattgcgccggccgcgtctcgccttcgtccaaggatcgacgccgaagtcgtcccctcgcctttcgtctccgtcattcccggccgtctccgccgcgcccgttcgtcgttgtcgttcccacgcctcgttgcatggtggtaaggatccctctccctcgctgccccgtcctcgtcctttcggtgtcgcccgtgcctgttgtgcggttgtcggccccggtacccgtgtatcggtgtcggcagtcgttcgcttgttcgtgtcgtgaccgtgttagtgtgtccgctcggtagccgcgtggtttccacgtgtgcagcccgtgtggtgtctagtggagtccgtttgtcggccactgtcacatcctgatttttgtttcaggatttataaattatttaataaattattaaaagaatttatattaaatgttcattaatttacaagtgaagttaaatgtgggaaataaaatttcttaaatataaagcatgggtggatttaatttttattaaattctccatggttaattatactctctggaattttctcggatttttcggagctcaattcttaattttaatcatacaaagagcatttcagtaattacccacatattaaattaatcattaaatggtctaattataattttgttaagtactttgagtgtccaagtattttcaggatttttcttgaaattatttgagcattggaagtatttttaacaattcaaagatcatttaaatgattattttaattgggaaagtaataaaatcctcctcctcagcttgggccattttcggcccattctttcctttccttcctctctcttccgccggcccaacctgagccgcctcctctcctctcagcccagccggaaaagtctactttacctccctggcactgttcatcttccagctctggacagagccgagccgcccgtgctgtgccctgtgcagtcgccgcttcctccgttaaatctcgcctccccgttgctcctttttccaatttagttgaggggaaatattcctcttatcctcctctatctttacccccaaaaaatcggagctaatcgttgagtatcttatccaaatcaaactcgttttcgagtttatctccaaaaccgagtttttgatttcccggatcgatttcttgcgggaggagtccgatctcttcaatccaaggctataaataggaccccctagtcctcctctttcgtttgccccctctcccgtggtctcccgtgcctcgtagcgctgccgccacgtgctccaccccgccgtcgtcgccggccgagctccatccgcgtcgcgccgccgcctccgtcgtcgccgccggtcgccgtcaccgccgtaaggtgcgccgaggtgtggagaagcccggcctcctgtcccccttcgtcgccggccaccggagctccaccgccggcgaggtccgagccgccgccgccgttcacctcgtcgccggtcaccgtcggtcgtcgtttggctcgagggtaagtaccgttgggttcgtctcgtcgtcctctacgtgtacatatcctccaaattcgcagccaaccatccaatctccggcgaggtcgccatcttggtccggccattgatgaggtcatcatgacgtcatcatcggcttttctttttcccgattttctaatagattaaatcttcggaaaatcataactaaatcatcgtaactcggttttgagtggttcaagttgctaaattcatctaaaatcatgatctacatgtttgtttactttatatgtactgtttatttggttttttagtctttttcttcgttttgcgtgttagcttgtcgtttccgtcgttgcgaaggttcgtgagtgcgtcggaagtgatcaagaagattacttgaagaccgattattgcaaggcaagtcacacagatcctaaacacaatcctttgagcatgttgatcctatatttaaattctctatttatttcaactgtgcatttattttcgaatgtcaccgggtggtgtgaacttattcctttgttatggccaatttgcattgattactttattccttgataccttgggttattataacttgactagttgggctttatatattggttcagctagatattagttatgattgcttagccatgcttagaaacattagcacactattgggataacttatgactcactattatttaaggatggcttaatgatagttcacgatggttaatcgtgattggttaattaattacttgccaactaaaacttgataatggtgggttgtgagcacatggttttgagagtcgtgctcatgacaattaaggaccggttcgcgagctactgttgtgaaacatttatcgtgccaaccacaagccagcgtgggcaacggctttatcttttgtatagcgtgattcattatagtgcgccagactgagaagtggcgagaagtccacgggggtcgctggggagtccatgccttgtttataagggggtgattatgatccaggaaaggtgcgctgtaatgggttatgttgtgcaaggggtattgtcacaactcctttccgaggtaccgtggtggtattgaggcacatggtgacatgatgtggggttgtgtcttgtgggtacagtggtacacctctggccagagtaaaactattcgaatagccgtgcccgcggttatgggcgggttgagcaatgtttttcgtgattagtctcacacctctcacaataattatggatgttataatctggtaataatttgtttagctcctggtttggagttagatctgtacagccgggtatggttgttcagaatggttgggcctgtgcaacatgggtgtgttgtttagtgttgattaaaatttatgattaattactccactgttttacttatcttaaatctttgctaaatgctgcttttgcaaatgagcctatattatgccatcctttggaatccttgtgcacttgcatatttgctgtgtggcttgttgagtatgtcatatgctcattcttgcaataatcatcaaaactcagttgaagataaaggttccagaaggagaagacgtttggcttataccccagttgagctgcctgtgggagtggagctgaagccatcgctagatcgttattccgctgctgttttcttttcttttgtaagtatgtaacgttattattaagatggatttttatattaaattgtcagtttgtgtacctcggctgattcttggacgaggattttatgcacaaattagttcggaaattactagtgaatttccgggcgtgacaagttggtatcagagccatctcgactgtaggataagccaaatagtcaaaccttaaggactaattttccggaaacatgatttgtgaaaatttctcctttcttccttatctagaattcttcacaaatcgttttgtcgttctctcctcttttccctctttcaacttgagtagttgttaaatttgatggagaaactcgaagacgtcgatgttgtcaacttctgcaagtcaagtggatcgaggaataagaagatgatagttgaatcaaagtgttcagctgtcaagatagagtgaagtttggaacctagcttagaacctatgccgccaaagtgtctttgaagaatagttagtagggttgaacgtttgttgtttgctttgtgtgtaggtatggttgcattcccatcattggagtagttcattgatgagtgtgtaactgtactaggttgcttgcttaatcaacttgaacaatataatggtctacacacaccagatcagtggtaacctggttaaggtcttgtctttagtgtaacccctctcctcctatcttttctaatctgcaacagatggtgaacactcgcgccagtggaagtggaaacaataacaatgaagagaacccaacccttgctcaagtgctagctcaacagacccaattgatcaacatgttagtgcaacaaatgcagaaccagcaaaggaacaacaatgtcaatcctccgccgccgcagaacaagttagctgattttcttcgtgtgaggccgcctaccttctctatcactaccaacccagtggaagcaggtgattggctgcacgctgttgagaagaagttggaattgctccagtgcacggatcaggagaaagttgttttcgcttcacatcagttgcaaggacctgcatcagaatggtgggatcatttccggatgaacagagcagaaggacaaccaatcacttgggcggagttcactgaggcattcaagaagacacacatacctgcaggtgttgttgctttgaagaagcgtgagttccgggcacttaagcaaaaggatcgtaccgtgacggaatatcttcatgagttcaatcgtctagctcgctatgctccagaagatgtgcgtactgacgaggaaaggcaagagaagttcttggaaggcttaaaggatgaggtgtcagttatgttgatctctcatgactatgaggattttcaggggttggttgacaaagcaattcgactggaagacaagaagaacaggatggacaatcgtaagagaggaaggattgttttccaggagacacagggtagtagccagaggcagcgtatcaagccactccaacttggtgaatctttttctgcaggtcaagaacagtcgcaacagttgaacatcggtggtgagatcaaatcagagactaatgaaagcaatgaagtaaacatcgagcaagctaatcagccggtgctagttcagcaggatcagtctcaggagaataacagtaatggaagggggcagcaggtatgtttcaactgttacaagccaggccactttgcaagagagtgtccgaagtcaaagcatcagcagccgcagggtcagatcaacaacattgtcgtcacaggagccaatgcggtgccagttgcgtcttcaagagttgcgtcttcaagtgttacagctcagtcaccagtttcaaagcagcagtagttttctttaaagccttagaataattatcggagttatggaataagatagactgcagtttacctatgcccttttctttctagccgttccgaatctcgggacgagattctttgtaaggggggtagatttgtcacatcctgatttttgtttcaggatttataaattatttaataaattattaaaagaatttatattaaatgttcattaatttacaagtgaagttaaatgtgggaaataaaatttcttaaatataaagcatgggtggatttaatttttattaaattctccatggttaattatactctctggaattttctcggatttttcggagctcaattcttaattttaatcatacaaagagcatttcagtaattacccacatattaaattaatcattaaatggtctaattataatttttttaagtactttgagtgtccaagtattttcaggatttttcttgaaattatttgagcattggaagtatttttaacaattcaaagatcatttaagtgattattttaattgggaaagtaataaaatcctcctcctcagcttgggccattttcggcccattctttcctttccttcctctctcttccgccggcccaacctgagccgcctcctctcctctcagcccagccggaaaagtctactttacctccctggcactgttcatcttccagctctggacagagccgagccgcccgtgctgtgccctgtgcagccgccgctttctccgtaaatctcgcctccccgttgctcctttttcatttagttgaggggaaatattcctcttatcctcct

SEQ ID NO: 60000 - DNA, 15531 bp, Oryza sativa
aaattacttgccagttaccactgattatctgttttcaaggtaattcatgatattgttggtaaattttttttaaaaagattgctcttgaatacttggttattattatctgtagcaccaatcagaagctacaacgtcaccttggaggttattaatcaatttgagcacctgcttgacaaattgaacatttgctgctatatatgtgctaatgcagtaatctgaatttatttggaataatcaatggcaagttatactagactgaacaccaggtagtattggaggaggatcaaaactattgaagtgatattattgtgaacaatttcacaatttaatatcacttcaatacttccatagtccaagtacgattaactgtttcatggaatttaatgacattattatacttttcgtggaatttactgaagattctttgacaatttggggtttggatatacttattaatgttaaatttgtaatttgtggccttggaaaaactagtttgatttgtactaagaatcacttttgctatttgtcatgtcacctgaaaatttcttgattgttaacacctaagcttgcacattgcataatcttaacttgcagaatatataaaaccacaactttagtataatttacttcaaattaaagtttactttgtttgcctctctagttttgatttttatcttgtttcttagtggttcggattcattaaataaaatacagtgactttatcttaagtaagaaatgaaaatattaatttcttttgctattgggcgttggtctagtggcctcaaaaagggtttgatagataagaaaaaatagccacttcattacttgatggtatcataaaaaaatagtttagcttttctctctctctctctctctctcttttttggagaaagggttagtaaagcttagttttttttaaaggattagtaaagctttctgggatcactaacttagattagataccacgaattgtgaacaacttgtccctttagtcaccatttatatctgaggaagctagggatgatttcgttgcacactcaagtcactctaaagtctaaaccgaggtttccttgtttcacctatatacttgtttgctttcaggatttttctctgttcttagtcttgcagattccaggctcggtctaatcgccaatttggcaatctttgtatgctctacaattccgtgctggcatatgccaactccaggtacgaattatgtaaatttcagagacttcattctgttctctctgttcaacacttggtttagtttcaaaacttcaaaaggagcataatctagtgataggagagaatcccacaaattccattgctaaaaccaaagttacttgttcgctctgtctctgtaatgctttcagtaatatatattggtcctgcatacaacaaatcataagaatctaaattgctgttgcttttgaagttggcattcccaatatcctttgttgtgttggaacagttcacatcaggctgtagaccaagttggatcagcttgaacgaatcaagcacttgttacattctgtctgttgttgaagcaaaaggcccccacgaagaaacatcgatcatatgcaccaagggtataacagaggaggtcgaatcccatgtcttgtggtggctgcaggcctgtagccaagcggatccgtccgcctgccagcaaaatgcatctgacggatgctacgaaaagagagacgatgttgcagaggtaacaagagacgctcgaaaacccggcgggtgtggtgagattctgccactaatcatggacaaatcacggacaaatcgagcatctatcacaaaccagctttaaacttttgagagttaattttactttgggcgacgctaatgggcggccagcgatcaccccccatccccctatacgtcctctcccccttccttctccccttcttttcttcctactacaccataaattttaaaataataaaaaaaacaaagttagaaaattttatgtataaaaatactatatataaaaaatatttgaattcaaatttaaatttaaattggatatataaactttttacttataaactttgggtctaaagtaactttaggtatatagaaatactatatataaaaaaatttaaatttaaatttaaattcaaatttgaatcgggtatataaacttttgacttataaactttgggactataaactttaggtgtatacaaatactatatataaaaaaattgaattcaaattcaaattaatatttgaatttaaattcaaatttgaatcgggtatataaacttttgacttataaactttgggtctataaactttaggtgtataaactttagatgtataaaaatactatatagaaaaaatatttgaattcaaatttaaatttgaatcggatatataaacttttgacttataaactttggatctgtaatatttaagtgtataaactttagatgtgtaaactttaggtgtgtaaacttttggtgcataaattttctaaaatatgaaagtaatgcggtgtcaaaaaaggaaagtggagggaggggggattgatcgcccggagcgcttgatcgctcgttaggattctcgttttactttgggccactttttattaccgatgtttcgctttggaccaccttaggaccaatgttttcactttggaccggatatttttacctttgtttcacattggaccaccctcactcttttatccatctacatccaacttgtaatatgtcgaagaaatagtcttacatatagctgtggcagttcattgacgagtaggagacggcgtaatcgagatcgttcatatgcttgagaagagagttgggtggtccaaagtgaaacaaatgtaagtttacccagtccaaagtaaaaatattgcttaaatggtggtccaaagtgaaacataggtaacaaaaggtggcccgaagtgaaatttactcaacttttgaataccttttctattgtacataaaaaagagttgtggtgattaagtgtttcttatttggtactggtatagtatatctcctaaccagaatcagcaccaatctttaacctcgcattgctaacatttgggctttggctgactggaaaaatgtttttgcgtctcatttgtactatcaaaagatatagaggatcacatcaggaataaaaggaaaatcgaaagtatgatttggctgcaagtccattaacataaggatttcaagaattaggtggagtcgcaattgtttaaatctttgctgataaattgaagttcacaaagaagaaactgtttctgtctaccaatttttactcttatattcagtcctctcattttcctgtactaaccatgattaacacgcctgaaacaattgagactatcaattggttctttcaagtttttgcaaactgttgtctcaaatattcaatgaggcaaattatgatggtgcaatgaacattggtttctaaagtatgtaaagaatatgctcatgataatctttgcattgtgtacttgtgttgtgaactattgcaaaaagtacatctttatatcactaaaagaattttaaggttgctgttgcataaagagattgagtactctgtgttgacttgctgatagaatttatctaccatttaaatccttaagatgaattgatctctcacttttctccttttttttgtagggtacatggcggagctaaacactatgcaaacggtggtttattttgctgtgtcttaaacatagtagtgatatctagcaactagcaagggactactacaatctttcagtatccaagcacatagttaaacaaaaacttacagatagcaacacaaactaaaagaattgaattgggaagggaataccatagacatctatggagtattaatatagaacacacaaacaagagtttaattaggtgcttaactataagcaagaaagggacatgtggtggaattctattatgagataactgatgcatagtacttgtaacaccatgcgccttaatttagtatttttgaaaaataattaaaagtcaggaaaatttaacttttcaagctgttgcacggatgaacaaggaccatggtattccagacatacatatatagacacacattaggtcctgttcttttctccaacaagagttggatgaaaattaagattttcgtggtacgcgtttcaaactgctaaacggtgcgtttcgtgcgaaaactttctatataaaagttgctctaaaatatcatattaatctatttttcaagtttgtaataattaaaactcaatcaatcatacgttaataccacctcgttttgtgtaaaaaacttaatcttcatcttcatcttcattttcagaagaaaagaagagttagcgatagcgacgctcctaattcttacggtgctaacggttgacggtcgttaagtgtaaactttaaccatcaactgctatataaaagaatataaaatatatcatcaaacttacttgtaggggtttactactaaccattatcactcgtattggtaaatatgagtatgcaggtgatttctaaatgaaaacacacccgtcttgcgacgaaatgcatctccgaccaatcgtacacgagcgctaggattggagggtccacatgacagtcaaaaccgatataaaatgggcttatccacgatgcactaatatagggacccgccagtcggcctcctagccgaagaagcagctcggaagtggggcccacagtttggccaaactaggggctcagccgaatcttcactgccacctcccatcctgaccttccttatgtaggctccagatgcactcctagtggtggttatgttggtaaccttcatagcacactataaaaggacaagaaactctcatttccaatacaagacttaagtggagtataactcacatccatattttaaggcatcaccttagtatgtggaattaggtagaaagtgatgggaagctctggaagaaatgcccccaaatatcggagttctctttgggaagttcagaaggagtgtcaggtttgttgacattcttccactcgagttccggagaagcattggagttgtcagccttcttctgttgcttgacctcagcgaatgcttgttttaataaagtaagtatttgagatctccatatagtatttaattatttgcttgagtgagatatagttacatcgttacgggttcgtcgcttagttcaattattatgtgctctagtattaggactctgagtaaagaatgaagtttctgcgcgaggctagagtaattatcaataacttaggcgcggtgtctaggttagtggtttcctttatttgttgtgtgctccatgcaaagtgaggtatgcggcaggtggtgacaaccttgtccatcttttatatccctccatgtttacgtacattgactcagtttgtcaaaccaggagagtgctagtgctcaaagcaattgatagagttttacctttaactcaagtatagtacattaacccgtaagaatcttctttagccttagcctaccattaggtgctgtccttggatagaatcctattattagatatgcacacaatccctatgatttgatacctttggaatactctaagttgaagtgctacagcggtatctgtgcgcttccgatttttattttactatatcaaatactaacaagcatttctgacgctgttgccatggaacggttgctatatcatcttcaaacctgattcatcctcatatcttttctttgttgtccttcctttctcttcttacctagcacggagcacctttctattcaaaacctttatgctccaaggaccgagttctgtgagccacctttttcttcaaacatatctgttcatctggtatgaactccgtcctagcttaagagccatggttcgggaataatccttctcaggatgtgaaagcgaaaatccctaccatcatttgcgtgagtttgagcaattgtgcttatgcctgacaataacggacatgacataagaaaccttaaagtggaaattgtttcacttctctcttacagagggggcgaagcaatggtatactcataccatgagaaaactgcatattgatgggacaaattaaaaagcatattatgccttgctttcttcctgttaacccgtgtagtctctctacgtggaggttcacgcgaaagaatccattggtgcagcctatgctcgtttctccttgttaactcaagacgacacagacttttctttaccgatcatgtgttgttacaacacttccactcgggtttagacaagatgtctgccatgtatctcgatacttctgctgtaggttcgtgcgcacacaaaacgatgtctgtggacaccccgagtattataccatccagtgtccaacgcgaacaccacatactattggagaagtgggatccatacacgcataaatagccactcatcctcaatgtgtccatgatcgcggttgacaaccttctgttataataactggaatgccaagtagtgaacacaagagataatcataagatagcttgccagtctactccgtcatatgtccgtcaaccactcgaaggtggcgaccaaaagcataccccagtgactcgatccaaggcactatccccgattatctcaagcgatcaaaacccgttactcatgcttagctagtccgtaggaatgcgactagcctcacactttcatcgcaagcaattaataaacatagcaagtaccataatagggttaaagtgcagcaggtacatgacacataatagggtccaagatcccaacatacaacacataaatatagcagcagaagtctcaattagagttcataggcaaaagataaaatcggtggtgccacaaccccactagggcaaaccaaccgggcaagagccaagctgcaagagatcactcattgccctcgccaccctcagcagagcaatgaccacacaagaagcataactcataaccggaatcctctcctgaaattgcagacaccgggttaagtacaagattgtactcgcaagtcttacccaaaattatatatacataagggagagagaagtatgcaagctttctagcctatagtgggtctctaggttcaacgtttgcataaagctaattttattgagaaattaatgagtaaaataagtaaggacaagtaactctagcatcattttaatttatggacagcaagtatataattctgaaatatataagcaaatgagcccaaacggcgctctcatcatcaaccatggactaccaaagtccataccaacatggcacaacatgccaacaccaccatcaaacataatcccatccataataatccacatttgattctaacataagtgactaacacatcaagcattgttcataaccgaggacgcggctattcgaatagattatactctgatcaaaggtgtacaactggacccacacgaaatgaacaaatatcaaatgctacacaccccgtcgagtgcggtacataagtgattcaagctcattacatgccctttcttagccccaccccaaccacctatactacgctggggttcccgacgactcagtcacgtgcgtgcatgatgtgaccaaggcgggcgcgccacgcgggaggcacccccggccaaacctaggcacccgagaacctccaaaggctacctgcctcacgactctccaacgtagtataaatgatcacagtagaactagtaagaacaagccggtcccaaataaggcatgtggtaagtacatagggtgcttgattagatgtcaaaatgttcggtccttaacgacctagatggggctacttgcatcaggggaaaccaacctcccatcatcgccctatcacccgtccaagtccaacatatttcatcaaccattatttagtgtaagtgctcaagttttatgcccaataatgcaagttgtctatataccactattaagcactgtctatccctatagttctattagcactaagcatggctaagcattaatgaataagacatcccaagtaatcccaaccagtggtaatagggtataagacaacgatatcacaagaactaaatgcattaataggttctacccatacaccataaaccgacaatattaatatctaggcaatacatgcatatatatatatatatatatatatatatatatatatatacatatagattgcaaccaaatcatttttagagaaagcataggttctatatgcttaggtgcttgccttgctgctgcgtggaaacacactcaacctcagagtcttgctccacatactccgaattctccgaatctatcgataagaggcaaatatgcaaataagattcgaataaacatgcatatgcaacatgctctacagaacacggggtaaacacagtggacatgtcacattttcaagaagaacatgggtgaaaagaatgaccctatttgctgccatgattctggagatataaaagtgacgagccacaaatgctgaaaatggtcctatgccaaaactgaatataaactatgggtcatttggtgatccccacatattctagcaaattttcatgggtgaaacttgctccatacaaaagagtataatttactggtgataggaatagtattcgattatttaatttggagtttgaacaagatagtaggtatatatgaaacctagagagtgagaaaaagaaaactgctgcctgcagcccttgtgcccaagatttgattcgaaagtttactttacaaatgctcagtgattgaggaaaatgaagaaggcatgatttagctcagctattggttttgtaaatacaatttttacaaggtgctggttagtctatgagggattaagtcgtaacatgaagtttctagctggcctaagaacttatgatgctgaaaggtagcaacttgcttccaatggcaactcataaaggtccaaaggttgctgttacactccatgcatgcatatactttaaaatgcaggtggtcaggtactgtggttgcgaaggttggagcacaaacagccatagcacaagaacaaatcgatgaagaagaaaaaaaatggtgatagcaacctgagtaaactgagggggatgggggttgtaatggtcggagtggagagaaacgagttgcaactgttctatgctctaaaatcttgcatcaatgacctgtggagagaggtagggaggctcaacacaatggcactcacaagagggacacaatggatgggaaggaaactcaccaagtggaggaaaaacatggttgttgttttgttgctgcaaccagcagcaagctccacctattttcttcccgatctccctcacgaacccatgcatgtgcaagatatttggatggatgggaggcttggatacttgagattgctgtggtgtgacatgcagggatggatctcaagtgtttggaggagatttgatggaaagaagtgaactgggagctcagcttgcaagaaagaaaagaacaagcaagggagaaagaaaaaaggaagaagatgaaagggtttcttgctagtcttatggacctgaggtgggtggacgacctggaggtgggatggggcttggtggagagcctaggtcagtgaaaggtggggccaagttgagctgggtcatgggacagataaaggaaggttagaaccttacatacacattgaaaatagtgagttttcaagaattttccttctctccttcttgggtaactagtttgtcctagctaaaagagagtcaaaaatgtgtgttctggcatggagatagattgagttacgtagtttccatttttcaaagtttcactcaaaaatttgaaatattttaattctggcaaaaaggtgaaatggggtatgctgagaactaaattgaattttaatgaggtcaaaactgagtgtaaaaattctagaaaaattatattaactcataataaataatctagtatttgaataaattataaaacctatatccttcagttcaactttaggcacatttagaagttgcttcattttgccaattaggtttctattaactaagtgtgactatatttgactgatatatttgaggtagtaaaaagaatgataaaattatgaaaccttcatagtggtcatcttaggttgtctaagtgacatgaggatcttcatggattttatgttgcttagatttgttatataaagtctctatgtttatttaacatgtatcaaccaattatgaacgacataaaaatcattacaaacaagtacacaagcacacaatcacttgttactaattctactagccaattgcgaagcatggtcaggtagattatccaaagagcgaaagattaacaactatactacaacgtttcttaactaccgcttgaccatttaatttggttatatacatagaggcttggacaaagcttagaagctaaaagaagacaccaaacaccagaccaaacactagagcttcatggattatctagtattcagtcagtttggtctctagaaacattgttccccttgtggaagggaaaacaaaaattagtctagctactcctcgaaactgttggtagattttattagcaccaaaacactctctgaacgatggatgagtcattaaaaaaagtttttgtttatctagcaaaaggttgtagggtcattagtctacctataatgatcactaaagtttcttaataactcaaaccaacagtttgggaaaatggtttcaatttctacccatgttttttatacacaaattaaccgcatgaggttttgaacccaaatagctttaaaacttccaacttttactaaggacataccccgatttccacttaagttgattaattaaaacttcaggatggtacaatgtcagaaggtagggacctcttggatcatatcatagagaacacttccttcgttcattgcgaaaccatcctggaaatcgaggatacacatgaggaaccatcgatggccgaatcagagaatacaacctccacatcccatgtttcgatcgttgaatccttaccggaacctcaggaaccgaaggtagaaaaaattcagcctttggaatccctgttcttatttgagggtgatctttttgaagattatggacacacctcaaacaattcctgccaaaagagaccaccagtcccacgtacttatcctgcactactcgaggagaatctcttcaaagagatggtgcaggaattaactaccatcatgagtgatgagtgattaaggtaggtggagctttcttctgaagtaactcagattagctcctcgtccttaaatattccatgtctcatgagagaggccatggtgcaaaatctttataatcccactattcatgcaaatattatgtttgcaacctttgcattaaattgcttaggagacgaactgttggctccaagagacagaacttcccggagcccatttggtcctattatcgaaggttatgagattctgcgcagggtgctgatctgacacaatgatgtcgaggctattctagacttccatgtttttgaagtccctgacttccacttctcataggtcatcccatagagaaacttctccttgatgctccgcataccggagtcctcaacatcaaacttgggaaaatggcattttctgtcctgatctttcgatcaaaaaattctttggcagaactcattcccgattccaagccaattgaggaagtgttggctatctcttcatttgagttccccgaatccctcctaaaagatgatgccagtgcattcgtcaaggaggaggacgatcctagagaggtgatcgagttacccaaaaccgatctgccttcacaacctttggttgagccctttaagccttctctatgcctacttgcacgatggtacggaatcgcccgttatcataagcgacaagctttccgatgacaagacctccaagctcacagccgtgttagaaaagcatcgctatgttctaagctactcacttcaagaccataagcggattagtacaatgctctgtactcatcgtattcttctagatccttcttgtgcgccctcttgagagctgcaacgaggactaaataattccacgagggatgtcgtgaaactccaacatgtcgggataatttatcccatcccatatagtgagtgaaagtgtatctaggctcctattgattttgatgattgattacaatgcgattagagaggactaacatttttattcaagcaaatgtgaaggttgttatgtcctcaacatgttgtaatgtgatgcataccccgtgaatgcgacatcacgatgtaatacggcaatgatcaaatggtatattgtatcttgtaccttgcattgtgtcgttggaaagctgtactattaaggggaatgatgcatagacatataaggagtgatgcgggtgctcaaaatctaattttcttggaagcatttctcttattggagtgttctgtaaatttttggatgttccaaaaataattttcggaagttccgaaaatacacagaacaatttttggcgttctggaaattttcggaagctctgaaaatgcgttgacttcgattatttctaagatctggaatttttggaagttccaaaaatgtttgtcgaaagttccaaaaatcacttttattgcacaccaacgggcagatttgtgatgtgggtataaatacccacctcccctcacttgtgagggctgctggttccatttgcaatcatttgtgcccttggcttgctctctcttgttagaataaatgggcagcccataataaatgttaaggataataataccaccctgggaattaaatgaggagtatctcaacttaaatagggagttattggaggctccctgttgaccggttgaggtggggattggaaagccacacgcgcgcgcgcgccgggccgggggcgtgggcgaggcgggcgtgcgtgcattgcattgcgttgcgcctctctgtatccttttgcaacggaccaaccccgagattgcctccgtaacgggcaggcgattcaatacccattgatctcgcgtcgttactacggcaacgggcggatatctctcctgcgctataaggaaagaggcaacccgatcagatctgctcggttactttgcacgctactgttctgcttccccgcttctgattgcttgcgcgcacgagagatcggagcgagcagggcctccggaaccacaccttcgcctgagatttgcaccgggtaggcgggtcatcaggtttttggggagtgcttccgcacgactgctcctcgtcttcgaccgtacgtccgtaccatgtctgccgccgctgccgaacctagagatggcgcgccgggagctggatctggcgctgcgaacgacaacaccaatggaggcatttctgcctcacaatccagcggagggacattcacagggtataaccttctacccttactgttatttcggtttttgatatctttattagtcgcaattctattgcgttcgatgtatgatgatgatgcttattatatcctaagcatgcttctggttatgtttgattttatcactagatcacctcacattgttcatgccatgattattgtcttaatattttggattaaaatatgctgatatatgactatatttccaacaatccaaaaacctgatgggtcattttcgttagttggctttactactgtacgaaaccacatgcttttgatggttctaattataagaggtggaaagcacatgcacctctgtggttgacagcgatgcaatgtttctatgtttcatggggcaaatgaagtgaaccacctctctctcctgaggaagaggttaagttcgaggcttcggattgcctgttctgtggagcattgattagtgtactcgctgacaatatagtggacgtgtatatgcacatgccttcagggaaggacatgtgggatgtacttgaggccaagttcggagtttgcgacgccggcagtgagctgtatgttatggagcagttctatgactacaagatggtcgatgaccgttctgtagtagaacaagctcatgagatttagatgctggctaaagaacttgagaacaacaactgtgagttgccggacaagtttgtggagggtagcattattgccaaatggccaccttcttggtcgaactttgctacttctctaaagcacaagagaaaagagttcagtgtttctgatctcattggctctttgggtgttgaagagaaggcgagggcaaaggacaaccggggcaaaatggttgagggaggttctagtgccaatatggtatagaagaagaaccctcatgcatttcacaacaacaagaaagtcaagcctgatgtcaaacccaaggctacaaccaattttaagaagaaaggcaagggaaaggcaaagggagactgctttgtgtgtggcaagtctggacattgggccaaggactgtcctgagcgcaaagacaggaagtctgccaacatggtcattgtcgacgtttgatgtcgcgattctggtatttgcatagtatggggatcgttggtaccagggtatacacgagacgagactgaggtaaaagagatggagacgaggatttttatacaggtttgggcccctgaattgtcaggtaataaccctacatcctgttggccgaagctggtattgctcttattcaccataatcacaccagtacaatatttggggtaacctatctaactgttgtcgccatggcggtctgaaggactgactcgtagtcgacaacagggtagtccttctcctcgagttcgtgcccagtgagatcagagacagcgcaatgtctctcttatcagtatccggagaaaccgtaggggactagccgtgtctatctctgaagtcgatatccggcgtcttgtttaggcgtatgttggcttgtatgtggatcttgtgtcttgatctattgttccgtgtatgttgattgtggtgggtgttgattgtgatcgtgtcctctctcctcctagggggccttgtatttatacccatgggtgtccccttgtccaagtagaactagggaaaccaatatggatacaatccgagtagtccttgtcgttcccatgtagaactctggttgtctttccttatccggaactcctcctatatctgcaggttgtttccgtataggacatggtatgtggtgggtcctgctgagatttagtcaactactattaggtatgtggtatccatagccctgacagtcattagcgagggcggaggaacatcggggtacggtaaattattacctacagttctctctgtttttcattcacctgattggtgggttgatactggtgctaatattcatgtatgtgctgatatttccctattttcttcttatcaggtcgggagaagttcctccttgttgatggtaaacgggtcacttgcggctgttcatggtgttggtacggtcgatctgaagtttacttcgggaaagaccgtgcagctgaagaacgtgcaacatgtccctttaataaagaagaatctagttagcgtctctactatgtagagaaggttttagacttgtgtttgaatccaattaatatgtcctatctaaatttgcaacttttattggaaaaggttatgacagcagaggcttgttccgctttcctttggctgacatgtgttataataata

SEQ ID NO: 60001 - DNA, 2115 bp, Oryza sativa
actgaggacaacctgaagataatagtgggaagtaaactgaatgtaaagaaagtgaatccgagctgcttggtcgtgggaactatttccagttatgaaccaagtgatatgttcgaagattgttttccaagggcaaattaaaaatcacatctaacaacgaagctttagatttgccaggataaccatcaaacaataagaagtccagcacaaagccatttgggaagacgtcaaagcatgtcaagtgggataagttggttcggttgagaaacataattcaaaggcaaagttatcgactctcgcatggaatagcagaagtagctagcacccggagagcaggaaagctaatatgaggcagttggtggcaagttagaagtaaatgacaagcatggtattctcatgatgacaagcatggtatcctagtaatgacaagctgatatcgacgcataacgtgaagtgggtaacttgtatgaggttgacgccaaagatatgaattatgagaagttctggaacggaagcatcattaaactaccgcaacctagtctgagtcagctaaaaggtgcaccctggttcaagtcaggtgaaaagaagattccatctgcaacaggagatcaagccaagcagttcagagtggggaagttttgctgggcaagtccattcaagaagatgcaacggaagaagtcagaccagaaaagaagaccgcccaacctatcttcttgctagcctcctcgaatcttggggacgagattcctgtaagaggggtggatttgtcacgtcctaataaattcatcccgaaataaaaatcatcctctaaaaagaataatagaattaaaaaaaattcgaaaagaaaatggcaaacactaaaatacgtgctagaaaaattcgaatgtggtccggagaatttttgttaaattctccttggtctaaaaagagccctcaaattttacttgaattttcagagcaccggaaatatttattaagcaacaacaactatgatcaaagtttactaaaaagaaaagctaaaaataatcctccttcctccctttgggccaagtcccaaagtcctctctctctctctctcggcccgcggccaaagtcctctcttcctccctctctttctctccctctcctcctctaactccttctcttgggcctcctctccttcccctcggcccagctccctcctcctccctctcttccccaagccgcctctccctcttctcctcctgggccggccgcccggcccaagccacgccacccagccgccccatcctcccgagccgcaaccacccccctcacgcgcgccgcacgcgcgttgcacgcgcgctaaccgtgtggggcccacgcgccggtcgtctccctcctcccgtgaaccctagctcctttcctccctcaaatccgtgcgatttaatcatgggattccaaaattaaatagggggaattaatccccattgattcctctttgatttcccccgttttcccccttgaatggcacccccaatcgcccggaacggccgcgccattcccggccgccttccatggccgccggccgtgtttcccgtcgccgttccgccctctcccatgcccggctccctcccctgacctataaaatggaaccccctccatgcgttctcttgttttagcctcctctccccggtcagccctccgtttcacggggaaatcaccggagacgcgtcctcgccggcaaaacagtggcgttgccgccactgtactgcctccagccacccctgccgcgccgctcaggtgcgggccggccacgccgtctcctccctcggcgtcgccacgtcgacctccaccccggcctaccctctgattcgtccggagaccgccgtcgctcgcgccggcctctccatcctcttcgtcgccggcgtcccttcggccgcccctccctcctccccggctcgtcggctcgctgagccaccaccacctccggcatcgcagcggcaaggtcgccctcggcctcgcctcccctttgaccgaaccccgccggtgttcgtcgtcgtcgtcatcgttcctcctcgccggctcgttgtctcgctgcgccgcctccgtcatcggattcgcagcggcgtgttccacgccgtcctcgtctccgtgcag

SEQ ID NO: 60002 - DNA, 1618 bp, Oryza sativa
tttactctgcattccattgcaatgggaacccatcataaaaaacatgacatacccctttactatcctagctgtgaacaaaagtaccgacccaaccctgcctacagccggtatcccggacaggcaggccaggattgagcccctagcaacaggatctagaccgggtgcgccacacacataggggtgagaccacccgcgtactagtccagtgccatggcatctcgactaacggacaccggcccgtgtagcattcatttgcctagacatctcgattactgagccgcagctcgcgtagccttcatttgccttagagatatccatcgtcgcaacgacttcatccatctctatctgtgtccttttgttcaggactagactgagcaccgagataagccttacccattagacatgtggttagtacggtactgctttgcaacagaggcccgagcttaatccttatattggccggggtgctacttcccacaactgggatgcacccaaatcccaccggaaaacaggttttacgggttttgaaagaggaagagaggtgtatgtccaattccaccataagccaaccattccatagtatccaagtgatatgagaattcccaaagtctaaagttataaaaccccctaatgttgcctaattaatcagcgcagcatctacctaaattcatactagtcgaaccattgaaagagcatctatgcccctagtggattttggtttattgatgacaaacgattaaggaactaatgcacttattaagtgtataagaaagtgattagtccgatgaagaagctaggaaattgacttatcgatggatgataattaaacagaagatattgaagatgcgggtatgaagtgactacctatcgcaagacggtgaagcgcaagcgacgctcagctgcgatggaccatgcggtggtgaagggcaagcaaggggcttggcgccggtggtgaagggcgagtgaagactgtgtcgtgatgaaccgtgcgaggccatttgaagccatgtattatccgcattaatcatttgagaaatggaagacgaaatgtcaagaatcaagaagatgagatcttcccgatgatcaaatgaccttgacgttggtaaccctccaagtgaagaaacaatatggtgtgaaggtactcctattggtataactttactttttaaatttgagtttaggatgccgtactattaagagggataccacatgcaaataattggttgaatacaagtgctcaaaaggcttcatctttgtgcgagttgaaaaacatgtgagttgaaaaacctaagccaaaatttcaacatctttgcaagttttctttgcaagtttttcaacatctcttgaaggttttggaccaagttttatgttgggtttgatagcccacgaaactagctttccatagagtccaagatcttcgaaatcggagttcggagtaaaaagttattgcatttttacttgagcaacatcagactatccgatttgaaatcagactatctgatgtatcggactatccaatttttcacagaacttcactctctgtcttgatttgaaaaagtcctatctaagtgagtttttctaagtatcggagtatccgatgtcggatcagatagtccga

SEQ ID NO: 60003 - DNA, 1323 bp, Oryza sativa
gccaagataagtttgtgaagccggatctagcctccgcaacgaaagagatacccttagtggaaggaggagtgcatttgtgcaacctcacgaggatagggttaaaaagacccggctctttgcgagctccctcaacggaaattagaatcccctcaattgaactccgggaaatacatcgacgcgtaaacctcggtgatattctcactctctttaccgtcttgttccattgctttgtgctatgctaatattgttgttggtcgagctcacctctttgcttgtggattgaatctagagctcttaggttgttctcttgtttgtattgttgttgtgcaggtcagatagtctgatctcagttcagactatccgatcacataggactatccgacctgatatcagacaatccgaccctattttgttttagcttccgcatttattttaaaaaaccgcctgttcacaatcgacatattttaaaccgcctattctctttcccttcatctaggcgacatcaaggtcctttcaattggtatcagagccaagtctctctattaagggctttaccgcctagagagtaaagatgtcgattagtggtttggtggatattgttcctttactccttttagatggttcaaattatgattcttggagtactcgcatacatgtgacatatttaggactatgggtcctcaaatagagcgagttgtagatgtgagcgtttctcctcctaatgataaagagctatcatctgaagaggaagagaaatgcatacatctcaatgctcaagctactaatgttttatttagtgttttgagtgaagatgtatttaaaaccatcatgccgcttaaagatgctcatctcatttggaccacactcaaggagagatatgacaagtccaaatgtgatgatgtactctttttggaagaaccatttgaggaatgttcaacttcatcaccaaattgcgaagaacctcaagtgactaccttcgatgatccagataatcatcccacgtccaccttatcaacacatgactacattgaaggcaatgaattggtgagtaaggttgacgatcgtccaattctcccattggattccaacaacactgataatgaaattgtcatattgcattgtgttgttgactcatgcatctcacctagccccaagtatatgtgtgaggatgatatggataaatgctctacttcctatagtacttgtggaactaaccttttgaagggagaagtaaatgagcccaatggacaagtgaagaatccacctcaccaagatgctcatctttctatttccaaagatcatgctttctttatggaaaagatg

SEQ ID NO: 60004 - DNA, 14770 bp, Oryza sativa
tgggactccaatattctaggcatttttatgttgatgtaatggcgtggaatttgtcggtgttccatgtatatttaatttagttgcttaaaagtcggtggtttcgatccgtccacatcaagcctccacacatgttcattactaattcatctgcctttaaaagcaaattggtaattagggagtaatttctgaatgttctaggctcaaaagtggttctggtaatcttgaatatttgctctggatgacattccctctatttttgcttctgacttgaactgtgaccgtgcatctctgtggtgatcatggattaaattaggaacaatggtttaattgggttattctagggagaagtgatatccattggttgtcatggctgcctgaatgggaattacatcatttgattttaagatttaatagcttaagtagcatttgggctcactaaagtgcttcctttttcttatctttcagacttccactatgaattatttaacacgcataaaagaacttcccttgcatgatttttttattatgaaatcaatatttatattgacaaacctgcttagcttcagttggacaatgataagctgcagtaaggctctttctcattgaaggacattggtggattctgcactgctgttctattacttaacttcagtagataatatatttgcccatttgcttgacatcacattttttattttctctgttccatatggtgttctatttctcattttaggtgaacatttgtctaatttatctgtaccatgatctttttctgaagatattctccgcaaagagagatcatctaaagcatggttaaaaaacagtaagtagcgaaaaaatcatggtacaggagtcaatggtacgcagtagcgaaaacacggttaggagttgcatattatgctgttttgctattccaaaacgtttttgaactgtagcaggatgtttgttcctatttaaacgagagccttttgagcttttgtagcttccctgctggttacattctaataaaacaaaaatagtccttattgaaatatgcactctgtaaacagtaaggggttcttatactgttttctttaattccacactacaataaaaagagtgagatcagatggcaagcattctttgtgaaaacaacacatccatatctggatgtagtggttgccttcatgttaaaagtgggtcacaatttccagtattggaatctaatttagtacatggcaatgaaatttcattgagctgtgaaagtgaggtatcaaaattaaggttggtttctattcgttcagggttgaccttcatccttctcatacaagtattttactaggaaatcatgaaaaagcatggtgtcttaaatagtggactactaccatttttgtttttgaaaccttaattcctctctcaaaatttgctacaggtatacacccatggtacctcagatacatcatgttccagccgttgaaagaaagttgcattcattctggtgattcaaactttctggatcttgaatggctttcaacttgagacaactcaagcgatgaaaggtgtttactttggcattgctattgcatttttttttagcgttttcgactgacataatatcatcttcacagtgacagtcaatttaatttacacattttcttttgccttagtgtaggaaaacattaaggataattattagttgattctcctgtaaatttcttacccttcatgtttaatttcatatcaatctaaattctagagttcttttgctctcactgcatttccatgtaataaatacaaatatgtagtctcgtgttgtatcacttgatataactatctgtattgagaggtaaaatgaaaattatgttgccacacttcctaaatccaattaataagtgtcttctgagcttccagtatgttcactgatactgatttgaagatatcctctgaaacatttttttttaaaaaactcattaatactgatggattgtacttggacaggtccattgcaattaatactccggatgtgaacctttcagcggagaatgttattgccacaatgtcttcttttgactggtagatttgtatgatcaaatatagttgtatcatcaccatggacacattactctgatcattatgtaaaactttgatttttattttttatatgcattggtgcttcatctttagattgtaaagtgtaagagttttgttctcaacagaatctgtaaaacaatgtatggaaattactcatcaacggcattcactgcaaatgtattcataggtttttttttcttacataatcattgattcagcctgaaaacaaatgattagtctacactaatcaagcaatctatatgcaggcggcgcgctattggcgcgccccagcatctagtgcatcattaagagtagctgcctgaagcttaggcgtccaaatttgatggcttggctcaggctaatgaagagtcaggtcaggcaagctcaggatataccagggcacaaaccaaacacatagttgttggagctcagacagcgccctggccaggaatacaagcatcaggacgcgggctggcataagccttgggccaatcttgggtccgtccctaccactagcaagacgccatatgaaactgaggataagcttccgcgcaccttttacgagtgtctaccagaaaactaattttttcaagcgaccaaaactaattttcacaggcgggagggaggtccgcctgcaccacaacgactgtgaaaatcatcgatttttgcagtcggggcaacggcctgcctgcgaaaatgcaaaaaaaggaaaaaaaaattcgccgcatgcggctcgccgccgccgccacgccgtcgcccccctccccggttggatctgagaggggaggggaggggagccgtcgtcgtcgccgccgtcgccggcgccgctgccggcctcccccctccctcctccggccagatctaggagggagggggaggggagacgctgccggccaccccgcgcgcgtcgtcgtcgccgccgctgccgccccacgccgtcgtcgccgccgtcgcccccgttggcctcccccctccctcctccggccagatctgggagggagggggcgaagggagccgccgccgccggccgcgctgccgtccccgccatgccgccgcagtagccgtccccgccgcgccgccgcatgcagtcgccgtccccgccgcgccgccgttcccgccgcactgccggagatgagaggagaggagaggatagtgagggagagggatctgagggagagagagatgagggagaggataagtgagggagagaatgggacttagaaaaaaaatctgctccagcctagtctatttatattgctcctcattttcgcaggcagaccatataaggtgcgcctaaaatgattttcgcaggcggacagcgtacatcaccccaatttatatttttgtaggcggtcatttggctccaaaagtcatgtccgactgtaaaaataagactctaatgttggggaaaatgctttttctagtagaggcctagcgttcgtgaaggatctaaactactatgtgcgtgagcttgacgaccgcagaacagccgacgtcttcatcggccacaaagatgagatgggggtatcgtgtccttcatgcaaggatacagcgtgtacatgcgcatctcgctcgcgatcgatgtcatatttgacgagagccccaggagggactgtggagagaactccttcagcgaggagtttacgtgttaattacttgccacaaaaccgggcttaacagaatacaggtatatatagctcggatagagttgttgtgcatctactaaaacataggaaacttatcttatctatctaaacatcccaacaactcttatccttcgctatttgttacattatcatatgtgagaaatatctaacactccccctcaatctgaacctgtaaggtttagattgtttctaaacatctctaactgtctgactgacagtgtcttggtgaagccatcagcaacttgatctttggtagatatatattccacttgtaaaagttttcttgcaacccgctcacgaacaaagtgataatctacctcgatatgcttggtgcgagcatgaaaaacaggattagctgtcatatactttgcaccaatattatcacaccataccttagcaattttgggtacctgaattcccagttcatgaagtaaggtttgtatccacataatctctgcagtagcattagccaaagccttatattctgcttctgtactagatctggatacagtagcctgcttacgtgcactccatgacacaagattaggccctataaaaacagcaaaacccccagtagaacgccgatcatccaaacatcctgcccaatctgcatcagagaaagcacttacaagaagagaattagacttgctaatttttagcccaagcttaactgtatgtttcaaatatctcaaaatcctcttagccgccacccaatgcttagtggttgctgcatgcaaatactggcacaccttatttactgaaaatgataaatctggtctagtcagagtcaaatactgcaatgctccaaccagacttctgtacctggtactgtcttctggtccaagaggattaccttcatgagcacttaatttttctgaaatagacaaaggagtattgactgctttacagtcactcatattcactctctttaacacatccatagcatatttctcttgtgtcaaaactatgccatcatttacttctttcacttcaatgcctaggaagtaatgcagtcttcctagatccttgagtgcaaattcttgattaagattcttaagcaaagcattagtggcaacaatagatgagctggctactataatgtcatccacatataccaacataaatatagtaacatctcccttactgtaaaagaacaaagatgtatctgacttagatgatttaaaacctaactcatgcagcttagtacttaacctggaataccatgccctgggagcctgctttaaaccatataaggccttatctagtttgcacacatagccatctttctgttcataacctggtggctgcctcataaagacatcttcctctagaaccccatgaagaaaggcattctgtacatctagctgacgaagggtccaacctctagagattgctatggacaaaatagttctgatagtagcagccttaactacaggacggaaggtgtcctcataatctataccatatctctgtttgaacccctttgccacaagtctagccttatatcgatctagactgccatcggcctttcgtttgaccttatagacccacttacaatctattatattctgccctttcttagaaggaactcggtgccaggttttgtttttcataagagcctgatattcactatccattgcttctttccaatttttatcacctaaagcctcatgcaaagtttgtggttctccagaagatgtaaaacaactgtatctaactgtcccatcagtgtatattttctcttttctaataccactttgtaaccttgttttaggtcgcattacctcagatagctgtgcagactcagacggcgcagatgatcctggctgatgtgactgctgcgcaccacctgacgaagacgcgacagcacgggcaggcgatggaggagcagcagtaggcgatgcagcaggcgacgtggcgcgcgctggttggatgcccgagtgctgctgctccgactccccttgcgtcgcagatccggaggcctgccgctgcagctgcgcctagaccgacgctgaatctgaggcggattctcccgccaagtcgccatttgctccatgtacccggccaaatgcccccggtatatctgaattcacatttctgggagattctgcacatgaaatatcagtagcatttggcatagagatattaaacagatgatcatgatgttcctctcccccttgatcagatgttttctcattgattagagtaggaggaagcaaagaaatttcagctcgaagccgggcgccagcatttggatgaagattagcaaagggaaacacttgttcatcaaaggtgacatcacgagatacatataccctgccggtagaaacatctagacatttgaaccctttgtggatattgctaaagccaagaaacacacattgctttgaacgaaattgaagcttatgagtattgtaggggcgcaaatttggccaacatgcacagccaaatgttcttagagatttataatatggtgtttgcttaaacaaccgttcaaggggtgtatcaaattttatgaccttactaggaaggcgattaatgagataagtagcagctaaaaaggcttcatcccagaatttcaaaggcatggaggcatgagctaaaagagatagaccaacttctactatgtggcgatgtttgcgctctacagctccattttgttgatgtgtgtgagggcaagagacatgatgggagatccctatttcattaaagaaagtgtgcagcttaagatattcgcctccccaatcagtttgcatcgaaagaattttgcgatcaaattgcctttcaacaagtttctgaaattcatgaaacttctgaaactaacatagtatttctttgcacctacagactcagaggcaggcccccacacatcggaatgaataagttccaaaggattatttgacacactagttgatctaggaaaaggtaattgatgacactttgcttgttgacaagcatcacacacagactcattgacagaattactaagacaaggcaatttattttgactgagaattctaagaacaattggcttggagggatgaccaagacgcccatgccacctctcaaaagatggcgtcgcaacgaaggcctgtctcaaagacaatctggctggaagtgggtacaggcctcgtcgacagggaccttcaagaattgtcctcctcgtggccttgtccttaatcaaaaaatatttgccatgaatttcaagaaaagcataattatctgcaacaagtttatgaacagatactagatttttcgccgcttcaggaacatgtaaaacatttttaagatgcaaggggcgactaggagtaggaacaatagcatgaccaacatgtttaatactcataccttcgccacttgcagtgtgaatttgatctgttcccttgtatctctccttggttgtcaatttgtctagctgcccggtaatgtgatccgtcgccccagtgtcaacataccagttggtatcaacaccgtaggcgtatgttgcagcaccgccaagcttctcatcaggaacatatgagtcatcataacgatgccagcagtcgcttgcaacatgccctcgcttgtgacacacttggcacacggggcgagtatcattgcctcgcccgcgtccctgacttgcgccgctaggggcgccgcggccgcgaccgccacgaccgaagccgccgcgtctgccacctctgtttccagtgctgctgccgcgtccaccacgaccaccacctcggtttgccgcatttgccgaagtggtgagataagcttgccgaatccgaatcctgttttcataactcaagagctgtgaataaacatgagaaattgaaactggagcaatccttgccgtggccatcagtccttcaaccgcggcgtcgaattctgaatccagcccgttgatgatgtacgccaccagctcctcctcatccagcggcttccctgtagccgccatctcgtcggcgagggacctcatcttcgcaatatattcgctgatagacataggtcccttctgtgtggtggttaaggcgaggagtacattgattgtacccgccttcgacttgcacgagaacatgtcatcaatcatgttccatgcctgggccgccgtcctagcgccggccacttgttgcagcacctcccttgatagagaggagaagatgaatccgagcacttgctggtcctgaacaaaccatgtcttgtactcagggttggggatgacaatcttggtcttcttgtccttgtcgccgtcttctttttcaatttcagccgccggagctgcggtcgtgctgacgatgtgctcctccagctgcgcacctcgcaaggtggtgaggatctgtgcagcccagagaggatgattctgtttggttagcttctccgagatttggaggccaaacagagggttggagattgccgccgccatagaaaagctcgccatgtcactgggagaaagtttgcacgacagaactaatctaatctagcgggaggctctgataccatgtggagagaactccttcgcgaggagtttacgtgttaattacttgccacaaaaccgggcttaacagaatacaggtatatatagctcggatagagttgttgtgcatctactaaaacataggaaacttatcttatctatctaaacatcccaacaactcttatccttcgctattccgtcatctaacagggacttgacggcaacaagcgatgcggatgtgccaccgagcagcaattccgtcatcgagtgtaccatgttgagaaaaccactaggcatatatcctatgttaagcatgcttggatcaccgtaattaaccaaacaggatatagtaaacagcacgattgattactgtagcagattagtacaaacacataccccagaccaattaaccatttctggctaattaaccaacggcgagttgataataacttgatatatatacaaatacctccccacatatttgcatgggaattcacgcagctagctattgaactgacgtagcctgcacttcaaccatatatatctggcctctcctcggtgttgcagcacagggggctatatctatcttttctcgcgtcaacgcctcgcgaccgtgcacagatgatgcaaaaggacggtgcaattctcacaggtaatgaacagcttgcaaccccaagcagagtctctctctctctctctctctctctctctctctctctctctggttagctgtttcttcacccttaatccactgtcataacctttcccttttgctgctactagtacactaccttattgcaattaagctcacctagcttaaccagcttgtgtgtaaacagcaacttttacgttcctttaattattaagcttgctgttagagttgaaattcagcttcagatgtggatgggaggccatgcactggaatcgatcgtccgagcagaatcgacaataagctggcaagcctactcatgtgtatgtacggttgggatgggttggacgtacgatcgagccgtgcaatctatcgatcgcataatacaaccgtgcaggagacatgggcaataaatataaatagagtttggcttgctttccaatcatccctaactgctttaatttcctgtcaacgagacagacggcatgctcggtttggcgtcgacgagcacgcatatgtatcaatgtgttcatgcatccatctatgcattgacgtctcgacatgtagcggcacagtccgcgaaaaatggagcacaggagaaagagtgtgatgggagcatgtaggtcaacctacccaacggtgaccatttccaccaaattagtattagtagtatcatttatatacattttgtatatactgctaattaattaataccaacttgacactgaagacaaatgtgctcatatatatgcagaccatacagcaaataaaattcaccagttcaactagtagaatatgcatatatctctcccccaaccccacccacaccccccacaaagaaaaaaggaattaactttaggagctagtagtaactagcaatgcaattgcgaaaattaattccaaacaataaaaataatgagattttaaaaacagagcaataagagctagcaaatttacttttcaacatatcgccctggctatatatgtacataagtcaataatgcaaacataattgtatggagttgctgctaattagctcgaccttgaagtaggccatagccttatattgtataagcaacaaccaatgtggatgccaaaagagatcataggtttgtagctgggaagacatgcatggaaaagtcacgacgcatgctagaagcaattctgcaagcattgcatgcatgtgctgatgcagtgtttgagggacgccgaggtgatcgatcagacgacgctcagtagtagtacttgcacacatcaattaaatcccttcacctacccgataaaccctcccgtcataaaggttcacccaactgaaagcacattttggcagctttttctagcaaagcaaagttggtacgtgtaccaccggcatggcataatagcatcttattagcacccggttctcggaaagtaagatgtttggatacatgaacttaactttagtctctatatttaaacactaaattagagtattaaatatagactacttacaaaactaattacataaataaaacattggtggataaaccatttatactctcggttggtaaccgcctttagtcccggtttttcaaccggttggtgttaccaaccgagactaaagataccttatcttaggactaaagagagggtagcggcagtcccattaggtctctttcttttcattatttttcattattttttagctagagtttaatcctgtattttctcccaaatcaagtgggatacatatccccaaatcaaacctcaaatcaaaataacatcccaaaacattcacatcataaatcttaagttacttatacacacaaatcaaatacatcacaaatcttaaaaaaattacacacaaaccaaatacatcacagattatacatctcagatcatgcaacaaatcacaaaattatacatcttagtgaatcacaaattataaaaaacaaaaaagatgccgacagcggccgccgcctgccgccgctcgccactgggcccgtgcgcggcccagccggccgcctgctgcgtgggaagggaggagggggaggagagggccggggatgggaggggaaggggagggggaggaggagaggaggagagggagatcgatctgagaggatgagtgcgaggcggttgtggaggagaggacagggaagaaggattatatattaagcgttgaattttagtcccgattggtaataccaattgggactaaaatctttagatctttagtcccggttgataacaccaaccgggagtaaagttaggatctttaaagatcccgggtggcctgacaagacctgacaggtttagaaccgggactaaagatcaaatatgcccattgtagccaccaaccggggctaaccgggactattgtggatttcggccgaccgactaaagatggtttctccaccagtgaaagctaatttgcaagacaaattttttaagcctaattaatccataattagagaatgtgtattgtagcatcgcataggctaatcatggattaattaggctcaatagattcgtctcgtgaattagtccaagattatggataggttttattaatagtctacgtttaatatttataattagtatccaaacatctgatgtgatagggacttaaaagttttagtcccatttaaacagggtctaaggtaactaatcaaggccataacatgtagtgcaccgcttgttaatgaatctaatcatatatatatgtgtgtatagattcattaacatccatataaatatggacaatactagaaaatcttaccatatgaaacggagggagtaattggcatggtgaagttaataagccctaaatatatcctgttttacatgcttgtagttgttagctagatagcacatgtacacaagagttcctcacagtaaaaatgtgatgatataattagcaaaaaaatgctatatatggtgtatctacatgttaattaattagaagggaagaaaagaaacgggagaaaattaattgctccggcctacggcatggatcacctatacttgacgacacaacgcggtgcaatcgcttccggtgtatatatatgcatgcatatatatgtagccgatgggcacacacacaactgatcatcgagccggcctaaaggaaacaatgtaacgattcaatacgcggcaaccaccatgaaagctactgcaaagcattcccgtgtttaaaggcgaactgtttcttgttgtgtatatgagctagcgctatatattgcagcttggagtatcttgagaaggaagaaagcatcatgcagaatttcctctccgtaggcacacgtatctcgtaataatgtcaaaacattttagggggtgtttagattcaagatggtaaagttttggcgtgtcacatcggatattatatagggtgtcgtttgaggtgttcgggcactgataaaaaaactaattacataatccgtaagtaacccgcgagacaaatttatcaagcctaattaatctatcattagcaaatatttattgtatcaccatattgtcaaattatgaagcaattaggcttaaaagatttgtctcgcaaattagtcgtaatctgtataattagttatttttttagcctatatttaatacttcatgcaggtgttcgatgtgacatggtgtaaaattttagggtgagatctaaacaggcccttacactagctagctactccctccgtttcacaatgtatatgtctaaattcattaatatcaatatgaatatgggaaatgatagaatgacttacattgtgaaacggagggactagttattgcacagttgacatgccatattgccttgcgtatgacaaatacaattttaccatcaactcatcaagttactaggtactctctttgtcttaaaaagattcaataaaaaaatattatttctcctaatgcaacgaatctaaacaaaaggttattcaaatttgagtttttttttttaacggagtaagtatatatacacatgcatatattggcactcttaagccttgttcggttaatccctcccacaaagggattgggagggatttggaggggatttattccacacctattgtggtgtggaattattccccctcaatcccctccattccttctctcttggggattaaacgaacaaggccttaagctgtatagctagctgggaaaaaaatacttaccgttctgtgggaagacaagcattaactaggccgtgtttagattccaactttttttcttcaaacttccatcttttccgtcacatcaaatgtttggacacatgtatggagtatcaaatgtggacgaaaaaaaatcagttgcatagtccgactgtcaatcacgagacgaatctttagagcttaattacgccatgatttgacaatgtgatgctacagtaaacatttgctaatgacggattaattaggcttaatagattcgtatcgcggtttacagatagaatctataatttattttgttattagactacgttcaatactttaaatatgtattcatatacttaaaaaaatttgacacgtaaactaaacacagcactagacaaatttatataccagccgccggctagctggtagcttgttctaactgcgagacaaattaattccaacgggtggacctggaccaaagctagctagccgtagcacacacagctgcgtcatgcacatgtaccaccaagtactgtacggttaaattagcatggcaagttagcattggcccgggaaattaactcgtttgttttcttgcatgtgtttataggcatccatgcacacgcaagggacggtaggggtcgggagagagggccaacgcaagcacgtcacagtgtttatagtacagcagaatagcagacactgtcacagtgttcagtggtggcaacaagcaatgcatgcaagcatgcagacttgcagaggcagatagaggggtggccatggcgaaacgaggcaaaaacgaggaccagctaatagctaggactcccttcctattattgtacatattcatatacttctctctctataaaaaaaaagcctagtattagcatgtaacatacaacgaatctaaatataaagtatgttcaaattcgttatactaagatgtgttatgtcatagtacgaggttaaatttttttaggacagagagaatagatgttattgaatctatacatatatatatgtctatatttattatcatttatataaatgtgggcaatattaaaaaatcttataatataaaacggcggaagtagctagctcttctcgctcggctgcacctggttactacgctacgttgctggccatgtgacggcgtgggccggcgagggaagagggaagggaacaagttagctagatagccctactacgctagctgtaatatatattggagtaattgtcatcaggtccacacctttggaaaacaactgctttcccatccatccaaaccccgaaataatcattgaggctgcgtgcaaatgcaacggccagggcaaaaacacaaatatctccggtataaaaacgacgtcgatcgatcgtacatcgcagccatgcatgaattagtgatgcgtggtaatgtaattaaactgcatgtgaaattgttatcgaattgtgctagtggtggctagatatactaattgtccggtcgacaggagacgcccagagatctttcaactagctccaccaaaccgatttactccagttttaaagtctcatctcttatatatatttgatattagattcttttctaatatttgtatcttaattgtctggtcgataggggcggttcgatattaattcactcggtatggacaagggatatgtttgccagaactgcatgcggtacggtaactacgtactcatcaataattccattccgtaccgacgagtatatgcaacaagggcaatgcacaatgcactttatttgatgatcaatcctgtagtagggctgcag

SEQ ID NO: 60005 - DNA, 7699 bp, Oryza sativa
cctagtatatccaccatgcaagcaaagtgctccagctgtggttccaatttgtagtgggtagtcatcaaatgaaagtagcggcagccatcatcgaacagcccaacatggctgcatgccctaagaactgcaacaaaagtggcatggtttggcactacattctctttttgcatcctctcaaacatcctgagtgcttctactcctagcccatggagcgcatatccacatatcatagcgttccatgatacaaaatcccgtttctctaccttctcaaacactagcagtgaatctggcatatccccgcatttggcatacatatctacaagagtgctggatatatattcatcatccagcatttcttgcttgataatctgaccatggatttgtttaccaagctcaatggtggcaaggttcgcacaagtatcaagaacagtggcaaacgtgaaatgatctggctttagacccatatctagcatctcggagaagaacttctgggcttcttcactctctttattgagtgaaaacccagataaaatggcattccatgaaacaacttgttgcccgccaattctatcatgaagtttttgagcctcatcaattatgccacatttgcagtacatgtcaacaacagtgcttgctacaaaagcatctgaaccaagtcctgacttgataactttatcatgcaccatcaatccatactccaaagaccgcaaagctgcacaagctttaagaacactaccataagtgaaatcatctggtttcataccaaagcgcagcatctcattaaaatgaagtatagtatcatcgtaatgcccattttgctcaagagccgcaataattgcattccaagagactgaatctttttgcttcataccttggaagataaggtatgcttccatcaatgctttgcacttcccatacagatccagaactgcattgttgacacagatgtccacatcaaaacctgatttaattgctaaacagtgaacttgctgcccttggaagtaacccttagtctcagcacaagcactgaaaacccctgataagctgactacatcaaaacgaatgctagacctaatcataaactgaaagagtcccatggcctcaattcctagccctgctcgtacaagcccaaccatcatggcattggatgtctccaccgtatggttgggcaacccaaagaatgctcttctagcatcggtcaagctattagccttagcatacacgtccacaatggctgtcccaacaactcggtcagaactaaatttgttctttatggcgtgcgcatgcaactgtctaccagtgttcaggcatgacattgctgcgcatgatctgaaggcactggcataagacggttggctcaccccaagccccaacctctgcatctcaatgaacagttctagtccacgcacatactgctcattttgaacacatcctgcaatagctgcaccccacgaaacccagttcctctcaggcataccatagaagaagcaaagtgcatcatccaaactcctgcatttgccatacatgtccaccaaagcactcccagtccggacatcgatctctaaccctgtctttactgccaatgcatggacttgaacgccaagtgacagctcttccaaagcgctgcacgacttgagcagaacagcaaacgtcgtccggtcaggggaaacacctcggcgagccatctccacgaatagatcaacagactcctgaaacatgccgcgctggcagtaaccggagacgagcgcgttccacgacaccacgtcagggtccggcatcccgtcgaagagcgcgaccgcggtggagatgtcccccgcgtgcgagtacgcggtgagcatggtgttccaggagacggtgtcccggcggggcatcgcgtcgaacaccctccgtgcgcacgcggcgcccgcgcagcgcgcgtacatctggaggaggcagttggagacgaaggcagtggggacgaacccggacacgaccatccgcgcgtgagcggcgcggccggcggcgagcgcctcccgtcctgcctgggcgcagctctggaagacgcgggagaacgtgaccctggcgggagccacaggaggcggctgctgctgctctgctggcatccgggcatgctcggcgagagcgcgacgcggggggtggaggccatgcggtggcggcggcgtagggcgaggcgagcggtggaggagcggccaccttcactgccgctgccgcgctgcgcatttgcccatttgcgcggcggaggcggtggccgccgacgaggcgacgattcgacggggaatttggtggtcaaactacatgggctaattgggctctcatacgcgtgcttaggaataagttcatctcaggtcccttaacttgtcaacgaatccgatttcgtccttcaaccgcaaaacagatacaacgggtccctcaactatcaaaaccggtgcaaattagatccctcgacggtttcgatggtggttttggctgacgtggcgtctacatggctaattttgacttggtcttgatctgacgtggcaatgatgtggcgcttacgtggcaattgaatccagaaaataataaccccgtgggacccatatgtcagtttcacacacaataataataatagtaatggtgggacccatgtgggccccacatgtcagtctaactcaccccctcctcttctgcttcctctctctccttctcccctctcttcatctctctcttgccctgggtcattctgaggtggtgtttggatccatagacttaactttagtccatgtatttagacactaatttagagtattaaatatagactacttacaaaactaatcatataaatgaaagctaattcgcgagataattttttaagcctaattaatccataattagagaatgtttactgtagcatcacataggctaatcatggattaattagactcaatagattcgtctcgcgaattagtccaagattatggatgggttttattaatagtctacgtttaatatttataattagtgtccaaacatccgatgtgatagggacttaaaagttttagtcccatctaaacatggtctgattctcctcttccccatcttctctgtcttcatctctcttccctctcctctctctcttctctccagttgacgggcggcggggagagggcggtggccggcggggagaaggggcgcgacgcggcggctggcgggagggaaactagtggggagaagggaaccagcccggcggcagaggcagcgccgccgtggccgtggctgcggacgacgtcgatgccgacctctgcatcctcgaaggcggccgtccgcgtgggcggatgagggggccacctcgccggcgggagaggggagaggcggctggccgcgaagacgaccccagcgacgattacgaccgtgcagcgcgcggcggaggccgatcccgtgagcaggaagctcttcatccacggcctcggctggggcgccagagccgacgacctccgctccgcattctcccgcttcgacttcttcctcttccgctcctctcttccgtcggctcgcgctcggcaaatcccgcgcgtcgttgtcgtcctcctcctcctcagtccagccctcgtcgtccattctccggctcttctcccaacgacgtcgcagtggaggagggcacggtgctgtgcatgccaccgaggatgctgcacggcgcgtccaaggagtttcttagtttgtgttctgtttggtcttaattttgtttatgtgcctaatcatacaaaggtagaagcaatagcaactagtactagctgactggagtatattttgcttcgtcatcatcatttgcttgtggtacgacgggattgatgaatgaatgaatgatcattgttttgggcaagaaaacaccgttccggccggactgacgaggaacccatcgatccgctcgccgtggcccatggaaacccaacaggagatggcggcgctaccttccgccgacggcggctaacaacggtgggtgatgctcgagcacattgaagaactcgaggtcgacgatgaggactccaactacaacttctgctctgccgctgccgacgacaccgccaataccgtgagtccatgatgaccttgctcacctctgacggccacgtcgtcagcgtatacttccgcctcgaagcgcccccggcgacgtcacgcctatgcccccggcacgctgctccctcctctcccaccggtgggaaggagctaggcgagctccctggcctaccggcgagcgcgcacaagagagagatggccggcgaccactcttctccatttccgccgccgtcgtcgactcgtcgtcgccggccgcaagagagagatgaagagaggggagaaggagaaagaggaagcagaagaggagggggtgagttagactgacatggcgggcccacgttggtcccaccattattgttattttttttgtgaaactgacatgtgggtcccacggggtttattattttcccagatcaaattgctaagtaagcgctacatcaatgccacgtcagatcaagaccaagtcaaaaatagccacgtaggcgccacgtcagccaaaaccaccatcgaaaccgccagggaacctaatctgcatcagttttgatagttgagggacccgttgtatctggttttgcggttaaaggacgaaaattggattcgttgacgagttaagggaccttggatgaacttattccgcgtgcttataccgtttcgtttcttgaggcctcgaatggatgggcctcaatctcggcccacccacatatatggtcctaaagtagtaaagtgaccattcaaaagaaattttctgaaagtgatatgcagatgttttctttggggaaaaatatgttctttgacctccttagttgaatgcagcattttttttaatacttcataagatccatcaccaaatttgtgtcaggtgagacattgttaagtccaattggaatataactaagacttttcactgacagatcatgcatgtgattttctcccatgagcttgagtatctgaccaaacactcctacggcttaattagtctccaacatgctagcatcaccagtactaattaattgctaatgctccatggccggctaagtacaaataccaatcacactttcttccaaaggaaaagtacaagacttgatctgaaaacaatatttgtctgctccaggaagacacctacacggctacacgactacacctactgaagaagaacaggagcgagaaaaatcaccaatggctcatgcaagaagcacaggatctctgccggtggcaaatgttcaggcactcgcagagacctgcaacgatccagatcagcagatacctgagaggtacatcagagcagacgccaacgccgacgagggtcatcagcgggcgacggaatgcacggcccgcaattcctacccgtcgatctcagcaagttgctcgatccattgtcgtcagacgaggagactgaaaagctggggtctgcctgtcagcaatggggattctttcaggtatgcagatttcttggcagacagactgaatttgatcagacaagttttgaaacgtacgtacgtagtgagagatagcaaaagcgttgactcacgatatggatgaacatgaacatgaactggtgaactgcatgcagctgatcaaccatggcgtgtcagaggatgtgatccgcgacgcgaggaaagacatagccgagttcttcaggctgccaatggagaccaagaaggcgtactcgcagctgcccagtggcatcgagggatatggccaggcgttcgtggtgtcgcacgagcagaagctggactgggctgacatgttctacctcgttctccgccccggcgagtccaggaacatggccctctggcctgctcatcctccatccttcaggtgatcgatcgatcaagatcaaagtcaaactgcttatgataatcatcaaattaatcttctgcggttttgattgcgtgttgttgaaaaagagagagtaatcttggttcttggcgatcacttgcctgtgatcaggaattcgatagatcggtactcgtcggagacggcgagggtggcgagatgcctgttggagttcatggcgaaggacatgggcgtgaggccggggtcgctgctggagaggttccaggaccagccgcagggcatcaggatgaacgactacccgccgtgccgggaggccggcaaggtggtcggcctgtcgccgcacaccgacgccgcctgcctgacgctgctcctgcaggtgaacgacgtgccgggcctgcagatcaggagccccggcggcaggtggctcgccgtcggcgcccctccggacgacggcgcgttcatcgtcaacgtcggcgacatactcgaggttaccgactgaccaacaatggcgtcgaggcaaacatagccatcgccgaggatgatttcttggcttcatgtttgctttgctgctacgtgcgtctgcatgcagatcatcttcttagccggggtcatctgcattccttagccggggttgctgtttctggggatttcttaggagtgtagcgtggctctacgccttcccgctattagaagttgtgtttagcctccgtagttcttcctaagatttagtttcttattttatttttctttctttggcataagccggtctagttgattgtttttttaaaaaaaatcaagggcaagggttcctatttccattactagaaatgagcaaagttatatagttcaaatagtctagctgattgtgttatgtaacaaaaatttattttcttttaatatattgacatgcaatttttttacgcgtctcgcaaaaaatgcatgcagatcatgagcaacggcaagtaccggagcgtggagcacagggcggtggtgcggccggacagggagcgcgtgtcggcggcggtgttccaccagccgtgccaggacgcggtggtcgggcctctgccggagctggtcggggaaggcggcggcgataacgcgcggtacacgtcgatgggctacctggatttcatgaagcgttactactcggcaaagctcgacggaaggaatcacctcgacggcttgaggattaaactgtcatcttcgaagggttagaattcattcatgttacaactgttgtaaacttgtaattggaaccggatttgatcaaacaatttgaaatactttcagcactagcaaatgtatccgtgcgttacaataggttgtacgaacataccttgtcttttttagactggtcaccggggggtgagcttaccttagcttgtacatcttcaaagaatcattgtaaacacaaggaataaaaagcctacgctgttcaacatagcataaatagaatataccctaagcaaaaattgcaccaaaaaaaacaatgcacaggctcggtaatttctctacacctcaaattttcttacggtgacctgagtagttacaatgacctagtggttatagtgacctgagtagtactacaaggtcctgagttcaaatctccatacaagtgaattttatattgggttgtttgcggggctaagttccctatttcaatgattatatatatatatatatacatccagttgaatgtaaaggccgggtaaaatatacccttctctaaaaaaaaattcttacggtcatcgagtgtgttccatttcatagacatgtgtattagcaacataatcatgtctcaatccacattgatgcttcctcgcactcttcatttaatccaactattcaccga

SEQ ID NO: 60006 - DNA, 37462 bp, Oryza sativa
agtttccaagtttccactacatatgtagtttgcactacatattttcccgatgaggtaagagaccccattttgccttgtacgtctcgtgtccttgtactagggttttaaatctcggctatagttgccactatatatcttcagctattgttgtttgagaaggatataagctatttgctctcatgtataatttagctgctatagctcctttcagcatgctatagctgctgctatagctgtttgaaaaggccaaccactaaatactttatcccgctatttaaggcgctgtcttgtacctacatgagttcatcctcgatgaagagcaaaattcgctactcgctactcatgtagtaggcaaggcattttgcaagaatgaaaggcggaagcatatagcggtcaaacacgtgtcatctagatctacatcacgagtttactttggcaccctcaataccaaatgcacccctttgtttcttatgtaactagagggagtatcatagttggggacacttcaatttatgcaccttttgtttctgtgtaaacttatttgtaattaatcctgcttaaaactcaatgagatgaaatcacttcactattggagaaatatttttacccatggttcgcaaccccctgtagtcccgattatacaaccggaactaagaatccgggactaaagatctttagtcccgggtgaaataaccaggactaaaaatccatctttagtcttggttggtgttaccaactggaactaaagatggtagcgtcagtgtcggttgatcactattttttttcttttttttttcattgtacctttgctcactacaaatctagaacaagcttgttgtaaagaagaaaacgatgtaattcctgcacgtgccaaatctacaaactacgggtattaatacaatatatataatgccattcccaatagataatggcaagcgacagagccgcatgctggcaaagcccggatgactagtgaccgaccacatttttcttttaagatatgaatgacaattgacgatgaagaagcaatggtggagtttcggcgaccgtatgacaagtccaggagttgactatggtgtttgaaattcatgtagataaatatgaatatgaagattaagtgttttatacaaaatcaggtggtattaacgtataattaattgagtttcaattattacaaatttgaaaaatatacttatatgatattttagagcaacttccatatagaaagttttcatatgaaacgcacagtttgaaaagcgtaacacgaatatctaaattttcatctaacttttttttagagaaaagaacgggaaccagttcaaattgtctcaattcattgaccaaatatatttatggtgtacactgcacacgaactaatattgcatatatacatatatgtaaggtgttaacttcaaatttattttattttaacaattggaaaaaattgtgacaactttaagagcatatatttgttagaattttatcttgtttgtaacggctaaaatataatgattttcaagataaaactttgtagtatataggtgtaatattattaaaagtactatacaatttttttatagattctttttaaaatctattagttgatgcgtatgaaatttatactgtaagtttgttggcatggaataagttgccaaaaatatacatactctacttaaaatcgagtgatgcaatataaatttaggtgggcatataagtaggtataatagatctatgtaaacgctaccgagcacatgcagctttgaaattacaaacatataacggcatgtttggttcgggggagttttttataagggattgggagtttagaaagatgatattataactgttttatttagttgagagatataggacttttggtggaatatggatggggaattgtggaagaaactccctccttttcaatacccaggtaggggtggtaattgggaggaaatgcctcctttactttgcctaaacaaatctcaaccatccgtttttattaatgacctaatctccaactaaactccctaccaatttacaccacctctaccaaacaagaaattgggattaaaaatcaaattcccatattaatatcaccatcaattccctcatataaactcgcaatccccttccctcgacttaaacatacaaaaccctcatttaactatatggcaagatgctttgcctcctaaatttaaatatatagacatgatgcttgcctgcatgtctaacaaactagggttaattagatccatgccattgcaaatttgctggtttaaaaaaataccactacttttcgtgattttgggtgtatgccactgaaactttataaaatttgaaccgtgccactccgtcaccatttctgttagtacctttcgtcatctctaacaggaaacgagcactggccgatgccgccgccgagcatgagacggcgatgacgaggaggtcgtcggcgagggccaggtggtctaagggtttggcaacgatgaggtgcagctcggtggtggcggtgacgagctcagcacaagattggggtgccacgagcaggcatcggtgatgtcgaggatggtaacccggcgagctcgggcatcgagatccagcaccggtcgtcggtgccggtggagaagctaatgccgttgctgagcacgactccctctcgcagctccaccctctgcgtcacctcctccctcccttccctttcttttcttttgccggctgccgcgggcgtcaagatccagcgccggtagtcggtgccgacggagaagctgatgccgccgccgagcacgactccctcccgcagctgcccgcgacggcagcggcggcagtggcggcaacgcctgcgctcccctccaactccaccggtgacgtgatgtcagactcgtcggatttggtggctgcggtcgccgctcccttccagttccacctccctccaccaggtgctaagcttgctaccatcgccggatttacatcgccgccgcgtgcctcctctgcctcgctcgccgaagttgggcgcggggaccagcgttggtgtgggcaggaggagaagcccacgagttgccgcccctgtacctcaagcccacaagctgccatcgacaagaccgcccacgagccaccatcgacaagccccctccacaccgctgtccatgagcccgagaaccgccggagatttgtcgcttactactgtacgtgccggagctggagaagaaatggaggcaccgatggaaatgtaccatcgcatgctcagacggaaatcttgacgggagtggtacggttcaaattttgcaaaatttcagtgacatgcacccaatatcatgaatagtgatggcattttttcaaaccagcaaatttgcaatggaaattggaatggatgcatttaacctaacaaactaacaacaggccattcagttgagtacttgcatttctggaattacatggcgacgaataaaataccgcaacttgctgtcttgccatcaaacctcattttcttcttctccatcgggctgtcctctgccctagctaatcctaacgtcaattcagatgttggcttttattttgggaattggaattgcatatagacggtttgatttctttacagttcaaatctaattcatccggtaggataaccaaaatcataatttgtgctaagtgctaacagtcttcatttgttttccatagcagcagtggtggatcagcttcaccttcacagggagagaaaaaacaacactactcaatttttaatgggagtagcaatataaaaatatttatagcgccatattttttacaaaaaatagtcagcatgtatttacaatataagtccataaattacatatgtaaatttagtgtatttataatgtaagtttcaaaattatatatgtaagtcttaaaattacatattaattacatatgtaagtggcgtgtaagtagaatgtaagtagatgtaactacagtataaatttgtataaagaatagcatgcatgcgtggaaaaccatcgaaagcttgaactaatgaagatgttaagttttaattaatcacagtcgcaacgtcagttgccacggcaataacacagatcttatagcaacatcaaccgttaaaaaatctgactgtaaaacaaacaaatttgtggcgacacaaatacaacctttccgtttttgatactagtgtatattaatctcttggacactagttaagcaaacagtacatttgtttcgttaggtacttcgggcatcagatcaatcggattgattgttcacttgaatatgttggttacaacttacaaatagaatttgatacgcaaaatctaattgatgctatgttatcaatttgacaacatggcatgcttagatttggaattccagagctgcatatggtcggtgagctttcgtttcctgtgttccccagtccggtcctgtatataaaggccacctggccacccccgaaaagaaaagaaaaaaaaagagaagaaaaccaagaaaggcgagagatacgcggagagcagccaactcctcgccttcgccttcggcttcggctcggcgccgcccctcccctctcggttagctgctgctcctgcacctgctgctgctgctactgccaatctgccattctcccccattcgacctctcccccgtttcctccgatcgactcgcttgcgcgcgggggaggtgtgatcgatcggttctctctcaccgcattgtgatcgatcgtctaggtcgtacgggcgctcgatctgcttcgaatcctccatttggttcgtagtttttattccccttgatggcccggacgacgcatggtttggaatttttctgctctaggctgggtttagtgtgggggtttggggtttttgttttttggttggggggatagcgtgttcgttaggtatttgcgctgctctgctcgttcggtcggtaaacgatttcaacggggtgatgcttcggtgtgttagttcacgaagttgaagcgttcgggttgtcggttctactaaattaatttattttcgcaatgaggctgaacaaacgcttcagtttctttaaataatgttatgttttgttcggatggggattttcttgttggaatactttagtttataatccttatgttggaaataaagaacctgcataatcaatatctgaagttaccacgttgctgaaatgtagcacctatcaagtggatttactactgtctactgtactagatatgtacccttttttttctaaaaaaaaaatctcgttgctaccaatgtcttgtgaaattgataaattgattacagtttagtggttcttaagaaatagggattgatttatcaattgtcattcctctaatttgatttaatgttgatttctgcagctatgatgagctcttcttcgtcctggtctaccccaagctttgggttagccagggaatcctcttcattgttgtttacacctggccttgtgcaacacatgggtcctaatccatcgtcatcttggtccacccctgctcatccagtctctgatagtcccacgttttctttccccacgccatttttctgtaagcaaccttttctttcatctttctgttctccctttctttttgtgctctttcatacctgccaactttataaaaaattaacaacatgataggtgcaagttcttacctacaaacagctcattttcctgtttatgcgtgtttgtgcttgtgaattcctgttcttctctatagtacaaatttctattatgtgttctaatgcttcaagatatcatcaagtagtttttttggtttggttatagtatctgtgttgcacatcaatctataagtccaattaatgtaggaaagcctcgtaatcactacagttttgagcttcttggtacatattttttttagtttgtctggtcacatactatatttttattaatcagaacgaattgatgcttcatatttctaatgtagtcgtccaatagtttttgttgatgaatgtcctgtggtaatacatcttgaatgctcaaaaactggctggttttttctaattgggccaggctcaaaaacatcttgatgcaaacaatttgctgaaccccagaataaaccaccgcagtattatattgtattaggcacctattgtcttcccaaacatccatagtgaatgttcaaaattgtagttaactgttatcttactcaccttggagaacctctgagctagtagtactgatgccaatggtggatgatgccaccctgattaccaatatttgatatgcagtggttgctcctgtttagagtaccttatgtatgtctatctttgatgtttatccttggtcgcacagacccttgtttagcttgggttgaaagtgctaatacactggaaggatttcacctactttatgtctctgagcatttgtttttaagattgtgaggaagatgcacatgcacatacctgtctgagtgtcccccttagcacatacttgaacttatggaggttagggatgaatctgtctacctcacaaaaaatgtattgaagcgcgcaagtgtgcacatgaatgcattcactaggatttgaaccatggtaggtgagtcatacaccttctccacctctgtgattggttaattgattgtaaggcaattttgatactaatctattttttcatggtggcatggcttaaaatttgacatgttccatttttttcactttgtaattttcttctcccatttcacttcatctagttcacttcatttttttgtatttttccatcgtaattatataggtgagcctgcgaaaggcagcagggtctatgcttataccaagactgctgatgatcttcctcataagcatacactatcaatttctgcaatgccagcatacataagcaaatcccatgaggagcttcgacatgaagattatcagagaggagacaaaggtataagtgtttgaagcatttttctgaactttagacttgtctatgaaatttgatgagttagaatttggataatgcgatctttaaagaaagcagtgacatgtcactacattttggagtaaactctttctttgttcctagaatttgattgcatcccttgtttgcgcttgcatcctttattattagcctaatgttacaccaaaagacaaattacatagctatttcaattgttatctagagcatctttacaacttactatctgagttcacgcgtccaattctctctagttatttaatctgaagcatctttacaacttattagcaagaatagttaactatttgatatttttttctctagtatttgcatgtagcaaattaaacagctaatgtgagcaataagcctatagttctaataatttatgcttagagttagtattaatggatcatttcctgtgatgatttatgtttaatattttgttggcacatttgctatatgtttgttccttttctatgtattaatctaattttatttgttaactctctaggcggtgatggcctgcagaaaattatggttaattcagctcctgtacctcccatgcccatgttatcatctgttggagctccagttaatatgatcaattcaagtcaacctgctttcagtttgaagtccaaaacaaatttcagtactccattttcaccagcagcaactgctgatcaacaatctgcacagctacagttctcaacacaaaatcactattatacttccaacccattttggcctgccccaataggattggtgcgaccatgttcatcaacaggactgcaatcttccacgccaggtctaaactgtaccggcatcacatcatttccattcctgcccacaaagcaaccgtctgtgggaacccaatcatcaactttatttcctaccacttttgtgcatccatccgtggagttgcaaaagaatgcctccacccactgtgctagctcacagactgctccttgtacgacacacggaggaattctattcggcacggctgcaaatacagtctcattaactacatcatctactgtaagttccttaaatcatggcttgtttgtgaacaaaacaaattggctctaatcattgatatttgtgttggttgacaggagccaaccacatcatcccttggtccaacctcatgccctgctactcgacatggagatgcaccttctactggatttgcatgtcaggaaaatgtattcagcaactcagcggcatatacatctactgtaagtgttgctgttgactgtagtatttatttgcggtgcagtacaagaggaactactatgcatgattattttccgttatctttgtttctcagaggaggcataaatcaaaacttcttcccacctttcaaatccatcgctcgtttttccagactctgctttatatgagaaagataatcttctttgcagataaatgcggatgttcccacgaataccatagatttgctacttccaaataacatccggctggtaaggcttagattttcttcaacaaatgatggtaatggaagtgttgcttcagaggtacggaactgaatctccatagtaaagagttgctctgcacattattatgcatgagtctttcataaaatgatctcttggcccctgtggcttctaaaatcatgttggaagctttgatgctttacatccttggtctcattactatttagaatgaaatgactttgacctttatgtctattcattctgatggtcatataataacataaccatgtccctttttgtaggttcattgtcatcatgatgctaaaacttcagaaacacccatttctttgtgcatatatcctggagagaaccaagagctgattatcaaatcaatggtgcagcctgctaagagtcacactgggaaacaatctagtccaactggtggtcatccagatgatcaaagtggtaattagtgtttgcatttcattccttctgatatatgtttcagacaaacagtttctctactctgactcatatgtacagtatgaatacatcatttatttattttattactccctccatcccataatataaggcatagtcaaacttggcacggtcttcaaacctaatctttgacttatattttctcatatactataagatttattgcaacaaaattataaccatcttaaagtaaatttaaatgtcaatccaaagatattaattttaggaaataaaatttaatttatagtattataataattgttggtcaagtatttttaaagttgaatcttggactgcgtgcatgtcttatattatgggatagaggaagtagcaattaaggagcaaaaatatgatcactgaagtgtggtgtaatttaatgttagggatatctgttgtgagtagtgaaaaatacattatcatttctaaagatttatctaaagatattcctataaatgtaaaggtatctcagaactgaacacttatcatacaagttcgatttttggttacttcaggtcgcagcaaagtatgcaacagtgctgctggtctgccatcgtcaggacctggtgagaatcagaaggggaatagcagtgctggtcacaagacaccaaagtctccactggctgctcctcgttgcgaagcgatagcggagtctgtactgcctcgcctgtacagcgccgattactacaccgtgccatctattgtggagctcgccgtgggagagagggacgagccaggctattgctcacatgtgaagggcttcacggtcggcaggcatggctatggcagcgtaaagtttgatggagaaactgattggagaaggcttgatattggatccatcgtggagttcaatgagcgtgagattattgtgtacagagatgtgagcaatacgccgcctgttgggcaggaactcaacaagcctgctgaagtcactcttctgaatgtcaagtgcgtcgaacagaagaatgggttgcagttcacagaggggccggcagttgataggtacaaggagattttggtgcagtggacaaaggaccatggcgcagaatttgtgtcatttgacgcggccaagggagaatggaagttcagggttaagaatttcaatatgtagagtcctctgagaatctataattctcctatcagtaggctcctgtgtctggtagaagtaacaacatagtaatcctgtaaaaaatgtgttctttttgtagttcggtcacttggtacggatagctggatacttctggacgaaataactttagctataaaaactgcctttgttgcgtaattttcaattttgcgcggttgtaatgattttgttagcgtttctgtcagcctggattgagttttagcatcaactctaaaatggtaaaggcagtattattttcttaaaaacaattacgtgtaggagtaacaatatatttatcctatgatctctactcctggaaatagatatgtagtcagtggttacaatgatttgagtaacatctcaagatcttgagtaaatctccatagtttaaattttaaaacttaattttagaattgtttcattttaattctatttttatattgatctttgaaccgttcataacacacatataaaagtattattcattaagttcttttagttgtttcattccttttttttccttttttttatcctataataaacaattatgttctaccaatattattctgaaacattcttttataacattcccactttgctactaacagtattagacaatatcttaggaacaaagtagccaaagtagaatggaggggggtagtttgcacgtctgtcattcagatagggagaggctgtgggcatgtggatgtggcctcaactcgtgcaaggatttaatactctgatgaaatttacattgcttatattttccatgtcctcaatatgtgggtacagaatatatgcaagattttagcagtgaagttgatctgaaatgctaatgtttaaacatataattgggttgcaccattttttttaacaatacaagtgacaatgtcaaggttgttaagcacagtaggataggatttgttatgatttgcaagatgtcaagttaccttgacaagtgagagcgcatagtttcttcctacgtaacacacgaacatttcgctagcaaataaataaacgctacatctcaatacatgttctaataaaatcatacatacagtgtattatgctcagcatggtatgaagtgttcgctaattgttaaaaatcaagtttctggctagagtatatcctatattcagcaccaatattatatcctcacaagggaaaacaaaagggttatttgacagcgatgaacaaagatagcgttcataggaaacacggtgatgctccatatgacaagtcacaggaattttctttttcagtttgttttttttcgtcaaagggttcccttatgggcaatatcttgatgttaagtgcaactctgcagtgaaaagaagtcctcggcatagcaccacttggaaggataaaaaacgtacacacacaattaacttacccgttctaatcatctagaaagagaggataaacttttggttttttatggcacgcttttcaaaatgctaaatggtgtgtttcgtgcgaaaattttctatatgaaagctgttctaaaatattagattaatccattttttaagtttgtaataattaaaactcaattaattacatgttattataacctcgttttgcgtaaaacacttaatctcatcttcaggagattcaaacaaaacgtagagtgtcaattgacttggggcgtatttactttcttaatattttcaactgtaccaaaaatttattttgaaatattttgacgttgtgttgaatgtgtttgctttgaggcttgccaaattttgatgttgtttttacgagagaaaacatcccgaattactaattcttttagggtggtaatgggaggctatgtttagtttgttagccctgaaagagaaacactaagagtaggtacaatagcaggttataagctagctataaacatattttaaagagataaagaaagagatggaagagcagcgggctacagatctgtagccagctatagcacggactacaagacgtaatgtgtgtatgacaggtgggaccaggtattaatagtatagtaagcaactagagtatgaattagttattacattggctatagatgatttggagctagtagtgggctatactattaaacttgctctaatgtcgtggtggtggagtcgtgggtgtataactttacccactagggttcaaatcctggtgtgcacgaatattatgcataggtaggtggactttcaacatgattttagtgaggttagagatatgtcgctggttttcgtctattagagcataggttaagagatacattcacggggtgtgagagtggtgttacgtctgtagtgaaaatggcaataaatcaaacatgccaattattggttataaatatgacttcttaattatgaaggcatattattttactaaacaaaaggatcgaagcttaaaatcagtttaagagacatcagtcaaacatggcacaaagagctataagatggaaaccaaactccaatagttcttaagtttctttttttttttaaaaaaaatctcatacattgattagtactctacaaatgtcatcacacctgttggtttcctggttccatagtgttgtattttggcttccaccacaagcgcaatttactcattgttttccatttctatatcttccactggcggcttattctcctccgctgcatcaacaaccaaaggtgagtccggctcatcatcctctgaacgaacaattactattaggcacaatgacctctaccggtgcaataacctcttccggtgctttgcattgaccactattgcaaacattatcctcttgcacgtcctctataggagtttgttctacctccgtgtgacttgtctcgatgattccaaaaatatatgttttcttctgcaccaatattttcagactataccctttctcccttattctagccacaaactttctccaactctcaataaatgcaagctccattactctccattgtcatccatattcaccccttactggccacacaacctttatgatatttttttcaaacactggatcttccccagacatattatacaaccaccctaacacgtcgttcaaaaccaactgctccggcgcattcaggctagtatcaacaaagatcgaaaccaccccgctatcacaaagttgtacatgaacatcgctataatatacacgaacggccacatcacctgacatcctaagaaaacatgacagattatcttactacattactacccaataacatcacctgtggtacatttttactctaatgcaaaataactaaattcgtcactactaaaaataacttcatgttgatttctactaatctacatttatttttacttagtggacactactttcaaataacttcatgttaatgtgtactagtactccatgtttatttctacttagtgctcactacttgcaaattaatacattgctactcacctaaaaatatatgtactaacctagtactaacttcaacatactactaatttaatatatgtactaacattcaacaatgattaacaaatcattagtgtcgtacttagggattataaatttatacctccagcgttgctgctctcttctgcatagtcatgggcatcgcatccccttccagccgcgcagatctctcccgcgacgatggcagcccgatgagacacttggtggtcctcgccccctcaactccaaaaatgacccttgtcgaagggtggagagggggatttaaagccgccagtcgaacacccattgtttgataggggcagtcgcagggacctgttgacagccacagttcaatattgtgcgctgggacctgttgacattgcacactgtcagatgtgggcccagtcgaacactcgtagttcgacaggtccagtccaactccttttgttcgattgcttccacctgttgaagactcgccgtttgataggcacctgtcgaatttcggcagttcgacatggccctattttgacaattatttttgggtggccatcatttttactattttccattaaatgaatattatttctgaaaacaattccacataaataataagctatagagtttgtgattttgctatagcttataacaggaagccggagtaacgagataagatccagggggactgggaaagtgcgcaaccaaaacatccaagaaaccaatcaaatctcgctggaagaaagcataaatactagacaaaaaaattccatttggacgaacatatatattccaagaagttggtggagactgactttttcttgggtagaatatttatacatgttgttgcttttactgaaatatgctgtaaaggggatactgaatagcactacagctagctaggtagctcaacactagtccagagaacataatcattatatcaaacaactcttgcgccatatgttcatgtttgattgaggagaaccatatgattgtgttaataaacaatttttttggcaagtacgtacggatgcaactccttgagtactcacaatcaaaatattatcagtatattttaaagtaaaacgaaggattagtggattaattgacaagagatgagaagtgccgattaatgaaggaaagctccccaatgtttctctctttcgggttgtttgaatataatcctgtttcgtttcttccatagattttttttttcggcgaagacatatttatttcttccatatgcttgacatgacatatatatggaccggaaccacggtcagattcatttctcgactcttgaatgatctgtcgtgccctacgttgagccaggatttgtggtgcactacatgcacacgtgggtacatttggtggtaaaagcacatagggattagctatgtatttatcgttaattttttaagatttttaaaagttacaaataaattataaattataagttaacgatataatttatatgtaacttttaaaaatcttgtgataacatattatttccgtgaaacagatgtgtcataacggaatcctatatgcacgctatgatttttaaagtaaactaggaatgcgtcatacgccaagtttgaggtatttataaaagcgagatattaaccggagaacatctgccacgatttctccataaattctttttgtcagtattaattaattgtttaataatattttaacctattagcttcatattatatcatacataagtaatatctataagcaatcatttataatcttcttcatcatttgaaaagaaggcagatgtattttcttaagaaaacatgtcaacgaaagtaaagtaagtataaaatagaagcaatgtgtttttttaattgtataatatattatcataatatgttaaaagataaattgagtgggacatgaagctccacgaaatacatgggtttatatagcctaatattattgatatattttgagaggcgatatatctatgaacatttcatgtagagtggatgagggactccacgcaacctagtaggaatacgataacgacgaagtatcattgcacagtaatattttttaaaatgtcatgtaccataaataaacacttttttatatataagatagatctaacagatagaaatactggttctaccggtttaagaggcataggagtattttaaaaatgtagcttaaaaattatggttgtttttatatccaacataataaagtgagcgtagttcaactggttagatttcttgttgtgaaacttgcccacccatgttattaatcaaaaggtttaaactctattatgattttttcttaaaaatgcatggataagtgaacaatagctatagttcgtaaaatatatatgactaaaagtaatgaatttctttaataatatagttaatttggatcttcaattttaaattttatagtaaataatctaatagtgtgcacaaataaaaattatctatatgatttagataatataattgtttaaaatttgttatcataaaatattttttccatataactaaaagaggaaaacaggagagaagaaatatgtggggaggtaagtacacacatgcatactggactggacaggcggagaggatataggggccctttttttatcattttgtatttggataaatcataaaatattttttccatctaactaaaaaggaaaatagaagagaaaggaaatatatgggagaggcacataggcatgtacgcaagcatacgtactggatgggaggggtgggatatgtgggcccttctttttatccctttctatttggataaataaatctaatggtagaaaataatgggtccatagtatattagtaaaaatcgacggctaggtgattaaatgtcacgtggcagtataagagcgattgtaggagtgctatgtggcggcgatggtcggatttctcttatttattagagtgccacttggtgacttgagagcatttacaaggtgccacttggtggattgggagcgtttgtaggaagtttaatgggctcttagtatataatagataataaataaattagaaaggtagcccgcgcacatgcgcggacaccttcttatataatgtgagtgaaattttattatgaatatttatgtgtgggtggatttttattaaaatattttttattatattctaaactaaaatgaaactcattttgtgtgctttgaacgctggttattttttttataactaaccatgcaacatataaattctaaaataaaattatttgagataatgcggttttgaattggtgagaaaatattgcgttgaaacaatgcatgtggtttctatgagaaaattttgggtattttaactcgctagaaggatatcttacaacccaaaagaaatcaaataataacatttttttattggattgtattttaaaatttttctattaagtatgggttttaaatccagcaacgtttgtccaattttcaatttatttcatgtccatttttattttttttcttttggagattttcattctattaatcatccttgaaatgatttgatctttacaatttgggacgaaaatacaagtgcatataacctggtatggggtaaaggcatactttctaaattttctctcataaaatattaaagtaatggtcatagtgtttttagtgaatatcactaaagtggattgtcttgtaacaaatacacatttttagattgttctaagtcaagactttacaatggactgtagcaagttttacaaaaaataaaaaaatggacatggtctttaatttctatatggaattgaattgatttattgctaaggccactgcacccatatgcttatcggtatgatgttcaaccaaccacacctttattttcaacatattgtctatattgctatatgaatatttgttatgattagtgacttcatagatgatatgtgtaattcggacgctatgatcatctttcttaataatatttattgttctcctaaaagatcatcttaaaagtatcaaggtcaatttctataggtacgtagccctcatatgcatgttaagagaaatcaattaagttgataaagagtcgttagatgcctaatgggatataagtaatagatagaggtccatttgtgttttttgtttgcccatataaataactttaattttaattgtcaaggagataaaaaaaatagagagaaaagaatggtgcatgctgtacacgggcgggagggcgggaggtttgggatatttttataaatgattaatctaacaacctaaaataatgtgttagatttgctaaaaaaataatgtgtcagatgtttatgtcgaaaccgatggtcgaatgttttgttttctggtcagaaattttacaattttatctgatttaagagaatgatgtaacatcttaagagtgtttataacatgtgtgaccgtctattaacaccacatgccgcaaagaaggatggagggatggatgtttggggtgttcttcttttaaacaatagatctaataacctaaaataacgtgtccatctttttttatgtcaaatccgatggttggattattttttttttgcaaaaattctaagatttttctctaatttaagaatgtcatatagcagcttagaagcatttataagatgcttaatggattttaatgctgcaaggagatggggatggagggagagaggttttttcgtattagaaaactaacaaatcaatagccgaatgctttgttcttttttaagattttctagtattttctttaatttaattgcaccacctagcagcctagaagcattcgtaggatgtttagagtgacagagtgagagttgctagatctagcaggtggaggtctatttgtggttttttaatgtaaaaataattttgattttaatttctcatgaagatagctcgttggtgcgtacgtgacggggaagttccggatgcatgtatttaagaaaaagatctaaccttctaaaataaaataatggatccaccgatttaaatgaaaatcgatggtcggagccactcgacgacctaggagcgtttgtaaggtgtcgcttggtggattaggagtatttataggatgtttaatggagttttagtatataatattatttttctgaaatttctaagattttttttgatttaataatgtcatatagtagctagattagaggtgtttataaaatgtttaacggattttaacactacacgggggtggagagggatggagagaggtctaggattttttattaaaaaatctaacgacctaaatccatcaatttaagtagaaatcgatgatcgggtgcttagaattttttaatattttctagtactttttctaatttaatagcaccatgtaatgatttaaaagcttttgtaagatctttaatgtgacggagggagagctgctagacttagtagttggtctattttgtgatttttgactgtaaaagtaattttgattttagtttctcattaaatagaaaataaaaggaaggaactgaaagggaaactcacgtacgtacgttcggcaatatgatgccaaaaatattaggtatgttggttccagaggttttttttttttggcaaaatagttctaaccatccaaaataatgggtccaccaatttaaatgaaaatagattgtcggatttctcttatttattagagtgtcacttggcgacttgagagcgtttatagggtgccacttggcggtttgggagcgtttgtagaaagtttaatggacttttagtatataatagatagatagatagatataacgattcaaaaactatgtaaaagttacgtgcaaatttacctgtaattacattacaattatactatatttacatccgagaaactttttttaaaaaaataacgataaatatatagcaaaatcgaagcggtatccatgagacacgagggctatatatgcccctaatatcttagagtgcgctagaacgtatcaaccaaaattttttatgatttaaccatttgaaaaacttgttttaaatagaaactgcacaaaaactcgattgaaaatacatagcaagctctcagaccgattagcggacatgtgtgtgggtgagatgtgacgcatgactctctcttcatgtttttttaataaagataatggaaagttacatgtctccttcctcccttgcgtcgcatgagtaaccattgcatgattagcagtagtagcgtggagagagagagagatttaccaggtcattcatctctatttggatcggcacagctactacttcggttgattcaagggggaaacaataacttggattagtttctgaacctttttggcttttactgcatgtggctctgtcatgcaggtattcatgccataagttaatcctaatttaaaaaggcactagtgtcaatcattgtccgtataccgatattaaaactctaatctgattttaataataatacatgctccttctctttcaagcttttctggtgtgagcggatgcttttccataatttatccgcagtgtacttgtctgatcttgcatatctgtgcctcccagggtactaattgaattagagtataaatcagtgcttttcggtgattaatatttgtaatgccatagctccccaccatatcgttcatttgttccaacatcaaatttcttccttttctccactcagcaacactggagtgaaagaaaaaacatgcacgtcatgtcaagcaagtactacacacggctctcgctctagtatttctgcaggcattctttctctcttttctttttaatctttaatgacttaatatttcaattcgccaaacgataattgcatttctagtagtatttaaatattatcttatgaagagtgtacttttgaatactatattttttaagtactatagtacttgctctcatttattttttttctccttttatcccaaacaccctcctattcccaacagttccacctttaacgaggaccatgtaaatatttttttttcttccatgataattgtttttaaattctagaattgcacttattataggatagagtgtatcatggtatgttgcgagctctcctttttagtatctacactggctaatttagcttcctactttgtggctgtttttttaaggtagcatattctaaataaattattcatggataaaatctgatagattatctacttgattgtagggaaaaaactatatgatatgttataatcctaatatatagcttaaattaagtgatctaagtagaatcgtcgaataaataatccgtggtatagtccgatgtataaacataaaagaacaggactcttgaatgaatgagcgaagtgtagatattgtacattggtcttgatattcttacccaagttatatcttggatcaccgactcgacgaacaattttttcacttaagaccagtttttacaacaaatatttttagtttagactgatggttcacatgtcattcagtttagaccgatggttcacatgttagtgagattaggggataaatcggagagcagttaggagaatgctggcaagctgctgcttcttcttctaggcttctatgctggtctatatactcgagcggtttctttctcccactgtttgtcatatcccccaattttatatatgccaatcgactatcagatcaggatatttgtatccctaacgttgttagatagaacttgatgtcaccggcagtggtggacccaggtcctaggccatagcaaagggcctaggacctaggcatgagaaatgctccggtgcaatctacttgaagtattctactccgagtagaattaatctggaccgtttattttatagggtagattagtaatctcctaatatagtttaggggtaatttgcataggatgttttcttcgcttcttcgcatcaggtccgacgcatcgcatctcgccccaacgtaggcaccgatctctccccgatgtagtcgcttcctcccggcaggcagcggcgcgacaaaaatcgctggcggctcggccggcggcgctgccagcagctcggcgtggcgaaatcctcagtttgcagacgtgtttgatttggtaattgaggaatatagtcttaggaaagcatactagtaggctgcctgatttctctgttcagacagatgcttatatttctaatctgatttcactttacaggctgcgattgatctcaacaagaacgatctttccgatgaatgccatctgaacgatatttgagagatgatatagctttagttagtcaccttagcgacggacgggtgaaatagagtaatgtcaggaacaagtttgattgtcaggaacaacctagctttatactctctctttggatcagaccgtaatactatgcaaagtgagactggttacgtcgcagacaactgtttaatcacggtgcgattagggctaatcttttgcatctttttggtgatccgtagcttcgtggttttgcgattcaatagtgtctaccagatctttcccgtttccagatcgtcttgatggcttgttggtgtgtgcaatgatcaaatatttgctgtcaaaatatcacgtgactgaaaatgcagccaactctgattgctaacattacatcatctctgattagcaacaaagtgtgcagtttgtgacatcagtgtccatgaaagcttccaggctttcccctggttattgccaaaaatatagtcctatttctccttatctctagaataattttggtaagtttacaacgtttggcaggaggaacgcacaaagactgcatgagtgtgcaaaaaatctgtccatattttctctgaatttgtactttgtgttaggtactacatttgtgggcatcccaaatggccaaatgagattaatataaggtgtggtatttcttgtagcaggaaacacacaccaagtcaaaccaaacagcaaaccaacatgcttgtgctatattcagaggtgcagtatttgtgcactgaacaaaaggcatctcacatcgctgtcccttgataattcatggatgtcaacagtatttcacatctgaacatccgcgcgtgctcctccacggccatcacctccgcgccacgctgccgtacccacagcggctcgccggcgctgcacatcctggcgagctggtccgcctccgtgggggcaaggtggaccaccaactgcttgtcctgctcctgcaagggcgccatgatggcgcccatgtacgccaccgagccgttcgcggctatctgcagtggcacgacgggtggcgggatgaggtcgccgcagcccatgcgcggtgcatgctcggcgagggagataggacggcgacggaggcggggatggaggggaatagcgtcggtatggagagaaatgacgacgatacgataggataggaagagggtgagtaagatactaataaattacgataatacccctatgcgaattattatttctggacaaaaatgcctctccacatttatacttccactaatcctagtgggagtagaactaaatctcaaccctacaattaaagatgatcaacggctcagattactttctactccgagtacaaagcaccggagtaggactagcgtttttttgacaaattggtccttgcagaaaacttatttcgaaactagtccctaccaaaaactatatccagaaataggccgtcggatcagcgccaaagcggttggcgctgaggttgttcttatctgcgccaacgggactggcgctgacatcgcgccagcgtggcgggcgaggcgcgatgtggcagggcctcagcgccaatgcacttggcgctgacaccttgcacaccctaaatagaccgatgtgcggcaatgaattaacggtgtcgctcgtggtgcaacggtaagtttctttcttgctatatctgaggactagggttcgaatcccaggtcagccatttttgttttttttaaaatcatcaatctacgtgcgtacatattaatgatgatctccattttcgtttttgtcttcaaatcttcaatgtacttttttttgtttaaattaatttttattaaaaagaaatatcacatttagtacaaatttaaaaagtagaagaatggattaaaaaaagtttagagacaacttttaaaagaaatatcacttttttataaaaaagaaattagaagaatggatttaaaaaaacttgagtttttttttaaaaaataaacaacaagttgagaactaagggtaagttttattctaaaatgtcacgtgtttttttaaaattaaaacaacacttgagcttgtaaaagaaatatcacttttttaaaaaatatttaaaaggaataacacatttagtacatatttaaaaataaaagaatggacttaaaaatacctgagctttgaaaaagttaaaaccgcaagttgagaactaagtaaaaaacaagtttagtaaaaacataaaggagagggttcgaaccctggtcactgtaacgccacctttcaaatacctaccactgagctaagccaaacctaattgttgcttttgcttttgcttttatttagccagtataaaggccagcgccgctgtagaacatatattctgatatttatatttatatatatatatttaaaaaacagagagcatcattaatcatttatatgtactaatgtacgcacgtagattgaagatttgaagaaaaaaaaagaacgaacaaggctgccgtgatagggagtcgaaccatggtgctagggtacacaagcaaatggtcataccattgcaccacaagtgcattgcttattaatggccgcgcatccttttaattagcctgtacaaggggtcagcgccaaatacattggcgctgaggccctgccacgtcgcgtctcgcccgccacgctggcgcgatgtcagcgccagtcccattggcgctgatatgaacaacctcagcgctaaagaggttggcgctgagccgacggcctatttctagatatagtttttggtatggactagtttcgaaataagttttctataaggaccaatttgtcaaaaaaacgggtaggactaaggcatcaaaccccattcagaagtcagaacaattcattttcaccatgtaaagacatgcgtcaaaccgcatttagatcaattcatttttagtgttgggtacgtttggttgtttgctaacctaagctatagcccagttgggcaagccacttcattgctgctttgctaggcttgccttgcctagctgtttagttcttttgcttctaacggtaataccgattgtcagatgttcgttttttccaccaagagattagcttaaaacaacaaaatatattcattttacagtatattgttacaacgtgatcacgggtaggcttgccttaccaactttggcaaaggtgcggaataaatctgtgactgtgattgcggtgaagcgaacgagaagtgttatgtgcggaggaatagggaaggcatgcaggcgacgataacataacgaaacatcgttggagagtgaaaattgttggagtcgctgatttacagcggcgcgcgcgtgaagcttgtcgtcgatggcgagccgaattcgctctccctggctagcgagctttttctcgctgcttcgggttagcttgcctgcaagagctaggaaattttgatagttccaaatggctggcctcaccaagttaggctagctgttccaagccttagatataaacataccgtaactagcctagctcagttcacaagcttaggtttctaatcctaaagcatcgctaaatatctatctatctattatatactaaaagcctatgaaacatccttaaaacgccctaagtcgacacatggcacccctaaaaacgctcctaagctgccaagtggcgctctaataaattagataaacatctaaccattgattttcccttaactcggtggacccatcagttttgaccattagattaaatttccatctctccaccctaatatacgatgcttgcatgctttggtcccaccaaaataattagttaagagtaaacaaacgtaaagaatcagttatttctctccccaaaaaatcaccgtggtattaattcttggaaagaaaaccgacgttgtagatttaatgcaggagcctgggtgtgtgcttccatcatccaaaaaattataccaacgaaaactttttaagtgaatatcacctttgcgtcaaaaaagtgaatatcactaactgctctaaactatttacagagtaaggttcagattcatgaatattgccctcaatagttagtttctgaattttcatgtttttgtttgattaccagggcctgatgaaattttcacggatgctaaatctcactacattaaattctcatctctcctccgtaatatatgacggtttcatgctttggtcccaccaaaataattaattaggagtaaacaaatgcagagaatcagttgtttctcacccaaaaaaaaaatcaacaaataaattttcagatgcaaagccataggaaaagaaagcaatgcgcctctagcttactttttcgaccaatatcaacgacatccatctacattttttcaggaacgagcagcaacaaccaaggttgaaacaatcctaatcgtatcaatcaggtgagtggtgcaagcagcaacttccatctttttattgtttgatctcttaacatagccttccacttctctatttttttaagcatataatttcgcttttttacctacaattttatactactccttggtgatgttgttcgtattctgatctgttgctactagcttctacaacaaagcgatatatcaaagttcttgcctcttggacaatatattcactaattaacatcgggtatttgggtgatgtcagtttatttttgagcacttagtcaagacgtcttgatgctgtgtgctttgccaccagaaatttgttaattgattttttagataatcattttggaagggtaatgcatgccgcttttttaggagaaacatattacaaacacatgagtttatatacatacgcgtacacttatccatagaaaacatattcgagagactgagccaatgatatatcttcaaattagtgaagtcatcataaacgcctcgctattgataggaacgttgcctactacaagaataattagccataaatataaggcccatgtcaagtctagatcttaaacctaggtgggtaagttcaccataggtaactaaccagccacactcactaattgcagataatgtggagcccctcttccctctccttaactccttttttccatatattatttgagataaatgtagtatataaataataaataaactattgtattttttaaattatatatagaatttttttattcgaccacaattatattctttagaattaaatcagttcatatcgatttgaccaattgcgttatatctcacagacaaaaaaaacacgaaaacatatgttatagtgtcatatatcacattataatcataaataactaaaattagctctaatatgtttgaaaataaagtttactaaattatattatttaccattaacttaatttatgatctatattaactatactttaatctgtaaaatataaattttaggtcatatttttattcttggtctgtaatccaaacggacatgaaaattataaaaaaagatgacagtatggagtatatatcactatatattctttatcggttataataatatgtaccattaaattagatttacaatataacaagaaatatgtcatatctttgcgctttacatggcatttgagaattataacaaaacgtgaaaaaacaatttaatgatatgggtaatatcatcacataaatatgcttactaggtagggtgcactctatttggcccatatcagttcacaaatatacgcgactgaattagatttacaatatcaacaagtagctagtcacatccgaggccttgcatggcaatcgagaattatgacaaatcatgataaaaaataacaatatggattatatgatcatataaatatacttatcatgtggattccaatctattcggactatacggggataatctaaaatgtcaattcaatttaccaaatcatgtataagttgtacgttttgtagactacaccctaaatattaagtaaaataacggatggagtacacatcgtgttttctcacctttgatttctattaaatacgtatggtgtgtgggtattttgtatatactaagttttgttaattaggggacataaacaatactaaagttatatatgagaattcaagcattaaaaatacacttcataacatgaacgtacttaacaaaaatgtactttagtctatggtgcttaaatatttataaattctctaaacatactaattatttctgctcttatttcaaactaaattcattttctccacataatataagagatcatatgagaaaaaaagaggagggagaagaagtaaatagaagtctgccattaaacagatagaataaagacatctataacatacaagaaaatttgttgattaaggtttataaactccaaatgtaagatatgctaatttctaaaaaaacacacacatggtacacataatagttccatatgaagcaacactattgttgtgaaacaatagtttctcgtaaattaaaaaccacatggtttaaataaatttgatttagaatttatataatgaaaaggtaattagaagaaaattaaaagcgacgttcacaacaatctcaaataaattattgataaaaaacatgttcagaatagagtaaaaaaatattttaagaaatactcatccacacataagtatttataattaaaattcaagcaacattaaataaggtgtcccgcgcatgtgcgcgggctacctttctcgtctagtgaataaccgacagctcctataagatttataatccaattccctttttcaaaaccaattgggactacctaaaaaaactgtcgtaagttttttgagaggaaaactttcaagagttatattgtaacttgcatataactatgttgtacctcctccgtttcatattacaagactttctagcattccttacattcatatatatgttaatgaatctaaacatatatatgtgtctagattcattaacatatatatgaatatggataatgttaagggttataatatgaaacgaaagaagcaactcatatgtaacttagagtatatctatgaaagacttacagctagcacagtggtacaactccggtctgcaaactgaagatcgtgggatcgaatcccagccacacgcttgctttgtttttcctcatccttgctcttgcacgaatctcggagcaagatctaatggttaaaaaacgcaagttttctctcctaaaaaccgtcgacaacaatgtagcaattccgaaccaattaagcacatataagaagatgtactttgcattgaaggagtaaaatctgaaacatgtgcttgattatgttgacatgttgaagaagtagatctatattagcaccttgcattggagatacatagggccaatcccacgtgaagaattttttttccacaactagtcaatgtattacaaatctagaaaatcagaaattgcgtcgacatcacacttagctgtgttggggtagcctgtatccaaagattttccttaaaattgattgtgctccaaaatggtttatccccctccagccctgcagcttgattagtccacaacttgtccagcacagcaataggccccaaaagtgtatagatgctcatgctctcgagtctcgatcacacacggacacagagtctccgccgcattttcttcttccccaacctccacactttcgtcctcccccctttctcctcccccttccccaacccacacccacacacacttccaagctagccgtctccaacaaccctccccccaccatcctccccatgtcctcctccctcccctctcccctcctcttcctcctcctcctccttcccttccccgccgcggttcgttcccagccggcggcggcccccgcgccgcagcagcaatgcccgctcaacttcaccgcgctccggcccttcctggcccagccgctcccgcccgacgactccgcgcgctgtctcctcgccgtgcagtccgttcgcctcctcctcgcgctccacctcgccgccacaggatccttcgtcctcccggctaactcctcctgcctcccgccgctccgcgccgagctccccttcgcgctcccgtcgccctccgcctgcggcctccaggggctcgacgcgctcctcgcgtccccggggtgcgccaacgtttccactctcggggacttcgacgccgccgtgccgccgtcctcgcgggcggacatgaacgccagctgcaaccgggacctcaccccggtccccgactgtacctcctgcaccacctcgctcagcaaggccgcggcggcctacctcctcccgggctcccccaacgacggtgggaacaacgtcaccggctgcgtccagtaccccttcatctacgccggcgccgccgccagcccgcgcggcgccgacgacccagccacggccaactgcctctacctcctcaaggtgaactctgcttccaaggccagctccagcgtccctggttgggtctacggcgtcgtgtttggctgcgtcgccatggttctgctcgttgccgcggcggctgcctcttggttcctggtgcggcggcggcggaggcgggccgccgccgcggcgctggccaaggccgcggccgacagcaggagcaagcgctcgcaggcgatggagtcaatcagcgcgagcaccacgctagtccagttcacctacgacgagatcaaggcggccactgggggattcgcaagggagagcatcattggccgcggtgggttcggcaatgtgtacaagggcgtgctcccggacggcgcggaggtggccgtgaagcggttcaagaactgctccgcggctggggatgccgcgttcgcgcacgaggtggaggtcgtggccagcgtccgccatgtcaacctggtcgccatccgtgggtactgcatcgctaccactgagagagaaggccaccagcgaatgattgtgtgtgacctgatgcacaatggcagcctgcacgatcacctgttcggtgccggggaatgccagatgacgtggccggtgaggcagaggattgccatagggatggcgcgcggcctggcctatctgcaccgcggggcgcagcccgccatcattcacagggatatcaaagcgagcaatatcttgcttgatgacgactttgaggccatggtggctgatttcggattggccaagtttgcaccggaagggatgacgcatgtgagcacaagggttgctggcacgctgggttatgtcgctccagagtatgcactgtatggccaattgactgagaagagtgatgtctatagcttcggagttgtacttcttgagcttctaagtggaaagagggcatttatctctcttggtgaaggccagaactttgtgctcagtgaatgggcttggttattggtccggagggggaagacagtggatgtgatccaagaaggaatggttgagcctggtcctactgaggtaatggagaagtatgtacttgtcgcagcactctgcacgcatcctcagctgcacgctaggccaacaatggatcaagtggtgaagatactagaggcagattcagcgtcaggtcctttaattattccggagcggcctcttccggtagtcgcaaacctggctgagattgagagatcagccagtagcagtggctcaggtcagctgtttagtccctctggtttccggtcttttactcatataaatgaagatgctgctttggagtctcctaaagaagaatgacacttttcttagctgagtagagaaaagtttatttctagattctctgtgtaccatattttttttgttagcttgatttctcttaatggaattactcaattgtgtagatagaaattgtacttttgcccccacccaggaaatgtaagattctttggtgacagttgaattcatttaaaacatatctgcttttttatttctttatcatatatttgacatttaaatatcattgattcattagtgtggactgtttttttctattggatcgtcaagatgagaaacaggaagattaaaacaattccctgttataaatttagtttgcatattgtagaacaaattgtgctatggagttcaaaggtacctttcacttctagagtcagataataagaataaatacattatatattcatattcttctattgaattgtctcgtatcttgaaatcggtaggcatagaaattctgaaatttttacattttggtcctttttgaaaacttattttacaaatagacccctgggaaaacttaaaccggaaatggtcctttttgggacgccagagtggctggcgccgtaccccaacatggcggcgccagccacactggcgccgtgcccgtgccaccgtggcaatagggctgtcgtggaggtgctgactaggccgaagggggcgccagccaaagtggcgctgcccctcatagcacggcgccagcatggctggcgcgcccctcctctgcgggccccaccaactttctctcccccccccccaaattttcgccaagtctgttctgcctccaggcaacggctggcgccccccctcccgaccgcggcgccagagtggctggcgcccccctcctccccccatcgaagcccttctgcctccgggcctcggctggcgccgccctcatggaccacggcgccagggtagctggcgccgccctcccccagcccgaaacccttctgcctcgcggcactggctggcgccgcccttcccaacctcggcgccagggtggttggcgccgccctctgcctccctgcaaattgaagatccatattgcacagatgtaccaattcacagttcgcaattcaaatcacaattcacagattcgtacagactaaaacaggttccaattgcacaaatcacaatgccaaaagtccatcacatagtcctcagatagtccatcacatattccacacatcaaacaatgccaaaagtccatcacatatcccacacatcaaacaatgcaaaaagtccatcctatattccacacatgaaacaatgtcaaaagtccatcacatagtcctcacatagtccatcacattttatatcacatagtgcaccacatatgtcatactaccaaccaatagattaacttcatacaaattacttcttccgttggcgccgaattgcttgcgagcccggagtgtacctacatttgaaaatccaatgtttaaaacattttaaaaacaaaataagggaaatcaaataacatttgagaatggtaagctcattttacctctttttcgctgcccgagtggatcgcaagttgtattgcgtgggttgcgtcccctgaggcgcgtcgggaagctgtgacatgtctatcttctcggcgtctggtgcgacgtagtcctcatcctcctcgtcctcatcgtcatcgtcgtcgctaggtggagccggcgccttcccctttcccctcccttgcttaatgcgtgacgacgacgagccaccaactccttcacgctcttctatcctgatagagtgtcgagcagtacttggacgcgcggattgaggtagtggtggtggtagtctccccggttggtacacgtcgtccaatccaaccgacctgcaacctaatcttgctgcaagtttccggcacctttgacgaactttctgcatttcaaaaaaaaaagaagtttgttaggcataactcaagtaatgcaaagtgctaaataaattttacctctaaaacattgcggagcgtgttctccgtgtcctcatcacccctcggagcttggagggcatgccccatttcattcacactcctgaggagctctctcgactgaaagcgtgaaaagatatatgttagggtctagggtgcaaatggaagtaactttgacaaatgcaagaaaacttacgactctgtctctaagtggggcgtgctccatttgatatccaactctagtccggacatcatagggattccgtccctcatcggagtcgcggtcatcctctatgtcggcttccgtccaagtagggcggaggaacagtctatatgtcctatgcagccaacgaaggtactctgagaaaagatgattttggtgtatagtctcgatgtacctatcgttccttccggctgttctccattcatcaatgtatctattatgctctagcccccagtctttcaccttctttgttctcaccctgtcatacctagacaagtagaaggtgatgaaacagtagtgagcatcgacaatggttaaatggtacaaaattgaacattgacaatgaaagcaaacaaagataagaaatatttacttgtgtaattcaactccagttgagatgtcctcaaccggccaatcttgtttcttcccgaactgtcgcatgacacggtgtggaaggtggtactcaactgcccagaaacaaatcaatgggcactggtacatgaaatagtcagagtctcgattgcacatcgagttcagggtcaggcttgaagcctcatttgtgtggtatggtaaccacttaatctgcaaaagttgaagagatgtcgttggttagtatctcaattaaagaagtaaatgtctatctagaagtaatattggaagtacttacatgttgaggctgcaagcagtccatctcattgacataatgcttgtatgccacatcccggtgagcatgtgcagtgtcagtactctcaaaaaggtaggccactgtcttctccatgtctggctcattgtagggccaaggagtgaagctttgcctccacttaggccttccaaccggtagtcttaaccacatccacatctgaatcaacgagcatctattttgcaccggcgcagcatcaagttgaacgcatgaaggtggtttccttccagaaccacctagacccgagtccatttcgttcttgaatcgtttcgatctcctcttccctcttgttttaatcttcagataaacgtgtataagatgtgagcaaggcatatggtagagcaatggcctttggcaagaacatgagttcccctcacctttaactttgaaggctcttgcgccgaatctaacaccaccacacgttataccacccctctctgtgacctcgtatgtctttttctgcttatcgaaacaccttgcagtgtgtttgttcgccttactttcttgcaccttcatcttactgtcaaccttggtggaccaacgctgccctaactggactcgcttcaaagcttcatcatgtctgttcacaatgtagtcattgcacttcatgaacgtaaatgatacgatggccgtcactggaagcttacgaacaccaactagcacgctattgaactgttcggccatgttggttgtcatgtaaccccaccagcggccatttctatcgtatgcacgagaccacttatctttatccaacaactcatcttcaagccatttacgaggaccttcgggaatacgctgccttagtgcctcaacatccctctcaaatatccacttctcgtcaatctgacatattcttaggagctcttttgtctgatgcttgtccgcaccggccttgtggaaattagcactgaagtgcctcatgcaccaccggtggtgaaccgatggcaatcctggaacaggagtcatcatggcattcattataccagcatgtcgatctgagataatacaaacctccctatgcggcccaaccacaacccgtcggacaagatcgataaaccagcaccaatctcgtgaattctctttctccaccaaggcaaaagctaaaggtacaagttggtcctccgcatcagctgataatgcagtcatcaaggcaccaccgtatttcccagttaggaaggttgcatctatagctagtactggcctacaatgcttaaaagcctcaatggaaggaccaaagcaccagaatgcacgcataaaaattttcttggtcactccatcaacgttgacaaccctatcaggatgagtatcgatgtggtagaccatactgggattcctctgcttaatggcttgcagcaaagtgggcaaacggacatacgcttcaccccattcaccgtaaatgagcttcatagcctcctctcgtgccctccaagccttgccatacttcaccctatactggaaaacctcaaatatatacaaagctaacacagaagcagagagtgtaggttgcagttttatggcattgcataacctatttgctatgaactttgatgtcagttgccggtggctccctgaaccttcggcagtagcacaactatgttccttacctacccgtgatatcctccacgtgccactagacctcttagttgcatggaccttccatttgcaccgtgggttttcacatttaacagtgtacctcctatttgcggcagaattgacaacacggtatggacgatggtgcacgatggcgtactcctggagccatagcttcaatgcgaccatggatgggaactctaaaccctttctgagaccatccacctggaatggttctggcaactgatctaggttgatgccgccatctagtagtgcaccatgggcatgtgttaggtccctaaactcaggaatgtccggcttcctcccaaacaccttctcaaacgcacgacattcctctaatgctaacttgtcattattagtaagtggagggaatggacggtcatcatcagagtcttcagcaaattcaacatcatattgctcaacacttgcctcctcgtcaacatcatctctattgacttctactgagacagaatcgtgaccaccactcaattcgacatcaaagtaatcatctggattcacatattggcatgctacttctgtcgggtattcagggttgactccgtacgacgaccaatgaacactcgccgacaaatgttcacttagatcaagcccctcttgtactaactcccttttcatcaccctcgctgcatccacatcatcagtaccgcaatgtctctttgatggtcctgcctcccataaatcttttccaagcaaaggtctcttcttctctccttccccctccaagtcttctcgtaccaactcactcttacttgcaccccctccacgacgagaataatatgtcacaaaattcttctcaacgtaatgataagaaggagatttgtttagatccaaattttctacggtacgaactaactttgatgcaaacacctctattgatctaaactgagactcttttaccaaatcaaagtaaacttcccattccaactgacctatcacatttaatatatacttatgcccttgaccaacatcgtatcttccataaaaacgaatctccacattatcctcggtccatccaagaacttctttcactcgtgaccttagttcatctagagttgggtgggtgggaaacaaaatggtcttcaatgacatatcctcaaactcaacatgtccaccaacataaggttccaccactctaccaccgtagtaaacacgaacaagtctatccatctacaccaaaaaatcaaatgtaactttgcaacaaaaattaaatcttcattcctaaacgtagtccaaaccgacatattataaccaatgcataacttaaattgtcccaaagctactactccaaaaaaatatttaatccacctacaactatcaacaagtttactactacattacacatcgaaatattacaaatactctatcatacaacccaaacctccatcatgcctcaaccataatttttcatccatccatccaaccaaaccatccaaaaattaacattaccacatatatggttaaaaaaatcatgacaccaatgagtacattgcaaacatgtagcactacaacaagccaatcctaagaacaaatgctaaaaatcacaaatttgggtaaaaaaggggttctagggttacccaccgatctacaaattcaaccaataaaaatgaaaaaaaagaagggggaatgaaggagtctacctttctcttcgatttccacaacaaatcccgcgaaaaacggcttcaaattgagtggatttgaggtggagaggtgagggggagagagagggagaagaacagcagctcgctgctcgggctgggaatggcgaaaatgggagtggggaggagaaaggtggtggggcccacggggtttaagg

SEQ ID NO: 60007 - DNA, 45208 bp, Oryza sativa
atgtcctttcagcatcagctgttggcaatacctgggaattgagtggaataacaatttggagtttttccaaatgatctccctagcaagaatcaaattttctcagaagggtttcctggaaattttctttttggcagcttggcacatctggaaacaaagaaatggcttcatatttcagaacattcaaccctctttccaggcatggagatctcttttcatcaaagaagttcttctgcatatgtgtagaatgaatgatcctttaaagcaaactatttttaattgggtacaaaccttatagtatctctgtgtgaaccgcatgtaatctttgtaaccttgtaaatattttctttatttaaattacactgctgggcaaagccctggcagttttcctggtcaaaaaaaaaaaaacttggtagatcctagccttccaggtgcattggttagactgttttgtgcaagaggcacagagctggtgtacatcatgtgacgatcatccatctaaatggccatgttagctttgcctttgcatccattttcagctcaagtcaatttcaatagtgtaactgaggaggtacttgacagggtaaaataaggaagtaccatggtatcaaggataggctatgggaatttgcactcaagccagatttaaggggatgtgatattgcagagaggagaaaaaacaacaagccagaactaatcctgcctacgaatttatttatttactaaagatcaaatcccatggttatggaacaacacaaaattccagtatttggagtaaaatctcgagaccaatgacacatcagtaacatatatcagagaaattatttagcatatctaaactaacctgtgtattggggaaaaatagcaacgaattagtgtacgtaacactgaatgccctctaaatgttgacagggactggtcatatggatgcttgaaatatcgggcttctgagggatatgtcatccatctgtaatcccattcatatgcttttggtgtgcagctgcaaaaacaaactacaagtaaaaatagtatttctgtcgaataactttagcctattttatattttggactttgggtcaggcatgtagacaagatcttggacaaatcaggccaagcagatctagtcaaaggcagattttgattttagcatttcctacttgcttacaatatgttgcgtttaagattcaagcataaaaagtggtttggtttagaggaataatcatgcaaaagcaagagctgtatttactctttcacagtggacgacattttcctgatgtcccatagtttaatagtttgatccttgcaatttgaaataaaataatgcccatctccacggctatcaataaatgtaatcccatctaaatgacctgtcaaaacaccaacttgttttcctctcttgttgcagcgcctatcccagacctgaagattggataacagtgtcagtcaaagaaagcctccatgggtgacttatcagaacttcgatatgataggaagcccttcacagatttcacatctcctaggcaagcaaaaagactgatcatgcattaataccaaacagactggtgttagagtttgcactactgaacaatagttcctctagcggctacacaaatcggtcctctagaggctgaactcattgctcatgtttcatattggttagtgacttagtgacttagtgtagacagtgtatttacaccaaatattcaagcactgctggacttctggcacgatcagccagataaacctgcaatgttgctgtctgacttaaaccagcaaatgcaaatagaatcatctttaaagaaagagtaaatgaaattgggaaatattagtctcaccttacagaggctatcatcacttccagagtataaaacatcactaccttcatcagcaaaggtgactgcattgacatcagcctttaaagaccaaaagttgagaaaataagatttagtaagaaacataactttttttttctaatacaatggctaccacaaaagagaaatgaaaaatatattatcaagaaaggttccaaacctaagttaatccaacaatataaaatgtagcacatacgttacattgtcttgttacagatagtcccatctactgtttgagatctcactatcaaggtggtttctggacaagggcaagttttcaagttcactcaacatccctgaaatgtttgatttcatatttctagttgtttatgtcagtatatgtttcgaacatactgggctgagtccactactactttcaggaaactggcaggaattgatgcagtgcctaactctactgcttcaataactccacatttatgacatgtgacaaaaataaattttagcaagacatctgctcctagctgatgatatttttgcctgctgaagcatgttcattaacttgtctattatacccagaatgagaatttttagtacaccagatgatttgataaacatgcaaattttgattcttttgtgcaaatttccagttttgttggatcaaagcttcctaaatatatcatcattcttcagaataaaatggcagaaacctttgtcagtgaccttgacctacaatcccttttgtcttaaattcctcccatatgtatatactgtgttagtgtgacgcatcaagctacactaagaacctaatcttatcaagttatctaagaaagaaacaaatggtgttattctaattacattgtaaataccacttgttcaaaatggtaatgatgcacggaagaaaagataatgtgcagatatcaattggtgggacagaaaacagtcatacattgacaataaaagcatgtagctcagtcatgcatctgtttcataccgaatgagcgtgaatgcgttctgttactttgtttgatccaatatcgtaaatacatattgattcattgttgtttccaacaacaagttctcggccatcttttgaaaacttaacagaaaatatggcaaaggagaacccatcatcatcattcgaaaactccaagccttcgtgaacttgctgcattataaataaaaacagaatatgtaaaaacgtacataaggacaattatttccaaaaagaaaacagtagaaatagaagtcacaaccatcaataaatatgctaacaactagtacatactattttgacaaggaaaaagtctacttaacgccctcgaatattatggtcagcctacttaatctcctaagtatgaaaccaggcgttcttcctcctatggtggttttcagggtggttttgccaccatgactgttgacattgaactgactcaagaaaatggtcactcacttgggcttggctttggttggtggcaactaagggcgttgttgcactctaggcatagcagtgttctgaaaaaaggtctaaaaggctgcatacaaggaacaggtgccccaaccttgtacacttaagccacataagtgtccgattataccgtataagcatccaattatgccgcataaacactacaaggtggggtcaccacacaaaactggataccgctttttcgaaccttgggccacagtgaaagtcagtaactgaggaagaagacatagcacgaagaaaattgccctcatcatctcataggcacgccagctgtcacaatggcaaaactacctccgaaacagtctcaggggttattttatttaaaatatccatttaggaggtggttttattttgaaggggtagaatagagtaatttttgtgacaacctgaatgggctggcaggtctgtataatagtgttgatttatttttcatgtttgcacactaaccataatgcgccccaactccaaaggttatagtttttaattatgtataaatgtttcttatcaaataaaaacgcctctagaatttttaaatataagtaaaaccatggtatgttttttcaagtgcctctggagtcagcacatgctgcaacacaatacaaatagactccaaatttcctatttttgttatcatcagaggatataccgtaatattggcatgtgattctctcatgccattctggatatctaccatatgaacgataggtgacagactggaataagcctgcaaaaagaacgagtaacacttagttaatgatataaaacaaatatacaaaaagacctgaactagtctcaagtgtaacttcatgaatagaacttagggagacatctaaaggtagcttgttaggaattataggaagaactcttgtaaatacttctaagctagtgaaagaaaataaagaagtgcaaagttgaaaaattacatgtagaaattagtctatctaatcttactcagttctcaaagaacacatgtatcataagttctgtagggacaggctactagaaaaggtccagaagatacaaacataagcaacaattatttgatgagatatatgaagtgcaataacagtttgttgtataatcatagtggactgtaataattaaagctatggtccatatagtacagtcttagtacccaggggaactgacaatccatatggtccatgatttgttttggaatttataaatctatcatgatatatccctaaagaggctgtcagttccctggtcaatttttcatggtctatatttctatttaccacattttttttagaaaaaaggggaatcaaatgttgagttactcagagtccaccttgcttatagggtacataacatggacagcaatggagccaaaatgcttataaaaatatgcagattgcatggattttgaaggtggtaatctgcaaattttagtatatctaggaatcaaatatgttattctaactcagagaacactcatattttcttcatgcacaataggttcaaacttgcattacccaaacaaagggctcaaatccatgtatgaaggggaaaaaagaaacacactatggaactaaaaatagtcagactgtaataaatattattcaagcacattgatgcgaatttttatttacaaaaaatggaatcatatatgttatcctgaaaagagtgagttcactagatgtcaatgagtaaacagcacacaaaagaaaagaaagaatgagaacaatgcataagagtcttactaggtatcgttgatcaggtgaaagagcaatatctgaaactgtccaacgtagctttttgcaggttatgtccttatgtatcgtccactttttctcagcattgtagattctgatatggctaccctgattaattgttggcataaaggattgtcagtcacccatatcacaacattttgtgcagccaaggtatctaaacaaaagctaaactcatgtggtaatggttataattttccctataatagcacaacgacatacccggaacccaccaatgagaagggaaccatctgcggagaattgagatatgtaggcttcactgtccatgtcatcaacacaccatgggccttttactggtaggtgtttacgaagagcataagagcaatcagctgaagagaacctaccaatccctaagcagttggattctctccctgacaacaacttgaatgttgagatatgcctcttttttccagcatgaagggatgcacgagtcctctcacatggctcggatttaagcctcgtaagatgggaaacctcctcatctatcgcagacaattcattaccatgtgaaggacaggattgttgttgatgacatgatcctccatgatgtgtcttccttttccagcccatgtttggatactgaaattatgagcatgatgaagtttgtcacttctgacaataatcaaacaactttcctatgctaaatattcactgaatacctaacacctccaaagaatgatcaattgatatactagtacagcagtctgcatgacagaaagacagctactgtgcttaacttcaaaagtaactccaagaaaattatagttataaaaggttgtaatcgtttattatattatatttctaggatattaatgatactcttccgctgcatctttcattacagaataaaaacgggacatgcatgcttgtagaggtaaatcagttttttattattaatttaataatacaaaaaaggaaatggctgagtagctcagcaacaccaatatgaccacgaaaatagtattcaaaatgagcatcactacaaaacaatactagaaaaacagttcagtttggaaatgacacaactcaaaatgaacagaataaagccttcgtccatctcaattaaagaagccatgttctcgatgggaggggcaagagtcaaaatcaaacttggccttagtgaaaatgaaacaatgaacaaatacctaagggtattctggtcgtttttaaaaacctcttcttttttttctttttttttttggcaatgcacaatcgctgatgggtggtgatgagctaatttcccccaaaaaaggatatctgacatacactttgtacagatgattacaactaaatctgttcaaataggaactgaaaggaggagggaaaaaaacaaatataaatttcgcattcacctcgaaaagaacaagactttaacgtggacacaagcttgcaatccagctatccaggcaactccaagcagggcagtaaagctgatagccggaggcttggactcttctacagccagtcattccctacacgatttaaaaaataatttaataacctgaagggaaggaaacggacaaatatgcgtgtgcagcgtatccctatcgcctttatgatctctaccatggcgttagattcttaagcggacgattggtccatagcaaagttggtagtaactgcaaacgaagtaccgacgattccagcataaaatcctaagacgtactactaaggaactccgaactcgctataatctgtgccggctcatgaagcgacccggatgaggagggagggaaaggagaggctaacctgtaccttcaattcgactcaacccgagacggaggacgaccgccgcgcccctcaaaacctgctcgccggcggcgcgagcgaggatgccgaaaaggggggagaaggctagggcaagaggccgtacacgccgtgcctacggggcccgggaattaggggcagagggcgccgaggtctcgccgcacgcgcggggcggtggaattggggaggaggcgaagctgccgaggaagaggaaggagcaggagacggggggaggcgatagctgggagaggcgggagccggtttaaaataccccaacatggaaggggaccgcgcgtgaaaaacaccaccctccctgccacatgtcgccgacgcgtgggcccagtagaccggctttggaggttggtgggctgcgaatgaccggtgaggcggggcgggtcggggatgtccaggtcctgcacacgtggcgggtcgcgagtgggtggcgggcgggtgatgcgtgtggtggtgcggcgcgctggattagagccggggtcgcttgcagccgttgctgccaatggagtttgtgtcgcacgccgtgatgtaatatcggatccgatgacgtcagcaccacgcgaagcatcgctacttgtaatccttcgatcgatggtgtcctagtcatcgtggattatccaggatgttggcgggtaagtgcaagtgctctacgctggagaagggatttttgtcggaccatgcgaaaatcacattagccctggttcaaataggggtcataactaaagatcagctttagcccagtttaaaagcccaatggcactttctgattttaatttaggttggtgagaactaaagatcatttttagttccagtttaatagctgtctggccgtgtcaggccctcaacgagtaaaagatcacacgtctcacggcccccaacaagtaaagatcacacgtctcacacatccttatccactctcgcctctctctgtgtctctctagctctcttgagaagcggaagcggcagccgggcgggagaagcagcggcggcggccgagcgacggaagtggtggcggaggcaccctccccctcagccagatccaccgggaggagaggccacgggatgggagcccaggtggcggtggagcgacggtagatcgacggcgtcggcacagccgtgcggcggcgtgacgggcagccgtgcggcagatggaggaagaagttcattcttctttttttgagattttgtgatatatttgatctgtgagactgtgatctgtgatgtatttcttcttgagaatttatgatgtattttgtcgacgtttgatgttgcggttctggtatttgcatggtgtggggatcgtcggtgctagggtatacgcgagactgaggtaaaagagacggagacggggatttttatacaggtttaggcccctgaacggtcaggtaataaccctacatcctgttggccgaagccagtattgctcttattcatgataatcacaccagtacaatacttggggtagcctatctaactgttgtcgacatggcggtctgacgatctgactcgtagtcgacaacagggtagccttccacctcgaatccgtgcccggcgagatcagagatagcgctttcatctctcctgacagtatccggagacaccgtagggtactagccgtgtttatccctgaagttgatatccgacggcgtgtcttggcgtatgtaggcttctatgttgtggcttctatgtcgattgtgttgggtgttgattgaagtggtcgtgtgttgattgtcccccctctcctcctaggggagcttgtatttatacacataggtgtcctcttgtccaagtagaacttgggaaaccaatatggatacaattcgagtagtccttgtcgtttccatgtagaactctggttgtctttccttatccggaactcctcctatatccacaggttgtttccgtataggacatggtatgtggtggatcctaccgagatttagtcaactactattagatatgtggtacccataaccctgacagtagcccctgacttcgatgcaaatgaacgaattcatattctcaaccgcgcgcagacattggagtaactgttatcgaactcatgtgaccgttctcggtgagtttaaagataacgttagacttcctttgttagcctcgtgcgggcacctaaagggtttgtctgagtcaatctctgatgtcaaccaagaaagtacagagcatacgactaagtctctcgtcttgctgtaatcgagaatttggattgaagtcaagaaattttatctcggcgggtacaccatttcttcattccgtattccttgtcgatatccaccaaccgttctcgagcgatcgagaaggcgcagagtctgcgacggagccttgtcaatatttgtcgtacccgccttagtcgatcttggtgtagaaccatagagacatggagtctttgataatgtcaaatagaattttcctaaaatcaatactcataaaagaatattagatagaaatagtccccgagcgaacgctcgaagggtgacatgttataatatgtctggaaaaattgaagatgaattaaatttataaaccagtgttttgtatatgagcgtcttctcttttaccgactccgatcagtcagtttgtagagttatacactctccctagcccccagccttgtcatcggagaattgttctcggaagataaggctcttggacctttgacctgcctcagttgaacaagcactgatcctaacccccagccgtgaagttggaaaatccaatttccgattacacggcttgattaacacgcacggcgagaactcttacatgaccagatcttacatggtctttcgtctctgaaggatccgacaaagccttatccgctttgggcgtccacagccgaagttcccttaagttcctcagaggctttgtcaagacagcgtgggacgttaggataggtttcaacgctaggtgtcttttatggtaagggatctctgggtaaaacactaggcgatactgtgcacctgatatcaactttgttggagtagaggtaatgggagaatcgctacaccactggtcgagaaccaggtagtagtcgtaactcgaccacttaaagtggagatagtgggagaatcgctacaccgctggtcgaggaccaggtagtagtcgtaactcgaccacttgaagtggaaatagtgggagaatcgctacaccgctggtcgaggaccaggtaatagtcgtaactcgaccacttgaagtggaaatagtgggagaatcgctacaccgctggtcgagaaccaggtgtagtctaaactcgaccactagaagtaaaggtagtgggagaatcgctacaccgctggtcgagaaccagatgtagtctaaactcgaccactagaagaggaaatagtgggagaatcgctacaccgctggtcgagaaccaggtagtagtcgtaactcgaccacttaaagtgaagatagtgggagaatcgcaacaccgctggtcgagaactaggtagtagtcgtaactcgaccacttaaagtgaagatagtgggagaatcgctacaccgctggttgagaaccaggtgtagtctaaactcgaccactagaagtaaaggtagtgggagaatcgctacacctctgatcggggaccaggtagtagtcgtaactcaaccactagaagcaaatgtacgagagttcgctatgattgactggttgagaaccagtgagtaggtgtctctcgatcatttgaagtcgtggtgcgaggaccgctgcgttattgttgtagtcgtaccttgaccatccgaagttaaggtgcgagagattgctacgttttactagttcgagaaccagcgagcgagtagaattatctctcgaacaccaatggatgttgcggtgcgagagattgctacgtgctggttggagaaccagcgagcgagtagagttatctctcggacaccgatggaagttggcggtgcgagagattgctacgtacttgttcgagaaccagcgagcgtgtagaattatctcttgaacaccgatggaagttggtggtgcgagagattgctacgtgctggttggagaaccagcgagcgagtagagttatctctcggacaccaatggaagtttgcggtgcgagagattgctacgtgctggttcgagaaccagcgagcgtgtagaattatctctcgaacaccgatggaagttggcggtacgagagattgctacgtgctggttcgagaaccagcgagcaagtagagttatctctcggacaccaatggaagtttgcggtgcaagagattgctacgtgctggttcgagaaccagcgagcgtgtagaattatctctcgaacaccgatgaaagttggcggtgcgagagattgctacgtactggttcgagaaccagcgagcgtgtagaattatctctcgaacaccgatggaagttggcggtgcgagagattgctacgtgctggttggagaaccagcgagcgagtagagttatctctcggacaccaatggaagtttgcggtgcgagagattgctacgtgctggttcgagaaccagcgagtgtgtagaattatctctcgaacaccaacggaggtgctaaagttggtttattacatgtgcgtctcatgtggccagcatgactcacacacccaacttgtagcatatctgaatgttcgttcgcaatcatgtcgggtgatcaagccgacgacgttcgcgaggtattatccgttaacaaccttttctcgagtagtccagcgatggccggcgctatgagataggtcgtcggtcttctttggtaggttgggcatgacgactctgcatttgtcgagatcgttctcgataatgcggtgtacttgaccacgacctactcgagtgctcaattgttcctgaaaaatattttctagaaggcaagatatatagcagataatatcgagtatgtactcaaaaaactacatagatcttctggtattatcaggatataacaagcagatgtaaatatcatgcattatgtaaactgtaagcaagcatgatttatatagaagagaacagagcgagcccccagcgttagaccgtagtcgatttaacatcggggacattcgcgcaatagatattgtataaaagacatgctctaggaaaacataataaatcatggatctgacaatgttgtatgatctgaataggtacgataagttgcatatgaaatattgcgtacttttgtagatacatgccggatgtatccacgaaattagtagatcaatttaaaaaaccaatctaccaattaccttgctgcgtactcgttcgatatcatgtgatctgacatcttttggtacaccgcggagcttgaggcttggatgatctcgatagaccaagttgtcgatgacgatgatggttccgatctagtcgcaagatgtacttggacaggttggatctccccaaagccgaagtcgtcgagtagcttgttgatggagaatccatctctcaaacccatctcgtcgaaaccttgaagcaccaaaatccccctacctggcgcgccactgtcgacgtttgatgtcacggttctagtatttgcatggtatgaggatcgtcggtgctagggtatacgcgagactgaggtaaaagagatggagacagggatttttatacaggttcgggcccctgaacggtcaggtaataaccctacatcctgttggccgaagccggtattgctcttattcatgataatcacaccaatacaatatttggggtagcctatctaactgttgtcgacatggcggtctgacgatctgactcgtagtcgacaacagggtagccttccacctcgaatccgtgcccggcgagatcagagatagcgctttcgtctctcctgacagtatccggagacaccgtagggtactagccgtgcttatccctgaagtcgatatccgacggcgtgtcttggcgtatgtaggcttctatgttgtggcttctatgtcgattgtattgggtgttgattgaggtggtcgtgtgttgattgtcccccctctcctcttaggggggcttgtatttatacccataggtgtccccctgtccaagtagaactagggaaaccaatatggatacaatccgagtagtccttgtcgtttccatgtagaactctggttgtctttccttatccggaactcctcctatatccacaggttgtttccgtataggacatggtatgtggtggatcctaccgagatttagtcaactactattaggtatgtggtatccataaccctgtcatatttgatctatgatgtgaatctgtgaatttttttatgtatttgatatgttattatgtaaatctgtgaatttgtgatgttatctgtgatatgtggtgttatatgtgacttggggatgtagggagcaactcaatttgaggaaatcaatatgcaagcagtaaaaaccaatgaaaaaaaagaaaaaaaaacctttagtctcggttgataacaccaactgggactaaagatggtagcgcaaaacacgtggtgctgccatctttagttccggattgggcgtcccggtttgtaacccgggactaaaggaggggttgtaaaccgggactaaagaccacttccctagcagtgattataatgcttgatgtggtgcctctaaaattgccacatataattggatgatgaggtgtaagaaataagtgatgaaagagaagacgacccatcccttatgcaaggggcaacctctaacaaacccaaagaaaaaaagatgaaagaaagaagggattggacacacgaataaaataaaaccatttggattagtatgctagaagtagtatagatgtggtgtattgtatatatcacctcatatcctacatggataaaattattggcaactacccctactataaaacttgccattaggcacccatgtagattttcgatctactaaaacatatgctaatcctgtagatcaccctaatgtggaattagggtttaactgactgttgtttgaagccattgcattgttctagcttgaaccggagtaaatgtaaaggatgcagaaccacctcgcgtattgtcggtgcaggagaagtagtaatagcagtgaggacgccgacttcatcctacagaggtcgccgacgatcacttgcggatagcggtggccttccggtcgtcacctactctatctcgagcatgctgctagaagtgaacaatattcgctgggaaaatagtactccaaaaatgcttacacttctaaataaattgttaaacgctagaaataaatcatacttatggacagagcgtggggggctgaagatagtgagaaacagaggcgaaactttgaatctactatagctgccgctgacgaaacagaggtgaaactttgaatctactatagctgccgctgacgcggacgcaagctgtacgtacaatgctcctcacctaaaaatgaaaacagaacggatgtagacggataatgtttatatcatattcgtttttataattttttttgccgaatatgaaaacgaatacgaacaactcagatgcagaaataaatacaatttatttaaatatgaataaggaacaaatataattggacacaaatacggaaaccattttttcagaacacggaaacaaatatcatcatatataattatatataattagcttgttttatataaaaatataaaatattttatataaaatatttaaattttaaataatattaatgttgtggactagtgtcaaaatctataaagtaggtcgaattagaattatgaaaaatagggtatgtttcagcagatatccgtacccgaaaaatgaactgaaaacgcgacaacgacctcagaggtgccgacctgccgggcgcgtgcaagtgccaaacgtgtgtgtggccacgagcgtgacgaacgcgatgacggttgagctcgccggtccgtggcgggcctcccgcgctgactgcacatgcttttctgccgcccttttgggtcccgcgcgttaagatccgcttcccctgcacgcctgcgcgcgtggcctgaaaatctataaaccgaccggccgaattcgatcggtctcactcacgcgactcggtctctgcagccggtgcagcccaaagtcttgcggactttttgtttcggtctcttctgctgatttttgcctgaacttctagaacggtggattaattaattaattagctcatctaaggccattttcaacccaataactagaatggtgtctatagcattaaataagctgccagttagaatgaaaaatgatgtgtcaagtgaataaatgagaaaatagaaggaaaccatatcttgcatgagacatagtttctacacaatatttaaaacatcatgtgatataagtagcattaaatttaagtatggaataatgctgtttgtattaaaagagtagtgtatagtactagtttcttgatatagagtttatgaaaactatgtctagtgtcttagatagggaatgggctaaagaagacgagtgtttagttaaccttcccctggtgtctggtgcagatctcccctatgccactgatcaacgtcgtctggcggaccaccaccacgaacactgaggtggtgaaacacggcaccgttcttcgtgctcccatttgtttggtaagcaacgtcggccgcagctacttcgtccgttccggtccggacggacagagcgactgcaacaggaaacgacaatgaacaggcgtggctcggcccatcccaacaaatttggcccacagacgaactggcggccgctgcattctccgatggccgctgcccgctacccgcttgctcagcaggtcaaatgaagggaaacttgcaggctatttcgttgcctgcacgagggctggctcgcacccgccgtgcaggcaccaccttgttttttttttaataatggaatataatatcccagcctttactcaaaagagttacagccaattattacatagtagttttcatgaacatagtgtaaatctaaatgaatagaacacaccgaagatcactattattgaaaccagcctaacgtaaggagatcataattattgaagtctatttgtaaatctccaaccataattggcaaatagttgcataaccgtggtctccaacttttggtatgcaaccttcagaaactcttcatcttcatcacacctttgtagttgtgcctaaaaccggagccaatgagttgccctgaaaataacctgcatataggaaaatgatggtgatttgtcaaaaaccatatcgttcctactcagccatattgcccaacaaatggcagaagctccaacaagtatcagtttactcattttcttatcaactcccaaaagccacccattaaaaatatgagatatgctaactagaagattaaaaccaaaagagaactgaactgctctccatagaaatttcgcaaaatgacaatccataaagagatgttgaatagactcattcttcaaaaaaaagaacacctcaagctgccattccagttacaccttgccaaattatccttagttaacacaacccctttaagcaggtaccacatgaaaattttaatcttaagtgtcaacttaagcttccaaatacacttgtttctctcgatatagccattattaattaaagctaggtacatagacctcaccgagaacaagccattctgatggaaattccatctaaaactatcagacaaatcattcaactgaatatgtactataaaggcacacaactgatgccaacaaacaagattctgaccaactaaagctctcctgaaagatacattaagcggaacatatcccataacagtggcaatagaagatgttttcctccgaacaattgcgtacaaagatggatatttatccttaaaagccaagttaccaatccatctatcttcccaaaatctgatttgttccccattattgacaatccaagaacccatatttaagaaagtacttttgacattcataagaccagaccaaaaatgggaatcaccttgtttcctgtcaacttgggttatagatttattataaagatatttcctcttcaataaatcatgccaaaccctatcctcattaattaacttaaacaaccatttacttaaaagatatttattttgtatctccaaattatgaatcgcaagaccccctggtccttgggttgacaaacaacatcccacctagtgagcctgtattttttcttatggtcatccccttgccaaaaaaaccgtgatctataataatcaattttacgaagaacccctttcggcacctcaaaaaaagatatcataaacatggctaaacttgaaagaacataattaatcaacaccagtctaccaccaacagataaatgcttgcctttccaactactaagctttttctcaattctctcttcaatacgtttccaatctttattagaaagcttcctaaaatgcatcggaattccaaggtatttaaaaggaaaggtacctaactaacaaccaaaaatattagaatagtgttcataacattcctttgcctgaccaacgcaaaataattcactcttgtgaaaatttatttttaggccagataacttttcaaataccgataaaatcagtttcaaattctttgcctgttgcaagtcatgctccaaaaagataatagtatcatctgcgtattgcaagatagacacaccatcatcaacaagatgaggaataaccccattcaagagtcccgcctctttagccctcttaatcaatagagtaagcatgtcagctactatattaaaaagaataggggataaaggatccccttgcctaagttggtagcctgtactaccctctcagcctgtttcaccttgtgcaatttttttttaacgactcacacgagacgatgcgaagttttattgatagagaagggaaaaattataagattacaaccctgaagggtcgtaaccaggaaaaagaaaaaaaatataccaccacccacacaccgacatctccaacacacaagcccaggagaaggctagcaccggaccggccgtcactaagcgtgaccaatcgccactagaccaacaaagggacacatacgagatttaggagatgccaaaacgacgtcttcaagaagagaagcgacggaaatccgccgctgccgtccgttgggactcaaaggagacaagaccgggctttcgcccggtaatcacccttgaggggtgagacagcacgacaacgccctcaggagggggaacatcgttgtcggtccggccaaggccggactgggttttcacccgctgctcaccacctgcgaatccacggctgacgcaccgaggctccaccaccacacaagctctgccgacatgtgggacccctgcaccagcgtcccccgccggtcagccttcgtgcgccgaagaccgcgccacacccaccggcaactccttctcacatctaggttgtctcctccactgccggccgcgcctctcgcgccaatccggccttcctccatcggccgcgcctctcgcgccaagccggcctccatctccgccgcccacgtctctcgcgccgagccggcctccgttgccatcggctgcgcttctctgcgccaagcctgtctccgacccctccaccaaacgatgccacgacggtcagatggagccgtctcccacgccctcgggtagccgtccgaggccgtcatgcctctggtgaccgcagtcacggtcaccaccaccacagctgctgctgccgaacgcccagccacctcgccgttgccatcctcacctcgcacccgactccttccccgccgccgatgtcgccaccgcctccacagtcacgaccaccgtcgccgctgccactgacgctagccatcgcctccgcagaccgccgccttgtgaaaattgcatcaccatagtcaggatgagagaaacgcgagaatcgagctttgctcacgagcctggcccgctcgatgcaacgcgtttgcatccgcgcaagcagtgctgcacccgcggctacagctcgttggttggggtaaccagggccgtacctacgaattcgaggccccggtgtgaaacacaatttaacgctaatataagtaggaaagacacaaaaataaattagcagtggagctctatctcagtgagaagaaaattttaaataaatgttagaaaaatattatgttatgatgtagtaatttatttttattatatggaaaaatggaatctttaatgcttagaacgcatgttcatatcatcgtcatgagctatagctctttgagttagccatgattgccatcgaacacttatcggagctaaaaaaaataagcctgttctagccaatgaacaaatgagtaaaagtgaaactttataaaaatggaacaagaggccttcaaatatattggaacgcattggcgtagattaaagaataaaaaaattagggcccctaaattttggggtgttcggtcgctcattttgcacaccctcatcgacggccttgggggtaaccactccaccccaagaaccctctctcatttgtcctcctcgttgctactgctatcctccgcctcttctcctcctcgggctcgggtggctagaggtatcagtgaggctcgtcctcttctcctccttgcgctcggccaagtagacgcggcaacaagcgaccaagcggcgtggagctcgctgccggatagatctggcaggaggagcacccagaggacagcggctgcaattgcatatgtgaaaatcacacggcccgacggtctttaccactgccgccacctttgttgtagtccgagtcattgccaagatcctctctcccttcatcagcagctggatctggccaccaatgacagtgtcacagcctgaattttcgtttcggatttataaattattaatagaatttatattaaatgttcattaaaatacaagtgaagttaaatgtgggaaataaaatttcctaaatataaagcatggctggatttaatttttattaaattctccatgattaattatactatctggatttttttcagattttttagagcttaaatcctaattgtaataatacaaagaagagttcagcaattatttaaatattaaattaatcattaaatgagctggtttcatttttttaagtactttgagtgcccaatattttcaggatttttcttgaaattatttgagcatcggaagtatttttaacaattcaaagatcatttcagtgattaactagctggttggcccgcgcaattgcaaggctagcacccaaacaaaatcatatattcttttagtatgattttacttaaaatttattaaatagctatctcattgtcttaagactttgaatgaccaaatcttatcatcctcgtgtttctagttatatagtttttaaaagtcacaccagttgctaccccttatgtcatcttcttctttatttgcttactcgatctatcactatttctattcattcttcttggaacctttaaaaattggattttatagtttttagagtttattgtcatgctgggtttcgtttttgtaatttctagatgtcccgttgaacattgccattatactcctctacggtctgttcactgtctcttctttttattgtcattgagattttaaaaatcaaagattattatcatttgggttcatttttactttctaaaagtcccgccaaattgtcagcagctttgccattgtactcctctacggctcgcccactgcctcccttctttattgtcattaagattttaaaattgaacgtgattatcattgtttttttcttttactttttaaaagttctaaacctttaaaaattggacttgtagttttattttttataatttttagaagtcccatcaaacgatgccactatgtccctctacagctcgtctcatgcctaccttttattgtcattgtgattctaaaaattgagcataactatcgttgtaattcattttttattttctagaagtcccatcaaccgtcggtggctctgcaactatactcttatacaccccgcccgctgcttctcctttttattatcactgagattttaaaaatcgaatatgattataaatggtttttttaattttctagaagtcccagcaaccgtcttacttatttgctttacggcatgcctgacgtccctccttttaatcgtcattaggattctatttagtgttttattaacaatttttatatatcgtatcaaccgccaccactttactcctttataggcctgttacttaattttatctcatcatgtgttttatatggtattttctttcaatagtctttatttttatcacaaagtttagttatttataaattgtattcctaattgaaatcttatttttcttttttctaatttcagaatttatttttttaaaaaagttaataccctattgtgttcttttaatgtttttgttttttattttcaatttcagttgtttcaaaattatattcctacttgaactctcttttattttttcaaattttggatattattttattttttattcaaaattttaattaatctcgtattgggttcttatatggattcttatttcaatattgcttatttttaattccgaatttcagctaattttaaattgtattcctacttgcactcttcttttattttcttgttctaatttcggatttttttattctgaattttaattaatctcgtatttggttcttatatgtactcttcttttaatattccttatttttaattccgcatttcagctatttttaaattgtatttctacttagactctcctttccttttctaattttggattttattttatttttattttgaattttgattaatctcgtattgggtttttatatagaaatttctttcaatattgcttatttttaattccgaatttcagttatttttaaattgtatttctacttggactctcctttccttttcaagttttggattttattttatttttatttcgaattatgattaatctcgtattgggttcttatatggaaacttcttttaatattgcttatttttaattccgaatttccgatatttttaaatcatatttttacttggactctctttttcttttttttttctttttctctgattaatgtggtaatttctagccccacagtgaacgcggtgccttctttcaaaactgttttaataatataattttaaaaaagttaataccctattgtgtttttttaatgtttttattttttattttcaatttcagttgtttcaaaattatattcctacttaaactctcttttaatttttcaaaattttgatattatattattttttattcaaaattttaattaatctcgtattggattattatatggattcttctttcaatattgcttatttttaattccgaatttcagctaattttaaattgtattcctacttgaactcttcttttattttcttgttctaatttcggattttttttattctgaattttaattaatctcatatttggttcttatatgtactcttcttttaatattccttatttttaattctgcatttcagctatttttaaattgtatttctacttagactctcctttccttttctaattttggattttattttatttttattttgaattttgattaatctcgtattgggtttttatatagaaacttctttcaatattgcctatttttaattccgaatttcagttatttttaaatcgtatttctacttggactctcctttccttttctagttttggattttattttatttttattttgaattatgattaatctcgtattgggttcttatatggaaacttcttttaatattgcttatttttaattccgaatttccgatatttttaaatcgtatttttacttggactctccttttctttttttttctttttctccgattaatgtgggattttctagcccccacagtgaacgtggtgtcttatttcaaagctgttttaataatagatagatagatagatagatttaaaagaaaaagaagttcttttcctcttcctagtattgggccgaatttggcccattcccttttctttcctcctcagcctacagcccgtgctgctccctcagccgaagtctgtttttgctccctcgcttcagtgcatcttcaacctccagccgcctctgtcccgtgcgcatgcactggcgcctcctccttccaaatccggcctccccgttactcctcattccaaattagttgcgggaatggaatcctctcaatctcctctacaaaatccccaagaaatccccaaaagtttttatggaaatcctttccgatttcgcggttcaacctttccttttcccggcgaggatcctaaactttcccaagtttttcccgtcgatgtgggctcgatcctgggctcccatggctatatatagagccccctccagctcctctttcggccgccacctctccctctctccgccgtcgccggaaaccttctccccgcgagcgccttctctctccgtcgccggtagccgctccagccgccgtgcgctgccgcctcggtcgtcgccgctctgcgccgccacctctcttggctccgcaaatcccagccgctggttattttgtgccaaatcccaccggaggtagcccgtcgtcgtgaaccggagcgccgccgtcgtcgctgtgcctccagccgcacgttcgtcgtcatccgtcgtcgccttcggtcgccgtcgactccattgggttcgcaggaacaaggtgaagcccggccactggtttttcttcatcgaggaacgctgaaacgccgccgccatcgctgacccgaccccgtcaccgcctctacctcgctgccggccgtctgccgtcgtcatccatcgtcacgccacccctcagtgagctttcctctctcccacgtcgttcaccggtgtagtttatcactagggtcttaatcccatctaatctaatcttgtttggccctagcgtcgtcatcgtctccgtgtgttgtcgtcggaccgttgtcgtggcctcttcttctcccgtcgccaccgtttcctggtgaggccttctctccgattcctagggtagatgtttgtgtaagccacatgtgtgtcgttgtcgctgtgccgttatcctaaccctagccgcgtgcctccgccgagccgccgccgcctagctgagcaaagtcgctttactgtcgctgtgtcgcagctgtgtgccgctttaacctagctaccgctttagcccgttgctcggtagtcgagttgtctagccgtaggtgcaaccctaggtttcaaccggcctatcatttgccgtatcggggctttaccgtgaatcgtgtctagcccaccggttttgtcgcagccgttgttgagtcgttcgttcgttcgttcgaacaaggtgttccccatgttcgttcgttcatccgtgttgagtggtcctttagttcagagccgccggttctgtttgccggtttcggttgatcatttgggtgatcctgtgtcacgtaaaattgactcgttgagtttgtatgtcgtgaggctcgctttccagatcaatccaagtcatccgatcttggtcgactcggtcaagattaatctcagccgtccaaaatcgatataaatccgttctctcttttcagtggcatattatttctgtttaatatatgtcatctaccaaatataatctaatctatttctagaggatgtttccaatcttttatcttagttataaattatttgtaaatcgtttaattaatttggaatagtgttttctttaatagatttaattggaattaaatattgtaaaattcataattaattcatatgaaaccggaatgaggccgttcaagtctcataattcatcttaaattatgatctacttgtttatttactttatatgtactgtttatttgttttttattagtctttttccttgttttgcgtgttaacttgtcgtttccgtcgtttcgaaggatcgtgagtgcgtcggaagttttcaagaagacttattgaagacccattgttgcaagtcacacagatcccaaacacaaatcctttgaacatgttgattctctatttattttaaatgtgtatttattttcgaatgtcaccgggtggtgtgaacttattcctttgttatggccaatttgcattgattactctttctttttttttcggggaatgattaccgtatttcttgattaccttgggttataatttgactagttggatttatatattggttcaactgttttagatataattgcttagccatgcttagaaacattagcacacgattgggataactaatgattcactattacttaatgatggatatttaatggtagctcacgatggttaatcgtgattgattaattaattaatttgccaactaattaaaacttgataatggtgggttgtgagcacatggttttgatggtcgtgctcatgacaattaaggacaggttcacgagtttcggttgtgaaacattaaccgtgccaaccacaagctagcatgggcaacggctttattttttgtatagcatggttcattgcggggcaccagactgagaagtggtggagataagcccacggggatcgttggggagtccatgccttgttttataagggggtgattatgatccaggaacgacgcattgctttgagttgtgttgtgcgaagggtactgtcacgatttccccctttgcagtgccatggtggtacttcggagcatggtaacatgtgtggaatcatgtcttgtgggtacagtggtacacatctggccagagtaaaactattcgaatagccgtgcccgcggttatgggcaggtctaacaatgtctttcgtgattagtctcacacttctcaccataataaatgatgctataactggtaataatttgattagctcctggtttggaatggtacattcctggtttggagatagatctgtacagccgggtatggttgttcaggtttggttgggcctgtgcagcatgggtgtgctgttcagtgttgattaatattgatgattaattactttactggtttacaattctcaaatgtttgctaaatgctgcttttgcaaatgagccctatattatgccattctttggtattcttgtgtacttgcatacttactgtgtggcttgcggagtattccatgtaatcatcttgtaataatcaatcaaacctcagttgaagagaagtcccaaaggagaagacgtttggcttataccccagttgagctgcctgtgggagtggagccggagtttcgctagatcgtttatccgttgctgttttctcttttcttttgtaagtatgtaacgttactattatgatgaatctgtatattaaattgtcagtttgtgtacctcggctgatttctggacgaggattttatgcataaataagttaaaaattactagtgaatttctaggtgtgacaaacagcaagcagcagagcagtggagggatggatggagcagtgaagcaacggaggggatggagcggcatggctggggcctggggatggggatagaggggatgtggaagaagatggcagcacggtagacgggaaggtcgccgaccggcgtcaatggcgatggggatcgatgatgacatccacgaaaatatttctttttctttttcttttttgtcctaacctgttagcatgtacgtgtataaaggtgattaatgaaagagtaatcatgtgattaatttagccagtttttccccacatttagacgtgtaaaacgattttataaaatttagtcaattgaacattttttttttgaaatagatcaaattttcattgacccggctttggaagaaagcccaaacagtatacagagtcttatacaaacacagaaaacaaagctacgaaacaaaagacttaaaaaaaaagtcggcacataacactggttctctcagaagcattccataccttgataacacctcacattcccccaggcactaacccctggtacaaaagacagcaaaaaactgaagccaaaagtagactcaaattgtcacaggaagacgacatggcttcaattgttgcagtttggccatcagcagctcacaccatcctttcatagtagcttgatctccttcctttagcatgatacaccactgctgaataaaagacaaagctttataagtgatttgcaaaggagactttgccaaaatatttgagaaaacccagtcattcctaattagccaaagtgcccagcacacactagcaaagagcatcacccacaccccctggacattttttcttttcattaaccccaaacaatctcttatattcataggactaatggttagacccaaaacatctctcaccacacaccagtaaagacaacaagaagacatttaaacaagatatggttagtagattcaatcttgccacacagtttacagaattcatcccctccctgccattttctcttaatcaactgggatgcacaaggaagcctgcctctgtctgccatataaagaaaatctttgatttttaaaggaattttacttctccaaatcttcatcttttcaacatctcttataccccaaaagtaatcaccctatacatagatctagctgagaagatctttttgttattgtatggccatattaaaatatctttgccctcccctagggcatgtttattcaatagatttcttaaatccttcagatctgcctccctggtagtgtccaaatttctcctaaaattagaacaaagccccaggatttacagaaaataatggagttttaaaattccaagggcgtatatgtgtttcagataaaaaggaaatcaaggataaaatattagaagaagcacatgattctttattttctatccaccctgggagtacaaaaatgtatcaggatttgaagaaaatattttggtggtctaatatgaagaaagaaattgcagaatatgtcaatttatgtgaagtatgtcaaaaggtaaaagcagatcattaaagaccagtaggattaatgcaacctttgcccctgcctgaatgaaaatgggatgaaattggaatggattttattataggtctaccaaagactaaaggaggttatgatgctatatgggttatagttgacagattaactaaggtagcatatttcttgccagttaagcaaacatatgatggaaacaagcttgctgagttgtacctcacaaggattgttatattgcatggagtacaaaaagaattgtctctgatagaggaacccaatttacatcaagattttggaggagttttcatgaagctatgggtacaaagttgggattcagctcagcatatcatccacaaactggggacagactgagagttaatcaaatacttgaagacatgctgagagtatgtgttttggtttatggcctagtttgggaaatttgtttgccattcgcccaattttcttacaataatagttatcagtcaagtcttgggatggcaccatttgaagtcttgggatggcaccatttgaagctttatatggtagaaaatgtaggacaccacttaattggactaaaacaggagaaggacagttgattggtccacaaattgcacatgatgctgaagcacatgttaggattattcgagaaaaactcaaaacaacacagaatcgacaaaagaattacaacaataatcaaagaagagacttaagttttgaagttggagattttgtttatttaaaggttatgccacttaaaggagttcaaagatttcaaatgaaaggaaaattagcacctcgatatattggaccttatagaattgtgcaaagaagaggtgaagtatcatatcagttgcaactaccagcagaattaaccggaattcatcctgtttttcatgtctcacagctcaagaaatgcttaagaaaaccaacagaacaagtacctctggatgacattgctttacagacggacataacatatgaagaagaacctgagaaaatattggaggtcactgaaaggaggttaagaaatagaggaattgaattttgcaaagtacagtggaaaaatcactcagaagatgaggcaacctaggaaagaaagtctgagctggaaaagaaatatccgcacctatttgctaactggtaaatctcgaggacgagattcctttaaggggggtagaactgtaacagccctaaaatttgacaactttttaaaaccaatttagtttgctttgattctctaaaaatatgaccgtcgagttagacatttatttaaaatattattttccatgcttatttttttatgtttcttttctcgtttaattttgtcgcaaagtgcatcttacacttcaaataactcctttgtatccaaatttaattctatcccgaatgtcggactatctaaattccgcatcaattcaaatcctatctattttaatcttcctcatgtttttcttttctctgtttccaccttaattttctttttccctatattttttccctttctctgttttctttctttcgtctcctctactcggctaggccgagccagggcctgtgtcaccccgtgttgtcacgcgccgatcccgcaccatgctcgcgcacgctcacgcccagctcgtgccagcccgcgtatgccacacgctcgcacgcgcgcacacgaggacgaacgacgaacgaatgcccagatgacacctccagcttcccgcctccgtaactccttcgtccctcaactagaaggctcaagaccggaggcaaaagaaccgaaatttcgacctctttcacctcctcaaatccgccccaactcccactgcctcaatcgtcgtcaccggaggaaaaatccccaaaaccctaattttgcgccattgattgagctccaaaattcgtcgcatacgttgcaaatcttctgaaattgaaggtacaaatggattctccatgccgagtactccctttcccctctctttccccttcaaatccatcgccggaacatcgccggcgccgcctcccgacgtcgccgctctgttcggccgtcgccagccgtacggcgtgccgccgctgccggccgccccaggccgagccgccgccaccaccgcgctccccttgctccactgatgctcaccatggccgccgcccttaccggagttcgccagaatcaccgccgccatggccgccgccgcctccagctcctagccgccgtcgccagcctcgccgccgccatccacgggaacggagtcgctgtatcctgtagatcgcaaaaccggtgcctccttgcccaaaatcggccatctccacaatcggccagggtgttgccggccgttccggtgcagagcgagagagaaaaatcctttttctctttctatcaagttaataaatcataaaaatttaccatccgtttgacctcgaaatcgaaatccgagacctactccaaactcctagaattattccgaatccatccgtctcagtttcgttgcaatccgagcacccgttgtcgcgaccctaattttagccctagggtttgccgtttactgaaattccaaaaatccctaaaattatttctttaaatccttttcacccattgttgcactttgtgataccatttgttttgtttatttttgtttttctattatttattgtggtgatgattgttgcataaatagaaaacgctgacgttggtccggtagtcgaaacgagtgaaatctccacgccagaaggagacggtttgtacgactacatcaagcccgaaggttgcaagacatgcaccctcccttgaacaatttaatcccggtagatagagttattttagtagcgtacttgtcctttggagtacgatagactgcacaaattcttttaaattaattatattgctattattgcattatattttcagttgttgttataaataccttaatgagccttaaagtctaacaagcttaggataaaatttgataaacatttaaacaaaatgttaattatttagcatgctatcgatttaatatggatattattatcattgcatatgaaaacatgcttatggaactatttatggctatatgctaagaattgttgacaccgcatatgagcgggtggaacacatgatagagttcatgtgtttggtttcatggacctgtttatggtcataatgggtatatcgatatatttatggttatttcttatttaaaattgatataataattaacccccttgtgtcaagaagaatgacatagtttcgcccatccacacaatcgatttgtcgaacctggccgtatattgctccaattgattaaacttctgcatgcctttcggtgtattggccattagctttcaagtgtgtgaagcaaagtgacatgtttcatgtttatatgatttatatatgtgggctcgatgggccccgagagttcagaactgccctatgggcccatgaagttctgggctgcccatcgagtaacgaacaatgataagtggatgcggaggtaggttggtacacacctcggaccggatcactccgagcaacatcccgagcatcctttaacttactggtagaagggagagatatatggagcaatattacaccttgttacttttcagcctagccagctgtgggtatcatgtgggtaaagctgggcaggcactgcagagtcgttgagtattcgaatatgccgtgctcccggttaatggagatgtgtctatgggtgattccagattatgggcacaagttaaactaaatggctattaattaatatggttaacttatttattacttgacgttctattcaagttatttataagtaacatttatattgttatgctcgttattattgtttaaattaaatgttcaatagtgttgtttatatcaaatgtttattaagttaggctctatgaaataactgttaaggttagggtttaaaccttctagctctcgatactgcatgttttatattgcaattattgtatttattatcataagcatgtcttgctgagtaccttttgtactcataaatgggttcagatcatgaggaagatgcttgtggagaacctgctgatctgttagagtgggatagctatggtttctaggtcatcctacgctcaggcagttcctggggtggagtctagcaatttatctgtttgtagaaataaggctttataggccatatatgtaatggtttgtatttatgttgtgttgtgaactaagtattgtataatcgaagtttatgcttttatatcatttcatgcgtaactgaacatcctgtgcagttacgtattcgtggggcaccatgactttatcgggtgtccccacaacaagttcattgttttagtatccataaaccccaagccaccataatcctttggtctgatcaaaccttcccatttcatcatatgatacttcttttttcccccaaggccttgtcaatagaatctccccctcaaagaatctattttcttatgaaactccctaggtaattgatataaccctataacatacattggggcacttgacagacatgaattgattttaatttctctcccaccatagatgagttaaccactcttccaagactgcaatctcttttccacattttgagttatttgtctgaactccctcatccctattttctctgtatgcataggcaaacccaaataagtgaaaggcatgtttcccactttgcagttaaacatgttggtaattcttaactcctcatctttctctacacccatcacatagatctcacttttctgataatttatcttcattcctaacatctcttcaaagcagaacaacaagaacttcaacaccctcaaagcagaacaacaagaacttcaacaccctgacatttgaaactccttccttaatactccctccatctacttttgatagtcatatttcatcttagtacacagaccaaggataagtaattctacttatcatccatttaaacatgttactagtcatttctcgtaaacatgcgattcattaatatttacattttcaatggccatgtagccaatctagtgtggaagaatggagagtcatgcattaaatccgagaaagtcattatgatgataggttgttggattgaaatatgcttatcaaaaataaaattttcatatttggaaatatgactatcaaaagtagatggagggagtagtaaataagatggtatcatctgcatactgtaagtgagtcagacctctaggaattagctcaggaatcaaaccttctaaaaccctacttgtttttgcctttttcaggatagctgccaaagcatcccccaccaaattaaacagcaaaggggaaaggaggtccccttgcctcaagcccctgaaagtcttgaaaaaagggccttgatccccattcatattaatgctgacattacccccccccccccgagattttcttcacccaaccaatgaactcactgctgaagttcttcttcctcgtaacctcatatagaaagttccaattaaccctgccataagccttttcaacgtcaattttgaagattatccctttttctttttttcttttcttcagctcatgcaaagtttcatgtaagatcacataaccttccaaaatatttttaccaggaataaaagcagtctgagtccagcttattatcttctcggccaccttagccaccctctcatttatagcctttatcaagatcttaaggataacattctgaagacagattggcatgtattgtttaatgttgtttgcatctgctaattttggtaaaagagtgataaccccataatttaatctgtcagtatccagattccctttatgcaattcatccaacatttccttaactatccccctaaattcaggccacatctcttatagaaacccacagggaagccatctggccctggagcagtgtttgccttcatctaaagtattaaaagtcaccccggtctgctcctcgctcagcgatttggcctggcgtggccacggccgcgttgcggcacgtcagcgtggctgcaatgaggagggttttggcgactgctcgtgaggccgcgtcggcgctggaatttttgcaataaaaccctcctctttgtgcgtttttccttgttcatccttggtgtgctgtttttggctcagcaatgtttcgtttagccccttcattttatgtgaaatctgatgcgggcgaggaggagacgaggaaaaaggggcgcgccctaaatcgtgcaggctgggggtgtattccccaaacttgtctttgcacagcgctccctctccccttcgcgagagcgccgccgcgtgagaggggaaaaaacgcggccgctacgctccttccatctttctcgtcggatgctgcttgtctcctggatttggggcttctccggccgctgcctgctctgctgcctgtggcgctactgtttgccgtttgtgggggctattctgcgtgcgccgtgttgtcggacaggattcgcggccggcgctcttcttgttgcgccgccgtcggcgcccccctcgaaggggatgcggtgggtgctggatggcgcggtcgcggtttggcgctgtcgttgttggggcgctgccgacgcccgctggaaggtagcctgtacgtgctggatgggtcgggcgccgtttgcttgccggcggatctgctcgcttagagccgacggctggtgctatcagggaggatggcggatggtgtcgtcccttgttgttcttccatggtggttagctccacaggttgcctgtctctctttcttcacctttttcctctgtctctgatctctgctttagagctgatggccaactctgatgtgctgcgtgcaggttgggctcggtggtggcggccgcggcggatggatgccgatggaaaggtatatatgcaacgcggccgcccgttcatgtttgctcttcttccccagatatgttcaatgtgttctacaggctgaatttgcctttcgcatgcttgtctcgcactgttcaccgccggctttcatgctgctcaatacctaggtcaaccgcgactacgatcctgatgactttgactgtttgtgcttcttgctgccctgcccgtttgatgttgatcgtgtggccgcgcttgctgatggttcatggcactgctcggtgcgcctcttctggctgtgtttggattccagtgatgggaactaattcctctcgcacggaaaacagagcggttcattagcgcgtgatcaattaagtattagctaactttttttaaaaaaattgattaatttgattttttaagcagctttcgtatagaaacttttttgcaaaaaacgcatcgtttagtagtttgaaaagcgtgcgcgtggaaaacgagggagatgggttgggaacatggggatgcaaacagtcagatatcgatttgctatcgctgacatgtggcccttaccgtcggcgttcgtctcatccacaatatgagctgtgtctatgtagggaaacacaactatgcatgcctactcttgtgcaccgatcggcgggagtggggctgtcaggttagcttgcaagtgcggttgtcaggttcaaatagttggggcggtgtgctgtgattgggtggggttttctcggctccatcgatctgtattggtgcgtgtggtctatatgctcctggtgactgaattgtggggtctaattggatgtggtgttagatggttctctcatggtgtatgatccagcctacttccttcatcgtggaagatgtgttaggatgtctgactttcaggtggggttgggtgccatggggtccatgtatactcctttcgtattggtaggtgcgcttgctgctcttagatgtgctgtggttttagtttgtcctttcttctctgctatatttgtttgcaggtgctagcagccatcttcttttctcctcttccttctcaagctttcatcgtcgtttccactgctctatcgttttcattgcttctttcgttggttcgatctacacgtgtagtccgcatctgtttgctgtgatctttgatcgttcagtatggcagggtagggtgtgaggaggctctcattttgttctcatctttattcgatgtttctcctgtttttatgcctcctgatcattctttggtttttctcttggtttttagcctatgggatctgcatgagctggatcgatccttcaagggttcttgattggttttgccaaggaacgttggtgctgctccttcgatcgaggaggttagcttcttcatcctgtgtatgctttccatcatatagactgccctattcactgtattcatcgtgcattttctttagcatgcatgtatgctaatggtcgtcttctcttgcgcagggtcagccaggctctctctttccgttctttcttctatttcttagccgacagctttgtcctctgtggatactcttggtcagcttgtttctgttgcgttctttgctgattgggtgttcgttcatacaaggtattttcatctgtcgtgtgctccctctcactatttcttttttcatcttattcattgttactcttctacattgtcttttggttctttttgatatcgttccttcgtgcttgtttgtatcttgctgtgtcggttctttggttgtcagatgtctaggacgttgcatgtctgctgtcgctatcatcagttattgtaccgataagggacacctcgatggcttttgttacttctgcataactaactccgcaggcttctcttccatgctttctttctttatattctgtcctttacagcctgtagtcatgtcgtttccctctgcctcacttttgattctgctgcattcgttctcatctttagttaatttgcagttgctgttccagggttccctctttctgtctttatatatttgatgctgttagctcgcttcatccccttgtagatattgctgcactatggtgcgttcttgtggcctgatcttttattgagactcaaactaggcttaccgttgcatggttcgcacatgatatgtgtgccctttgtttattttttggtttgagatagataattgttttcagggtgaggtagccatgcaagattttaaaaacttgatatctgctgttaattattggttttttatttttggtttgagattactaattgttttcaagctggattaaccatgcaagattttaaagacatgatatgcattgttaggttttgattttgtctggcgaaaaaagaagtatgcctgattaatctctgcagtgcgatctgggagcagcatatttggtgcctctatgttctcttctgtatagcgcagggtagttttccggcgaattaacgagtatttaatttgttattgcgggtaccagatacgttgctttcctgctttcatcactccttcgtgttatatgtcgattatggtcggtgcctttgttttgctattcattcatactgatatttctcatcctatgtttttgccagcgcatctgccctgttttgtaaacaaagagttcgcgcgtactttcttaaactattaaatgacctttatgcttacatggcatggccattgtctgtttaggttattaggtttttcctccgtccttgtgatttggcttgtctgtttatgatattgtggatgatggccgatcatatgtggcttagatctgatactattttgcagcttattgtgtagattaataccatgtatctgctttatcaattgtttggtctgtatatgactcctgattgtgtttctttacatcctgcagggctaattgtcatattctgttgttgtctctgggcctacactggatcgcagtcttcttttccactgttccgtgcaaggtaactatctccttgctataattggatttttgttcctgtatatgaatatatgaatttatgtgcttcctttttagctcgtgcatggattgtgtgtgtaagtgcttgttttgtatgcctggcaatctgtgctaatgatctgtgatagaatgtgcttagactttatgcatatgtgttgtctctgttggggcatgtaacaaaaatgacagtcagcgcatcatcttttggtagcaatcgcacacgttagcttgcacatggctatctttctgctctctttcctcatatttcaaacattgctgcctgtaacgaatttcttttccctgttctctctaggctttatagggctaaggtagttttctgctctcttcttctccatctcatcttttctgtcttccctgtgctattccttctgcctctgttgcacactttacttccagattatctctttgcagtgttttagggatgccatgaaactctttatttattcctattagtctgcgtatattgctccatcagtctcggcaaataccagaccaccgtatggacagggttcagagagttcgcgcgagtcgagagaaacgagccgcgaacattttgttgcgctcatctgcgatgcgcatagaaagcgccataccgttgccagcccaacctccccagattcatcgagccaaaaagccacgttcgttgatggactttactccagagctatccaagctacatagacagcaccggtctttgctgcgttcaaagatgcctcctctccttgcaccacagaatggtaatactgtactgaaagcacacctaacagcgttcattaccctatatatgagaagctacggcactaaaatatgattgcaatgttcgttaattgcagctttaaacagcagagcctccggtagttcatcaaggacagataaggaatacatccaatcattgaaaggtccgtgttttctgataaaaaaaataaaacaatttatattggccggttaaaagaaatacattctcagatatgtattgtgcagcatcatacccaggacggtcgtactatggccctccaacacatgagtgcccctactgtggtgcagtcttctggtttcaggagagaattaagactctatctgctgtgtcaaagaggaagaaagtttacaacctatgttgtaagggtggcaaaatacagctgcatgctttcaggccaccacctgaacctctcgctaccctattgaaatttgatggcgatgcacgatccaaaagatttctgaggcagattcgatcatacaattcaatgtttgctttcacttcaatgggagcgactattgataaatcgatcaatactggaaatgcgccttatgttttcaaaattaacggtgttgtgcaccacagaattggtactcttctaccatcgcatggtgcacgccctaagtttgcacagctttatatctatgatcctgagaatgaaacccaaaatcgactcaatatttttgaccgtgaccgtgatgacaacgataggccagaccctgaaatcattgctgccttatcacgcatgcttgatagcaacaatagacttgttcaaaatttcagatacgttagagaccttctttctcagcatggtgatgagaaaataactcttcgcttattaggctgtaatgctagagatgatgtccagtataaccttccaacaagtactgaaataactaccataatagttggtgactttgatgcgaaagaatacaaatttgatctgctcgtgcacgatagagaccacggaatgcgtcaagtttcttccttgcatccatcatacctatctttgcaatatcctttgctatttccctatggtgaatctggtttccatctaggcatcgaatatagtaattatgatgggactggtagaaaatatctcacgatgctggagtttcatagatatctaatgcattataggctaaatgaacctaatcctttcacatgctatggccgactgagtgaccaagctgttgttgatgttttttctactatcgaagctaatagactacagtttataatcgatcatcaaaaggaattacgtgctgaatctgtagaagaaattgtagatgtgatagatagaggtgttaccgatggagattcagttgggaaacgccaaatacttcctgctagctttactggaggcaggaggtatatggtcatgaattatcaggacgcaatggcaatctgtcgcgtctatggttcgccttacctatttgtgacattcacatgtaattctaagtggcaagaaatcgctgaagcaatccgatttgaacccggccagcagtcatctgatagagcagatgtaattgttcgcgtgtttaacatgaaagtcaatgatttcatcactgatattagagagggaaggacttttgggaaatttcttgcaggtagcagccaaaatttattttctgtttagtgtttcaccaatattttccttatagttcctgttctttaaacctttttagttctgtacactgtcgagttccagaagcgcgagctgccacatatacactgcttggtttggcttgcagcatcaactgctgacatctcagcatctgtgatagatggcttcatctctgctgagattcctgacattgaaaccgatcgactaggatatgaattggtaagcgagtttatgatgcatggtccttgtggcgatgcaaacaaaaaatgtgcttgcatgaaaaacgacaaatgctcaaaacattatccaaaagactttcaagatgagaccattattgatgaatctggcttcacaatatacagacgacgaaacaatggacggtttataattaaaaatggaattcctttggacaatagatcagttgttccatacaacctgaagttgcttaaaacatacgaggcacacataaatgttgaatggtgtaacaagtcaaacttaattaaatatttattcaagtatattacaaagggacaagaccgtgcaaaatatactttgagacaactgcgaagacatgaaatatgtcaccaaatcatgacctcgctcctcctaatgaaatactagaatacatggatggtagatttctttcgacatgtgaggcgtttcatcgagtatttgagtttgacatacactctagagtgccaccagttgagcgtctagctgtgcatttgcctgggaaaaactatgttagatatgagccaggttctgatttgcgagcggtgctgaatagccctggtgcgaaacaatcaatgctaactgcatggtttgaggctaatgcaaaatatctaagtgcacgttcattaacatactgtgactttccaaaggaatggtcatgggactcatcatctaaaacatggcgtgcacgaacaccagctgcgaagataggtaggatatattatgtgcacccaacctgtggagagctatattatctgagaatgttattaatgatcgttaaaggcgcgcaaaattatgctgatgtacgcacgtataatggcaatgtgtgactgtcattctttattgctctgttggtaacgtacgatcattgtttgataagtattggctttacatgactgatgacatccataacaggctaaagaaagcactagataatccacaatgcatcattccacatgagcacttgctcaatctcctcctgcgtgaacttacaactgtttttgcaaacagtggcggtaatataaaagattttgacttgccagtacctacatctaccgcacacatgcccgacagtaatagattaatcgatgaagagcttgcagctgatccacttatgatgtccatgcatgctgactctctgatagcgcagctaaatgatgaccaaagaaagatctttcacgctatagtctcctcagtgactgcaaaccagcctagctgttattttgtaagcggtcatggtggaactggcaagacatttctatggaatgctatcattgcaaaacttagatcacagaacagagttgtgcttgctgttgcctcatcaggagtagcatcactgctgcttccaagaggtagaacagctcactcttgattcaagattccaattgacattgatgaaactagcatctgtaatataaaacgaggaactatgttagctaacctcctcattgaaactgcgcttattatatgggatgaagctccaatgacacataggcgctgttttgaagcattagatcgcacactccgtgacattctctctgaaacttctccagcgaattcgatcataccttttgggggaatgcctgttgttttaggtggtgacttccgacagatattacctgttgtccctaaaggttcacgtgccgctgttgtaaacgcatcaattacaaattcaactctatggaaacatgtcacgctattaaacttgaatataaatatgaggttgctcaatcctaccctttcacagaacaaaaaggatgaaatgcatgaatttagtcagtgggttttgtctgttgggaacggaacattgcctatgactgcgagggaggatgatgctcagcccacgtggataacaattcctgatgatcttctcattatgaccaacgacgataaaattgcagctattgtgaccgaggtataccccaactttcttacatcatatagagacccaacataccttgcttcatgtgcaattgtttgccctaccaatgcagtagttgatgagttaaatgattatgttgttggtttagttccaggaaattcaacaacgtacttaagctgcgatacaatatcaaaatgctctgagcaaataccggactttgacatgttatacccacttgaattccttaattctattaacgcaacaaactttcctacacacaaacttgtcttgaaagaaggtgttgtcgttatgctcctccgaaacctgaaccagtcagctggcctctgcaatggaacaaggctgttagttactagcttaggtcagagaatcttgcagtgtatcatactgactggatcaaacatcggtgaaactgtttacataccgagaatcacattaagcacatcaaaactgaaatggccttttacactgcaaagaaggcaatttccagttcgggtttgttatgcaatgactatcaacaaaagccagggacaaaccctcgaccaggttggcatataccttacaaaacctgttttcacacatggccagctttatgttgctgtttcaagggcaacaagtcgatcaaggctcaagatattgatccagaatgatgatggatcatgtggaaaccaaacaagaaatgttgtttatgttgagatacttgcagcggtgcatcaagcggtcatactctcgctatgtttgtgcatttcttgtgtctttgctccacttgtcttgtgctgttcatgtgatagtggacattctttcttgctgcaggctatgccgcttcagatgtagcctgcttttcctcgcaagcaaaacattgttcctcttgtatatacattttggaatagcttttttgctcacatatataccatatactatgttatggctgcatagcctgcccgttacacttaagtacacttcatcttgacttcctgtctcattccactgatgttccctgtttatatacactcagtatctttagtgtttcatcttccagatttccaatggcgtatgtgcatatttcaagccttttctgtggggacaccaacaagcaaataaaagctcgcgtatccaggctatggattttccatgatatgaatgatgagacaaagatctaccacaccaaccttgtcctgctggatgaaatggttgttgtctacttactgcttctttggtttactttcactcttgtatatatcttgtggcacactaacaaagtattttgggttaaaaatatgcagggcagcagcatacatgttcagatttatccatctgtgatgaataggtttaagtctgtcctacatgaaggaaaggtttactacattgactccttctctgtcaaatatgcaaacaggacatacagaccagtcaccaatcttttaatgatcttatttaccaaatggacaactttagaagaatgcattgatgttcttggtgactaccctggcataacattttcattgacaccttttcaagatatcccatctcttatcgacaaaaatactttctacattggtatgctcactttacatcatgtattcttgctatgtttctttcacatccttgtgtccctttattaaacttatttgctttcaaaccagatgtcatgggtgtgataactaagattagtgacacagctactgtgcgccctagatcaagcaacactaatagcttgaaacgaacaattcaaatctgtgaagcaaggtcagttacgctatacgcttactttccttttgatataagctgtcctagcctcataacatgcacggtagtcatcctgccaagctcacagtatctaagctgaagaactttttggccacttataaaaacagcaattcaacactccatatcacgctctggggaaagacagctgctgccttcaatgcagaagaagtgcataaggctgggcagacaaggcctcaggttgctgtctttgttgggacacttgttagaaactatacaggcataggtatatgtctacaaacatataaaactgctattctatccgtctaataaatttacaatctataaccatttatatgattatacacagggctaaccttaactggaagttcaccatgcaaatggtatattggtcttgacatggttgaagcgcttgagctaaaacaaaggtagtactgtcagccctcattctttctccagtgcctatgcaatcctctgcttacaaatataggagtagtacaccacttatgaatttgtctttttccttctagctttgaagcaaatttccagcctatcaaatgggtcgaaaatgctgcagcggggttcaaccaagacattccataggaaaaaaccatagaacagatccttgctctcaatccacataaacatcaggtttcttttctgcccatttactactgaatacattcttatcctgcctatctatcttttcaatgaagccatccttgttgcagcaagaacgttttatagtcaatgtgactatcaaagacatagcaggcgacagttcctggtattataattcatgtgatctctgctacaggacctccaaaccatatggttcaacatatagatgtacaagctgctcatatgtaggcataccagtgccaaggtaaagaatatacttgagaggctatatccatggcttcgggaaactctttaaaatactttcatttaacatgcagaaacaagatcctacttaccgctgctgatgacactggcaaggccacgtttattctcttttgaagaacagcacagcgtgtcatacgtaaacctgttgagactcttattgaccaaaatccaccaaacaaggaatttattccagacgaaatcacagccctcatcaaccagagctttgtctggaatatcagcttcacacaggatgctttcatgaagaaccaagaatccttgcaagtaaacagcgttgtttcatcggctggtccaatacagctgatgctgtctaactcaccaccaccttcagagcaaacgttggctattatcccagcaagctcaagcagctctgtagagggagcatcagcagaaagcaaaaaaagcactgaatcaaagataaaggccagggcaaaggaaactctgttagcgctacatactctagtgacaccagtgaggcatattgttaggcctcgatcagagcagactccaactagcaagcttg

SEQ ID NO: 60008 - DNA, 1323 bp, Oryza sativa
cacaattatggctcttcagagttcagagactgactgaatgtcacatttcagcagctaacattttcattttcagacaacaaaagaatctaccatgcattaatttcatttaagacaacaaaactcagcagtaaaaaaacttccattttctcaacagggagttctctaaactttcaggatttctatgagcagaataaactgcaacctctgaaccaggaacaataacactatggcacgtacatcttgggaaagattcaatttttgaatggtcgtgagaaatatcaaataacacttaggccaacatttctaggtgaccaaccaacatcagggaaaaaaactcaaaaggtagccgtgttcttgcagtgccaagttggaatccataccattgggagctgtaaatggcacaagaggagttggatatggaggcaaggggaaccggcattgccgtgccagctgcctgaaccgatggcgtcgcttgtagatgcttcgcagattgcggcagcagtcaggtaactgaaatcacatttcctttccctacatgaaagaaaccctgcagaaagatgcaagagaagctgatgagaaaacaagatttcagttctgaaaaaccagtgaaagctccaatggaaaattgttagaacatcacttcagtttgcaacaagaagtttcaggactctttatgcaacagaaaactggtttagcaatgcacatcagtagcaaaaaaattcagcttcttggttgaatctctcattaaatctgatgttcaggttctgtttacatataccaaaaaaaataagaaccaccccataattcaagatgtactaaaatttgcattttgcggtgaacaaagatgtactaattattaattattaggcagggcaataccatctatccatttgctcgccatacggccaatctgggatatgctctgcaccatcgtgacactctcgctccttctgtccagtacacacacaaaaacaaaaaaaaaatcagaaagacgaggattggagtcaagagagatgaggaaagaccaaaaagctaaaaagctagattagtaaacaggtcacaaccgatggaaatatgcacaccacagcagtagttgaagcacaaacatgggcgtggaggtggtgccgttgccgatgcccaccatcaacgaggccatggcttcctgatccacggcagcaatggatccgctcgcgcgaggatagaggcagacaaccggcgacgcgtgaggataatggtggcagcaccgagatgcacccctaaaaagggtattaggggagccagaaactcttttctatcaaacaaaatatagaagttcatttaccc

SEQ ID NO: 60009 - DNA, 9010 bp, Oryza sativa
  unsure (1)..(9010): unsure at all n locations
attatttctccaacaaaatgtgaaaatacactccgcggtgcattcaagcacctcttgtaagctgaaatccttgtttttcatgagaatcctttgtcctttggctgtctattcgatgattcactcccattggccctgaaaccttttccatttacatccttgctgaattgataacataacaatattgatgtcaatacatctatcagaacacaagacggatatctttgtatgaccacagcaagcaacaaacgtgacaaatcacacgactgtaaagaaagccttacgcaattccaatactataggttgatttatatccttttgaaagtcctaattaatctaatgaaaatttatcataaaaattaaggccttgtttgaattttttttgtctgaattcacaatggacaaaaaatgaaaaaagagaaagatgatattagacaatataacagtgagaaagagcccaccccatccacgaataacaacaatatgattacctgaaggagttaatgtacgtgcatagatgaatgactggaccattccattttcaaatgttccaagtagctgaccccaaaccctggagctgagagatgtggtatagcctaaacatgatggtaatagatgtatgcattagggaacgatttacaccagaaaatagtgtgtatttctttttgacaaaatggatgtttgcgatggtcgcagtatacgataacatttgttgcttttctatatcaaatcactgtagaagacaatgtggaaaatacaaagtttaataatacagtaaaaacccttacaagcccttgaatatttgaaaaaaacaatgaggtgctttgagcttgctgtaaaaaaatgcaccaaataaaataaagcaggattaacagatgaaccaattgcacagcctatgaaggaacattataggacatgatatgcacgcatcatcaataatcacactattcaaatgctcacctgcatttccttcttccgatcaatcaccaaggctgtatttgggccatacaaacgaacagtcacagaagacttgttgcccttgccatcttctacggagacactcagcactgcaagcagtaaattacagttgttgtttccactaagttctcggtaaattggtagtacttcagtgacagaacattatataattttctatagcaaacaacataagataagatgatttaggcattaaaaaagcaagaaagaaatggtaaaagagtccctgatctcacaaaagttcagaaatgcaattaagttcataaatgttcagaattcagaaatgcaatcaggttctggtaatagccataatgttatgtctgccgctatccaaattgctttaaaatgtgcctaaaaccaattttccctttgtttgagcagcagcctgacctctgttttcctctacttacaacgagttgcttaggtgaagcaggaaggaaaaaaatcatgacaacgcgacaagccatgaaactgccaaggagcagggactcacacatattcgtgatgctgccgccagacaccgtctcgatcgagaagcgcgagctgtctagcgatgaccgtcctctcaccaattccttgcagatacctctgcacaatcgcgaacgggagtccttgtgtgagaaccaaaaaccaaattgaagacagataacgacctcccgcaattcccttgatgagccttttctctaaaaaagaaaaaaaaaaagaaaaactcccgtgattcctccaactcagcgcccgcacccacccacgaacgcatcgaaacgaaacgaaaaaaatcccagaagcaaattcgaagagagagagagatggaggggatcaggggtactcgcatgatgcggggcgtcatctccgggagcggcagcgcgatgtcgacggacgcgccctagccatcgcctccccgagctcgccgtctcggccgctagtcgggggcgctcgatgatgccgacggcagtggcggagacggggatggctgcgctcggcggcggcgcgaggcgggaggcggaggcgctcggagacgacaacgcgacgacggcggcggcagcggcgggggaggtggaggcggcagcgcgagccgacggggacgacgatggctacgttgcaaggcggaggcgggggcgcgaggggaaggcggaggcgacgacggcggcgcgagggggaggcagacgcagcgggagagggagagggtgggatgagaggtggcggcggctagggttttttgggggaggtggacgcggccgcggcggtagaggtgggcgcggccggggggcgcgaggggcaggaggcggcggcgcgtggcggcgacggcgggagaggggaagggagaggatgagggtgtgtttagttgaggaaatgaaaatttttgggtgttacatcggacgcttgaccgaatgtcggaaagggttttcggacacgaatgaaaaaactaatttcataactcggctagaaacgcgagacgaatcttttgagcctaattaacccatcattagntaattaggctcaaaagattcgtctcgtaatttcctccctaattgtgtaattagttttttatttatctacatctaatgcttcatgcatgtgtctaaagatttgatgtgatatttttgggaaaaaattttggggaactaaacgggcctgaggagagacgagagagaagagggcggcggcggctagggtttggggcagttagagttagtgcgcgtcgctttgcggaaaagcccctcgtcttttaagttttacatcgctgtccttactcgcgatttttccctcgttttaatgtatatccgacttttataagggtctcgacctaaaataacatctcacaggtactgtttggagggagctatttcgaattacaaacaaattggagggctttttcgaaaaatcaccaccgcgcgcactgttcctatcctacgtggcatagccgagcggacgccccttccgccgctcttaatggtttctaatgtgtcatttattccatactttgcgctggtaaaagttgctttttgatattttattattcttcaggcatatgcgcgaaccaaacgcacaaagcttcagcctgcctgatgaggcaagtgttacatctcccaacgctgcctgtccggcgtgagtttttctcaggcgtggccctcaggacacaaaccaaacaaccccttaggccttgtgtattatttacaagatggaaaaaaaaggaaaaagttcacttgacgtccctcattttgtcgtcgagttttgtaatactggatataatgcatcccgaatatttgcaaaacggtcacattaggtctgaagacagtatagctcccaaatttagttgacgtggcatgtgagtcagtgtgggacccatatgaaccccacatgtcagcaccacaagtccacaataccctcttccattcccatcccctctcttcccatatctctcatcgtgcggcatgggcggagccctagttgacctgatgaagatgctgttgctccttcggtgaggcccgtgagaagctttgctagggtttatccccgcgtcgccgccccaaaagatgagaccaccatggccgcggtccagtggtggtgttgttccagaccaacatcaccaaggctgcgtcgaggctcggcgccacaacctccatcatgtttgccatcgctctacaacattgatggcaaccagcgcgccgtcatcttatatcggttccgcggggtgctgccttggacagtcgagaagaagcaggtggcatagcaggaggccgagagcgctccaattgcctcatcgccaaggctgagcaagaaaggcgcccgtgcatcatgcacactgaaggagactgttaataaccaaatttagtaatctaagtatcggagatgaggatgggattgaagcggaattcgagatggaaatcgtcatgaaaacagagtacggatcggctgaagtccgaatcggctgcggttggggtaggcagagttcgagtcggacgaggttagccgatcgagccgaatccggcaacgtgacgcggtatgcgttgtcgggttgagctaacgaacttcatgaggattgccacccatggatagagttttgagaaggcaattgtatatattaattaggatatttcatgtaatttccttagagatatgtttgggcaaaagtctgccgcaaagacttatggtatcttagagtttgttagaaataagagtcgtgtccgacatggacatattttgtaatctcaggtataaatagatcccgagccctatgtaatcaatctaacacacgttcaatacaatctcggcgcatcgccacccttttactttcgttttgtttcgacgagttcttgcttttgggttgagcccgcatcggtttcgatcttcaactagaggtaaaacttgttatggcggcttgcgttctcggtattagtgcttacatctttatgatactctaatattgcttatgtaaatcgtcgagttatcatatattttatgtaatctccgtcaatatcgctatctaaccttcaatcggctaatgtctgttactagaaggcagtcgattaggttaaataccgacgttgacttagattacataggatatcaaccactctatgaaacatccaacggcttgattgtctagatattgtccttattttcatacttatacctgcattagttgagtttgatcttatgagtcgtgattagaatctcaacctctagcctgtctttggttgccgattagggtagcatcgggtttcagccaatcttacctgatttaactatatttttcttatatgcttgattgacatgttaaatctgccctttatattaagatcttgttgcatttaggtatattaggctttcgtttggtatattctacttgctttaatatcttaatatagagtggtatcggagtattagctgatacatgctagatctatatgatcagctatgctatgaacatatatagtcttgttgctaatatatctttcgatctaagtaatttatactgtctcggcatggcgaccgatctatcccaataacttgatttaagtatatatcgacataaggattatatattgttaatatctacagccaatcgagtaaatttagttctttcttacttattcacgattgccgatcgatctacatatgacatcggctcaaagataaatgatatgtcatcggcaactagccgatcagctatcatttatggatttaaccgcggtttctttgtctttatttcttgttgattgcaggatcaaattaactggcacggtcatacacttaaaggcaagcttttggacctgcactggagttaagcagatctccaaggcctcgtgtttttacatcaacagagacgtagccgatgatccttaatcccggcgtcccagcaaaaaacgctttccgaaccattgaaggagttattttgcactagttttcagagacgggggagatgttataccggttttatggttgagggaggaaattcaatcaggaggaagatgagggatgacttattccaaagggatggggagagcccttcaagggcatggtctgtctgatgggccgcgttagtcaaaaacctgagcagaagtaaatgggccaatcgttctgcatttcacaggttctgggctggaccatagaaattcaccgagaagcgactcgaaagcagtagttcgtgtcctcggaacgaacacgtattttctaatttacgtgtctcccaatcgtagccgacgacggtcggtcgctctctctcgctcctcggctcctctccatttcccatcacccggcgctcgcatcgcgtcgcactcgcccaacatcgcaagcactgaagcacccacacaccctacctccacacgccctagctcgctctcccagcgtcgcgctcgccgccgccgccgccgccgccggcgggatgatccccttcaattccgccgtagccgaggatgtccgctccctggtgcagggcgtggacgactccaccttcgactccacccaccgcgagctctgccaggtaaacgcgagccgccctgccccgccccgcccgggcccgaaatccacggcccgaggtgcttcgtttcggcctggcgttttgcgcggcggcgattggttcgtgccgcggtcgtagatccgccccccccccccgtcgcttggatttcgtctttttgaagcgcctcaatcttgagggctgatctagggttttggcggatttatctgtcttgtgggtattgacgaggagcgatactagggcatcgcctttgatgctcttctccgcgacttaatctagggtttcggtgggattcctcacgattggataacgtgggatgtgttggttggtgttttttttttgttgcatagatccctcaatgtggtgcacgtgttccatggttcaagtttctcagtttgatggtcgtgcaaaatttactcttgggttggaataggacacttaagctttggattgttttgaatttagcctgacttgtggtcagatactcagatgagaattgtgttaagatgcatatgtttgtgaatttgtacaagattttgcattctttgtcattgcagatgtcttgggatgtctgtcttatgtttatacttacacaatcaactccgctagaccaccatcgactttttagtattggcgctcttagaattactcatttttgtcagaatgacgcgctgcattttattgtattattggtgcatggtgtttttagcattatggactctggatcattctaaatgatttataccttgtctcttgttatcagaactgttctaactcatttgcattcataattatctccaccggaatttgctttagttggtggaatcctttctaatattttttacctttcctttgtttcagctagcggactgcagtcctgatggatgcagtttgctgcttcaagtttgtttggatgaagtgctgctgaatgccgacgtggcaaagagctctcgattgaaacctgagctcttatcaactgttttcaagtattgtctggataaaccatacttcagcaccagtttttgtgaagcactgaagacagtacatgtcagtgatatgttccttgtaaaattgtcaaatgaacttaatctatctgctggagagagggttggagttgggcttgccctatcagattctggaaatctaggcttgattacgaaaggtaggtgcttggtagatcaatttccctggcttagtcatgtgtcagttctcattgaaatgcttaattacacctctattctttgctttatagggcaaaagttctcaatcgctgaaatcgaggagatatgtgcaaatccagcccatgttttaacaaatgatcaaattcacgatattgttgtgtttcttcaccagactgatggcctctcaaagcatatggattctttcactaacatcatctccctattaaatgtcaaagagatgccattctatgttcctgccccaattaaggaaggcaacgctcggccaacaatttcttcaaggtttgaagagttccttctatttacattatgcttcattttcaattttgctttactcatgcacatttcattgcctttttggcaccttacaggcacatggaactatacactggtagcttggatgatgattttgattcccttctatctgaaattgggaaagaaataagcatggctgacatcattactgaattaggctacgggtgtacttcagatattgctcattgtaaagaaatactgtcactatttgagcctcttgatgatatgggaatctctaagttgcttggagcagttgtttgcactcatgttggtcttggtgaagctcataatacatattcaacgttcatgtcggccgttggcaacagccaaccaagtgactcatctcaatttactgcatggaatattgatgttctcgtggattcaattaatgaaattgtgagtctttatccttcatcttcttgattatcattgctgtcaacttcttttccttttcatttcttaatacgtcttgtcttgtgagtgcaggccccaagaactaattggattactgtagtggaaaatcttgatcatgagggtttctgtatccctgatgaagcggcattttgtttgctgatgtctatatattctcgggcctgcaaggtatgaagtttttctgttgtactgtactgaaagtcatgaactgttttacggaattattgattgattcatacaggatccatttcctcttcatgctgtctgtgggtcactgtggaagaatacagaaggacaattatcattcttgaaacatgcggtggctgcgccaactgatacatttacattcaaacattgttccaggaagatggtatcactgtcctttcaaaatttctttaatcctaataaacatcttatttcacacttgacacgtctaacctttctgatcttccttaggtattccagaatttgctaaccgcatgcaaggcaatcaggcttggtactgcctggaccttctagaggttttatgccaacttgctgaacttggctatgcaacaatggttcggtcaatgcttgactacccactgattcattgccctgatgttttacttcttggtgttagccacatcaatgtatgctttctgttccaattttgtttaatgcctccccttgtatattatatatctttttaactttaggaacaacattgtctatttgcagactccatataatctcctccagtatgaagtattgtcttgtgttttccctatgatactgaaggacactacatacagtagtcttatgaactctctctggcatgtcaacccttacctcactcttcgtggatttgttgattcacattccgacgcaaattgccttctcagaactgttgagatatgtcaagacctaacggtaacacaattttgccaaacttttgtagctaagtttttaagttgacaacttaacagtcttgtagtttgtttatattttatctgaagtgttaactttgtaattcaatgagcctttatttggtactcggtgactcttaattttttttatttgtgtacaaatgaagtggacggttaagatgtag

SEQ ID NO: 60010 - DNA, 700 bp, Oryza sativa
cagcaatagctatcacagatgcatggtggtcacctttagaataagttccttagttgttcggctcgctattgtaacacttctttgaatgacaggacctataatctctttgatggccttatccaaagccatatccatgattctacaaataccaagaatgtaacagatcattagaaaaagaagatcaaacgtaagctgatattatcttcaaaacacatacttgctatactgcaacgagccaaaagagctaagcttttcattaattctgaaatatatatctgcacgtggaattgccgcaataagctgtgaaggacccacaaaaaatatagtcaattataatgaaaatcaaactttgatgtacatagagataagcagcaagtgcagacctggctaagagaaaatgaagacgatgatagtgatggtgtttgtgatggcgaaacctggctcaaaccaagagaggaaacctgttcaggcatgattaaagcggacttgtcatcttctaccatattgtttgtaggaaggcgaagaggtgctgcatactgtagtacaaaaatatccaacatggattaaaaaaacatttgtgcgtacagattttaattaaaactaaacatgaaagcagaagaccaacctgactcaacatatttggaaggcttgtagcacgggaagtgctatttatctctggttgtggttccacatggtttat

SEQ ID NO: 60011 - DNA, 540 bp, Oryza sativa
agtgttgaaattattattttttatgtcttgtgatactaaatagatgcattaaaactgtttcttattacattaagtttatcgctatgtttggttgaaccttagctaaatatgaactattgtaggctgccacaacaccatcgtcacaagcttctcctcatcattctaccactgtatcagctcctttacaacccactggctttctgcggtctagaagttctgctccttcaggtcactttctagcttacatgttaagctcaacactaatcagaacttgctgataatttaaccatagtcattatcattctttgtgctcgaatttatggccttacattattttttatgacccgtccattgttttctaggcattcgacaaccttccttcaccacaggatttggagctgctctgaatattgaaactctagttgccgctgcagaaagaagagatacaccgattgaggtttgtttaatttttggtgtgaaaccgtgaattgcagcaaaggtccacacttctcaaactatttaaaccggtttgggggcctg

SEQ ID NO: 60012 - DNA, 1129 bp, Oryza sativa
ctcactgctaaaaaattgaactcatctttactgactaacatttgctaacaaagctaatctttttgactggaatttgattacagaactagcctatgttgactgaaatgtactgtcagaactaattattctgggtgctaacaaaactattctgatatgttggtgcctaacattgttagaggcacacaaaactaagcattgattatctgacatttgcacatactttcagtgaattaaaatgacctaaacagaactctgaaataattatagtgaaaaccctcctgaaatttcttcaggccaagaacaaaaatagtgaattgtggatactatgatagaaatcaaattgttggtgataaaacctaaaatcataaagtagtcatcaaggggcctccccttgctctaactccagtactccacaaaatccatgtattgttaatgcatatattcaagcaggtcttgttgataaaaaaatctcgagaatatcagacaaaaaacaaatatgcccccattgccagtacatgaaaatgcactaatcctcccccaactctgttgccaaccctcgggcccacatgtcagtgagcagatgatctggattgtacttgtacacatacaaatcaggaaagcacaaaaaagataatagaatcactaacctaataaaagatcaaatacatcctccccaaatgtatatagcttcagaaactgcattatacatcctcccctaatgacataaaactttagatcgaacttaatcaaccaaagtcaacgcacagcatgacacagatgacaaggatctactagcttagaaaatggaaataaactattgctcaccatctgggccgtaaacatcacattgcctaatttttaggagctgaagccacagccgcaacagcaacctcccatcacctgaagattgcttcatcgccgggatgccttgtcgagtcagcggagtacggagtggcgttgctgcacgagagaagaattctctggagaagacgagcgaggccgtcgccgagaagaaatcggcggagttgcctcctcccatcgtcgccactcgccatcgacattcgacagcatcacccaccgtcgaaaagggtggaacaaaccggatccaaaccgaaatagcttgataaaa

SEQ ID NO: 60013 - DNA, 17248 bp, Oryza sativa
  unsure (1)..(17248): unsure at all n locations
cgacctgattcaacccggttttgttagtttagatttaacccggttcagagatgtaaaatgaacttatttcttaattgttcaagaacaaaaaggcctaacccagttgcaagaaacgctaacgatgagcccataataataccggcccaagggacccctcacagaaaccctagaaccgcctgattttcatcataaagacccctagcgccgcctccgtcttcgccctccgttgctccccctctcccagatccgcccgcctccgccgccactcgcgccgaatatccggcttctcaatccgcggaaactactccctgttgttcgtcgacctcttcgtcgccggagacatctaggttttctccctctctatgttgctgtatgtttgtatggtcgcctcaaaactcttttgtaagtttctttattatgtgctcggtggctaattagccaatcacacactgcggccgccatggcagcaacctttaaccctgtgtgaatggtcagtaagcccacctacattgatccgctttgttgcgtcgattggaggaacgactcttcttgtgcgtgcttccttcattgatgcatcaacgcacactgctatataatatgacctagctctaagttaaatccatcccgtgttgaattcgttttctaggttgcaaataagctgttttagaaatactagtggggatctccatgactcacgtatgcattattcatttagagtggagggttaggggtactgacatgaacaagtgcggtgactcgttagccagtcgcaatatcaaagctctgccgctggtagtaggtggtcacctatatttagttttcgcggtctgcatcttgtgcaatgggcggatggagcaatcggcaaaatcggtccttcaggctgttgttgcgaacactgcttgctgctgctttgctaacagtcaataccaaaacaactctttcaataccaaatcaactctttttttttgtccctttctctaagcaagtcatctcaccacacctgatgttgtgtgttagttgtggtggtagcattttttcctggtagcgcgcagctatacgctattctaagtcaggaaggcgatgggcatttagttctagttatctatatgtagtatgcagcagttgacctgttgttgctgagtggatcatagcagttggcttcaccgcattcatactttgtagtttgccttgcatagacaatctggtacagcgttgtatgaaccttaatgttctggttttgccttttgttatatgttattggacccatctctttgtgattttacttacaatgttgattacgcctagaggagacatctaaaagtttaaacctattctagaaagctgaaagtatcaaaatgccctgcctatcttgatgttcattgaccatgttcctccaaacccctaatggaaatgttctcatctctataaagtatacttcctccttcccaaaaagattcaaatcctaggatgaatctaaacacacatgtgtctaggttcatccctaggatttgagttttttttgggacagaggggagtactactgaattttgatacgtcgagaacaagtaatctttgttcaaataggnnnnnnnnnnnnnnnnnnnnnnnnnnnactttttccgactgaagtatcagtagtaatcattatcaggcttgtctgacagtgtctggcatgatgaataaattgtataattttttttcataggattcacttgtgaagttttttttttatcatctgcagtttccctatacggctataccatgtcgatgcctggtgatgcccaacctgaaggttctcaccaatccgcttcctccgcaaaacctgccttgtcatcgtgccggaggaataaatctgagaacacgtcatttgtctcagatttgagagatcacatccaggagtttatccatgcttccccgaatgagcacaggacctgttttaccaagactatcaagagaatgtttggcatgtcaaaggtcgttgcagagagatccaccgaagcaaaggaacctggagctgaaagtgttttgccacttcagaccacggtgtcgcggtagactgtgatcagtaatataattttctctgtagaaagtaatctgtcgctgaggatgatcttaggatagagaagtcatagttacacttgataccagtagatcatgtacagtaactggaggatattctgtattaatttgactgctaaaaggcctatatatattgtaagaagagaaactgagaagcagttctttgaattatctacacccaattgtgctatcacactagaagagacatttcctcttctatggaatcacgctgcacagcataacactttttttttctttctaatccaatcaaatctttttgttgcctataaaaacatgtctatcatctacaattgcgtcacaagtatgaccaagactgtacaaagcagcctagctgatccagcaagcaagcgccgcggcgacgagctggacgtgccctgctcggagagcgagctgaggctgaactgtgggttggagccgtacaacgcctgcacgccctcgacgtcgtccacggtgaggcgcaccttcttctcccgcggcttgatgctcgggtacatgacggcgcgcggcgacgccgagtggccgagccccaggacatggccgatctcgtgcgtcgccacggactccaggtcgatggccgacgccgtcgcgtcgacgtcgaagtccaccgcccagtgctccgacgcgtcgaggtggagccgcccgttctttggggagaaggcgtggccgaggatgccgagcggcccgtcgaacggcacgccgtcgccgtggttgccggcgtagaagcccaccttgatgtcggccgcctcgtagtcgtccgtctcgacgaagcccacggggatcgtccgcgcccaccgcgcgaacgcgcgctggaacacggcacgcacggcggccggcggcaggtagccgacggtggccgtcggcgagacggcgtaggacagcacgatcggcgggtccgaccgcgtccatcgcggctcgcccttgaagaacgtgaaccggctgaccacgccgccctgcgcccccggcgagagcgcgacggacacggggcgctccacatcgtcatccccgacgccgcagcgcggcgacatgatctgatcgagcgtggcgttgtcgagccggccggtgaccggcaggctgaacctcgtctggtacctcctcacggcgacctcgaggtgctcgtcgaaggcgtccgtcgtgtcacgccccggcttcgccatgtacccgaacctcgccaggtaccgcttcagctccgcgagccccgtgacatggctccctcgccccgcgtcgagcagctgcttgaacgagtgccacgccacgccgccgtgcccgtgcaccacggggagcccgagcaccaccaccatcgccacggcggcgaccaggcacgacgcggcagccgcgcggcgacataggaacatgagagcgcgcgcggcgtggcgtggcgagggcgaggcggccggtgtggccgttattctcgttatcgtgggggctcgcgggggaggcagtggtggacgaagaattttatgtgcacacgagagtacgagacgagagacagaaaaagctgtggatagggagaagtgggtcagccgatggagctccggttggccaccggctgacctcgtcgtcttcctcctcctcgcggcggaggagagacggtcttcctcacgtaatccactggttaagaattcaatctcctcaacgacgaccaactgtcgccggtcatcgtcgtgacgcgaaaatacctaactccactctctaatctaatctatgtactcctacttaacttggtttcgatttggggataaaaatcctaattggctcatcacgaaaaagaaagaggataggcgctaattggaaccgatcataaaacagcaaaacaacaagctgccgtgtggcggtaaggggtttgcttgacctgaagatggcaggaatcgcagggagagtatcaggttcaacgcgtgttggtgttcagaaaaaattgggggtcaatttgtcgaattgatcacggtgctgtgcacaagaggggattggattatggatggccttgtcaaatggtgctttccaagccaaaaccaagaaagcgattggacccgtttctctgcttggacctgggaggcttacgtttgtggacagaccaagaaagagaagctgcactagcctagcctgaaaggtaccttcgagttgcgccatcgcgttgaacaccaacgcatggtttatttttcttttcgttcttctagctactactgttgtacggtatgtatttttccctcatagacatcatttttccatggaatcatcatcatcctatggactgaaactactgaaaactctgcaaaaccgaattagaatcaattaactctggattgctaagttgcgtagctctctagtatagtataattaaccaagttgagtttgacatggatgatagtatatgatataaacgtttcagaaaaaaaaaggaataacatatcttgtttctgatagggtgcttcacccatccatccaatatggctaacatgacaggatcgtatgttgtcgcaacactgccgtgtcatcgtctggtcgatgccgatttcttcgcgtcaagtgcgaggtggtggtgagacacggacgcaatatctttcatccatatcacgcgggcgtccatccgatcgcgacccgcgcgcactagagccgtaccaacggtttctccatgtcattttgattggtctgcttgcttgcttcccttcttaataatctccatcaccttgaataataatcttctaattgtagtacttgagtttttttggtctgtgcaattacgcatgaaggtgttgattgtgagcacgcaatgtgttgcagagtcagtaagcttgcaggagtttgcaagaacaatgcaatttgcagtgtctctacgtcatggcttggctctggctcgtgaggaggggagatggatgacttctgctttgtttattctgtcaacgagatgatgtctggtacagtgtgttggtgcaggattcgttaaaatctgacatgggagagagcaggtattgttgatgagtacggtttggtttaagaacaagatgcctttggcaggcagaggccaccagtccaccaagctggaagagccatggagaattggagatggaggctttgcagcatcagagtttgcgattgcactatcgcagccttccaagtctggttgccgtggaagtacaccaacgttgatgtgcatattttgcaggaggaattttctggtgaaggatgagagtagcttttcgatcgacgcatgtgctgtcacggtcgcagaggaaagaagaggagttgcgtccatcggcgtctggggctccagcccacaaagtggcagctattgtagtcacggcccatatacgaagcttttagctttggggcaggtctcgaccagcatagccttttgcattttactccccccgttttataatgtaaattattctagcatttcgcacattcatattttttttatatactagattcattaacataaatatgaatctagatactagattcattaatatcaatatgaatgtggaaaataatagaatgacttatattgtgaaacggatgaagtactattttagtaaatagtttgtactatcactgctcagtagagttggattgtaacaactgtattggctttgaaaaatgttgacaccacactagtaagttttgttttaagttgtgattttaagttgtgaaatatttggtagggcaaattttaacataaaactaaagcaacccttagaatatatattctccatggtgaggctatgagagacgccgaccaaccttggtgaggctagacagattcttctgtaatgaggaatgggaccttacctttgtacaccacatcctgcatgccctgtccacaggaacatctgatcactgcccactgctcctctccaaccctgcggggctgcgacgtccaaggacctttaaattcgaaaacttctggaccaggctacttggcttcaaagctgaggtacaaaacacatggaaccagagcaccatgcaccatgagcctttccaccgcctcgcagacaaattgagccgaaccgcaatgtccctaaagagatgggcaaagggcatctgctcagaagcaaaaatcaagtatcacatggcgctcgacataattcagaggcttgatgtagctcaggagcgccgggagttaacgcaggcagagtacaggttgagactgggcctaaaaagaaggctcttcggatttgcggtcatcgaaagagcatggaagaagcaagctgcgcgcttaactaatattaaagaaggggacgccaatacaaaatacttccatcgtaggataaatgcaagaaaaaggaaaaatcacatcttccgcttaaggaagcagaacggctgggctgtcacacacacagaaaaggaacacaccattgcagaacacttccggcaagtcatgggaagacctgagccaagagagtgtgatctcaactgccagtctctagggctcacccccgtcgacctctctgggttggacgaccccttcacaaagacagagatccacaaagcgttaagcgaaatgcctgtcgacaaagcaccaaggcctgatgggttcacagggaaattcttcaagcactgttgggacattatcaaaagcgacgtagtggccgtcttcaatgctctgcacgacatgaggcacacacactttaacctcctaaattccgccaatgtagtgctcatccccaaaatggacggcacggagggaatcggagactacaggccgattagcctgattcatggctttgccaagctcttctccaaggtcttagccatcaggttgcgaccactgatgcactcgctaatcccgacaaatcaaagtgccttcattcgcgaacgaagtatacatgacaacttcatgtacgtcagaaacatggtcaggaaacatcacaggactagaaggttgatccacctcttcaaacttgacatctccaaggcttttgactcagtcagatgggactacctcctcacgctccttcaaaatagaggatttccacaaaggtggcgggaatggattgcgggccttctatcaacttccacttccaagatcatcctaaatggtacaccgggagaggcaataaggcacggaaaaggcttacgacaaggcgaccccttatctccattgctcttcattctagcaatcgacccactccagcgccttttggacaaggccactgatctaggggcgataagtaaactgagaggaagggttatttgcttccgcacatccatgtacgctgacgatgcggtagtcttcataaacccacaaaaagaggacgtacgagttttcaccgaccttctacgtcgcttcgggcaggtgtctgggttatgcactaatctgcaaaagtcccacgtggtgccaatcaggtgtgacaacctggatcttgacgacatcctggatggcataccagtaaccagagcaaatcttccgatgaagtatctaggactacctcttaccacagcaaggctaagaagagtagacctgcagcctctcttcgacaaatcaatgaaccgcatagccgggtggaggggaagacatattgggcttgcagggcgttccaccctagtgaaatcggtgctcacttcacaacctgttttcctcctgacagggctaaaagcgtcaaaagagtctcttgaggctcttgacaagcagagaaggaagtttttgtgggcggggggagaagccttgacgggtggaaaatgcaaaatcaactggacccgaacctgcctacccactggtttcggaggtctaggaatcctaaaccttgagaagtttgcaagagctttgcgcctccgatggctttggcaggaatggaagtcaccggagaaagcatgggtgggttctggtacgccgtgcgatgacaccgataagctcctttttgcggcagcgacatccataacaatcggaaatggggcgactgtgagtttttgggagtcagcctggtggcaggggagaaggatgaaagatgtggcaccgctagtctacgcggtctccaagaaaaagaatagtaccctccaacatgccttgcaatcagatcaatggctgctcgatctgggattaccagtggacgtgggctggacaacagagctgattgaccaacttgtcacagtttggaccgccatccagacaatagagttgacagaacatgagaacgaccaaatatgttggaagctcactagccacggtcaatatacgacagcatcggcctataatgcacaactacttggaacaacgaccaacaatttcaacaacctaatttggaagccctaggctcctcgcaaatgcaaaaccttcgcctggctggtcattcagaatagagtctggacctctgatagactatctacccggggatggccaaatggatccatatgtcccttatgtcgtcgggtccaggagacggctctacacctcctcgcaggctgccgctacacaaagagaatatgggcgaccctagcggaatggacggcgtgcaacaatattcaccccaaccattggcggtaggtttcgtcggtgttagaatggtgggatcaaaccacaagtgtaaaagaggcacccaaaaaggctctacgctctctaacgctcctagtcgcctgggagatctggaatgaaagaaatcgcagaacattccagcataaggagctcccaccgagtggtcttctgacaaaaatcaaggacaaagccaagatatgggccttagcaggcgcgcatcatctgagaaattggcttgttccttagttcactagggccaaaggtcctgagtttttttctttccctttacactgtacagttttctccttctatattcaatgaaattggctgctcgccaattcgttcaaaaaaaaaaaaattctccatggaagacatctaggtgaaacccaacacgacgaccttttttaaagacttattattcaagtaaccaacactattaccctttcaagaagaaacaatgtctaataaaaattaatcaaagctatggcaaatctctgaataagttattcaatgcaagtgaagcgtgagaccatgctaactattaacggcacaggcaagacatggagggtagagtggtagacgtacgagtcgccaaaaaaagggttttttctttgctgtttcctttttctgctggatgtgctgttcaatttcccttatagtttcgacgcgcttgggcttggagtcggctgtcaagtcgacacgtggtggtttggcaccgtacagctcctggacgcccttgacgtcgtcgtcggtgaggctcaccttccccctgtaatgcctgtacatcatcgagctctccgacgacgagtggccgagcccgagcgcgtggccgatctcgtgcaccgccaccgactccaggtcgacggcgagcggcggcgcgtccccgccggcgccggccacgttcgtcaccgcccacttccgcgccgcgtgcaggtgtatccgcccgtcctgcggcgggtgcgcgtgggcgagcgcctcctcgccgccgcccttgcagacgcagccgcacgcgtcgcacttgccgtcggctgtgtggaggtagaaccccaccctgatgtccgcctcctcgtagcgcgccgcctccgcgaacctcaggggcgtcacctccgcccaccgcgcgagcgcgctccggaacgcctcccgcacggcgtcccgcgggaggtggtcggcggtggccaacggcgacacggcgtacgtcagccgcatgtccggccgattccaccgtggtctgccccacaggaacgtgaacgccgccgcgccgccgccgccgttgttgtcttgggaccgcagtcgcgtcggctgggagccggtgccacagccacacagcagaaacatcgtgtacgtatacgtgccgccggtgagttgcaatactagcgtattgatcgttgtcacgtaactagttacgattgattaattctataaattagtcactcctgtgttttgtttatagatatgacacaggccgagtgtgagcagaaatcgttctgaataactaatccgaataaaaaaagcaaacatcggaattcaactccgtacatgtattccatccgaatagcattagtaaaagaatagtactagtcttttttttttcttaaaacttactccattcgtccaaaaaaaaaagacaaaccctgagtttccgtgtccaaagtttaaccgtccgtcttatttgaaaaaattataaaaaaaattaaaaagataagtcacacataaaatattaatcatgttttatcatctaacaacaatgaaaatactaattataaaaaaatttcatataaaacggacggtcaaatgttggacacggaaacttagggtttgttttttaagacggacggagtaatctctgctaaataatgtggtggaaaccctagttgtcgcacgtgtttccctgcttcgccgccgtcagggtttagttgtcgagcaatgttgttgctacaggacagggcactgaagtgacaacatcggatccatattagcagggcagcacgacggtggaatcataattcaatttcaaaattcgaacttaataattggtgaattgtaattgacgtagaattcttctttcaaactaagcatttacggttcaaaaactaactgatgtatgttttatataccgtgcaatacaggggttcagattctctagagttggcatcaactccacccagtggatttgggcaaatctcatccatcgttttatttctacggttaagatcctaattgactcccttaattgatgcatatttggatctttcttttcaactgttctatttccaacataatcaagaaaataaacgtaattaatcttgttcctgcaattaatagaccaacatagaagagtttttcagtgtagagaagagtgatatcgtagatggtgaacatggacagccttgcgatggtgcagaaactagctctccgcctcgaatcagagctcagggcaactggacagcttactacaagcaaagccatcgctagcgcaagcaagtagcaacatgtacgtacatcatgtcgagctccttgatgctgctgtacagctcgctgatataacctatcatagagtccttgtttacaagcttgacgaaggtttacataaaaaaagtttgatgaaggtaagatcaaaagtggaaggaacaaattaaggataggttgagctgcattgatttaatctcaaccgtaggtgataaattatggctgagattggcccaaatccaccggatgaagttgaagccaactctaggggatccgaacctgcaatacaggggttggtgactagcatcattaattaatttgctaatgattaatatttgtaaagttggatggttttatccacctaattttaccggatgagttcatccatcatcattgtgaaatattttcactctcggctatcccatccacatttactcatcaactaattacactcgaaaattagtgaaaaaaagataatatataatcggaaaacgccgggatcggatcgggcgctcgacgcgcgccagaaaaattggacgctgcgcgcgcccgccgcccatgtgccgcccccacgccgtgcttcccacgcgcgccccccgccatgtgtgtagtgccgatcccgccacgtgtccccaccacgcacgtcgttgcaacaaatcacccatatattatggaagccctctattaagggaatccgtttcactttttttccaccaaaaatatttcacctagtgtattcataatgtttcactatgtatggatcaaatgttgcagtgaattgaaacactctttcgctatttgctgaaatttttttttatatagggtgaaacaacacttgatttttttggaaaaccgttatttcatacgttgtagcaaaatatttcatgaggtcatatggttatgtttcagctttttaaaagactaaaatatttctatctgtttagtgaaacatgtttgatctacttggtgaaacagtgcccgaaaaaaaattgggcgtccaatttgtaggcgcctcgtatataatttgattcttttttcaataaaagaatggttattaagtaccaatagtcaaagctaattcaatatctaaagaagtttattcaatgaaagtgggagtgggatcatggtaacaattacggcacaagtgagagctagaccacgttgccaaaaagagctgccgcgagctttcttcttcttctctttcttcatctgttggatgcgcgacaagatgtcctgcttgaagtaggcaccgaagctgaaatgtgggtttgccccgtagagctcctggatgccgtggacgtcgtcggtggtgaggcgcaccttcctctccctgcagctgatgaacgggtacatcatcgagctcctcgacgacgagtggtcgaggccgagcacgtggccgatctcgtgcgccgccaccgactccaggtcgacggcgagcggcgccgtgtccgcggccaggttcaccgtccacctgtgcgccgcgtggaggtggatctgcccgctcttctccggcatggaggagtgagcgagcactccttcacagtcgtccccgtcgtcgtcgtcgtcgtcgctgtcgatgcaggcgcacccgtcgcaccggccgtcggtgtagaggtagaagccgaccttgatgtccgccgcgtcgtagcgctccgcctccaggaatctcatcgggatcacgtccgcccaccgcgcgaacgcgctccggagcgcggctcgcacggcgctcggcgggaggtggtcggcggtggccgtcggcgacacggcgtatgtcagtaccctgtccggccgcgtccaccgcggcttgcccggaaagaacgtgaacgggccggcgccgctgtcgttgttgttgtcttcgggccgcggttgcagcgtcgtcgtcatcgtcgtctgcgccagtgccggctgggtggcggtgagacgcgccacatctccgcttctacacagagacatcatcgcgcgtacgtacgtgccgccggcggcgaggtgcagcgcatgcagtactgatgtgccttcacttgatcgtccgttacgtaattgggtacgattgattttgctatatgacaacaccgaacgccaatgtttggacgtttttccgagcaaaattcacgttccgagtagtattatgaacgccaatgtcttacacaaatcgtaactcataatactactctgacttgtatgttctgagcaaacaccagaattacacacgtgttccatgttttatcggaatagtattggcaattggaactagtagtttgaaattacatgtatgaggagtcataatcaatattgatctagtgctaaacgtttttcacaactgcctgcaacaaaagactaacgaggcaattaaccatccttaagaataaaaagacttaatttccctaacttagagggggcacaagtaaggcctggtttagttccccaatttttttttccaaaaacattacatcgaacctttaaacacatacatggagcattaaatatatattaaaaacctaattgcatagttaaaggaaaatcgcgagacgaaccttttgagcctaattagtctatgattagctataagtgctacagtaacccacatgtgctaatgatggattaattaagctcaaaagattcgtctcacagtttccagtcaagttatgaaattagttttttcattcgtgtccaaaaactctttccgacatccgatgaaacatccgatgtgacactaaaaaattacttttcgcgaactaatttccctaactagaggggcacaagtaaaaagacttaatttcctaattttgaagagaccacagaattagataacataatagtttaaacttgtttagtattctgtgacacggataaacacgttgtggcaatagcatatcaattttttccctgccaatataagagcttcttctagtactactactagttaacatgcaatctagatttttttttctagaaaagataattgcttcttttcataatgtgattaatcagagtttgtgcaacggtgcaacccctaaatacaaggtctccagcatagattggagcatgctctcaccatactgcagatcaatgactagctagctagctagagcggcaaaagtaagatgcaggctataccaagtcgccaaaaacgactccttggggtgtcatggtccggcttgaagtagtctaggaagctgaagcttgggttgaccccgtacaactcctggatgccttccacgtcgtccacagtgagccgcaccttcctttccctcgtgccgacgtacgggtacatcaccgagctctccgacgtcgagtggtcgaggccgagggcgtggccgatctcgtgcgtcgccaccgtctccaggtcgacggccgccggcgacgcgtcggcggccaggtccaccgcccaccgctccgccgcgtcgaagtcgatgcgcccgtcctccggcccggtggcgtgggcgtacacgttcagcggaccgtcgaacgggtgcccgtcgccgtgctcgccggcgccgtagaaccccaccctgatgtccgcctccgccgccgccgcgtcgtcctccgtcgtgatctccgcgaagctcaccgggatcacctccgcccaccgcgcgaacgcgctccggaacacggccagcacggcgtcgcccgggaggtagccgacggcgtcggtgtgggacacggcgtacgtcagcaccattggtcgtccgtgtcgcgtccaccgcggcttgcccgtccagaacgcgtaccggctgaccacgccgccgtgatggcgcagcgtaggcggcggcggcattggccgtgcgtcagcgacggcgacgcatgagaggatgcaagctatcgccagaagcaggagacacgcagcatctccgcggcgacgcgggaacatggtcggctgttattctcgttatctgtcggactctcgccggatttgatcgtcgtcacgtcaacgggctaccatgaactgaagattgacacctatgcttgatttacggactccaatggtttgcttctaaaaggcctgagttgggatcatgggaaattattaaagtgtactagtataataatattataactactctataatcacaatatgatttatatgtgtaactcgtatagaattctgaaaaacatgttcatattggattgactagctctagaagctcttaaatctgagatcgggtgttcgactcccactaacgcatagtcgtgcaaaattcgaactcccgctagcttatggttgtgcaaattttttttcctcccctctcacgaatctcgaggcaaccaaaagatcacaaatttgaaacttctgtggagaaaaaacgggttaaagttatttagcaattccatgaatcataagcttaaaatactacccaaacatgttctaacttcggacaaccgatctaaactagttaagtcctgtacttgatacacgtgctcacatcaacggctattttttcactgatagatgatattaacagcgggacgtccgtgataacttcgtattccggccaaaatagtactggccattggcacatcagcaactggtacatagaagagaaaaaatcaagtgctgattatttcttggtacagaagatccatgttctcgaccactaaatcttcatgccctcgacgttagcccttccgtcaagtttggccgagaagaagcgcttcatgaaatcctcgtaggccatcgacttgtacaccggcctgccaccgtccttcgtcacgagctccggcagaggcccgaccgtcgcgtcccggcacgcctggtggaacaccgccgccgagatgcgctccttctccgggtgcaccacggccctgtgctcaacgctcctgtacctcccattgctcagaatctgcaagcagcagccatgttggtagatgattaagctagaaactctgtactggtgtgcaccagcaattcaacatcgatcagcaaagaaaaactgtttcggtttcagatcgacgcatcaggtgaaagcctggtcaatattttacctcaagcatgtcgccgacgttgacgacgaacgcgccgtcgagggcttcgatggtgagccacttgccgtccttcctgatctggaggccctgcatgtcgttcacatggagcagcagcgtcaggctggtcgcgtcgcagtgcggcgacaggccgagcaccttgccggtttgcctgcacggcgggtagtagttcaccctcatgttctggggctggcctctgaatacctccaggagagactccggatcaacgcccatgtccatggccaagaactccaacaggcagcgtgctacttttgccgtctccaaggagtacctctccatggaattcctgtcaaacatttgtgttgtgatatgcagcaaaatggctcattggaacaagagaagccatgaacgttcagactgaaaaactaaaccttggaaataaaaaaaattgttcatttcttggttgaaatttctcaaaactacttatttcccatagtcatgatcaatgcaaagattagttgtggttttgtttgtgaggcagacctgaaagatgaaggatgggcaggccagaacctcaaatccctggactcggttgggcgaagccggaggtgtagcaggtctccccagtccagcttctgcttctctgaaacgacgaagtgctggccatagccttcgtacttgtctggtggtttagcgtacgcctccttggcttcaagtggtagcttgaagaactcagttaagtctctcctcacgtcgctgatcacatcgtcaggcaccccatggttgacgagctgcagtttaatttgtgagatcaatcacagtttatcctacttaaatcagtgtcaccttgtccaaatttgaaaaaaaacactatttaattctctcccacatggtttattgatcattcagtttaataatagttgtatcaccttgtgaatcatcaaagtaaaagcttgattacataatcttgacgtacctggaagaaaccccagtgctgacatgcagatcgcagcttggcacactcctcttgggatgactgcgggttgagcagcttggcgagatcgatgaccgggattgccgtgttgatgccttggccgcagatgacctcttcggtgccagcctccggcctgatgtacctgtcaggtatctgctggtcaggtcggttgcaagtcagtgcgagttcctgcacatttggcacctgtagagacatggttaatctggttttctcttgctgctcttcccactgtgctgatgatg

SEQ ID NO: 60014 - DNA, 28764 bp, Oryza sativa
tagttctgtgagaattcgcttggatatatattatgtttttagaaaattatgagctacaattaggaatccgatcgtctcaaattagcatgcgagtttttctaaaaaaaatcattatacaactcctgtatttccaaaagcgaacgaacttaaaaataaaaaattaactcaaatacgaatatgtattttcaaaaacaaacgaacttaaaaaccgactcatacacggatgacgtaccaaagtaccggtaaaaacatctttaatttttataatagtagagaaacaaaaaagagttatatatcaaatttaattgtactttaagatatgttttatcttttcctattaaaaaattcaagatgattgtgtactcacctgctttcgttcgtcacttggtgaaaacatacagcccgatgcatggaaccgtttttattattattgcctggttcaacaaaactcagtaactaattacatccactccaaagaacagatatccagcctaactataaaaccaaaaaattttctttgcaactaaggaaaccatcactgcagaaggctgaaataacattgtcatacatacaaaagaaatctagtacttcctccgtttcacagtgtaagttattcgtgagaaacggagaaagtagttgctcaccaccagtccaccaccgagcaacatggacacggccgcttgatccagatcagcttcgacgaggatgttctatcacactttgcgataaagacggtgttggacatgagcggacaaagcgatcgaatagggacatacgtcttttcttatacgccacggacgaaagacaaaacgaattaagtatagagtcatctataattttttaaataggtaaagatgaaggaggaagtcatcacccttaaagtccacttgtaagtgggataagtccatttgagctccctctaattcaaaacgtggtatttgatatctatcgacatatgaaaccgtttaatttatggttacgtcaaaatggtttttgtctacgtgtaaattccgtaataaaacaacatttggacccacgccagcttagctgtcatcatccacgtacctctcttttttctcttcccctccatctcgatcttcaagttgccaggcactgcacactggggacagatcagagaacttatagatgccagtatgccacctcctacctcctttacgagctccgttgttgcaccgcctctaacatgatctcacgaccgcctcctccatatacttagggggcatttgtaaatttgccaccggttttttcaatattacaaggatgccactcgaatgatggttctagtagcatttttacaattttctagtggcagttttgcaataacgattcaaagtagtggtaaatttgcaattgtccctatacttagacgaggttgtggtactgttcttcaccatggctgggcgagcttgaggtgtctctgtgtgagattgttcacacgacggtaaaatatgaagaaatttaaatgagaagtgattaataagaccattagtactctatcgtaacaactattttgtgacaaattcccagtcaaaaaaaatattttgtgacaaattcaaatcctagaaatacgtataattattatgagatagaggtagtaattgatatgagtacctagatatattgtactctatatttgattacacaattagctttattttttcttttattattattatatttcattgtgtgatggtaacagttcaatttccccccttggattatgcatgggtgcgtgatggttctacacgtacgtatttaggaaatttattacagtgcatcaaaacttcaataaaatccttgttctatacattaaatatttatgtccggagagagtacatatatttgtatggatgtaacacttgttttgtatgtattgaagaacaaaacaaatgaattttatttgcacttccaaaatttaaaatcagtacttgccaaattatatatagagtgttgtttagtttggacctccttttctactaaagttgggaaaattgtaaaaaacacacacaccggaagtaccttcaagtttgacatttcaccctataaagttattttattgtaaatgcacatccactattatgttttattacaaaaaccaccccagcatgtgcttaaccaaatcagcttgttatcgctggtgtagagctccacatgctaagctagccgagtctatcgtgtctaggtgtttaattagacttattcttcatgtttcatcaaattttttctgcataaagcaaagctcagagcgacaacatttaagctttcatcaacaactctatttgtggaatctccaaaaaataagtgtcaaaattatacttctagaagtatttttagttttggtacagatcacattgatgtttcacaaatatacgaaaacatattgattcggttaagcacatgtgcattgggatagtttttgtaaccaaaccgagtatgtggattgacatttataacaaaacaacttaaagagtggaatatcaactttcaagcgacttatggaatgtttttttttttgcattttttctactaaattttcacattaaacccacttagcccatgtttttatttcgatattagtttcgtttggattccttttactctactacttcgtcccaaaaaaaatccaatcataataatgaatatggacacacatgtgtctagattcattgctagagtttatctttgtcggtgatatgggaccgggagtatcgtgaccagaggcttgaggcagacacaatcgcccacgtggcccggcaccctcggggacgtcgggcccgagggtgaggtgtccgccctcctcttgatttccccgaggggggtcgggttactcctgccccggccccgacggccgaggcaccccgacgcctaatgaagtttgcgccacatatatgggttaggtgaacacggcagggctcacctaaccgcatttattgcggactggacaggcacgtcacgctgcatgcagcgcagtgcagcacgttcctttatccggtctgtgaccagtcacagaccggtcagatcaacggttaggtggcgactggcggtctgacgcacgcctcgccccgtcccgtcaagacgagagcctctaggcacacgtctccagccggagctagcgtgttacttcttagagatggcacgttagccctggtcagatgaataccaggcttcatcccaaccattacaggcaagatgttacacgaagaagggcgaaatacatgttgcaaagctgacgcgtggtggacaagaatgaccgatttgtgaccggtctgacactgctcatatcgtcagcagacagcctcgttctcacaacgagcctgcctccggcagaagtggaggtaggtatgtgccgtcccgtcagaaggacgttcggagggcaaccatgcaaatctccgcttcatttatgaagagaagaaaagtccagtttggaaagggaggggtgcatgtggtatccccttgagatataaaaggaggaccttgcccatttagagtgggggggctggagattgacgaacaaagaagaagggagagtttggctcacactttgtaactccttcattcatagatccaccaaaacacaggagtagggtattacgcttcccagcggcccgaacctgtatacgtcgcctgtgtctcttgctctttggataggccgcgatctttccacatacagagagagcctgagatctcaccctgagcccccggccgaaccggcaaaggggggcctgcgcggtctcccggtgaggggccacgagctccgtcatctggcgcgccagatagggggactcagcgtgagtcttctgagctctcgcactcttccgagtgtgccaagcttttcttgttcagcctaatggccgagcaagcaaaggcgcccgacctctctccgagtgtgagtggcgacgacggggagccaaacccacgccgtcgagctcgtactcccccgcctcctccacatcaaagtcctaagcagggggaggcgctcgagagggttgaaagatccgcggcttcaccaatcgcgggcgatggaggagaacggcgagatggggagcgtcgcctcctcgtctacggcgacggcagcacgccccagggcgcacttcaggctgctggcgcgctcctacgtcacccgcccgtcgtccctgacccggagtctccagcccagcgatggctggacgacgtggccaacttggtcatgacggcacagcagcgcctgggtactggtggacggtcctccacccccagggccaccggcgccgctaccaccggctccgtgtcgtcaaggcggagggcgcggcgagcggcggctgttgcacgccattcggctgccactccctcatcggcgcctccgactcgggagaatcagtgtggagagccggatgcccgcctcgacatcgagcgccggcgtaatgatcggtgtactccctatgcaacggagggcgcctcttcgtccagagtgtcacctcgacatggacgcgaggaccagccctccgtgcccccggctggtggtgtcggctgtagagcctttgtggcgagtcttcggaatgtccgttggcccccaaggttccggcccaccatcaccgagaagtatgatgggagcgtcaaccccactgagtttctccaggtctatacgaccgggattgaggccgctgggggtgacgacagggtcatggcgaatttctttcccatggccctgaaggggcaggcgcggggttggctgatgaacctgccacccgcgtcggtccactcctgggaggatttgtgccaacagttcaccgtgaactttcaaggcacttatccacgcccaggtgaagaagcggacttgcacgcagtacagcgaggggatgatgagtcccttcgctcgtacattcagcggttctgccaagtccgcaataccataccttgcatccctgcacacgcagtgatttatgcgttcagggggggtgtgcggcacaaccgcatgctcgaaaagatcgcctccaaagagccccagactaccgcggagcttttttagcttgcggaccgagtggctcgtaaggaggaggcctggacttggaacccctccggttccggcgtggcagcttcggccgcccccggatccgccgctcagacagggcggcgtgacaggaggaggaagaagaggtcggtccattccggcgacgagggtcatgtcctcgccgttgagggcgctccgcgggccacccgaaaggggaggcctgcgagcgacaaaaagaaggaggctggtgctcccagcagggagcgcccggccggcaagtggtgctccgtccacaacacctccctccatgatctcgcggactgtcgcgcagtcaaaagcttggctgagcggacgaggaagtgggaggaggagaggaggcaggaacgccgtgaggacaagtccccggcaattccctccggtaaacggcgaagtgaggctaggcagaaggcccccgctgttgacatcgatgacggcgatgatgacctaggtttccaagaacctggggccaccattgccactgtcgatgggggagcgtgtgctcacgtctctcgccggagcttcaaggctatgaagcgagagcttctggccgcggcccctactcatgaggcgacgcgtcgggcgcggtggtcggaggtttccctcacctttgaccagaccgaccacccaccgtgcgttgcccggggagggcagattgcgatggtggtttcccccaccatttgcaacgtgaagttggggcgtgtcctcatagatggaggagcggccctcaacatcctttcccccgcggcctttgatgccatcaaggccccggggatggtgctccggccgtcccaaccgattatcggtgtgacgccggggcacacatggccgctaggtcacatcgacctaccggtcacctttggtggatcagccaacttccgcacggagcgggtgaacttcgatgtggcggacctcagtctgccgtacaacgcggttctgggtaggcccgcgttggtgaagttcatggcggcggttcactacgcctacctccagatgaagatgccgggccccggtggccccatctctatccatggcgacctcaaagtcgcgctcgcttgctttgagcagcgcgcggaccacctcgctgctgcgtccaagcccgagggtggtgacgagaggcttggcacctccgcccccaccgccccgaggcagcggattgccacatgcgacgaggtcccggtcaaggagattgccctgggcgacggcccatccaagaccacacggatcggtggtcttctggatggcaaataggaagacgcgctcgtctccttcctgcgggcaaacgctgacgtcttcgcatggagaccggcggatatgcccggggtccccagggaggtgattgagcaccgtctcgctgtgcggccgggcgcaaggccggtccggcagaaagtgcggcggcaggccccggaacgtcaagccttcatccgcgaggaggtggcgagacttctggaggccggattcatccgtgaggtcatccatccggagtggctggcgaacccggtggtcgttcccaaggcgaacggcaaacttcggatgtgcatcgactacaccgaccttaacaaggcatgtcctaaggacccttaccccctgcctcgcatagatcagattgtcgactccaccgcggggtgcgaccttttgtgttttctagatgcatactctggttaccaacagattcgcatggctagggaggatgaggaaaaaactgcgttcattacccccgtaggaacctattgttatacatcaatgcctttcgggttaaagaatgcaggtcctacttttcaacgtactactcgaatttctttgggtagccaaataggacgtaatgttgaggcttatgtcgatgacttggttgtaaaaacgcgcaaccaagaaactttactctcagatctagcggaaacttttgagagcctccgctccgcccgcataaaactgaaccccgataagtgcgtgtttggtgtacctgcgggcaagcttctcgggttcttggtctctgcccgaggcatcgaggccaaccccgagaagatacgagctatagagcggatgcgcccccccagcaaacttagggatgtgcagtgcgtcaccggttgcatggccgccctaagtcgtttcatatcaaggctgggagagaaggcgctacccttatttaagctcctcaagcgctcggggccgtttacttggacggaggaagctgaacgtgccctcactcagttgaaggcatatctcagctctcccccggttctagtcgccccggagccaaatgagcccctactgctctacttagcggcgaccccccaagtagttagcgcagcgttggttgtggagcgcgatgaggacaatcctcattccgcgcgcccccaccctgtgctgatttggcccgggagcaagcagggaggagaggcccccgagccgaacggtggcctaaggcccctgacgaccggagtcggccctctgcccgcttgtcagacggtgctgggtgcccccgaccctcaggaaggccccgaggccactgcgggaaggccgcacctaacgccctttgaccccgaggctaaccctgtgcggactcgacccgggagagagcagggagaagaggcccccgagccgaacggtggcctaaggcccctgacgaccggagttggccctttgcccgcttgtccgacgacgccagggacccccgacccccaggacggccccgaggccactgagggaaggccgcccctgtcatcctccgaccccgaggccatcggcacagtagacgagtgcgccccgagaggccacttggacgaagaacgcctcggggacacggcccctagcgaagaggatcggccccgccgaaaggtgcagcggcctgtctactttgttagcgaggccctccgggacgccaagacccgatatcctcaggcccagaagttgctttacgctattctgatggcctcgaggaaactgcgccattatttccaggcgcatcgggtcacagtggttacgtcttaccccctcggtcaaatcttgcataatcgagagggtacaggacgggtggtaaaatgggcaatcgagctttctgagttcgatctgcactttgaaccacgccacgctatcaagagccaggccctcgccgattttgtggcagagtggaccccggctccagagaccgtctcaatccccgaggccagcacggacctttcgcagctgcctcacaccgcccactgggtgatgcagttcgacggttctctgtctctccagggcgccggtgcgggggtcacgttgacctccccgaccggagacgtccttagatacctggtccgcctcgactttcgagcgaccaataatatggcagagtacgagggactccttgccggactcagagtggcagccggactggggatccgccgcctcctggtgttaggcgactcccagctggtcgttaaccaggtctgtaaggagtatcggtgctctgacccgcagatggacgcttacgtacgccaagtgcggcgtatggagcgccattttgacgggatagagcttcggcatgtgcccagacgggataacatgatagccgatgaactctcacggctcgcgtcctcgcgagcccagaccccaccgggcgcctttgaagaaaggcttacccagccgtcagcgcgacccgaccccttaggggagacggatgcgcctgaccggcccccgaggcccgtcggagtccaggcctcgggacctgaagggagcgctccaagatcccttagattgattgcttggatctctgaggtccaaacatacctcacagataagactctacctgaggaccgcgaagggagtgaacgcgtccaacgcatctccaaacgctacgtgctggtagaagggaccctctatcggcgcgcggctaacggaatcctcctgaagtgcattcctcaggaacaaggtgttgagcttcttgccgatatccatgaaggcgagtgcggagcccattccgcctcgcgcaccctggttggcaaggcctttcgtcaaggattctattggccgacagctctcaatgatgcagtcgacctggtccggcgatgcaaagcgtgccagttccacgccaagcaaatccatcagccggcccaggccctgcagatcataccactttcatggccatttgctgtctgggggcttgatatcctgggaccgtttaggcgggccccgggcgggtttgagtatctgtatgtcgcgatcgacaagttcactaagtggcccgaggcttatccggttgtcaagatcgataagcactccgcacttaagttcattaagggcatcacggcccgttttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcagaaatcctcaaaggccttaaaaccaagaccttcaatattctcaagaagcacggcgattcatggatcgaggagttgccagcggtgctctgggcgaaccgaaccacaccaagccgagcaaccggggaaacgcctttcttcctcgtctacggcgcagaagcggttctcccatccgagctcaccctgaggtctcctcgggccaccatgtactgcgaggctgatcaagatcagcttcgcagagatgacctcgactacttagaagagcgaaggcggcgcgcggccctccgagccgcgcgctaccagcagagcctgcggcgctaccatcagcgccacgtccgggcccgatcactctgcgtcggcgacctcgtcctacgccgcgtccaaacgcgtgctggattgagcaagctctcaccaatgtgggagggtccgtatcgagtgatcggcgtcccccggccgggctccatacggctggccacgggcgacggcactgagttgcctaacccgtggaacatcgagcaccttcgtcgcttctacccctgagggggggggggtcgggtgtcaggttttgggctcgggccaaccccgcacccccctcgggtgtgcagggttggccgggggctaccacacatgcacattctcacttctcttatttcaccttttcaataaaagcagtttcaatttcctaaaggctgtttttgtgccgttttttccttttggagaatcttgacttgaaataaggtcactcgtgttcaaccttgccctcgggggctcggttcggtcagctaaaatcgccaaacggggcccagaaccgagccgtgccccggggcgtggtgaactccgagggggaatcggcaaaaacccacaatcgggtcacccataaccctcggtcaccacgttcccggcctggccagtctcgacatgtggatctccccaggcactagccccgacccgagccatttgaggactgggacttgagcacgagcccttaaatcaagctaagacgcaaaagggccacggcacaaatcatcctcatctcatatgcatagcaaagtaaaattaacgcaaagaatttttcatcatttttgattgcagattaagttgatctatacaaaaaagaggcctgaagggcttagaagaaagaaaaagaaaaactggagatcggagggggcctgggggctcaatccgatgcgcccgggtcgccggcctcgtcgtcagcatcgtccgcgccactggcgtcgccctcctcgtcggagttgggggcaaacgcgagccgaggggccgagccctcgaagctgttgacgatatgttcggcggcatcccgaacccgcgcgcgcgcgtcgtcttcggtcccggcagggaactcatccagcgccatccatggggagaagttggggtccctggcctggtaactcgctaatacgagttccactgctccttgggcgaggtccctcgaggatgacttgatggtcttctcgagctcctcggggagttgttggagagcccaggccatcttcgtgaggtgcggagcgaggccttccagattggtggagtgcgttgtcgtctagcctttccagaggcccacctgccgtccggcgcgatccagacgggagactgcgtcccaaagcgtgccgggccctatctcgcccgccaggcgaagggcctcggcttccccggcggatgagtctagcgcgcgctgcatgtcggcgacggtgtgttcggcagctgcgaggcgggcggctaagtcgctttcgcccgtagccgccccgccgctgcgcgccctcgcgtccagctccttttcccgcgcctcgaggttagcagcccgctgctctagcgcggctctctcggcgcggacgcattccagattgcggcgcgcctactcctcctgcgctgcctcgcggagggacaggctgtccgccagccgttgtgccgcggcctcggactccccgagagctcgctcccgctcagcgagcgcgtcctcgcggaggcggagcgcggactcctcttcggcgcaggcggcctcgtgcgccgccagcgtcgcctcccggatagcggcggcggcctcgcggtccgccaagcccctctccacggcgccggcgtgttcttccagcgccatggcacgggcctcaagggcctcctcgcgccgccgggacgccgcttcagtctccgttgctcgctgctctcgggcagcggcggcgtcaaggatcccctggtgtcgaaacatgaattcggcaataataaaagggggtagcgcacgagacctaaaagtggatggatgcagagacaaatgatttagacaggttcaggccctctcaatgagaggtaataccctactcctgtttggggatttgaatccgccgagtatgtattgatctgacgatcaggttgtctcatgcccctagagggggctccctgccctccttatataggttggggggcagggttacaagatagaagccttaaccaatacggtatcggtttcctaaatctactttacaatattatcaaaccaggactttaggccgttccgtaatatacaaggaaacgtaacacccaagtcatgatctgttacatattacaaaaatataagttatcccctataactagtcggataaccatgccgtgtgggtatggggtacccataatctccacagtagcccctgagaccttcacagtcgaaaagataaccttctctcgaactagattactccaaagccgagtgcttcaatcatcttcgccatggtctcccgagtacttttaccaaatctgaagactgtggaaggctgaaaaataaagtcaggtgcaccgactagatgcacctaataggtgtagcccccgacaatgtggttaattgaacaaaccaagcatatagtcaaggaataaataatccaaccaaccgagtggttttgataatcgtaatcaaccaagtgacttgatatcaatatatagcatatgcggtgtgaatcctccaaataacatgatccgggtgatataccaactgctttgtaaaatatgatgagtgatatagcaaaatagctataaagaagcttgtatattgtgaataaagaaatttccaaagtattgggcatacgccatgcgcacactgctttaacagatgtgcttaagtccctaaaagacacatggtttcaccacacctggaaatatatggtatatgtggtataacatccgagtaagtaaactcataaaggatttaccaaccgcctgaaaaatgaccataatatataatcagcctaagccataatattggtcaataaaaatgcacacttacgtggcaaaaagcaatgatattgtatccaatcaattgcttgataaacccaaacagcaccttgactatataaaaaagtcagcgggacagctatataaagctttactgtttgacaccttttaagatgcattgtaccaactcctaaaaagttaagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaaaatatgccttcgacaccctttaaaggatgacgcatgtaacatgctcccgagtaataaatcttccgggtaatatagaccaagtgtagctcatatgaatagcttctgatctgaatgattatcccctatgggatactccaaaataaatataataattgaatcccgactggcgcaagtattcggttgatagcccttacggggaataataattggtccagtctttgagcatagaaaatagactcatgactatgaatccatgtggaatgtatccggaacaagtccaaattggagatataatcctcacgcttgagttgatgagcccctgagcatatagcttgtccttctgtcatagtcaaaattgtccattgatggtagctgacgcagttggcatagagacaagacgaccaacatagagataatattgcccaccagaggtggcaaaaatattagtggtagtgaagataatgataccaatcaaaagtgatgaagttgcacagccgtggaggcgaagaaaccagtcggcaacagtcaggtcagctagcagtgaagatgtaggcgcccaacaacaacgaaagaacagtcggtggtgacaaaagcaaaccgacgatgaagacgtagacgcgcatcaacggtgatggcgaaatccaccaatcatgaagatgaagaaaataatcggcggcgacaaacgcatccgacggtaatgatgattagcggcaacagagatagccgactatgatgacgaagtttcccatcaacggcagcagagtaggctatgttgatgaggcttgacaagatgttgatgaagatgacgatgtcggtgatccagtcaatagcgatgtagcagccgatgataacgatgagatcctctatcggcagttgcgtagtaggccaatcgtgaagacaaataattggaggagagttgatgttgttgcccaactcgtctaaaccgaaatatttgaagttgttgaagtagaatgtctattccgaagcaaagatgaagataatgactcctggagttgactcattggctgattaattgatttcttcagcttgacataaaatttgtcaaattttgagccttatatttgtgtagcccccgactctttggttagttgggaaacaactgaacatagagtcgagaattatagcttcttgtcgtcgagtagtcattgcttgattgaagatatgtgttgaaggtgtccaagtagaaatcctgaatattggagagtcacttgttgtagtaaaatatcatggcattgcatgccgagatgtcgaggttcacaaagacgtcgtggttggtgaagtagtaaaacttgcgaagtagcagcaatagagtttgccagtgccgaagataataaagatgaagtcgctccaccatgatgacaaagttgcatcgccgtgatgaagtgaacacgagtcggcggcaacagaagcaaactggtagcgaagacgcgcagttgtgaagataaaagcactagtcggcggcggcataaccagtcggcaacggaagacgatgatgtccatcagtagtggtagctgtataaaccaaatgtagaggcgagggcactagtcagcagcagacgagacgaccggcggtgaagaagataaggccaatcaacgctggcagaatcatgcagccatggaagtgaagaaaccagtcggcagccatggcaaacgtaggcagcttgtgttgaagatactgatgcctattagtagtgacagcgatgtagccagccgtgaagaaggtagcatcagttggcgttataatgggccagccgtgcaggcggtgacaccagtcagcggcggatgcggtgaccggtcggtgaagacgtagacgcccaccaacggcagcataataggccaaccgtgcaggcggaaacaccagtcggaggcggcgaaggcaagccggtcggtgaagacgtagacgcccaacaacggcggcataataggccagccgtgcaggcgaaaacaccagtcggcggcggacgaggcggccggtcggtgaagacgtagatgcccaacaacggcagcataataggccagccgtgcaggcggaaacaccagtcggcggcggacgaggcggccggtcggtgaagacgtagacgcccaacagcggcggcataaaggccagccgtgcaggcggaaacaccagtcggcggcggtcgaggcggccggtcggtgaagacgtagacgcccaacagcggcggcataataggccagccgtgcaggcgaggacaccagtcggcggcagcgaaggcaagccggtcggtgaagacgtagacgcccaacaacggcggcataaaggccagccgtgcaggcggaagcaccagtcggcggcggacgaggcggccggtcggtgaagacgtagacgcccaacaatggcggcataaaggccagccgtgcaggcggaaacaccagtcggcagcagcgaaggcaagccagtcggtgatgttctgactgatccattcctggagcgtaagagataagcctaaagccatgaatcccttttatgcatatctggatctggatcctgcagaacaaacatataggatgagtagtatctgatataaatataatactcgagaaaaaatcaagtattttaaaatatttataaatatgtatttctcctcttgtcaattttgatttccccgagcagatgactcattacgttcaaacgctctgcccaactagtcatagccaccaagcactgggagtcggcctaagcacttcccaaacatgcatatgagtgacatgagttcgtcattaatggaacaaagtttcacggatcggagtttactactcgggtacttttgcaattattaagagcagaaaataaatttatctcatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattataaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcagaagtggccaatgtgggaacaaagtcgtccatcaataacaatgaagacaccagtcggcggcgacgaaggcggtcgacgatgaaagcgaagacccccaacagcggcggcataataggccagccgtgtaggcggaggcaccagtcggcggcgacggaggcaggccggcggtgaagatgacgatgcccatcaacggtggtgtgaccaaccgaccgtataggcggggacaccagtcggcggcgacggaggcaggccggtggtgaaggcgtagacgcccaacagcggcggcataataggctagccgtgtaggcggaggcaccaatcggcggcgacgaaggcaggccggcggtgaagtcgtagacgcccaacagcggcggcacaataggccagccgtgtaggcggaggcaccacttggcggcgacggaggcgggccggcggtgaagtcgtagacgcccaacagcggcggcataataggccagctgtgtaggcggaggcaccactcggcggcgacggaggcaggccggcggtgtagatgacgatgcccatcaacggtggtgtgaccaaccgaccgtataggcggggacaccagtcggcggcgacggaggcaggccggcggtgtagatgacgatgcccatcaacggtggtgtgaccaaccgaccgtataggcggggacaccagtcggcggcgacggaggcaggccggcggtgtagatgacgatgcccatcaacggtggtgtgaccaaccgaccgtataggcgaggacaccagtcggcggcgacggaggcaggccggcggtgtagatgacgatgcccatcaacggtggtgtgaccaaccgaccgtataggcgaggacaccagtcggcggcgacggaggcaggccggtggtgaagtcgtagacgcccaacagcggcggcataataggccagccgtgcaggcggaaacaccagtcggcggcggcgaaggccagccggtcggtgaagacatggacgcccatgaacggtggtgtgaccgaccaaccgtataggcgatgacaccagtcggcggcgacggaggcaggccggcggtgaagtcgttgttgctatcagcaatggcggtggcgaggacaagccggcggagtggactcgcggccgatcgaccggaaagctgagacgcctcgagtccatgaccagcatcaatcgcctcaatagtgccgcgtagttatatgcgaacaacaacaaaaaatagcaagaaattaatctgagattaaaaatcaatatgataaataatgataaaaatcagattgagtttccccctgactgatttggatcaagtcagagaagaggagcttgaagaagtggtcgacggaaaggaagtgaaaactccccaaagcgaaaacgaagtcggcgactcatgaaattgattccatcgcgctcgttgataggaaactcgacgcaacccctacctggcgcgccaactgtcgaaacatgaattcggcaataataaaagggggtagcgcacgagacctaaaagtggatggatgcagagacaaatgatttagacaggttcaggccctctcaatgagaggtaataccctactcctgtttggggatttgaatccgccgagtatgtattgatctgacgatcaggttgtctcatgcccctagagggggctccctgccctccttatataggttggggggcagggttacaagatagaagccttaaccaatacggtatcggtttcctaaatctactttacaatattatcaaaccaggactttaggccgttccgtaatatacaaggaaacgtaacacccaagtcatgatctgttacatattacaaaaatataagttatcccctataactagtcggataaccatgccgtgtgggtatggggtacccataatctccacacctgggcggcgtcgagctttttctttagctccgcctcccagctcccgtgttggagacggagggtgtcctgcgcctcgatcatcacagtggtggcgatgagggcggcctcccgctcctcctccacctctcgggcgatctccgccagcgccgctttgcgggcttcaagctccgagacatgacggcggtgagccttacggcccacctccaccatgacatccaccgagcgccgcccctcctcgacgcgcgcccatgcggcctctcgctccgctcgctccgctcgcaaggcctccacctgggcgctgaacccatctagcaccgcggtgtttgcggcggccaaggcttgcagaaggggctcggcgctcagcggggcgacagaagacgaggagaaaagccgccttggagagaatgcgacgcggctcggcccgcctgaagacgcgctgagctcagggatgtcccccgaacccgtttggtcctgggcgtcgcccgagggagcgggcccaggcgatgcgcccgcggcctcgtcgcgagccgccccggaggctgtcgcctgagcgtcgcccgagggagtgggcccaagcgacgcgccagcagccttgtcgtgagctgcctcggaagacgccatcgcctcagcctggcgagcccgggcggcctcctccttagcggcttcttcggcttggcgagcccgggcggcctcctcccgagcggtatcctccgcctgacgaacccgagcggcctcccgggcggcctcttcagcttcccgtaggcgatctgcggcctctcgccggtcagattctcgcctttgttcctctgcggccgccggatcttcggcctcggactggccggacttgggatggcgggaggaacgcgtcgggatatcactgaagcgggagaaaaaaccagaagacagacaagatggataagagagaacttgcttttgggataaagggaagatggttgcaaaaggcgtgaaacgaacctgcgagggggtcggttaaacgaccacattggaggggaaatcaggtttccccgggatggttccgtctcccccgtcttgcggagccgcttcttcttgcgctccgtctcgggctgtgatgtcggcgcggccccctccgggcgcctgctgctggcacgcaccgccccgccccctcggggaggagatgggggaggtgttcctcccagtttcctcttcccccgggcgtcggcagggcggctgctccccgagcccccgtcgcggggcccagaagcacgaccccctcctggggtagattcttcccggcggctcccgcccacggcatcgtggcccttaggagcctcctcctctgaggccccgacccccatcataatggtcaggatggaggcgcggtctggatcgatgcaaagggggagaactccttgaggaatgagggatgcttccacggagttgagattcagcacccgttggaccaatatcttgaagtcctcaggagcccagtcccatttgactccctggtgggtcctcatgtagtcctcggacccggtgtactcccatgcgctccgggcgcgccgctgaagcggcgcaatccggcgacggaggtagtcgccgtacaccatggcccctgtgagcccctgggatcgcaggcccgccagacggtcgaggacggcgtcatagtcatcccccagatctaccggcgcccgccagctggagacctgcgccgggggctggcttggaagtcggaggcgcgcttcgttggcgaggggggtgtagaaccagtcgctcttccagtcgtcccacttcttgcggagggcgcaggggatgtagcagttcagcaccggcccccgcggctggaagtagcagccaccaaccaccgacggcggcgataccgactgcacggtgaagaaccaccggaacagccgaagagatgggcgcaccccaatgaacatctcgcacagatgcgcgaagatggccaacgtcatcaccgcattgggggtgaggtgcgccatctggagatcgtagaactccagaacatccataaagaaagaagaaaatggcggaaccagccccgccattgcaaaggggaggaagaagacggaccgcccagggtagtcaggtgccgggcgtccctcgcccagcatcactatctcccggccggtggcagactccggcatgaagcggcgcggcagccccgcctgcctctcgctcacgatgcgagaaggcggtagtacgctaccgtcgagcagagcagagccccgtgccatggcgccggaggaagggatgattgagaacgagcgcgtgtggcgaaggtgaggcgcagcagagagagagttagggcgcaagcggcgaaggcaaggggaataatggcgaaaggaagggagcaaatcttttccacggtgtctttatacccttgccatcgctgtgcccggctcctcgtttctcgcgcccactatctcgctccctcgtttctcgctatctcgctccctcgtttctcgtgcccacgcttccactaatcccattcgcccgcttgcggcgcatgaggtggatatgcggttgcggcagtcgagatagatcgtatcgtgcgcgcgttaatcacgctcgtcgatcgaagtgacgttgccatgtctccaggcggagcaaatcggctcgcccagattcgtgcgctgctcaagagatgtggcagtcttgaagagaccgcccattattgacagccaagttaccatgaccgatgtgcatggtttgagaccgttgggtttctgcccaaccatggagaccggtcccacctgtcaccaggctttaggagtggcgtcacgcccgaccgcttcccttgagaagggcgatcgccctggcataacgccgggggctactgtcggtgatatgggaccgggagtatcgtgaccagaggcttgaggcagacacaatcgcccacgtggcccggcaccctcggggacgtcgggcccgagggtgaggtgtccgccctcctcttgatttccccgaggggggtcgggttactcctgccccggccccgacggccgaggcaccccgacccctaatgaagtttgcgccacatatatgggttaggtgaacacggcagggctcacctaaccgcatttattgcggactggacaggcacgtcatgctgcatgcagcgcagtgcagcacgttcctttatccggtctgtgaccagtcacagaccggtcagatcaacggttaggtggcgactggcggtctgacgcacgcctcgccccgtcccgtcaagacgagagcctctaggcacacgtctccagccggagctagcgtgttacttcttagagatggcacgttagccctggtcagatgaataccaggcttcatcccaaccattacaggcaagatgttacacgaagaagggcgaaatacatgttgcaaagctgacgcgtggtggacaagaatgaccgatttgtgaccggtctgacactgttcatatcgtcagcagacagcctcgttctcacaacgagcctgcctccggcagaagtggtggtaggtatgtgccgtcccgtcagaaggacgttcggagggcaaccatgcaaatctccgcttcatttatgaagagaagaaaagtccagtttggaaagggaggggtgcatgtggtatccccttgagatataaaaggaggaccttgcccatttagagtggggggggctggagattgacgaacaaagaagaagggagagtttggctcacactttgtaactccttcattcatagatccaccaaaacacaggagtagggtattacgcttcccagcggcccgaacctgtatacgtcgcctgtgtctcttgctctttggataggccgcgatctttccacatacagagagagcctgagatctcaccctgagcccccggccgaaccggcaaaggggggcctgcgcggtctcccggtgaggggccacgagctccgtcaatctttttttcgaatggaggagtatctttcaaagtgtgtcatgtcatcatgatctccttctgcttaggtacgttagcattttttttaaaagaaatccaatgcaaaatattagttaaaggggtctaaaataaatatttggtaactagagggactaaatcgaaattcactcgaaaaataaacccctccctctcccctagaggtggccaaatgggccgggccaaacgggcggcccggggcacggccgaacctgtagcaggcacggcccggcacggcctgctacagtaacgggccgtgccggcacggcacgagtagccgtgccgtgcttgggccgctggccgagcccgcgggccggcacggcacggcacggctactgtagcgggccggcacggcacggcccgcggcacggcacggcacggcacgccggcggcccgtcaggcgcggacaaggcgggcggcggtcgaatgggaaggcgccacgtggcactaacggctatttgaccgttcaaatttgaaaataaccgttgggaggctaaaaaattcataaaaatttcgaaaaaattccaaaaaatctcaaatttcgccctataaatagggcatgaaccctagccatttctcctcatcccacactcctcatcttgtgctctcaagtgttttaagtgctctctttgttctcaagtgtgcattttttttgattttgacaaaatttgctcaaattttgtcaaaaatcaaaattagtttcgtagttcaacagtttgatcgcagaggtttgaagagctcgcggttggaaagatgtaagtaatattcaaatttgtgtattatttgtattgtgtttgtgaattcaataaatattcgaaaatttgtttatgtcggtttaaattttcagaatggatccgaactttccataccagtcgccgtcgttcaccttgggtgatttcgaccccaactacatgtcggggtttgacggtacctccggatcggctccaactccaccatctgtggaggaggtaccggttcatacggctgtcgttgaggaggtaccggttgaggcggcgacagcttcggaaggattttccggaaccgcgagcggaagtgtttcgacacacaccggctcgaagagatcgagaacctccgttgtgtggcaaaacttcgacgagataaaggaaacatgccccgacggaagggaggtatcgaaagcccgttgtagaatatgtaggcaaattttatctgctcgttcttctggtggtacaggtcacctcaagcgccatgcggagtcgtgtgccaagaagcaaggaatacaactccggcagcagcaacttatggtaaacccagacggtacggtacgcagttgggagtacgatcccatggttgctcgggaatctcttgtccggttaatcgccaggcaagatttacccctgaactttggggagtcccctgcttttgaacattacattcagcaatctcataaccctaggtttaaagctgtgagtaggcaaacatcaactagagatttagagaatgtttatcacaaggaagcaactgcacttaaggaactgtttagtacatgtactttctctgttagtgttacttcagatatatggagtagtagagctagagaggattatcttagcgtagttgttcattttgttgatgatgattggcaattacaaaagagagttttagggcttaggttaatagatgtctcacatacaggagaaaacatagctgaaagaattagggaagtaattaatgaatttaatcttgctgataaaatatttgctgtcaccctagataatgcatctgctaattctagggctattgaaatattgcaacctttatttagtgtgtatgctcaatcttttctactccatcagcgttgtgcatgtcatataattaatttgattgttaagactggcatgaagagggtaggtgaccacatcgatgctgttcgtcaagcaatcgcgtggttaactgcttctaacccgcggattgctgcatggaagaggttttgcaatgcggccggtgtgaaagctcgtaagtttgccaccgatgcagagcatcggtggaatgcaacgtatttaatgttaaaagttgttttaccttatagtagtttcctttctgattttgttcagtcacgtggtggcccaagaaacagtgacgggtcttcagtactgaacgagcatgtttgggcaattgtccaaaaatttcaccaatttctagaaactttttatgattgtactctaactttgtcacaagtttattatccaactgctaatataattttgcacaaccttcttgaaattgctactttatttaaagaatacgaaaatgatgacattctaactgaacctgtctttcacatgaaacaaaaatatttgaaatattggaaaaatatacctatgttgtatgctcttgcttttgttttagatcctaggtgtaaattaaggggattgtctgctattttatcacttgttggagatactataggtgtagattatagttctttttatactgaggttagacgtaaattatatgaggtttttggaagatatgaagtaaagtttcaggaagttcgccagcagagaccccctcctatccccactacaggtaagaagaagatacagtggggtaggatttggggtggatcgtcttcaagttcaatccaaggtggtggcagttcgtcggctacaagtgtagacgcctcttcgcatgttgtggccgaagagttgtccggttatttggacagcgacgccatccaccacgaagcacaagatttcaatgtcctcgggtggtggaatgaccacaagataacatatcctgtgctttcaaaactagcacgggatgtgttgacggtgcccgtgtcgacggtgtcctccgaatcggccttcagtctatgcggccgaatcatcgaagaccggaggacgactctgcgcagcgaccacgtcgaaatgctactaagcgttaaagactgggagcttgctcgacaacatgcccaatacactgcggacaaccaagaattggccgcccagttcgagcaactctacctggatccagaccaaccccagtagaattttgttagaagtagttctgacctttgagctgtactcttttctttgtcatggttttctcattttcccctatgagtttttacatgacaaagtttttaacgaggcagcatgtatcattgtatcctgtaatgatataaacatcaataaaggtcattactatttttaacaaattcttttacaatattttcgcaagtgtggatttatctttaaattatttcaaaataatgaatcacaatctatatttttaaatttttcaacacaacaaaaaaataccattttttcttttttttaacattagcaaatcattacttttttaaaaaacttttatttccattttttaaataccattttttcattttttaacattagtaaatcattacttttttttaaacattttatttccatttttaatttttttttcttatacatttactttgcttttttttttaaaaaaaaacactgtgcactgcaggctggtggcctgccttcacgggccgccgtgccccgaacggcccgtgggccgcgggcgtgccgtgccggcacgggcacggcccggccatccacgggccgtgcttgggccggcggctcggcacgtgggccggcacggcacggcccgtttcatcagccgtgcctaacgggccgtgcctaaacgggccgtgccggacccgtgcccgtgccgggccgggccgtgccgcccgtttggacacctatactctccccccatcgtacgcaacgaaacccgattgccgcgccgctccccgtggagcccaagtggcggcgagggtttccgccgcctctcgtccgcctcgccgacctcggaccccggcctccatcctcctcgccgacgagagcccaagtgtgccgctccccgtggagcccaagtggcggcgagggtttccgccgcctctgctccgctcgccggcgacagccccacgttctcgaccgccgtccccaggtccgcttccggaatctcatcctttgcgggctgatactgcttcgcgcgtcaagccatcaccagctgctccctccgtctccggaacaacaatattctctccgactgctcacgacgggagagcggcgcttcggcgacggcgatcccggtacgcacacgcttgagaggctcccactttcttcattctgctactgtacggttggattcgtgcataacaatcactcaaatctctatgtctaacctgcccatgattatttattaagttcgagttggttgaagaatccactttgttttgggggaacttttacatgatagagaaatgaatggtcttccgttgtgaaacaccatgcttgattttacaggatggtgctgtgttgtctcgtttctaggtttatagactgtcatttgctatagaacctcatggtttatagttaaactgcacattagatctgtcaagagcagcagacaacagtagtagacgttttatttattaaatgatgaactgttggtctcaactctcaagcagtattttgattatctttaattctaagtgccaatagcagcaatagtaatggacgtttctaaatgtaattataaggtttgtgtgcatatttactttgatacaaggatgcataccgtgcatgcatctcaattatctatgccactaatctaatatatattttggagatgaaggaacagcagatggagaaggcaaacaacacaatgtttttcaaccaagcaactatctactctactccaagtatctaagggtaatgatactaatcatatggatcccttaccctcaatttgatatagcgctattgttcatgtgatatgtattgtctagtgaggcatgctgaaatttggctttaggatcaggttggtgagttattgttattttgggagtatataggctcaagagcatctgacacaaaagaactcctactctctaataaaattattgtgtgctatttatggggctgcctaggtgatgaggaaagaatgagttcacaaacgtgttaaactgttaatccagtatccctgaaaagtaggttggtttaatttaagttcaaatgccttgtggatttcaattggtttttatggctgatcttttgcggactgggatggaagtttggtttaatcattttgtactaggttagcttgtccatttctcttatgctctcgttggcatgttgtgttcttgctggatacttattcatctcagtaccttcatgaaagtggggtcaatgtcatccataactaggtcagtaaggactatgcgcaagaactgagtcgagtctatgtaaaagtagttgtccttttgatatggtagaggaattggtaggactgcttaaaaatagttgtccacgtattcgtttttaggtaaatggtgttataggactgcctaaaataaattggttattatgaactttgattgatcttatcagttcttgccctcttgctatgcactaagtagtcacctcttagcatttatcatttcatttacatgtttactctatagttcagtagttcttttgacatgattggtgtcttcgattttcttccatagaaatgtaagttcgaaaatattgaacatgtttgatgctttaattgtcgttggggcagtcactttaggctgaagaatcattgtagcgaatggattatcaacaatcagatggaatttatgacatgccagatgaaccattgtttacactaaatttgaggttgagccacagcaatgacctggatagagttcataaatctttcaccagcaagattgataaggcccgaacgtatctcacgggtaggttcagaaggattgtcaaggtcaaaggttctaagagaaaggagttcgttcttacccctgaaggccctgatgtttttaccattgctttcactgatggtactaacagagtaactgccataattgaagagagaaatatgtggttgagaggtttccaaactgcagacggacacatttttgagtttaatgatgaacacggcaatgaagggaaggatgctaatctggatgacaagactgatgaaatgaataatcagttcaatggtaatgacaaaacaagagatgaggaggtgaaggatgaggaagaggctataaaggaccaaaaactgaaggttataaaggacccaaagatgaaggctataaaggaccgagggatgaacaagcactgcaaacaaaaagaaaagagcaaagcagcatgtggatccaaaaagaagcaagtgaataggaaagaccaactcaatccaaaaaagtatattagaggatctgttctcttacggcatgatagcaattatggttctcttcttggacctaacagactgcctctgtttcaagtagtatacagtacaatgagggatatgctgcagaatttggctcactttgatccaaacaactattcagataaacacaagcgctcgatggctgcactgatcatccatacagctgagactttgaagaataaatatatatcaagtcttgtgttaaattctttcaatccacatattggtgcaaggcttcaagcactggatgatatgggagcagcacatattaacgggtggtctacagcctctgaattaattttgaaatccattcacctcccatcaaaggtttgggactttcaacagcaagaattttccaagtgcaatgaattttacaaaaatcag

SEQ ID NO: 60015 - DNA, 9372 bp, Oryza sativa
cgtcgccgccgaatggtgtcgtcgcctatacggttggttggtcacaccaccgttcatgggcgtccatgcctccgcctacacggctggcctattatgccgccgctgttgggcgtctacgacttcaccatcggcctgcctccgtcgccgccgactggtgtccccgcctatacggtcggttggtcacaccaccgttgatgggcatcgtcatcttcaccgccggcctgcctccgtcgccgccgactagtgcctccgcctacacggctggcctattatgccgccgctgttgggcgtctacgacttcaccaccggcctgcctccgtcgccgccgactggtgtccccgcctatacggtcggttggtcacaccaccgttgatgggcatcgtcatcttcaccgccggcctgcctccgtcgccgccgactggtgcctccgcctacacggctggcctattatgccgccgctgttgggcgtcttcgctttcaccgtcgaccgccttcgtcgccgccgactggtgtcttcattgttattgatggacgactttgttcccacattggccacttctgccatcaccaaggggaatattacaaagctaagtcatcatttattttattctttatatgatatttttcctttccctctgcctcactacaccaattggtcttccattgagtagtgagtcgggggctacagatgttatatcatatttttcataatatttatcttgattgcttgcgacataatctgagtacaaaagtacctatcgagttatggagttctatcttcctatgctttccgtttggtttgccaatggatcgttgcctttgggccgattcctagcacccgggggctcgttggatggaccgagtaacgcaaggtgctaagtattattcggaataaatctaaagcatagagatgagataaatttattttctgctcttaataattgcaaaagtacccgagtagtaaattctgatccgtgaaactttgttccattaatgacgaactcatgtcactcatatgcatgtttgggaagtgcctaggccgactcccggtgcttgatggttatgactagtcggacagagtgtttaaacgtacagagtcatctgctcggggaaatcaaaattgacaagaggagaaatacatatttataaatattttaaactgcttgaatttttctcgagtattatatttacatcagaaactactcatcctatatgtttgttctgcaggatccaaatccagatatgcataaaagggattcatggctttaagcttatctcttatgctccaggaatggatcagtcagaacatcaccaccggctcgccgtcgtcgccgccgactggtgtcttcgcctatacggttggttggtcacaacaccgttgtcaggcgtctacattttcaccgccggtttgctttcgccgccgccgactggtgtcaccgcctacacggctggcctattatgccgctgttgttgggcgtctacctcttcaccgaccggcttgccttcgccgccgccgactggtatctccgtctgcatggctggcctattatgccgtcgttgttgggcgtctacgactccaccaccggcctgcctccatcgccgccgactggtgtttccgcctgcacgctggcctattatgccaccgttgttgggcgtctacgtcttcaccgaccggccgcctcgtccgtcgccgactggagtttccgcatgcacggctggcttattatgccgccgttgttgggcatctacatcttaatcgccggtcgtctcgtctgttgctgactagtgcccttacctctacgtctggtttatacagctaccactactgatggacatcatcatcttccgtcgccgactgattatgccgccgccgactggtgcttttatcttcacaactgcgcgtcttcactaccggtttgcttctgttgccgccgacttgtgttcacttcattacggcaatacaactttgtcatcatggtggggcgacttcatctttattatcttcggcaccgggaaactctattgttgctacttcgcaagttttactacttcaccaaccacgacgtctttgtgaacctcgacatctcggcatgcaatgccatgttattttactacaacaagtggctctccaatattcaggatttctacttggacatcttcaacacatatcttcaatcaagcaatgactactcgacgacaagaagctataattctcgactctatgttcagttgtttcccaactaaccaaagagtcgggggctacacaaatataaggctcaaaatttgacaaattttatgtcaagctgaagaaatcaattcatcaaccaacgagtcaactccaggagtcattatcttcatctttgattcggagcagacattctacttcaacaacttcaaatatttcggtttagacgagttgggcaacaacatcaactctcctccaattatttgtcttcacggttggcctactacgcaactgccgatagaggatctcatcgttatcatcggctgctacatcgctattgactggatcaccgacatcgtcatcttcatcaacatcttgtcaagcctcatcaacatagcctactctgctgccgttgatgagaaacttcgtcatcatagtcggctatctctgttgccgctaatcatcattaccgtcggatgcgtttgtcgccgccgattattttcttcatcttcatgattggtggatttcgccatcaccgttgatgcgcgtctacgtcttcatcgtcggtttgcttttgtcaccaccgactgttctttcgttgttgttggacgcctacatcttcactgctagctgacctgactgttgccgactggtttcttcgcctccatggttatgcaacttcattacatttgattggtggcatctttactaccactgacatcttccgttacttctgatgagcaatttcgtcttcatgttggtcatttcatctccatgccgactgcgtcagctattgccaatagacaattttgactatgacagaaggacaagctatatgctcaggggctcatcaactcaagcgtgaggattatatctccaatttggacttgttccggatacattccacatggattcatagtcatgagtctattttctatgctcaaagactggaccaattattattccccgtaagggctatcaaccgaatacttgcgccagtcgggattcaattgttacacctattttggagtatcccataagggataatcattcagatcagaagctattcatatgagctacacttggtctatattacccggaagatttattactcggaagcatgttacatgcgtcatcctttaaagggtgtcgaaggcatattttttggcctaggcctaatatgtctgcagcccatattttcaggtgtggcctgtcacgttcttttagggacttaggcacttttcgcttaggccaaagtgcgcgtgatcaagtgcccaataccttaaaatccttttataccgcagttattcgactttttaggagttggtacaatgcatcttaaaaggtgtcaaacagtaaagctttatatagctggcccgctgacttttttatatagtcatggtgctgtttgggtttttaagcaattgattggatacaatatcattgctttttgccacgtaagtgtgcatttttattgaccaatattatggcttaggctgattatatattgtggtcatttttcaggcggttggtaaatcctttatgagtttatttactcggattttataccacatatgccatatatttccaggtgtggtggaaccatgtgtcttctagggacttaagcacatctgttaaagcagtgtgcgcatggcgtatgctcaatactttggaaatttctttattcacaacatacaagcttctttatagctgttttgctatgtgaattttcaatgatgtagccaactttaggttacactcatcatattttacaaagcagtcggtatatcacttggatcatattattcagggattcacaccgcatatgctacatattaatattaagtcgcttggttgactacaattatcgaaaccactcggtgcatctagtcgatgcacctgactttattttttcagccctccacagtcttctgttttggaaaaagcactcgggagatcatggcgaagatgattgaagcactcggctttggagtaatctagttcgaaagaagattatctttccgactgtaaaggtctcaggggctactgtggagattatgggtaccccatacccacacggcatggttatccgactagttataggggataacttatatatataaaatatgtaacagatcatgacttgggtattacgtttccctgtatattatgaaacggcctaaagtcctggtttgataagattgtaaagtagatttaggaaaccgataccgtattggttaaggtttctatcttgtaatcctgccccccgtcctatataaggagggcagggagcccctctaggggcatgagacaactagatcgtcagatcaatacacacccggcggattcaaatccccaaacaggagtagggtattacctctcattgagagggcctgaacctgtctaaatcctttgtctccacatccatccacttttaggtctcgtgcgctaccccattttattattgccgaattcatgtttcgacagaggaggaggcggcggcgtcttctcgggctttcgtggggtggaggcggcgtggctactggcgaggagaggacgagagcagcggacgacgcgtttttttgatttttttttttactagcaaaagtgcccgtgcgttgcaccgggtgatcacggagtgtgtacagtgacaaaaagtgttgtttggtttagacaactaatctgctaaaaaaattatttaccacgaacgtctcaagcacccatgtcaaatcaaagatttaaatcaagattgactggttccaccacaagaaacttatccggttaaactatacccactttgcaattgtgggaatatacatgtgtattgttacctgagaaaaatatgtggacttcaacaaatcgtaaaaatcaatcttattaattttgtgagagtgagtattgttttttatttacaaattgtatttgaggtcaaatattaataagtagacattaaaaaaaatgaaagaagattagacggtgaggggaaaaaataaaaaaataaaaaaaaagagcgaacaaggacaggtcaagaaaattttattatttaaacatttttaataaatagatgctcgtgttacgtgtgttgcaacgggtaaactaaaattataataaatataaaaatattagatcgttaggatttagtttttatgttatgagccctttaaaaaaatatattccttacataaaaaaaagttgtaaaagaaaggcccattagacttaaaaccaaacaaaaattaaaaccaaccctataaatctctatatgtgccggttatatggtatacttgtgctgtttttttattcaaatacagagtgctcatttttttttaaaaaaaaggcccgtcagatctaatccttatccccgagagagcaagcggagagcgagcggagcaagcggcgcctcgatccttccgtctcctcatcttctcgtttttcccgacttcccttatcctctctctcctcccttcattttcctctttctcggggttctctctactgccatcgcaaccagcgacgccctcccctctcccctcaccagtgcgccgcttcccctcccccttcgcacggcgccctccacccggctgacggcgccctcttcctttcggtcttctctctcgctctcctctttctcggagccgaggcggcaggcggcggcgcaagaggggaggcagcgggcgacgggtggcggcggcaggtggagacggtgaggcccagcagcagcgggaggcggtatcggaggtgatggccgcgtccgcccctctgcggcagcggcgggaggagcggtggccgcccagaggcgccctcccaccgctagatccggcgggaggaagggctccggagctgcgccgcctcgccatcctccccgccgccacctaatgcgtcggtcgatccagcggtggcggctccctccgccccctctcgccttcctccggcggcggtggcagcgtcggcggcagccgcgggcggatccggcggcggcgggcggatccaacggcggaggctccctcctccgccgcctctcttctccctccggcggcggtggcggcggctgcgacggccgcggattgatagcgtggcgacggctgagggcagcagtggcgacggccgaggtcggatcggcccctccgctgcagcggcgggaggagcggtggccgcctagaggcgccctcccaccgtaactaattaacaatgtttgttcaattatttagttattaagtaaagtggcaaaaacaccactaaatatgtcgtaaaaaagtattttaaccatgtctagtatgtttgtctatttacgcaaatatttatagaaaagatgaatgatcaaatgaattcaaaaaatcaacttcgaagatgaacgtacagcgtgcatggcaccctcacacgcaagtgggctatgcctgtcatgatgcaaggttaggctggtgaatgcaaaattggtcattctctacaatggtgtggttgaaatcttttgttgaacccggcacatggtcaaacgatagaacttgtacatactccctccgtctcttaatattagaggttttgaccactcgtgttattaaaaaaattatgcaattatagaaaacaaaaagttgtgtttaaaatactttggataataaaacaagtcacaaataaaataaataataattctaattttttttaataaaacgaatggtcaaatagtgcaagcaaaaaaataaaaaaaaatatattaagggatggatggagtaattcagagtacaattggctttttgtttgattaggctgtgtttagatccaaagtttggatccaaacttcagtccttttccatcacatcaatctgtcatacacacaacttttcaatcacatcatcttcaattttaaccaaaatctaaactttgaatccaacttggagcacgagagcaacatatcacttggcagggctacagaatcctgacgcacatcaactcactctcatatgaccatgcaaacaagtacccatatcattagtctgacaaatcccacaatataaggtacaacaaccacatcatcattcatcgtcgcttgatgtgttcacgtcttaagcgtatgttcggcgtgattaaaaagaaatgcattgatcaccacctactcttccgccatccgttgtgaactcgtgattctggtgcaagcaagattcctccacgttgcagacgtggggtggggcttgatattcctggcactgatctacagagtgattaaacaaacctcacagccaggacaacaggaataaggatatactactagcaactgccgtatagcaagatcaggaagatccagcaaccaaacggagacaactaaccggctaaccgcagtataccagaagtagctcgatcggtaagagccagatccagaacacacacactgtttttatctcttggtgcaacacagcctgtgtttgtttttcttgttgcaacccagcctgtgtttttcctgttgcaactgatcccaattctcaaggaaattaaacagatcatctgcatggctatcctctaactttgaataactacttcctcccttaaatataagggattttggatagattagacgctttatagaaccataaatctaaacagagtctatctaaatatattatattttaagacagagggtgtaacatgtggagtattccttctatccatgagtaacttgagcttttcacttaccagcagcttttcatttatttacccccaccagttctataaaaaaactaaaaagtactactagtattactccatctttggcagcagtcgctgtgtttagttcgtgtgcaaaaaatttttttattactgacacacgtttaaagtactaaacgtataataatattaaataaattacagattctgcctgtaaactgcgagacgaatctattaagcctaattgatccattgttagcaaatgtttattgtagcatcacattatcaaatcatggcgtaattaggctcaaaagatttgttttgcaatttgcgtgcaaactgtgcaactagtttttgtttcacatttagtgctcttcatatgtgtccaaacatttgatgtgacgaaaaagttagaagtttgacggagaaattttgaatctaaacaccgccagtgttactttgcaaggcggaaagacgcaaccaggcgcacacggttccaccgcaaaactgccccccaaaccgaagcgcacgctacctcggcatccaccaccacggtgtttgcttgcttgccccccgtgaccgttttgagccgtccgtgcaggcgtgcattcaccagcgcgcgcgcgcgcgcggcgctaggacacgccgtgtcgcggcgcggcacggcacggcaagtaccttaactgaaacccaccgcgcgcgcgcgcgggcataggcgacgccgcgacggtgcggtgagccgttgagcagtgagctactagtggacggcaaaggcgccgcccttctagtaggtttcagtgtaccaagggattaataacaaaatcacgctctgattattttatcgtctagaattaactgtaactgcgtccagatcctgacgcgtatcactccagataaaccaaaagattacaaaaacatatctgctctttttatttttatcgtctaagtttaatagaaaaaactgcatcctgatgctgaatgtctgatgcgtatcacaacagataattaagcaaagattaaaaaacaaaaaaaaactctatctagaatcctatatgtcgggactcgctctacagaccgggacagggaaggtagaatcagctttcgttgacccgctcggcgttagcactcgagagtccccgtccatcctattaatcctcgggcgtagcaccacctcacctagtctccaagctccatcgaagacgacgactcactgctagctggtagctgctgccggtggtgccgatcgactgccggacggcgggcagagacgccatgggagaggagaagagccagcagcggcggcggcagggccaccctctcctgaggggaggcggcgcggggaagcaggccgggcggcgttacacccacggcttctccgcctcccagatggtcgggctcgccgccctgtgcggcgcgctggcgccctcgctcccgccggacacccgcgacgacgactacgacgacgccggaggcggacgctatggcggcgccggtgcgtccgacgccaaggccgtcagggacttccttctcgcctccgccgc

SEQ ID NO: 60016 - DNA, 6375 bp, Oryza sativa
tctccatggcgttcctaagaaaatgtatctgataggggaagccaattcacctctcacttttggaagaagctccaagaagagctgggtacccgattaaatttcagcaccgcgtatcacccgcagacagatggacagaccgagcgtctaaatcagatcctagaagatatgcttcgcgcatgtgtcctagatttcgggaagacctgggataagagtctcacctatgccgagttctcctacaataacagctatcaagccagcatacaaatggcaccctatgaagcgttgtatggacgcaaatgccggacaccgctattgtgggaccaagttggggaaagccaagtgttcgggactgatatcctgagagaagctgaagctaaagtcagaaccattcgggataatctaaaggtggcccagtctcggcagaagagttatgcagacaaccgacgccgtgacctggaattcgcagtggatgactttgtgtatcttcgggtcacgccattgcgaggtgtacacaggtttcagacgaaagggaagctcgcacctcggttcgtgggtcctttccgcatcattgctcgacgcggagaagttgcttaccagttggagctgcccgcctccttgggcaacgtgcatgatgtgttccatgtgtcgcaactcaagaaatgtcttcgagtgccatccgagcaggccgactcagagtaaattgaagttcgccaagacttgacctacgtggagaggccagtgaaaatcctggacaccatggagcgcaggaccaggaaccgggtaatccgtttttgcaaggtccaatggagcaaccacgccgaggaagaagctacctgggagcgtgaagacgagctgaaggcagcccatccggatctcttcgccagttcttccgaatctcggggtcgagattccgtttaaggggggtaggtttgtcgcgtcccaaaacgactctaaaatacatcctcgaatttatgcctagaataattaaaatccatgtgaaagcctccacaattaaaatgtgcaaagttaaaagtcaaataaggcttggaggatttttgtatatttcctaatagcctaaaatgcgtaaataaattttagtggaattttcagagcacaaataataattattaagaaataaacaaagttaaaatgattttataaaaggaaaaaccctaaaaagttccctttccctccccctctccctcttcggccggtccggcccagctctctatccctccctctcctctccccgcggcccattcggcctcctccccgcgcgcgcgccgctgacgggcgggcccgcccgccactctcgctgacgggtggggcccacccgtcatccccttcctcccgccgctcccgccgccgccgcgaatcccgccgcccccgtctgccccgcgtgcaatcaagaggggggaaatattccccgtgattccctccctctttccccccatttttccctccctctctccctcggattcgtttggaaatctctcccctaacctcgccggcgccatcaatggcggccggatcttccgcgcccgtttcctcctcgtccggccgctctctctcactcccgaccctatataaacactccccgtgcctccctccaccgtttccgccactcgccgccctctctccccgtcggaatcgagctcgcgccatcgctctctctctctgccgtcaccgccgagctccggtccgccgccgtcgtcgccccggaccacctcccgcctcggcgtcgccaccttcggcttcaccgcatccccggcgacctcgtccacccctccgtttcattcgccgaccgccggaacgccgtcgaccccgtccacccgagccgcgccgccgtcttcctccgctccggtcgccgtttccgtcgtcgccgtcgacccggggtgagccgtggaccgccgcttcttttccccctccccttcccctctctcggccgccgctccgccgtgcctatggccgccgccggcgaccataggggcgcgggcgcgccgcctcccgccgctgcgccggcgtggccgccttcgggcgcaccgtgcggctgccgcgtggggcccggctgtcagccgcccgcgccctcgggtgcggctgacgcgtggggcccacggcgccgcccggtgcgagcccgggtgcgcccggtccaccgtggaccgtgaggctgccgcgtgggccccactcccgtggacccggtccgcgcgcccctcccctcggctgacgcaataaatccatttttaaattaaattttaaatgaagaaattcgcaaatattcatttaaagagcatataaacttcaaatggccataacttggccatttgaactcggaattggaccgttcaagtctctaatttttccttaagaagtcaagaacctatttttgtgctttgttcctgcttgttatatggagtttattagagtgaaagccttttcttttccgttggtcgtgtagacgctgcagcttcggaagatccgctcttcgtggaagttgaagccggcgtttgggaaagcgagcaaggcaagtcacatcatccttgaacatattgaatcccagtttataaaaatatgttgatttaaattattgcattatcgctttatttaaattcccgcgtaatcactgttttatttagccatgcctatttacctttgttatgaccttattattgttattgttattatttccttgttcaccctagaataaacaaaaccccaactagtggacactctactcatggtaccactagtatgattttaggtagatgcttcgctatttaattaggtaacattaggcggttttacaactctagactttgggatattcatatcacctggacactttggaattgttggagtattgtggaattggattcacacctccccctctattcaaaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtagacggatggagatggacgaagtcgggggtcgatggacatctctagggcaaatgaaggctacacgagctgcggcccggtagtcgagatgtcatggcacagggccggtgtcctgctgctaggggctcagtcctgcctacctgtcccggagattctggccgtaggtgggattgggtcggtactcttgtctatggctaggatgggttggaaactatgtcacgtcttccgtctgtataccgtggtggtatgtggcacgtggttgcacgtgaggaagatgtgtcttgtgggtaaagatgtacacctctgatcagagtataacctattcgaatagccgcaccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgataaataataatgtatagttctagaatcgtgtctacaaaatagctttgagcaactaaatatctttaaatgccgtttactgcaaccctaaccctttatattctaattcccttgtactcccttgcatttattctgcacttgtgggtgtgtcttgttgagtacggtggttgtactcagtcttgctcaatttttcccaaacccagaagaggagcctctggaagatgaaggctttagtgtctagctcgtgcctaccgtcaagcgcctgtggtcgtcgccctagtcttccgctgtttcccgtttgtctttgtgtgtgctgggccttcgtcgcccatgtaataaattaactatttacgcttccgcttgatatactctgaaatgtatcaactcttggtgtaccttgcctcctgggacaaggaataatacacgcacgtaaggaacgcccgttgggttaattccggtcgtgacagtgcttgcctcctgtctgaacgcagagtgcacgatttccgaggcgcaactgggtggttacaagggaacatggtataacaattaacgaaggaaggatcaaatgcaacaaattaggtaggctgccattctgccttgcagacgggacaagcagattaagtgcgatcctatcaatgcataatatttttcaagcaacataattaagttcaaatataggctcgagatgttcaaaggtggcttgccttgctcgagatcttgagcttgatcctcgaaatcctcgcactgcgggtcttcgggctccgaaactatacgcaaaacaggacaactcaataaacggcgaaaataaagctctattaattacctctaagcgtgccattagatagatctcgagattaggaattttggaagttgaacggagtcaaacggacctacggttgggaagatattgaatttctaagattattggatttttggtctaaaggaaaaggatttatttaaatcctttttgaaaaagaaaagaaaagaaaagaaggagggggaaaaattagacttccctcgggcggctagggcgcggcccgagagaaaagggacggctctgccgagctaaatgggccggccggcccaacaaggcgacccagagcgcgcgcgcgggcggggaggagagagggagccggtggaccgggctcacctcgcgtggtcccgagtgggacccgcttgtcggtgacacggttcaccgtgcggaacgcgcacccggcgcgcgctagggtttgggggagggacgcggtgcacgcgcgcagttcgcgggggacacggatgcggcgggcccacgcgcagcctcaccgctcgcggtggaccgcgcccgcgagcggggccgaggggagcggctgaccggggtcggctcgacccggtcttggccgagctggggccgacgtggcgcctacgtggctgccacgcgggccggcgggaggtagacgacgacgccggccggaacggacggcggacaacagcggcgagcggcggagcgaaccacggcgatacaggagaaagcgagcacaccgggtggttgcacgggacgaggggagtcgagccaacggctcggattcgccggagggagctcgacggcggcggattgcggcggcggcaaccggcggagggaaaaggggaaaacggcgacgaggtcacggggggccgattcccggcggcgagagcatctacgcggctacgggaatccgtcccttgcgccggattaggaggaaacgcatcgagtgaggccggcgacgagaggcgcttccgagctcgggcggcgacggcggcgagcacacggcgagcggcggcaacggtcggggcggcgccggctagctacggggaggctactcgtgctactacccgagtctaaggggaggagatggaacgaggaggaagaacggagggaggcactaccgtgcgggcgggcgcagttacgagagccgacggcgcgaaacgtgatcgtttcggcctcgggctgaggaagaggagggggagggcgcgcccggagtccccttccgcgtccttgctcgtgccggctcctccgacacgtgcaacgacgaacggcgacggcgaacagagcacgggaggcggcgacaatggcgtggcggcgagagacgaaaaagagggagattggaggaggaatgagcttgggtttataggggcgacaatgtcggtttgggagaggggaaccgacattggacggtcaagccggcgagctggcgcccggctagcggccaaaacgacgacaggaggtgacgccggcgagaggaggaaaagaagaaaggaagagggaaagggggcttgcctccttgccgctttgggaaaaggaggagggagcgggggtgacgcggcagaaggaggaggagctctgcctcatttccttggaagctagcgcggggagaggcggggccgagtcgatgacaacagcgatgacggcggggcggtttggagcggagcggcgacacgggcggcaggcgcggacaggcgcggctgaggctgacggcggcggcgaccaggcggtcggccaccatggcacgcgcgcgcgggaagcaatgggtggcgcggcggtttgagcggcgcggctcgggcacgcgtgctggctcgcggggccgagcggctgcgcggctgcaagcgcggcagggcggcggggccgggcggcgcagacggcgcaggcgcggcacgggcggcgaccacgcgggcgcgcgcacgcgaacaacggcgcgcggggagcggcagcgagggagcggagagggagggctcggctcggcgcggctcacgcgcacgcgcgcgcggcgcgcgg

SEQ ID NO: 60017 - DNA, 14082 bp, Oryza sativa
caatcaatcaatccagccctgccctcctttcggtttcgggatcccctttccccgctttccctgatgcgagaccgaattcctcctccccatccggatccggctggtcaccgttgtgcgtgcgtctagtcggagatcagcacggcgaaaaaaaaaacccgtgtgatttttaatcgagaatttcgacgacgccatgcgtgcaccgtgcagcgtgctgcgccgccgcctgtgccgtgcggaaacggccgtgcaagctcctgcaggccaaacaggccgcggcccgtcacaggcgacaagtcaggcctgccactgcgataccgacaccaaagtatatatgtgctcccgtaacacgtcgttttgttttttttttgtcaaagtttaactgctaatttccatttttatactactccaagtaacattatttttgtgtaataaggaatgtttagtgcttgttgggtggcgcaagattattcacaccgcacgccaggcagggcgcaatcgtgtcaggaaaggccacggaacattatttttcggcccaaccgatggcggcggcgggcacctcctcctcctcctcatcatcagatcacctctcgagcacggcgcaccacctcatcggccccgtactcccccgtcccgttccttcgttccgattcggtccttcgcctccaaggctccaagccacccgcgacctcgagcttcccttctctctctctctctctctctttctctctcgcggcctcgcgtccgcctgcctcctcgcgacaccgcccgttccgttcgagggggggcgaagccgggtgggagggggaagaggatggcctccgaggacggctgcggcggcggcaacccgccgggggacgcagcggccgcgccgccggtgtggaacgccgcacctgcggcgggagctggctgcggcgatctggaggaggacctccggttccagtgctgcgtctgcctgtgagttacgccgcgtcttctctctgttttttttttctccgcccatgttgtagtgacctttgccggcgtatgagcagacgatcccctttcgttgattggacgttcgtgctgcgtgattacgcgccctcgcttttgatccagtgcaattcgccgcttattttcgtcgttgatattttcttttttgcatcgattttatgctctatacattgcgccgtccctaaatttttgcgtagtgatattaagcttagatattgttaatgtaagatctccatctaggaataccggtgacgaattgtagccataatttgctctaggtgacgggaaaagcaattgttgagctcgacatcttgcaacatttaggggaacatctaaataggtttagatcatgctctagacctttgatggcggagggcctgcaacagtctgttttgttgccatttgtctaaactgcgttttacattggccttctcttgtaaatgctgaaaaggcacattgtcttgctgtagtttttttttactttgactggttttgaatctctggtcattgtgttaattcgcaaatgatggcatttaaagaaagcacagatatcttatgtagttgttcaatctttcttgcagggagcttctgtacaaaccagttgttattggtaagagtttgctgttcatgctaacataaagagcaacctgattgcatagtatatattttttgaaatctcatttatcaattactggtgcagcatgtggacatatgtcatgtttctggtgcgtccacaatgctatgcatatcatcagggagtctcattgtgctgtctgtaggcagccttataaacattttcctagtatctgtcaactcctccatcacttgcttataaagcttgaacctgtggaatacaaaagaagggaaaaagaggtactaggtaagtatccaaaatccaaaccattaaacctctttcataatataaacaatactgttcatagtaaatgtttgtatttcttgcgaagtatggatactgcatgtattgtgttttgcatatgaatacaccgtcaatttcgatgctcttgcagatctagttcaattttttgggggtcatgtttggattgttatagaagcatttatatttcaaaattattttgcgactgccatctaaagtgctagaacacaaccagttctactgagcaataatgcaatttcataatttgaattcaaattcatcaaatccaaattgattggggtcatcagggcagaagggaatgtgatggtgtattcatgtagagggtgaggttgttatggcatcgatggtataggttcctagttggctgtgcaaacatggatgtcagaggatgttgctggcaatatggggatagggatttgtaagttttgggtgagatcattggatgaggaggatattggtgaatacattgccttagagtttgtgtttaatggatattgaaagtgtagaaaaagttcacaatcttatgctgaacaacacagagttttttcgctttgcagttaccatgacagttcttaaatttcacaattcacactatatggatgagtccatccagttttacgttttggcttattttttgtagcaccagagtttcaagaattacagcacgcttaacaaaccaaacatggtttcctcttccaatagctgtttgcctgatttcagtaattagcacgtcctatttttctgcaagttcttactgatgctcttcttttggtttcgactcagaggatgagaagcgtgtggatacatattctccacaaatcattgagtttttaaactccaagagcaacaattgtggtaagaattgtgccatacaactgcaatgatatttgtctcagctctcaagtttgcctgaacttataagatgtgctaccttctgcaagaaattgatggggagaatagacctgaagaaagtaatagtcgacctccacaagaagttacatctgatggcaacactatcaatgggcatccgaagaaagttaagctggaggacgtgtcatgtgctctttgtaaggagctgttgtatcaacctgctgttcttaattgtggtcatggtaagatttaaagctagaataaaaaatgttacgtattgcgctaattgtctcacatactgacttacctttatttatgaaaagtgtactgcatgtcctgtttgtcgtccttggatgatggtgcactcaaatgccaagtttgtggaggtcttcatccaggagattttcctaatgtttgcttggatttggaccattttatcgaagactattttccagcagaatatgacttaagacgagagaagattaagcttttgaagggtgaatgcaatcaaggatcatcttcaggtaagcttatctcacatggtgtattttcttatataccatactgatacagcatattaaaattaaggaaaagatcctattatttttttagaagtaattttctaaccatagggcgatgttgcttatgtgaagtatttctagtatatggtgtagcattatcttctgcatgaagagattggcgtttagaacaagattcagtcaaacttttgaaactttccccatcaataacttttaaaatgcttagcttattttttttaaaagttatgtgaagatttaccctgaaaatcactatgataatatcatcaacttattagaatttataaatttatttccaatataaaattgtgaaagctgtactttgaggactgtaaaaaagtcaaaagtcatgtatgctttgaccgaagggagttactatcttactggtaacaatgagtattatatatttatatgccaatagccactatgatttatcctatgatgtgaaatgcgtagatgaatattagcaatagtttgtagaaattaaccacaagattttatactaccccagttacaggtcagtaggccacaaccagtgatacagcactggaagagtgagaggaaccagcttgctgctttctgggacagtcataggaagttggtttcgatctactataattctctacgatactgggctagttctttcaattgtctgaaaagatagcatggataatttgcctttcctgttttgctattggttatggaaagtttgggcacgagttatgaaagtgatatctttgtaaatacgtataactttcgaaaggaataccataactgatttcttctttcatggctaactgtttttttttgtggtgtggttaggtacttcatgcataaaagaaggcaggggtagaccaacaaataaggaaaaccgtgcacatcaggatgatgacttgtcagatgttcatattggggttggatgcgattcatgcggggtatgcacaagttgtgaactttttaagatttggtgaacatacatccaatggataaactgttctagtcgcctagtaatatccaccatgcagcccaaatagtgatttttggttactggtagtactttgggttcactcagtgccagaaaaaaaatgatttcgtctcttaaattattcacactaagttgttgcaatctccatattctatcttgtgatcactttgatgggaacacattttcaaattttatttaagttattagtacttaattcaagtgtagatttgtgttggaaaattagaaatttgtttgcaagacgaggtttacataagttatgtgtccagttgtttagtgttctctagcctttctggttttaaaccttctaatgtactcccaccgtcccttaatataagggaatttggagagatgtgacatccgtccaaaatctcttatattttgggacggagggaatattgttttacacaaaaaggaagccttaaatattttataaggtacatttgtatcatgcctttattctcacttctctgctaatatgaaattgacgaatgcattgcagatgtatccaatacgagggaagaggtacaaatgtaaggactgcactgaattaattggatttgacctctgcgaagaatgctacaatacaaaatcgaaacttccaggccggtttaatcagcatcatacccctgaccacaggatggaacttgatcattcagcactcttcaataggttgatgaggctacaagggatacacgaggagggcccaggagagataatcatagaaggtgcatttgttgctcctgacgctgtggtgcatataatagcagatgatcatgaggaaatcgaggataacggtgaggatgatcacttgctctagaaacgaatcagtggtattaaacctgaatttcggcattgtcctttctttaatgtggaggaggctacatgaatcatgaatggtactgtatgaaatggagggattgaacaaagcttgtaggcgtgtaacgcccatagccccttacttcaatctaatgggaaacatcttatttctgcttttgtaatctacatttatattcttgttaatggaaatacgaatgagaaaagaacggcaccaggtacagcgtatcacaattcacaactgcacaagcgaagaagcatcctgtagttattaatgttttgtaataaataccttttgttttataaatcttcttttgcacgtctagaagcctggtaagctcttttccttgaggctccagacttcaacaaaagggggtgtttagatctagtggtgtaaaattttggcgtgtcacgtcggatattatataggtgtcacatgaggttttcgggtatttatgaaaaaaaactaattacaaaatccgtcagtaaaccgcaagacgaatttattaagtctaattaatccgccattagcaaatgtttactgtagcaccacattattaaatcatggagtaattaagctcaaaagattccacaaattagtcacaatctatgcaattagtattttttttaagcttatatttaatagttaatacaggtgttcaaacgttcaatgtgatagggtgtaaaatttttctgtgggatttaaacatgaccaaaatagaatgtgcaatctcgtccctccgtcgcgagcggatttggatcggcttaaacagtaacagtgtatgtcattggatgtaaattgggcgtgccagattgcatactgtactgtacaaagtactgtagcatgaagtactgtagccgttgttactgtagcattcgatctgagccgttgatcataaaaacggacaaccaaatttgcgtgcagttgttatctcgcggttgcaactttcatgtataactgcacctcatcccaattcgtcgcgagcagctccaggatcacggcgtaaacccaggagcggagccccaccggcacggcgatcaaagtgccgctgctgcatgggcctcccccctccccctcctctcccaccaggaacaacgacgccgcgtgccccttgatcgccacgacccagagctgtgcggtcgtgtggagtgtggacgaactggcctcgggctgattacgtagttccgtgccgtgcgctttcgtttttcatgactacgattatgcttctgcatccgcttgcgcgtggagccgtgcacgcgcgagtgagcgacacggcaaggcaacgaggcaaaggcatagagcacgcgaatgggggtgggtgagtggcgaggccgtgacgggagagagaggcaacgggaaatgaggtacgctgcgtacgcaacgcgcggggggcgtagtggttgggccgtgtcttcatccagcggttgggccaggtttcagctttgaatcctgcgcgcaaagggggagagcaaggaacaagtccatttcaactctgaaatataggttcaatctaatttgtatcactcaacatcaatatcaaatgttaactccctaaccaataaaatcagtccaatttaactccctcggctatttttgcgggcggtttttgttgatgtggctcattgacctagtctaaccagctgagtcagggggcccatatgttagtgactatttttcttcacctctttctttttctcttccttctcttttacccatcaatgcaattgggttgctggtgagcgagtcccctcgaccaatgcccccgacacggcactctgtggcaccgagctcgttagatctagcccgaggctcgtcagatctagatttgagaggcggcggcggcgacaacatgagtacttcctcgagcgtgcaaggccactccaacaagggtggctcgtcagatcaaactaaagatcgatggtggcaaagacggaggaagctcgacagcggcagtggagaaagttcaggaggggactggtgcttcacatcttaagggcacgacttccccgactcctcgacacgatttcgaccgttgcctcatgcatcatgggccttcatcctaataagacttatgtgttcttatagaggcgcaacccatactaacgtgaatgaagatcttcaaattagctatgtgaggccaaacttcacctcaccgtacactgtgaatggccttactgaaccttcggaatgaaaaagattataaggaagtggacctccaccattatatcagcaaggagaaacttttgatggtatttgtttataatgaagatgaatacgaagttaggatacacaaaacaagaaaatcattagcgcatgattagttgaattttaattattgtaaactttaaatgactttattaaaaaataaattcatttaatatttttaaaacaacacctatatagaaaatttttggcataaaatataccgattagcaatttaaaagatgggctaacgaaagtcgaataaaatatgtaattttaacagagatgaacaccgccaatgagggattttgtaccggtggaaaggaaaattcttcctttctctctctctctatctccgcgggaaaaatctctcgtgtgccttttcattattctaagtttgactagcatgatactagtagcaactaacgcttctcttttcaactccatggcatcacaagctggctagttgctgctggccagtgtatcgccgcgccgcgaaatagacgaacctacagggtgtgtttggttttgcttgcaccattctagcctggtccgtatgttccatccaggcttaccctagcctggataggtgggtgcaaatagggttgttaggttggttgtacgagttaagttggttgattgtacgcgcaaattaatcctgtatacaagagatattatttggtttggtgtatgaggttagaatatggttacctcctcttttgtatggtaagattaccccttgcaattttagtgtaccattcaattgtagttatagtactattcaatcagccaaattttgttaaaatctgttgcatatgtaatgggtgaattggtataaagaattataaaaaaaataaatggtgccaacgatcaataattcgccgctttatatacgctataacaggtgagggaaaaaaataaaaagaaagaaaagaaaaaaaatgtgcatctcgttctcgtcgatgtcatcctcccgccgccgcactaatcgttgctgcaccggtcgccgtcctccacccgctgcgctggtcatcgccgcagccctcctccgcaccggtcgttgtcgtcctccacccgctatgctggctgccaccgtcctccactcgctgcgctggtcatcgccgcaaccctcctcctccgcaccggtcgtcgtcgtcctccacccgctgcgccggtcactggtcgtcgctgtcctccacccgctctgctggctgccaccgtcctccactcgctgcgctggtcaccgctgcagccccctctctttccccactgctcgctaccggctaccctcccggatctggtggccggcggcggaagaaggtgcgggacggcgacgattgaagacggtggccagggattgaagagctcatcgtcgttctctccgtcgagctcgtcgccaaaccatcgcctctggcttcgctctctgtctaggtatgaggaggggggggagaaatgaggacggggcggtgactccatcgcaagctgttgcgtgctcggtcccgactccctattaggaatgcaagtgggtagtcccgctatccgtataaaaacccgtttgctagtttatttttcacgtggtagtataaaatttagaagaaaaaataaactagaagtgagataagcgggctaaaaaaacccgcttacccgctccacttacatccctactcctaacacgtcgccgtgtatagtttgtatacatacccgggacgaggcaggcaccgggcgtcggcaagcgcgtcctgcgtgaccgaccggaagaaactttttcagttgttgcaaccgctagctctcgcgcctttgcctgccttgttgcctcatgcgcgcgccgcaacgcaagagtgaaacacggaggccgccgcgcccgcgttatggcgtaaccgcgccgcagtataccgcattaaggtgctgagtcatccccgtactgtacctgtttctctctctctttttttgacgcatcaatgcgccctctgcatgcatgcatgcatgcctgcctgattggagcccctgtccttggctgcagtagtgacagtggccacagacgatgaccttgtggcttgtgctgattctgaccgtctcgattgaatgacgactactcaaagacacagacacccacaccatgagagaggcacaggaaagagaggcgtgtgcgtctccatatgcgcttcacgcctctctcacggcctccctcaacacgggtataaaaggcgaagcagtgggtagtgctaggttgggttggtgcttggctagccacggtattattgcgtgaaagagggggaggtgaggacgtgaggtgaggtgaggtgaggcagagtgaccacagcgacggcagcgtagccatggcgaccaggccgggccctttgaccgaatggccgtggcataggctggggaacttcaaggtacacgcccaaattctcaccttctgatttctgagcgaagaaaacatgttcatcctttttccttgctcccccgttcgttcctcttgatgaacttcaacagatgcagttgtttgcatacagtgaatggccagccaaatccaaaccttaaaattgcacatcccagtacatgcatgcagtttcctaaaaaagatgattatattctcggctagtagctttgtttgacatgcatggcatggggtggcatgcgcagtacgtggtgatggcccccgtggtggcgcacggcgcgcgccgggtgatgcgcaacgggtggggcgacctcgacatcgccttctccctcatcctgccgtcgctgctgctgcggatgatccacaaccagatctggatcagcctctcccgctaccagaccgcccgcagcaagcaccgcatcgtcgaccgcggcatcgagttcgaccaggtcgaccgcgagcgaggctggtcagtcacctcaacacgcacacgcacaacaacaacaacaacaacaacaagcagctaccaccactgtatatattcgtgctgatttgcgttgcgtgctgcagggatgaccagatcctgttcaatgggttggtgttctacgcggggtacctggcgatgccgagcgtgaggcggatgccggtgtggaggacggacggcgccgtggtgacggcgctggtgcacacgggccccgtcgagttcctctactactggttccaccgcgcgctgcaccaccacttcctctactcccgctaccactcccaccaccacgcctccatcgtcaccgagcccatcacctgtaagccacacgacttaaaggctgtgtttctttactcaatattctcaactccatcctacttgtttttccacgcgcacgcttctcaatctattaaacaatgcttttttataaaaagttttctatagaaaagctttttttaaaaaatcacattaatctgtttttttaaaaaaataattagccctaatttatcatttgctaataagtggctttgttttacatgcatcagtcatgagttcacacaactcatagcagctcatctcacttcgttagtttttgtttaatgccttatcatctcatgggtgttcatttaattaacttgttagtaccgtaccgtgtctcactgttcagtctaataattgttatatatagttgattgcgttcttagattaatgaagtgcgcagatcataaatagtaagcacaaagtggccgatattgactcctctcgtttgtttaatttcatgaaaaaactttttgtcacttgccggagatgccatgccctacattcctagtatgttctcgagttaaaatatgatgaagtagcagttgcactcctcggaataacacattcttagataattaaagaattcgtcgtagctaagaacaacacacatgaaagtaaagaatgaccagcaggatgcaggaatcgaattgaagacactgtacggagtattaatttcagaccaacagctcatcttctaccagaaaaaaaaaatcacaaatgttctgccaacatcatttatgttctctgatccatgaacagtaccacagtatcttttttttttttttgcaatgcaccttttcatgacaaaagaagaaaaagaacacctacgggacgggattgtgatatgtccagtctgaggctctgagcttcacactgtgtcactgtcgtagagtaaacggcataaattggctgtacctgctaggcagagagagagagaggcccgtccagcctgcaagaaatgagaaatgcatgtgactttctgaattgcagcgctgatgtgttcgattcagtttaggaccactcccggtgcaggccaatagtaggagtattacctttccttaccaatttgaccgataaatgctggaaagaacggccggtatactcctattgacatttcacatggcatttgcagagcttcagtgatgatgggtgaacagcctacagtttacagcacagagcctgtagtttacagtacagagagtacccaataaaacgagacataaatattgcggcttgcagaaaatgcagtttggaccacctccacaaccttctgatctagatatagctgttgctattactgatactgaatggaaaactgaaaacaaacataggttaagggttggtttagttcacgccaaaattagaagtttgattgacattggaacgatgtgacggaaaatttggaagtttatatgtgtagaaaagttttgatgtgatgtaaaagttggaagtttgaagaaaaagtttggaactaaactcggcctaaggccgtgtttagattcaaacttttttttttcaaacttgcaattttttcgtcacatcaaatgtttgtatatatacatagaacattaaatgtggacgaaaaaaaaccaattgcacagtttacatgtaaatcgcgagacgaatcttttgagcctaattacgccatgatttgacaatgtggtgctacagtcagcatttgctaatgatggattaattaggcttaatagtttcgtctcgtagtttaaggcggaatctgtaatttgttttgttattagtctacgtttaatacttcaaatgtgtgtccgtatacttcaaaaattttgtcacacgaactaaacacaacctaagtagaatacttcttccgtccttcaatgacttttttttaaacaaagttaacaaattagtaataagggtaaaagatcgaagtgctcctcattaataagaaagtagtattgttagtgatagttaggggtattgaagggatacaaaatcttaattcacggacggagggtaggtaagaaagttaaaataagtcttttatgggcaaggttgaaagactagaaatgaaatccctttaggacaaagggagtagtttttatcaaacgttggcaaatacaggtcctacaagtagaacaattcgaaagggattgatcgactattatagttgctttctaagtaaaagaaaagatcatatatctgggaggaggctattacctgaaattgaacgaggtgttttagctataaaacatcagtgtgatgttcatgcataggtcctgttgtttttttataaagcacatatataagagtatgtacctaccctgttaatgcacaattactattggcacttacaacgattttatacattgcagctgttattcatccttttgctgaacatgtggtctatttcatactgtttgcaatccccatactgtcaacaatttatttgggaaatgtttcggccatgggcattgtggggtacattgcttacattgacttcatgaacaacatgggacactgcaattttgagttggtgccagagtggattttccaaatctttccaccccttaagtatctgatctacaccccatcgtaagtgcaacactcttctctcatgtatctatcatagaaatgtattaccaacgtgatgacagattggatcactgaattcacataacttgaagttcagcctcgtgagttcataaacccaatgctaacaaacaaatgctatttccttctgcaggttccattctcttcatcatacgcagttccgcacaaactactcgctattcatgccattttatgactacatatataacaccatggacaagtcatctgacgagctgtatgaaagctcactgaaaggaacggaagaaacacctgaccttgttcatctcacgcatatgaccaacttgcaatcagcctatcatctaaggataggaattgcatccatagcctccaaaccgtacagtgactctgcgtggtacatgtggacgttatggcccttggcatggctgtcaatggtacttgcatggatttatgggtcctcagcatttgtcgttgagagaattaaactaaacaagatgaagatgcaaacatgggcattaccaagatacaacttccaagtaatcacttcccctcgcttatgcatttctaaattcaaaggtatggattatggaagatactaactgttctggttttgcactctgcagtatggccttacgtgggagagagaaccaatcaacgacttaattgaaaaggcaatattggatgctgatatgaaaggggttaaagtgattagtctaggactactgaatcaggtgtggagttcttacctttaaagctcgtgtaatgagaatcaaattaatagtttaatggcatggtaaaggttgaaagtagcatgataaaacgtgccaaaaataaacaataacaagaaaatctcatggacatgtcctctgtttcatgttaaaaatgtgattagttgaaaaaggacagcaggagtgcaaaaatttaagtttgtg

SEQ ID NO: 60018 - DNA, 10228 bp, Oryza sativa
gcaataagtacgagaaaaatgaatttttgaacacctcaaattatgaaaaattctacaagtttgacaacacaaaatactacacaaacatataggactaaatttaattctcatataaaaaaatactccataagccacattaatatattatttgccactctacaggggactcggtacccttatttgacattgaaatgctaggtaggaaataaaaatttctataattgtacttttcatgaatggggattgaaatataacccaacatacttatatcgtcgaatctattaatatttattatttgtataacacgcataatatatgaaattatactttccccaatgcaagatatacacacacacacacactcactccaaggtccaaactctaaaaggataagaaacaaagggttagaagaaataatacaaatagcaaatcccaaaaattgaaacaacccttaaccttttcgacgcccctccataatctctcgaggctcctccacctacgccgatcggcggatggactcggagatgattttcaggtcgatcgacaaagaggatcggccacccaggcgttagtagactcgatgtcgtagccgtaaatttaaccgcagccgccgagcaagccggtgcctggacttgtatacgagatattcagatatatatataagctgcgcgtgtgccggcgtatcgtcgtcgtctcgaaaccgagggtaagtaggattagcagcctggacggacagctcgatcgaaacctagggataataggaaacgaacttgttctctctcacgtacgaactcgtgcccccaatttttgtggaaacaaatttggtagatacgggttgtaatcccgtgcagcctgccgcagatcgtcgcggagtggccgcagtatcggttggatctggatggtactcccgctcggctccaagcctccaggcgcgcgacgccgagtctgtaagcgcgcggcactcgatcgggctcggctcgcgtcgaaccagaaagcgtcgagcggatgacatcgacgggcgcaacaccatcagggattcagggccacgtgcatttttcatgccatcaaaaattcttgtatacaggcccaaatagatgatagacttgggctctggaattatattgtttatgcatattcaagccccaacggaaaaaggaaaaagaaaatgaagcggagcttacagtacacacatgaaaattccttcagccgggcattgatagcatacatgatacatcatgaataaaccatcactatcagaacgtcgaaaaccaccatgcataaaccatgcatgcgagagtaacatcctggccattagtagcatatgcatgggaagacatcatactacagtaacatcacacatgcattcatacatgaatgccatctatagtttgtcaatatcagaagacatactgctaccggagcccagcaacatcagaagacatcatagtaccatcacacatgcatacatgaatagcacattctattagatttagagcaccatcaaacgtccaaaacagtgtctcgtagtgttctgattatcttcctttctgctacatgtgccaaacgtgtcgtgggttggagaagtctgatgtttttcgccgggccagcgatagaagccggggtgagtttattaaggttgggaaaacaattgcaatactgcagggttaacatggttgctggatggcaatcttggcgctaagccagattactgaagaagagctaaggtggcgccacggccagcagatatacacacggtaatgaccagttatatttagtccagctccggccaggccggcagctcgttttttccaaaccatcaggtgatcaaacaaactgccaaagtcccattgtgttccagcgaaagaatggtgtttttctcctttgtgaattcaccttcatgtggaagaatttagtgttggcgtcatcatgcttgatgtgggtcagccgagaatgctgacgcatccgtatcctttccaacgatgctagggctgatgtagaaagttaatttctgctacatagctcatagctatgtgttcaaaagattgcaaagataatgtgaacgtacttgtgtcaacctgaacattgctacctctactcaattcccagatctgcagaagggtggcactgtgtaagagttctgctcatattgtaaaatgcaaaagggaaagggagtaacattttgatctaaccttttaagctgaccccctcctcagccttgttgcacaagacgagcaacggatctgttgaaggaaaaatactcattgccttccttttcttctcagcaactagattttcaaataacttcttgtgctttgctttcaattcttcatgtttatgataaagcttgattagaaaacaataattagttagtataatttagccaatactagcatattaaaggtaaattcgtagttaccttatcattttttttggcatgcttttcctttctcattacgttgtatagcttcattttgaatttgggaggattgtgtactcaacgacaataatccatcaacggataatagcaccttaacctcctttttgccctctcttggatccaactttaagtgtgaggtatgcaaaaacatcacaagctttagttaaaataggaagttccccttcaacaatctgaactgctgtggacaaagagctcgcttggagtgcaatctgggctgcacatggtatatttgaatgatgttccaacacgcgatttattccacccattactacaactccaacagaagcgtgcaaacaacctgataaagcaacaagttcacgatccttaacagcaagtttacttccaggaaatgcatcccccttgataaactcaatgtgttttattgccaaatttggatctgttgtccagcaatcgtctgcatagaattccttgcttttgacaagagcttgctcctggaaatcccatacttttgctgcgatatgaagagatcttaagatcaatctggatgcacttgcccagccattgatatgagttgcccccacatagcccaatggttggagctgtgcaccaacccttgaattcaaagatttcaaaataagacgagatatgtagctgtttttcaaactttctgctgagaaaatgatcagggctgccattgctctcttgtgttttgctgagtaattgtatcggtcaaaatgtgccaaatcctggaccatgtttttcattacgctatatcccacctgaaaacgtgacaattcatttggttctttgcctacaaggtcaccatagttgctgttgtgttgtagaagtattgagcctttaatatacttctttggccttggtggcgcattttccttcaccacatgttccttgcttgaacttgctaattcatacttgtctctttgcttgtttttcttatccatcttctcacgcttctggtcctctataataccctcctcccttgttttacctttctcatttatagaaccctccagcatctgcatctcctccttatcgtcaaattcatagatttggccatcagcagtcctaaatcctctcatccacatgttttttccttccactatggcagttacagttgaagcaccatcagtaaaggctacagcaaagacttcaatcccttctggggtaatacagaattcctttctcttggaaccagtacccttcacaatccttctgaacctgcgcttaagttctttgcgggctttatcaattttttgggtagatgatctcaggatagcactgaagtcattagcatgagttaacttcaggtctaaagtaaatagcagttcggatggcatgtcatacactccaaatgactgttcatcacccattctgaattagaaacgagctgatagacaagttgtgttggatatatcactgcaatcaaaatatcgacaacattattaaacacacagatgtaatcaacttagcttttttatacacagaaaaataaatccaccaacaaattaaataattactcaactacaatgtaacatctcaacaatgatatagcctaatccctccagtaatttttcccttccttttattttttctggttcttttggcttttgctgaccaacatataaaagtaatacaatgattcgcaatccatttgcgtattccaaatccctaggcagccaaatcgcacacattatattcttgaaatattatactgactcagaattcatgtacatgcttagtaagcaacaaactgcagataaagcaatagtgacacatactcttgaatcaaactaaatatgtacaaacacataccttcagatgcttggagaggatagagggggtgatgtgcctgtacaatgtacttgagctttccgttggtgtctggtcaaaacactgcactgttcagcttctccttgtactgctgcttcatctcaaacaatttaaacttggaatagtggaatagataatgaaggtgcatgtgtgatatgcacccatatatcaataaatatgtacaaacatcttgtgattacttcgtttttaaagaaacacacagtactgccactgtaccgacatttcctcgcatttaagagatgtctgaaacatctactaacaaaaaaaaattctggacaaatatgaagaaactgtgaggtgtgagagaaaagaaaagaaagaactggctagtatagtagtattaattgcagtaccgtcgataacaacagatctttttttttaaaaaaaaacctaaggcggaactttgttccacttttatatttagaagaagagaattgacctagtttataagaaaaaccgggcccaaaaaccatacaataacaacatatcctagttttcaagaaatgtacaattctgctatatgcttataagtctaattaatgaagtttagagccagcaacagcaaaggggaaaaaataacaattagcgtgtaacttagaaataacattaggatctccatcaagaaaagcaatagaaatcttcacaagaaccgacaatctttatcaaaaaaacaagcggattgtttacccctgattatgtaccccgtttcacatcgcaagaggtcaataactttcgtttcgcttcttctataaccagtgccctagaaatggagcgtactggaatttttttgacgcaagggtgcctaaataatcaacagcaaaaccggacggaaagattccagtacgcacgaatcgagtttatagcaagcagcaacatatcaaggcaaacgcgtacctagggttttccgccgtgatgcgtcccctgctgccaagacaaacgcgaccgctgtttgattcgtcccgccgacgcggaggcggagggctgggggcgggcgcagtaggggagagggcggcggcggcagaggcacgcgacgcggatacggcttgacgccgcagaagctcgccgatcgccggattctgaaggtgccctaggtggggaatgcaggtaggcttgaggttgagaacggaggccgacgccgccggcgatcggcggccaaaaaccccacccgcctttcaactctaggagagtccgctcgcaggcaggagggtcccactcctcagcacgcaacaacgtgcgggaccaattatttgttgacacgtcaatgtttaacttaacgtctagtactaattaaaggtttacttctaacccccgtgattagtccatttctagcatcagtacctcacggtttaacttgatttaatcaaatattttgtctcaaagcaaattaccaattttctaaaatatattcttcagctatgtcacgtttttcgatgtccactaataaattatgcaaaaaaaactttgattatactattgcaaaatctcttactattttacttaaaaaaagaaatgtttccttcatccgtcaaaacaaaataaatagccaaaaaaaaaagtccgactccctctcagaaacgaaaaaaaaaagtccgactctaaatccgattctccccttaaaaacagaaaataaaacacaccactcctctcggtctcagtttgagtccgagatcccaggcacagtcctctcggtttcaatctataccgtgatatcccatacatcttggtgaaaaaaaattgatgtgccggattgaaaatatgtttgcaaaaacggaacctaccggaggagagcattccatttttatatgattttaatttttgggtttgtacttttctatttgagtccctgtaatttttatatttacacttgagtccctataatcttgcaataagatacttgagatcgtttttttaagaaaaaataataaaagggagagaacaatgacagacaggtgcataaaaagaaaaagaaaaagaaaaagaaaaactgcaaaaaagagaaacaacaacaataaaattttgtttcccctaagtggcgaaaaaaaccgtagatccgattcctataaaaggcaaaaaaaaaagtggtgaaaaataaaggctagatccgattactttaaaaacggaaaaatgaagtctgattcctataaaggtgagaaaatctgaaaaaacatctaaaaaatttcgtccaattccctaagaaagtggcgaaaaaaagggttcgtaaaaaataaaaagctagttcatacaaaataaaaaatacgcgcgagaaaaaaatagaaagggcaaaacaaattccgatttctaatcagtatatatctcttctctatctctaatctaatctaactatttaaaaagagaaaatacacgagaaaaataaaaacagttcaaaaaaatgcgtgagaaaaaagtcagaaaaagcgcaaaaaaatgctaaaaaggttttccatcttccataaaaaaacgtgcgagaaatattatttccatcgtcggtaatttttttaaaaaaaacatacgaggaaaaaactgtaagaaaaaatgcgccatttctaaaaaatgatttgaaaaaacacgcaagaaaaaaacaccgtctattaaaaaaacaaatcgctccgaaaaacctgtcagaaaaaaaaaacgctaaattgatggacgcttgagtcggataggatccatcgattttttgccatctactacacggcttttatttcgtcatatattcttctgtattggaaaaaagcaaaaaaatgaacattaaaaaaaaggaagcaaaaaacgcgcgagaaaataattgtcaagaaaaaccggcaaaaaacacacgagaaaagaaaagcaaaaaagggagaaacatatggttttcgtcgtcggtaaaaaaaattaaaaaagaaaacatgctaggaagaaactgttagaaagaaatacactatttctgaaaaatggtttgagaaaatcgcacaagaaaaaaaatacaccgtttataaaaaaacaagccgctcattaaaatataaacattatcattgacatgattatgcatgaaaaatgtatattatcattagaatttatttacccgttgtaacgcacgggtatttttgctagtttatcaaaagtttaaaatgctactacaagcttccaatcagctagaaatacatactccctctgtctcacaatgaagcacctcctaacattccaatgtaaaattaaaggaggataaaagaccaaaataccctttattgataataaattagtattggtgggtaggtggcaaggggtattaagaaataaaatttttcgatttgcgaaccgagagtagataagaaaatagaagttgatttattttgggacaaagtttgaattacagaagttgatttattttgagacgaagcgagtacacatttgtttctggcgtaaaatgacataaacagtgtacaaaaaaaggggagaaattcatcagttgtaacttgcaaagacatatcatcgttgacaggcaggaacaaaatccagcacagcttctcccacgagctcctcccagactccaccctcaatttgctcggtaatgtcaaccaactgcgtcctcatcgttttcacccagcctgttccttcaacctcctgcttcacaactctctctatcatgatcccagcattatctctcctgctcaccacgaacatccgtgccccgtaaatccaatctttcaggatgctccagacttctatccccaatgcaggagaggaggcgtccatccatgttcttgagtgtgctttgctccatgggaatgtacttagcaaggtgttctcgccgatctcaacaagagcaacattgacacaatcgaaaagaagcctttggtatgaactttgctcccgaagctccaagactttgttgaacagaatcggatcaagaggacagtcaggtaaatgccagccagtgaaaagcatactcgactgcgcatcgtctaatccagcagacgacattatattttgcacaagaacatggcattccgattcatcgtcatctacatcagggagaaaagaagactgccctcgggtgccaggtaatgctgattctgaagtggtgtcgtcccatgataaggaacaagcaacagcctcaattgctgaagatcttgagacagcttctgaagaaagttaagcagaaatgtcagtatataaactaaccaatctgagacttgaagaactctaggctggaaactagacttactagcattttttgatgtagtgcttgcagatgattcaggttcattacaactgctatcttcagagggtgcatcaagaactgacgtagggctgggttggtcgcgtgtactatttaggacctcattcagtcctagtttattcaggtttccacttcgacaatccaatgatgcaggtacatcagttaaagcagttgttccctgtaataaaatttctcatcaaattctctgtggccgaacaaatgcattgaacaaatatttcttacaaatggaagaaaggatgtcatagctcaagaataaatgtgcccatatcaattacccagctatatgaaaagaacataagatttggcttgcaagatagatgagatgaagtgcctacctctgaagtgctggttgattgcacagcacaaatatcaagtatgtcctcacaaatggtggatttttcattaccatccaaatcatggttggcatcttgttgactatcaccgccacagtcttcagtattccctgaagacaaatcagatgtatgattggcagatatctgccttgttgttcttttacttcttggaaagaagaaatctgaaactctacccctgaaaaatgatttttctttatttgatgcgacaatatgttttgttctttcatggccctgatgatttgaagttttcacatttgccaccatgttattaagcgtggatggaatcagaggaacagatgttgatcttggcaaccccataggtctctcaccatttttttcatctttcctacaagcagttgcatatttagcttgagtaggtagttcattttctctgtcataacagcgactggtagaaacagaaggtaactcattgatgaaattatcattcttcacatcctgaagggagagcatctctcctaaggtgcatgtgctccttggcaattctacttgctcttgactgatctcatcacaagttacagttgcccatcgctctgaaagccgttgcttggcttccttagtaactgatgactcagcaaagtgggagatcttgctaaaagacgatcccagatagggatttccatgttttttggtataatgccatgttcgctttgacacaggactacatccccctgagtcactgaagctgtcaccttcatcttcaatatagtcaatatcagaatcactgttctgatcaatttctgaatcacctaatgaactttcatctcctccatatccatttgagtatgaggaagataaaaaagattcatctccttgatgacagccatcttgctggttatgaatgataccaggctctacttttgtagatcgtagggttgccccattgccatccaatgctaccctgaaatcactggggttaattgatagaaatggagttgtcctgggggttagctttgcatttgttaaactcggcttccctggagtaggcctcaggagtactattctacttggcaaggagggattttcttccttaaaattagaactctgatggaactctctcattgctgctccattttgctcttgaatttgctcagttccagtttgtcttgtgccatcactctcaaaagaaccaagtggctttagtaccgtaatccgttttttctgagggggtgctagattggtgtgagaccctaccaactgtcttgagaaaattgagttaggttcttcaagaaatttcagaaacaaatctttgtttgaacctaccaccctaagagctttttgtaagttcctttgaatgaagcggct

SEQ ID NO: 60019 - DNA, 8568 bp, Oryza sativa
accctaccaactgtcttgagaaaattgagttaggttcttcaagaaatttcagaaacaaatctttgtttgaacttacaaccctaagagcttcttgtaagtcctttgaatgaagcggcttctctgccatgccttagcatttttttccatgacacttcctcgcaaaatatccactctgttacttgtgttcccagaagaccctcctttctgcgaaattttgtcctgaaaatagctcatccgtgtttgtgcttcagatacttcatacacatcattatattgaactgcttcctgacaaaatgggtggatatcttgtgtcgttgactttatgagacgatgctgctcttgttgctttaagtctttgtttagtgcttttaactggttacatgattgacttttcctgaaccacttttggcctggtgtaaaactggtccattagcaggtagatcctcctcaaggcccattaatcgggcaacgacacctggtggctttctctttaattccacttctttagtcatctcttttgctaataacacttttaatgaagttgcatttgattttctacgtgaagaaccatcacaaggtgcctgcagagaaacccatattaataataaaaaaaagagcaagaatcatcacaggaatgaaaaaaaatactagctggatcagcatagtttaatggcataagcatattgcactacatatagttttacacttcattttcatgtgccttttattctcaaaattatttctaccacatttcatatcaaaataaaattgtcacataggagtagaggagcctaagttaaccacacagaagaaaggtatgccacaggatgctcacaggttttctgtccgcatgaaatttgtcagagtcagtggctttctccaaatatgaatagatctgttggacaggacaacctgaaaggattaaaatttaaaattatgtatgttctgcaaatagcacaaaccttagagatatacccgaaaaaactaaagatccacaaaagcaaaatgaagcgagaaataaaaaggaatagcaaaactgccaaaacatctcattatcttggaagagcgtaagaataatacaatgttgtgtaatccccccccccccccccccccaaatagagaaaaatggcctttgatagagcaatactgcaaagtattggcccaatggccctagctaatatttccagatgcatagcatatccaatttcccacacataacatagaactaactagatgtagaacacattcaagaagtgccaaatttctgtttcaaaaaagagaaaatgaagaagaataagtactgaagggcataataatttgatataatggcaagaaatattgaaatttatggaaaaccctcaaatccctctaataaaatacccacataaatatacataccatctccttgagtttgacccatagctggctttgctccagacatccctcaacaaattgattgccttctggcaataggtagctgcaactcaatcttctggagtatggaatcctgaaaatagtgacatcccatgaaccatgtgtgattttaattttccacaaactaaagccaagtgacctaacttaattacaggaaccatttcagatactagtgggtagtggctggcattgatgagcacggtgaatatatctgaaaagctctcagaatttaaagcacttagggtttgtacttaggggacatgattctgagatattgctgtagcaagatgccctctttccacaaaatttcaagagacacatgcttaaaagctggaattctgcaggcacttgtaaggcagattggtgaaagaggtagcacagttcatggtctgttcttgtataaaatcacaagaaatgagaaatggcgagcagaacgataagattcgacggggacatggcagcacttggcaacatagaaaagaataaggcgggagaaaaaaggacaggataaaagcatatgagcagaaacaattacaaaaaaatatggacccatggcactaacaagatcgtacatacttccaaaaggaatcttgcagcaaaaacataatctctgaaagactgtattttctgtcagaaataaaaatcagttatgagaggtaggaaggcgtattttaccatgtctttagatcagacaaatgtgaaaacacgaaacagaacagaaaccgagcaagtacaaaatacccaggatttctactctacgtacaggcgacagaggaatctctgtagacatcgttccaaaggcttcagaatttatcaggaaaattcgtcagaatttcgaatcttgacagtggaagagaattagggggagggggggaggaaaaaaagactgtaaaaagtaaaggaggagatgtactccacgtagaatagaaaacaacaatgggtgaaactaccgagatgtttaggtttatacatgtccaaatgagcactgcaaccgagacaattcctcaggtctgtagtctttcgcaggttaaaaaacaccaaaatctaagcttggcttgctgagtgtaactagattccactgttacaaaaagaagtgcacaacactgaagtaattacaaaaaccagaacacgacattacaaccagagggtacaggaaagcatccaaagaatcttgcagataagagagacttcgaggtctggtgatctgcgctgtttttgttctattcctcactggaaatttacgaatttcatgaagagtttggaaatttgatcaaacaggtgtgatgtttatgccaaaccgacgaatgttcatcatgactagaccttgtataacagctggcattccattttatttatggtgcattttcttgactgacacaagttatccccaaatcgtatgtcggacacccctagaaaaattgcatttgccacttcccagatgacaatcaaatcaaatgtagcacacattgagtttccagtattgatatcacaaaccgaatacgggagaaaaaaaaaatgcacagcccaaacaatgcctaatcctgcataccaaagctccaccaaatgaaacagaatgctggcattttccatccagcacaacccaaatccaaccaggcacatcacatcacatcccatcccatgggaatcccggcacaagaaaggcccgaagttaagtgagcctgtgatccagagagagagagagaatcgctagtatgcacacctggggtgatgcggcagcggagcattcttggccgccgccggcggccggggaggggagggagcagcttggcttgcgcggcggaggcggcggcggcggtgggttttgggagggggtaagcaacggagcggaggagacagtgaagcagagtggagtagagtggagagtgtgggactagtgggatatgcggaaaaagcctttgcgagccgtttgtttgccgttcttttcttcgcgggggcggggcgttcgcttgtttgttgcttgtgcagctgtgcttctggcccgtggcgcgtcgtgggctgcgtacgtgcgcgcgcgcgccatggatcgccttaactaacaaaaaccagaagttggtggtcactgggattggatcgaaggatattctcgtgcgttcttactgggattggatcgaaggatattctcgtgcgttctttttccttcattttttgtgtgaagactttttattactccctccatctactttcgatctactttcgaatgtcatatttatcttgacacataaatcaaagataagtaattctatttatcatccatttaaacatgctactagttatttctcgtaaacaagcgattcattaatatttacatttctcgatgccatgtagccaatcttgtgtggaaaaatggagagtcacgcatcaaatccgaaaaagtcattaagagaataggttgttggattgaaatatgtctatcaaaaataaatttttcagatttggaaatatgcatatcaaaaatagattaagggagtagctgctatgtcattctctttttattaactgctatgtcattctttttgtgaaacattaactagactactactctctccgtcctataatataagggattttggtatgtattacactgtttgatcactcgtcttattcaaaaaatttgtgcaaatataaaaaaaatgaaaagttgtgcttaaagtattttggataataaagtaaatcaaaataaataaataataatcctaaaatttttttaaagaagatgaatagtcaaacagtgtaagcaaaatgttaaaatcccttgtattagagaacgaatggagtatgttcttaagtacatgtgtttccaaattaaggtgattttttttcttaaaagacatgatccattagtctcaataaatgtgtgatatagtaccagtgatgaaaccaacaacatttttatcaggactacgtagaaaagcctaagcaaccgtccactggatggagatgtcgctctataacgtatcgttatttttatttaaacacggtacatatgcttatatatacatgcgcactcccttctataaatattagtatctactcgtatattatatcgcttataaattttttgaaaatgtaccagtattttctaaaatttatgaagttatcacatacaactcactattgacaattatgttatctatcacaaacaaaagagataatcataaatataaatataaggaccatatcaaatgcaggactgaaattagcgccaatggaagagaaattacacaacacgacataattagtggcatgagagtaattgtaagaaactgtcggtgtataaaagttcggcgacggtgcatacgctagaaaggaaagcacagcattcgctcgagggagaaaaaaaaaagtaaagccaaggcgttcgtgcattagccttttctacaacaacagtatcaatataataaaaactttgtactacaagtgctatttacaaacagaactaatttgtccttactttaagcaaagggaataaacagacgagcaaaacgtaaccgcgcgccattcttcccacaagaagatcaaccagacaaccaccacacggccacaagcccacaagcccaccccaccccacgcctcggcggctcggcgctcacgagtcacacgacccgcgaacacctctgccacctatccgtttccatccagttaggcaccgtcccttaacatttgtcgctgcgcacgccgcgccacgccacggtccaacacacgacgccacctgctgcccgcgcaacagatgccccccgcccccggcccccctctccgcgcaggcgcggctaggcggctagctatagcggcgcatgccccgcgcgcgcgcacagtggatcaaacagtacgcgcacagtgcacgcagcgcccgtcatccacagccacaccgtccgcaccgcgcgccccgctcactcggccgctaaacccaaaaccctccccaccaaccgccaccgccacggctaccaccagcagcagtagcaggcgcggcagagcagaggaaggcatatccgcgcgcgcgaatgttgcctcccgctacgcgacgtcgcgccgggccggacgatgagacggagcagagcagcgcgagtgcgcgacgcgagccatgaccaacggcaggcgacgccgcttccactgtcgcggcatctgcgtgcatcagcgatgcccggccggctgcccgccggtcacatggctataagcatcgaatcgtagcgtagcctcttctctttttttttctttttctctgcgcgcggcagggcagggcagaggcaggcgctttcccggctggctggacccgtgcctttcgggaattaatgaggaggggtcaagatcaaatcgcgagtttttttaaaataccgctgcctacctgtaggctgcggaccgtgcaccagtgcatgtcagatacgtacgtacgtattcaggtccagccgagccagagccagccagccatatgcacagcgccacaggattttattccgaacaaattgtatgagaacatgtacatgacgcgtcagcccaagccagtgtcaggactcaggacgagctgggacgagtaggcgggcgcgaacatgaaaacggctgtttgttccgttgtgcagcaggcgacgtagagggagagggaataatcgtatgatcgtcgttgcgaaatcgtgcgatgcagcgggggagaagagaaggcggtttatgtgtacaacagtggcgcgtgttaggatagtggacaaacgatcaccaggggaaaaaaaaaaactagcacccgtgacacctgaagatgccggcgatcgatgctgatggtgatgggacgcgcggaaccgaagctagctagtccaccgctgccatgatgacgatgggggaggagaacattgatgtgcagcttgatggtgagctaccacaagttctatatagttcaatgttatggcagtaagatggaaacgtgttgtgtttttttcgtgtcatacactggtgcggttacttgtttaggttctcgattgaatgaatctaccaagcatgccaagcaggcaaggtacatccgtacgcatcaggaaataaaggccatttcctaatcactttgtcaatttttttggcataaacctttacataaaccaagtgaatgattattttttggcattgccaattgttttggcttgggtaagtttgggtctgtttggggaagcttttagattctgagaagcagctgtttggtagccagcttctgagaatctggaagagctctgaaacccagcttcttagtttatttttcagaatctgtaactacagattcttagaagctgtggactgtttggggtagcttctagtagaagcagctttttgggaaaagctatagttgggacaagctcccccaaacagggcctttggcacaaaccaaccaagtccaaaattccatgcaaagagcatgaaagtccaaagaatatgtttggtttgctatcagggtttacgattccgacgaaatccaatcggattaagcgaaatttcgacgttccgacgaggcttgaaagtagaaactgtttgagatttcgagaagttttatccaaattcaaatataaattgataaaaaagaaaaaatcaaataaaatcttataaatactatgatattcatagaacctattgggatataatttttttaaaaaaatgatgtattgtgtgtatttactgaaattttcatcatgaaaaaaaaagaatttcaggaaattacctctattacaaattactgatcaaaatttcgatgatttcggttagaatttcgccaaaaccaaccggtttttgagaacttgtcggcaacttagggaatttgtatttaaattttggtttatgaaatttgttcggaatttaccggttttccaccggatttcgcgaaatttcgaattccgccagtgcccgaaacggaagagcatgtaggaattgtaaaccctgtttgctatcttcttgggagcattcaattgaccatttttgacatttctaacaacatgttcatagtcataaaacaaaagcagcatgttcattggattttattatacatttataccacgtaccaactccaaaataagaacttcaatgcgccttcactgaggcaaggtgcacgcacggcagttattgcaagatcattctgtcatgagcatgtcaattattgcaacatcgttttgtcacgtagggaggccaccggagagataaaattaactagcattgggatcgaaggcaatcaattgctggacctgttttttttatggccaggagcaccattccatcgatctccctgcccaactcggcaactctacggcaattcgcagtacagttgcagggtcagggaagcatatgaggctacatgaatctacacattttttttcctctccgatttagcgtccagtttgggagtaaaaacgatatgagtagtggagcttctgcggtaaccgctacaggtcagttgattccatgggtgaaaactggaaaggtaaaaacttgtcccaccacgttgccagttgcatttcatgttgtcccactagttatgatcagtttcactataagtttactatatcggcaatatttctttcttggagctgagattgattcttgggttgttatctcactctatcctttgttatctttagtgctagttcaaaattccttctctccctttttttttcctgaatgaacgtaatagctcaagtaccaagcatcttgacaactccttgcatgtaaaaagcatctcaagaaactatcgattcaccaagaagcttgtgtgatatgaacgattgaacggtaccttggaggcgtttgtaccatactaatgtcagacgataactctggagtgctggtaaaaagttcagtctggtcgcccaaatacttccaaggaaagcaggaattgagctgtgcggccttgtgcagagaatatgtagccttttactgtggcccgatactgtttagcatagttcttgatcccgttggaatttcttgaaagaaaacatcacatgtcggggggtaaaaagcttcagtcaaaaaagcttggaaaattgacctcaggcaggcagagctcggggatttacctttgagcttttgacccttcggctgaagatttacaattcaatatttgtatcttacaaccattgctagcaacaagtaaaacagatg

SEQ ID NO: 60020 - DNA, 63580 bp, Oryza sativa
ttattctattcttttcttcattgtttttcatatatagattcattatatcccatcccaaaatcccaaatcaatcaaccccgaatagtctccaaattctcaaatcaatctctaaatacataacaaaatctttaaaaaattacatcacaacttctacaaaattcattacaaatacatcacatattcacatcacacacaaatcaaatacatcacatattcacatcacacacaaatcaaatacatcacatattcacatcacacacaaatcgtctcagatccgaatcacatatttaaaaaaagaaagaaataaaggaagaagatgaacggcctgcagccgcggcggcgcgccgcctcgccggccgccgccgcaccgcccgccgcgtccccggatctgccgccagccgccagcgtgccagcgcgccgccgtgccgcctcgcccggccctctgtgtgccgcgccgccgcaccggccggcagccgccgcgcgctgcccgccgcgtccccggccgccgccgcgaggccgccagccgccagcgcgccgcctagcccggccctccgcgcgccacgccgccacgctggccgaccgggcctatgcgccccgccattgcagagggaggtggggaggagggagaggaggagaggaagggaggagggagagaaagagataagggtgactctgtgaggagatgagttaaaaaaggagaggaggagattgtattggtccaacccgcgtgcagccaccccgcttatgtcgacttttttcccggttggtgagatctttagtcccggttggtaacatcaaccgggagtaaagcttatattgatcttttttcccagttggtaacaccaaccgggattgtaaatagatcttggactaaagatcaaaaaattcatcagagctttcaaactgggactaaagatgtttttattcccggtttttaatataaccgggactattgtgaaatctggtggaccgaccaaagatggttcctccaccagtgatgatactgcagtttttatactttatttgtttctcgttttataaagaatgtttcgatatttttgtttgtttgatgtttggtcttttatcaattaaaacagtttaaccatatctttttttttctttcttggatcaagcatccgacgatcgaagctacgtttttttctctttttttttttaaaaaaaaagaggacgactagagacgacactgatagaattgttgcaagttagatgctacaaaagtggagatggtttttcgtttcttgagaggatattatctctcatttcttgcatgccacttaaataaaacaagttcaagtttaaatttgacttcgataagttataataaaaacaaattaattttttaggacaaaaacaaattaaattgaaactagttttttttgcggggaaaattgaaactagttaattaacgtgtgtatatttgttataacttgtaaaagttaagggtgtgtttagttctttgggtgtaaagttttttaagtatacggacacacatttgaagtattaaacgtatactaataacaaaacaaattactgattccgcatgtaaactgggagacgaatttattaagcctaattaatccgtcattagcaaatgtttattgtagcatcacattgtcaaatcattgcgtaattaggctaaaaagattcatctcgcaatttacatccaaactgtgcaattgatttttttcccacatttaatgccccatacatgtgttaaatatttgatgtgacgtttttagccaagattttttttatctaaacaaggcctaaattaattttaacttacatgtttgcatagtgatatactcactctgtttcacaatgtaagtcattctagcatttcctatatttatattgatgttaatgaatctagatatctacttacattgtgaaacggatgaagcatgtatcttttactaatctatcttaccagtttttttaaaaaatattttaattactatttagattacatgaaaaaagaggtgatatataaatctcaacagatgaaaacactactactgtcccacgaaagcaactgattaacccaaaaataagagaccggatcggagacggcgccgcgcggtgctacgtacgtgaccgagtccgagagtgactccactcatcgtaacgcctacatactatcctccgtgcttatatacttcgatgcacgtgcgcccgacctcttcggctcttcctcgtgttacccaactgacacgctcgtgaaaggcctcgctcactaatcactatggagccggaggaggaggaggaggaaccaaacatgtacaactcggaggccggggaggagaaccacgtcggcggcttctacgagtgcacgggcctccctcgcgacgcggatgggttcgtcgccgccgtccacgaggtgaacccggtgcagttcctcgccggcgtcttccgctacctgggcgaggacatggcgggcgagctgctccgctccgacgacgacgacgtgctgcactgcccgagcatcgccgcctcttcctcgccggaggagctcctcgcctgtgccgcccgcgcctacaccggccgcgaccgggagcgatgcggtggcagcgtcgtggagcacttgtacatgatctgctcctgcttctgcccgcacgcggcgacgacggcggctcatgtgtcggcgcccgtcgtcgccggcgctgatcacgtcccggccccgtgcgacgacaacggtgtcgacctggcttttacgcaggacgagttgaccgcggcggcggtgaccgtgggcgaagtggacgaggacgaggtggccgtggcggcggcggcggcgacagtggacgcggccgtagacgagatcgtcctgaatgcactgggattcaatgagtttgctcgcgacctgaaggagaccatcgaagcaaaggatcgtgaggacgcgttgcgcgcggagggctcgtcagtttctcccggcgttcgtccaccggtgtagccgcgtccgcgttcgtgttgtcgtgtgacatgtttccgcccttacgaatcggtgtcgtaatagctgtggattttttctggacgtccggagttggaggtgtatgctgtagtacgtaatacttcagttaacgttttgcacaaaagttttgcgctttggataattgaatagttatccaacctaggtctgcttataatccatcaccaatataggtctgcttgtagtccttcaccaacacagatatgatggttcgtgccctatcaaacattcttttccttgcaagctaactatactactctctttgattaaaacaatgatgtttaacccctattaaaactcttaaaacgttcactattaacttatctaaaaaatacttagctccaaaacataaaaaaaaagatgggtatatttattttgattttgtaagcttagtggatcttataaatttaacttttcaatagaaaattattgtcaaagtcacatataaaaataccttaaaagagttaaacgagctgtagtacctccattatgaaaattcacatttatgacaagtggtttgaaattccctaagaaaatattgttgtattggatgattacatatgtagaaaattgtttttgtttctcacgatgtgactttgtggctcatgttttacgagattcatctctctctctcttgtatgcacgagcaaatcaagtcgcgcacatggctggcccaccaaggcccacgtcacgctctacgcagtgaaacaattcagtcggccacgtgcccacatgtggaccccagactcatgtgattgcgtttctcccgtgcgatcgtgctagaatttttatgttttttcacctatttttattactgactttattttaatttcccctataaaaacatacaaataataaaatttattgttgttttaagcctttgttgaaaaaagtggcttcatgtttacttactacagtaatttgattgtaaagttttaaatttaagttgaaaattttattaagttggttgaaggttttcaaatttgagttaaaagttttgaattttaagttaaaagatttcaaatcttcagttgaaagttttcgaatccaagttgaaaattttaaatctgaatttaaaaatcttcaaatccaagctgaaaattttcaattctgagttgaaaaggttttaaatataagttggaagtttataaatcttcacttgaaaatttttaaatctaaattgaaagttttctaatataagtttaaacttttaaatatgaacttaatagttttcaaatctaagttgaaatgatttcaaaatttcaaaatttgattcagtaaaaaaaagaaaggataatagaaaaaagacgtgtgcggggaatttttttagaaaaaaaaataaaaagtaaaaaaccaagagacacacgcgggaggttagcgagaaacgcataacaaaagtgggtccaccactttctttcaccccgtgcaatatttccaaaaaatggtgcgtacgcagttacgcaccaattagccacaccctaggttctatcataaatcacgatacaatcttattcttctttgctcgagatttgtgatagagcacacatcacaataaaaattgacgctttcttaaaacaaaaaaacctcaggtttgactcccgctcaggcgcccgatgggaggaggttaaaatcgggcgctgacggcagcgttcgatttacgtgcaaaactactttaaactgatttttctcttaaattacttatccaaatcatgatccggttgcaccattaaattcgttgtaattaaatcttcgaaacaaggccactcctagatatattccaaaaaaaaattagcttattattgaattatttttaaaggttgcacgatattccattaggtatattggaattgtttcactaagtagatcgaaaatgtttcactcgtttaaattagatgttgtttcaccttatataaaaacaatgtttcagcaaatagcgaaagaatgtttcagttcattgcaacattagatctatacatagtgaaacattgtggtacactaggtgaaacatttttcagtggaacaaaaaaaataaaccaaattcccttaataaggagtttccaaaatatgtgggggtttttttgcaatggaaggtttcgttcactgcaacattagatctatgtcatagtaaaacattgtaagtacactaggtgaaacatcttttgtggaataaagatgatggataagtgggtgggccaaacaggtgctcacgtgggggagggcgagcgatcgattttcccacctccccggtagaccgatgctgggcattctccggttttatcacaaatcgcggtacaatttttctttgtgtttgcttgagatttgtaatagagcacatgtcacaagaaaaaaaatgacgctttcttagaacaacaacataacaaaaaaacaaaaacccatccaaagcttaagcccacggacgcggtgcgagtgtgcgacgagcccagagaggcaaaccaaacgtccaaacctccgcacggcgccgccgcacgatgcccccggcgccaccgttctcctcccacggcgacttcgtcgccgccctccaccgctgcgccaccctcgcgcacctcaagcagctccatgctcacgccgtcgtcaccggccgcgccgccgcgcagaccaccaccttccacctcctccggttcgcctccctccgcctctcctgcctcccctacgcccgccgcctcttcgacgccacgcccagccccaacgtcttcctctactccgccatgctctccgcctacgccgccgcctcctcccactcgcaggaacacgcccgggactccctcgcgctcttcctccgcatgctccgccgcggccgacccgcgcccaaccagttcgtctacccgctcgtcctccgcgccgcctgcgccattggggtccagctggtcaggtcgatccattgccacgcctgcaaggacgggttctacgggcacgattttataaggacctcgctcctcgatgggtactcgaggtacgggatgatgggcgacgcgcggaagctgttcgatggtttgactgataggaacgtggtctcctggaccgcgctggtgtccgggtatgcaagggcagggaaggttggggatgcgatagtgttgttcgaacggatgcctcagagggatgtgcctgcctggaatgcgatcattgccggatgcacacagaatgggttgtttgtggaggcagtggggattttcaggaggatggttgatgaggggttccggccaaatggcaccacagtatcttgtttgctgtctgcgtgcggacatttagggatgctgaagattggaaaggtgatccatggttatgcgtggaggagctgtgttggttttggctcatccgttgtgaatgggttgattgatatgtatggtaaatgtgggaatttgatggaggcaaaatggatctttgatgcgttttctgataggggtctgaccacatggaattctctgatcaattgccttgcactacatgggtgcagcgagagtgccattgcggtgtttaattcgatgaggaatgaaggggttcaacctgatgaggttacttttgttgggctgttgaatgcatgcacccatggagggtttgttgatgaaggtcttagatactttgaactgatgtgtgatgagcatggaattgagccagagattgagcattatggttgtgttgtagatcttctttgtcgagcaggacggtttcaggatgcgatgaattttatcaatgatatgaaagttcaaccagacgaagtcatttgggggtcattactcaatgcctgtagaatacacagacacctagaactggccgagcatgctataagaaacttgttggatttgaatccaagtaatgctaattatgtagtgatgcttgcaaacttatacagtgaaggtggcttctgggaagaggttaggaaagtaaggaagctcatgaaggaggatgttacaggcaagaagctgcctggttgtagctggattgaggttgatcgcaaaactcgccggttttattctggtgatgatggtcaccctgagtcagaggatatctatgacactcttgataagttagctaccacaatggaaatgcaggctacatttgcatagattaataattcatattcaaaaatcagcatcttctaattctgtacatgactgaaactgttgacctaggcagcattatgctggtagatagatggtcgtgttcccttaaacacttaccctgagctatttatggctgaggtactgcttatatgccactactggggtgtacttctacaggatttatccattgtaatgctgttatctttgcatatcatgaaggtatgtgtatattatggatggccgaatatgcttctgcttactcccattttgtatcccacacctggtgatcttttttcttaattctgtcttcagtgctgccactgtgtttcccttggttcggaagtaacaaactgtcctatctggcatgtaatacctgctgctgctcaaccattataggtatggataacacctctatgtcggtataccatgaccaacctttgttttatggtccagtcttcacaaaatctacgctcgctgataatttgttgtcaaatgtcaacagggcatattcttgttctttttccccctcttgtacaggagcaccaaagtaaaggagacataagctaaagatggagtgaagaacagatgataaagagttttctataaactaccatttttatctgttatgcaggtaattttatattaattcaatttgtggagaacccttgcaaaatgctttcattatcaagtactttggacttttgagcctggactaacgaaaagcattacattaacagctggaatagctggttgagacttgagacgagggatatacggaaagctgcaatcagttgcatattggcctctcattatcatgtatgattgtaggagcatggttcaaagaatatgttctgctccttatctgctttgcagtaagaccaatacacattttatcattttatcttccatatcttatctcggtttctcttgatttgctctcatgtccaccatttcctccctccaattcaaagcttcttcttgtttaaacttattatgtaattcgttctaaattggtgggttctcaatctatcatctttttatcctgtctctgcaaggtgcaaaaaggtgattctttgaaagaagattctgggtacggagggaattgcgactgacgagatgcttacagttcatctgctcatgtgatgtgtcacatggcagaaaacatggagaaatgagcgccatacgttgccatgctgcgattctagagatccagtcatccagacagtggaaaggggggtcgtaaaggatggcgcagattatagaataaccatacagagtacaattgaaatggaccaacgatgaaaggaaggaaatctgagaataaattccagtgcagtgccagtgtcagtttcccggtgccatgcctgaccatgtaaattgcgatccgtatgactatccaaaagaatggcaatggctgtagtcctccgaatttagtgagttgaaagtgacttgtgagactaaataaaatataagcgactggcaatggctttgatcctgtagccactagccagcgataactgataagtgcagtaatgtctcagacaatttttagggcgagaacttttatggtacaatgtactgctagtatatactataagtatatatgatctaacggtgtagattgatttgattttttagttaattagattgcagtataaagtttgaaagggtaattttgtcttttctttgttattctatcatcaaatcatgctatcgttacgtccttcgtcatccaggaccaggtactcccaattagattcaatctgaacagaaaattactaaagagttattttattttctatcaaattcctaatatgcccttctatatactgtcagtatatactggtagtatattgtaccgtaaaagttctctcgacgagcgatgacagtggatcgaagattggccgaatatgccatgtttgacagtggatcgaagattggccgaatatgccatgtttttggaagatttactccttctgatgttccaaagaagggcgcccttggcatgcatgtcagtgctagggtatgcttagaagagcttccggcggctgtatcttataatcacaagtttcctcaaacaacctagtttttcatccaaatttggagaaattacggaatccaaaaaataaaagcaagtttttacagcctttttaggttcttaccaacttcttctaagaatcttagaacttgtttggcagagctctagctccagctccatctttcctatagctggagtccaaccaaacgatttcagctctacccaaaaagggatccatctttcttatagctggagtccaaccaaacgatttcagctctacccaaaaagggagtggagctgactagagtactctcgtaaaaatgaactagagaggtgaaactggatttacgcagctcgacaactccactacagacccaacttctaaagttaaatttagaagttgaagctctaccaaatgggaccttaaactcccataaacatgtcctaagcttagaatctaaaactccttcaaatgtccaaaaaaaatctaatcgtgggaatctaggattaagtttttttatgagacagaatgagtatgtgcctctaaaatctctttaggggaagaatttttttaaaaaataaaagaaccggaggactgccaataacattacaaagatagcttgcatgtactccttccgtatatgtgcatagctagaaataaggtcttttagggagttatgctttgagattatttggtgacctacgatttacaattttcattgcattttgtagaggtcatgcacgcttatatacagtggtgtgaatgtggcatgtgtgttaagtatatgcatccaattatactctcttgaaaaaagaatcatttttaggaagagtacaacctatgccctacaacaattgaagcttgaatcaatatattttgtctcctacattcttaattaatcggagcatgatcagggcatcagtagcaggtaatacctaaaagggtactagtgatgactgatgaggtccacatgaactagtaagttaaaattatcatgtactaacacaatgttaagtacaaggaccaccaagaggttgagacttaccagtgaggtttaaaagatcccatcatataactattaatttggagacgtttcacatatacttgaaagttgcctaagtgtgacaaatgattggcatttcctttttaagtctttaagtctaaatacctcaagtagctttcaagcgccataaaaaatcacgggtggaacgagttaagaactaacctagcctggagttcctccatgaccttatcactccaagacagaacgacaaggcgatcatttcaaattctaatatcatgagcctagcctccctccggtttcattttaattgacgttttgaacaatgacacggtctacaagatatatttttgaccttatttttctattataatatatataataaataaatacatatttatttttattatagtgctttaaaagacaaatctatatatgttgttctagttcctttaaactaaatatttttaaagttattgatggttaaagttataaaagtttgaccttaaccttgtccaaaacgttaattaatatggaaccaaaggagtatcaatactaatatctcctttggaaacatgaatttttctctcaattcacgcgatcattgatctaattcattaataaaatcacatacaacttcgataaatttgttcattctaagggtccctttgaaacataggaatttcaaataatttggaacgaaatgtatcaattcctataaaaatcctataaaattaaatagggggaaaaactttgcttccattatttgagagtgcaccaaactggcacatatctctgctcctgtaccggtccaaagtcaaacgttaatacgttatatgcattctcctagcagtcgcctatacattactgaacacgcattcgggaagtacaaaaaaaaatcatataagtggtgtacaaactacaaataccacagttgtcaaccttttatttattattacgtatggttttttttttcaacctgatagcaaacacgggctctctcctcatgtggtcacccgatcattgacaaagaaaggtagattatacccgtttccagtttttccacctgacaattatatcacacatgatactttgttgtacaaagcaaagctctacttgagagttgagataaagggatttttgctaagattttgtgtaaatttatatcaaatcttagtcaaatcccctgttccaaacagatgatctcagataaaaaatactactatctttttcttcctattatacaatcacgaaacctgcagcatcagatcaaccttgaaaaacgcttatatgcatttcgttcgatcgatgatgctgcatgtatgtactactagctcagctcctccggttccactagacatggcctcccatctcggcggcgacctgcgtgccgtgcgccgacttgagcatgaacccgccgacgctgcggtccggcttgccgctcgcgtcgtcgtcgtggtacgcgtacgcgaacccgccgtggcgcgtctggtccatgccggccatctcgtcctcggccgagatgcgcagcaagcccagcttgttgagcaccaggaacagcggcgccatggtgaagctcacccacgccgcgatgaccaggatgaccactatgtgcgccccgagcagccggccgccgccgcccatgaacagcccgtacgggcgcccgggctggccgaagatctggtccacgtactccttgcgcgcgaacagcgccgtgaagatgaccccccacgcgccgcacccgccgtgcagctgcgccgcctcgagcgggtcgtcgaacttgagcctcgccgccagcgcgttgaggccgatgagcacccacgccgagacgaacccgcagatgatcgcggcccacgggtcgacgacggagcaaccggcggtgatcgccgcgaagccgccgaggaggccgttgcagacgtcgatcacgttccagtgccccgtctggagcctcttcccgaagagcgtcgtgagcgccgccgtgctgccggcgagggtggtggtcacggcggtgcgtcccaccgccgaccactgcccgtggatgctaccgggcgggccgtaggatttgaggatggtgaggaacgagccggggttaaacccgtaccacccgaaccacagaaggaagctgccgagcacgacgagcgacgcgctgtggccgcgcagcgccaccgagcggccggcgtggtcgaaccgcccaatgcgggggccctcgatgagggcgccccagagtccggccacgccgcccaccatgtggacaacccctgacccggcgaagtcgatgacgccggacccgaagagcagcgaccccgacgtccgggaagccgaggcccacccgtcggcggaccagatccagtgggacaccaccgggtagacgaagccggtgaggaaggcggagtagatgaggtacgccacgaactgggtccgctcggcgatggagccggacgtgatgcccgcggcggcgatggcgaaggcccactggaagaggaagaagctgtagtcgaagccgacctgtgggacctgcttgaggccgaagaagtgcttcccgatgaagccgttggacggcgccccgaaggcgaaggcgaagccgaagaggtagtagaagagcgcgccggcggcggcgtcgagcacgttggtaagcatgatgttcatggtgttcttggcgcggacggacccggcgcagagcatggcgaagccgagctgcatggcgaacacgaggtacgccgagaagagcaggtacgtcgagtccacggccgacgtcgtgtccgcgaactggttgcacaggtagtccgtcgcgttcgccgccgccgtgcccagcagcgggccgagggtatccgcgcacgttgccatcctcgccgcctcgacgcgcgctcaacacagactgtagaggagaggggaggagcaatggaagtgtgggctgtgggtggagtggggagcggccgcgtcggatttataggcgacgtggagagggagcgagaaggaatccatgacttggggggtgtcgttgttgattccttcaaagtgtgaagggcccacctgccagtgaatctttggctacctctgaaatgtgggacccctatgatttgcttgttgatttgtccccctcctgttcgtggtcgtagttcatcgaatcccgtggaatctctctataggcctactgtaggctgcggcctggaggctgtgtttagttttttgatataaagtttttgaagtacacgcatacatattttgaagtattaaatatagactaataataaaataaattatagattctgcttataaattgcgagatgaatttattaagcctaatcaatatgtcattagtaaatgtttactatagcatcacatggtcaaatcatgacgtaattagactcaaaagatttgtctcgcaatcccatatttaatgccttatgcatgtgtccaaacatttgatgtgatatttttggctaaaattttctgggatctaaacaacgcctgagtcgcaatacagtggtttgtactttcttttaaaaagtaaaaacgactgtttgtacatttcgtcctcctctatatttgtctatagtgaagcacttgttatatttcctcctctgtttgtacttaaactttctttacttttttaacaatattatttttattatatttccacttgtaacacttggaaatattttataatttctaaatctaattggttcaccatgtttctaaagaaaattttggttgcacgaaaagacacacatgaatatgttaaccaaaacacatgaaatccttcaagctttctgagtggtactatctccatttcaaaacatatgaatttctaaggccctgtttgtttcagtttaagattattataatatatattattgagctagattactataaactgaattataataagattataataaaccgatatagaataagttgttagctgtttgtttatctggattattagctgtttgctagttattagctatccaataattaaaaaaagcacctttagagtggattaccagattatagtaatctggcttatagattataataatctatcataataagttatctgtttgtttcagcttactcctaataataatcagattataataattctaagtggaatcaaacaaggcctaaattgtttaacaaacattgaggttaggtcatagtctttttttactttagtatagttaattttttgaattttgaattgcttggattccctaaacccttccaagcatatgattagctatgaaatcattgagataatcggaatgatggaaactactacttatattgtgatgcaattgaattctaaaaatccttatattttggtattcatggagtacttttgaagctttcaccaaaacacagggctacgaattgaacccaatgattaatgttgtgtttttcctgtaactctaccatcatgtaatgattgtcgctctgcctttttaagcggctggtgctggttgaacgggaaagtattttctgaacctaggtgagctgcacctaggctcattaccgctagatgcgcctcaagattcggacgtacacgatacccacctgctatatgtgagaaacctgagaaatcatcacgaatcgcttaatcgatcgggcggcagacgccctaggtgcagctgcacctaggtgtagaaaaaccgcgtccctgttgaacatgtactccctctgttttttaatagatgacgctgttgactttttctcacatgtttgatcatttattttattcaaaaaaatttacgtaattataatttattttgttatgagttgttttatcacttataatactttaagtgtgacttatatcttatatatttgtataaaatttttgaataagacgaatgatcaaacacgtgagaaaaagtcaacggcgtcatatattaaaaaacggaggtagtattatcgttcatggtacttctctacccacctgaaattttcgttgtctatcatcgaagaagatcagccgttgcacctcatgctcaaagtgcaggtgctcgcgaaaaagtccagcacgagaattcctggaaatcttttataggagtacgtacttctctaactgtcaagctaacctgtacaagtgtgcaccacccaagtaaataagccatcgcagctatctcccattttgcaccggacttttggaaaccacagatcaacgtatctcctcattggcacaccacctgtcgataggcagctcacgcacgacgatgcgaccatcgtgccgaccgcgagaccacggcgagaggcataaaaacaaccgatcccgagatgggcaggcatatcggcgtacgcacgcagcccggtgagacccgccgcagttggagcgcgcatcgccatcgccgcgagcccgcgaagtccacggcgccctcgtcggcggaacaccccagttgctgacgagactgacaggtgacagccgagacagccagaaaagaaaaacgaagccggctgtactaacgacatcaaaaagaaatgggagccccgtctgtttcagacgtaatggcaatggtaatactaattagtaataagataagctcccagttgacgctccacaactagccaatttccatttcgcatgttcgattattccccctgacctccatgccatccagtgtgcatcttccgtgtcccgaagagctgctcccgagtaaactatgcctgaatccagagtccggaaacacatatgcggtgtctggatctgccgttgacttgtggattgtgattaaggaagtgttctcctctctgtttttcgtctgacatcaccgtcctgctgccgattatagtattttgagtttacagtggatttggcctctcccctcatttgctgaatcttatgaaaatgttttagctgtttgctcctgacagaatagtgtgacctatcatgtgaaacgcgagcgcaattgtactgtactatcatgtgaaacggagtatttccgatttcaaaccgtattacctgccaaccgtttcatggtgtcaggggtacgcgatccgaggaggtcgtatattgtactcattgagcactagtttggcgtatcgtaacgttgagcttcatttagaaatcagaatgtacagaaaaaaagagttcgctgcctgtgattcagttctgaatctgatcgagctcacctgcatctgtgctcgagcgttggttcgtttcgtaatttattgcagcttgaattttgatgacagctgttactgtttctggacccttcgagatggcgattgctcgagctcgctacgtcaacaggagggccgttgaatttacccattttccacgcttgcgtacgtacgttgcggcggaggaatcggcttgctcttgttttcttttttaaaaaaacgcagatatattgtttttttactccgtacctctgatccaactaaccgtatgctgtatagtgtatatacagttcttatcttaatcaggaacacggaaatgtcgccgtcgtgatagggggggccgagaaatcgaaatgctcgagaggtgggggtggtacgtcgtgtggtaccgtgctgtattgtttttagttttccacgttctcatgatcgcctcctgggcagccggcttctatctgtggaggaagcaccacggagaggagcggagagggagggcgcggatcatcaacggcgagccgcgagccgcacgggaagcgcggcacatgcagatgtaggcaatggcgcacggcggcgcggcctgaagccctgaaccgcgcggagaacgacgctctccgtctctccgagtcccttccgtgcgagaagccactaccgcacggtgcgcgcggggatgcagccatgcaggacgaacggggcgcgcgggggagtgcaggccgcagtccgcagtccgcagggcaagcggtcataataggccgttcgcagaagcgtaaggaaggcctttcatggctcatctgtcacttgggggttgggcggctgggcctactttgcgattgggcctcagccatacgttccttagcggaaaaagtacaccaaaggtccctcagcttgtcatcgggatagaaaaacgtcctcgaaccacaaaaccagatatgcggggtctcttaactatacaaaaccgatcacgcgaggtccttcggtgattttgattccgattttagtctatgtggcagctgagtcagcgtgggacccacgtgggtcccacatgtcagactgtccacgtcatctctctctttcccatcttctctccctttctcctctccatcactctcttgttagggactctggtcaggccgacagccgatcgatgggtgtggaggagggggctgaggcgcagctgttgcgacgtggtaaattgctcggctacctagcgacggcgggagcagggggtgcggagtggcgtcggcattgcgcggggaggctggtgcggcgcgtgaaggtgctatcggcgggccgacgcagtgcgtgaagacgtggtcgacagcgacaagaggccagcttggctaggaggtacagccggcgactgtgcggagagcgggtggacgcgggaggcacaactacagggggcgtcggtggagcagtgtccacgcgtcaatggaggatggttgatggtggagcaatagagcgttagctatggatctacaagggaagagcgacccagtgtaaacctagcccgatcttggccgggccaccaacgatggcgctttgggcgtcgtcttccctctcagaagtgttgtcgagccatcctcttcctctaactaggctgccgcgtgaaaaccctgtcttggttctctctaagaccttgatggagaggagcagcggtgctcatcgtcgctcttctccctagagatgtcgtctaggaaggtcccttgccaaaactcctcttaggcagctggtgcatgctcgctctagatgtcttgtgctcttgtgacgatgctctaggttatgcaagtcgaccacgttggcgggccctaggagggagagtagttccttcttctctctcaccctctccctctcaatctcaaatacatggctagaattgagatcggtggtcaaccgtagggcttggttttgggcggtcttagctgtagtttgcttgttggtctagtggcgaccaatcacgctttgcgatggtcggtccagtgcaagctttctcctgaactatgtgtatttgttgttagtgcgtggtggtgaaatttttttcttccctttcctggctactgtcttccaagatactagccttgtactactattcaacgaatcatcgtgttgtctggtggtgctgatcgttaaaaaaaaaacttgtagtactactatagcagtagtctagtacaagctagtttctccataggaggatactttggaccatctcgcagcgattctcccaaatggcatatgccgagctccacgttaacatcataatgacctaaatactgatacaaacaggacacgtctaaacatgtacaagaaagccacaaaaatccatacaggtgcaaatgcagagaagaaaggaagcaaatatcaaaagaaagccacaaccaccatgggctgaagtgccaccacgcccacacgactgcctcagcttatatatgcacacttcacaaaacactttccccaaacggacacgatcgatatgatcctactacacaaactggcccgccgcggcttgctccggcgactttctgggctccacgcgagccgtctccgccgccgacttggccctgacgcggcgctcgccttcgtcctcgtccacgtacccgaacccgccgtggcacgtcgggtccatgccttccatctctgtcgcgggcgagacgcggagcagcccgaacctgtgcagcacgtagaagagcgtccccatggtggcgctgacccacccgacgatcaccaggatctgcacgatgtgcgccgcgagaagcctcccgccgccgcccatgaacagcccgtacggcctccccggcaccccgtagatcagctcgacgtactccctgcgcgcgaacagcgcggtgaagatgatcccccacgcgccgcacccggcgtgcagctgcgtcgcctccagcgggtcgtcgaacttgagaatcagcgacagcttgttgcagccgatgaggacccacgccgacacgaacccgcagatcaccgacgcccacgggtcgaccacggagcagcccgcggtgatcgcggcgaagccgccgaggagaccgttgcagacgtcggtcacgttccagtgccccgtcagccatctcttgccgtagagcgtcgtcagcgcggcgacgctccccgccagcgacgtcgtcacggcggtgcggcccaccgccgaccactgcccgtcgatcgtgcccgactcgccgtagatcttggagatggtggtgaaggaccccgggttgaagccgaaccacccgaaccacagcaggaaggtgccgagcacgaccagtgaggcgctgtgccctttcatcgccaccgtgcggccggcggcgtcgaaccgcccgatgcgagggccctcgatgaaggcaccccacaggccagcaatgccaccgaccagatggacgacgccggagccggcgaagtcgatgacgcccgacttgaacagcaacggacccgtcaaccggccggccgaagcccacccgtcggtggaccagaaccagtgcgacaccaccgggtacacgaacccggtgaggaaggcggagtagatgagatacgcgctgaagcgcgtccgctcggcgatggaaccggacgtgatgccggcggcggcgatggcgaaggcccactggaagaggaagaagtcgtagtcgtaccctgtctgcggcatgtgcttcagcccgaagaactgcttcccgatgaagcccttggacggcgtcccgaacgcgaaggcgaagccgaagaggtagtagaagagcgcgccggcggcggcgtcgagcacgttggtgagcatgatgttcatggagttcttggcgcggacggagcccgcgcagagcatggcgaacccgagctgcatggcgaacacgaggtaggccgagaagagcaggtacgtcgcgtccaccgcggaggaggtgtccgtgaacctgttgcagatgtagttggccgcgtcggtggagttcgccgcgccgccgagcagcggcccgaggctgtccaagcacgtcgccatggtgtgtctcactagccaagtgtggcaaggttttgtgctgcttcttgctagggtttaggaactaatggaggttttggtgtgtgattctttgaagtagacgagagaatgagatgctggactatttataggggcagaacacattggaatccatggttgatggttgtttttaattggatgattcgtgatcacagacagcgggaaatgcaaaaccgaggtgcgcgtggatgcatgtatactgttttggattccttctaacatgggagtggattctaatacctcaaggggatatcccctcgtatacctttttcttccaaattcgatgtaaatagctatggaaaaaatctgaaaaaaattaacaatgtagagtataatgatacctactagtccaccaaaattcatattcaaattcgatctacacatcgagaaacaaaaaagacaaatttagatataaacagtacgctactattcatacgctgaatttgtcttttttatatctcgaagtgtgagttgattttggacttaagattttgtgaagttgtatatatgtgttgtatgaatgttgtcaatttttttcagaatttttcataaccgtttagatggtttttgagtaaacgagggaacatcccctcgagggattagaatagtttcccttctaacatcacatatactagtgcctgaaaacctttttttttcttttttgccaactgcaatgagttgattaatttttttagtggcagcaaccaatcttttcatccaacaggtgtgatgagtaaaagaacgagcagttcacctctattaatgaatgattgaatattactgagataattttatcatccttaagaatacattgcagataccattttttaatgtaaaatttggcacatacaattacttttttttagtgaattaaatttctcttgaaataaaggtacgctgcaattttatttttttgttttgaaatttcacaaaacaagatttttaactgatcttgatatcatatttagtttcatgtataggttggttcattcataaatttaagttcattgagaaagacatgtgattcacttatcttcaaaaattgtcagtgatgatttaatttgttacctagacgtctcggcgctggtgttgtaagactgttaaaattatcccaataggtttacactggttttgcgacagtgatatttgttttgtttttacttaagtattgtcttgacttttgatgatgagcgactcaactagcctgagttcccgctttgctcagaaagtttcagacatcagtaatttatgctgggttgggagtatccgacagatccaagcaaggtcgcatacgcaagatgccagattcaactaagatccaatgtcactatcagaaagtcgtgttgttgccatcacagctaagattcttttatgcattcaacattttttaaaggaagattcagaaatgttcttgttattatatcgtctgaagaatcgcattttgtcaacttcaagtattacaggttttaatctggtatctcctcgcatccttgcacgaggtagttgcttgtcgtcacgtccgactatacgcatactgttgtgtcatgaagttgcatatatacaaccatatacttgtatgcgtaatatccattgactttgttgattaactgtttaagttcttcaggcatgcatgtaaacccagcagcggataggtcgtacctagcagaacatggcgacaaaactcatcaatcgagatggtatatgatgtgtgcaatgcgtacttagcgaacgattagatattcgataaggttattggcacaaacggagataaacccatttgcttccataccataccggcggcttctgtcttggaagaaccttgtgattaatttgcctccctgaagaactcgtgtctgactgaaaccatgtaatcaacaggtagtccatgctaaacctgcttgctgactactgagtactctgtaattgtcaatcagatctctgtgttggtctggctacattaacctgtacgatattttcactgaaactatatgttttaactcactgcaaatttatgttgtttgtcttcagaaatgagggtgtcaacatagattaaccatgtattcttacttcttggcatagcagtaggtaatttcttccagtagaataaattcagatgatgaagcaattccttaggtcaaaactctgacaagactggataagatgtggtggatagggacgcaattgcttcttccttgcaagtatgacttgcagatgctgcgtatctaatttttacactctggagatagatcacgctgatgcgattaaatacctattgttttatacttttgtcgtgcctgctaccacacctgtatgcatatcagaaggttgaccttcagaagttcagagaatggacggatctctagtaaacgaatcgccattggacggaaacgagtgtttcttattagcaaattgcaaaccgggtgtcctcagcgagacgttgatgtctagtgacaaatagttttcacggatgagataaactagtcttctcggctccagggatcaaatgtcaataaacgccaccgtaaaagattttttttctcttcttacccaaatgctactcttgacttattgataaaccaatgtacagaaattgtactgctcgttaagtttatgagatatactagtcacggtttctgccttctgccgcagctgatttggggatctctctacgttactgttgtatgtgtatttcagtcacccctgaacttatctgaagctttgtaatgcttttctgaaacttttcacgggctttgtaattgatggaggcccaatttcaggcccatttgaactgcacttatctttggtcttggcgtcttgctcacagctgggccacatctgttcatatgtagtatattttttccacctcggatatctgcagcgcgcgcgagagaggaacagagcaactcgccaacaagccgatgacgacaacgcaaagcagcctctgttcgcatcggcgatgacgcgaagccacaaaccgcgaacgcgaccgatgcatcgccggatgcggccgcgcgcgcgagccgagggcccaacgcttacgtccacccgcgcgcacggagtcgtggccgtggtcactccaccacagctgcacggctgggcggttggccggttgcgcagcagctggttaaaattggctgcacggcggcatcattcaaggcgttggagtacgtagacaaacaggttcccggtcaagatccggtagctgagtggagctccctggtcaggtgtacaatcttgtgcggctatcctaaacagcgagataactttggatgatgtcaaacataatactgacattgaacaaaacagctggctacaaaaaaaaacaccttaattggctagacatggtaatttaaccctgcgcatcaaagcaaagaaccatggcaactactactccacagtccacacatgtctcaggcagaggcaggcgacgacaaagagtacagcagcgtattcaagctgggaagcgacagccgacaggcaagggtgctgcgaagaaacagtagctcctgcaaaccgtgaggaccggggtaatgcagggtctgcgggtggcacaaaagctaccagcagcacgaatgcgctgggaacggggagggcaccacagcaccattcgtgctcagcctcagcagcagcagcacaactcgcaacgatatccacacaaacagagtgcccggccaaaaccacagaaaaatcaggggaaaaaaaatctcatgctgatccagtgatcctcctgccggccggctgccagagatgagagatgcaaggtatggtattcatccattcgtcagtcaaaaggcactcactgaatgtgagtgaatgcacaccgagagagagagagagagagagaggcatgaacagccacaggacgagtcaaagtaaagcaagcaacttcactcgctcacatgctgcaacaaccacactttcggtggcttaagtgaataatagtaggccggaccacctgcttctagggcagcaagacgcccgggcggccggccatggctgcctgatcacaggttcagaaaccaccactgccacacgcacacacacacgcagctgctagctagagtcgccgaccgacccatccatggctagttgccatggaccatgcgtccaacgaaccatcaattccgagctctcaacctagtgctcgatccactagctcgggggaaccaaatagctgctactaccatccaaggattcggtatattctcttttgtaccatacccccattttccctcctgcctgaatgaaacggattgtgtggctagtaaggctgtgtttagtttacgctaaaattgaaagtttggttgaaattgaaacgatataatgaaaaagttggaagtttatgtctataggggagttttgatatgatagaaaaatttgaagtttgaagaaatattttaaaactaaacacggcgtaaatagtgttgctatcggtgcgagtaaagacgctgcagatagcgactgacaggcaaatcaatgaattggccatttttcatgcatcaccatctcataattttatttcgtgtgatccaatccacttatcactcactgatctatgtgcaatgaactaagtccagaaaatatctgggtagctgcactttggtttgtttgatttgtacctaacttctaattcatccattggaacaattataatgtttttaagcagcgataactgtgcgatagacttatggttacatgactccaacttatagaatctaaatcctactccctctgtcctattaaaaacgaatctagaaccggatgtaacatacatatgtccagattcataataataactaggatgtgtcacatccggtactagattagttttaatgtaacggagggagttggacgacatactcacatattagttcattttcaatgaaaatttagtgggaccaagtaattgttgttagttactccctccctcccaaaaaaaccaaactactccctccgtcccaaaaaaagacaaaccctggtttccgtgtccaacgtttgaccgtccgtcttatttgaaaaaattatgaaaaaaaattaaaaagacaagtcacacataaaatattaatcatatttttatcatctaacaacaatgaaaatacgaattataaaaaaaatttatataagacggacagttaaagttggacacggaaacctagggtttgtcttttttttgggacggagggagtagtactgaatgtgatatatttgtccagattcgttgtactataatatgtcacatccagttttagattcatttttttgtgggacatagtgagtatgtctctttatgcttgtgttatggacgcactagcttgtgtatatgtgcgttccaagtaatcgaagaaaacaattttgaatacttttgattcctcttaattggaatctcaccaatttttaagtaccatcataaaatgacacttccgctctaaagttatgacggcattatattttaagcattggcccaaaatacaccaaatgactaaccatgtgcactgaaaaaggtgtcatattaacattataatgctgtgaaatatctcctgaggcacttagccccattactcatttttaaataaaataattcaaatctttaagctgatgttgaaatagtttggctatgtttggcttttttggagactcaaggtgtgattggttagggatggtaaaactttacatagtaaaaacattattgcatattttagattttgttttcaaaaagaaaatagttcatattgcatcagggaaatttggcaaccaatgaaaacaaccaattccttcaaaacaggctagagtatcgcgtctatagctttgagattttgtattttattcaatatagaaatttggttgcaccaagaaaattataataaaaaacaaccaaagtattaatattttttattttatactttaaagattttggttcaaaagaatagcggaaaaccctgatggaaagctcaaagcgaagtcccgctaatatcgagtattcgagtctcacttctttattattctgaaaaacctattatccacaccactataattgacatggcataattaaccatgtaacaacgcttttatgttgatatactgaaatgccataatccttgtcgcaccaatttttttcacggcgtaaaagtattatcttacggtaccatttatagttgtgttgttgtaaatgttcccaatcgtacataacgtgtagaagggtttatttcaaaatttgtttagaataacgttcagaaaataaaattttccactgccttcgcccgagagcaggaaaatcaaatgcacctacaaagagaaacggcgcaggaaatgaaaacaaaagacaattaatggagtctagtggcgccggtcaaagagagcattcaaagtggattgcactcggaggaataaacaagaatactttgaacagcccctgcattgaccggtttttggggctcctgaataaccactagcctctcaggggctagatgcccctgccccctcgcacaccattttttttttacacgcagagaagaagagacattatcacattaggcacgggcttaattatctagcaacaaattagctacagaatgaggctaagcgcagtcaccgaactaatcaggaagcgaattagtcaccgaattcggcgagggagagagatcgatcgacgacgagacagacgtcaagatgaatcgaacttgtagtacttgtcgacggcggcgaggacgtcccaggtgcagcttagccccttggggaagacgacgaggtcgccggcgccgaactccacgcactccgacgagcccttgatgtgcgccctcaccttccccttcaccaggtagcacgtctcccgcgcgtcgaacttcaccgggaacttccccgtcgggcaaccccacctgcgcacgcacgcacccgcccacgcgctcaattaaacacgtacgccatgaaggagcaggaaatggacagcgatcgatcggcactgtggcgactcacttgggccaggacttgacgcctagctggagcaggcgcgactccggcgggttgcgctccacggcgatggagagggtgccgccgccgccgggagggtccgtgtccatggtgtccgggtttgagctcgaggccatgagctcgcgcgcgaggtcgaggaggagaggagggagaccgggagagggtgagcagtagcttgcagttaggagtaggaggaatgagttaaggagggttgtgtcagtttgggaggtgagatgatgagttcttctacttctagttctcgcgaggggggaaggctccaagagagggcagttggactgatggctttcctgtatcaaaacaagggcaagaggaatctccttccttcatgtttttaatatatacaagtgtgtgcaataatattatattatttttacccagcatgtgtatatcatttgggacaagtcaatattatacatatttttttctgaatggaaacaagtcaattttatcctcttcctatgaggccaaaatagctctatgttgcttactatctctgctctaaaatatactatatccgttttaaaatataagtatttttagtgataaatctgaagatgtagttatccaaattcatactctctttatcccaaaatataagaaccaatgattggatctaatatttcgtggtactacgaatctggacaggctgtccaaattcatcctatccaaattaatagtcctaaagaatatctcattcaatcctaacttcttatattttgagacggatgtaataactaaaagtttttatattttgggatggaagtagtaaaatattttgcctatgttattagatggacaaaatcccttatattttagaaaggcgatattaccttttatgagagaattttctcttatttgtactcttcatctaaaatataagtatttttagatatgtgtagagatacatagccagaaatatttatattctaaaccggagggagtagtagtattttgatatttgtatcaaaattagcattaaacacatatccatgacacgaacatatactttggtttttttttaataaaacttgtttggaaatgagatatattatgtttttctaacattttttgtgcctgcttgattgctcccgtacaactgtttgctacatgaaacagcaatgccatggcttgctgttgcagactaataagctgcggtcagacagccaagagccatggtgcattaactttgtgcaaataagatagtgaaaaattaagttattttggaaccaagggaatattattgaaaaggaaatattcacacaacaacttatgtatccacaacatttacctattgttgttttaaggcccaaccctacttgtcaatgtgatagcaaacataagtgtattctatactcctatattggtaatacttatcaaatttgattttttcacaaacatgtggcttttgactctttaagttttaagtttagagatataaatgcgaaccactctgaatgtataacttttgttaggtacattacaatgtaaaatgacacttttatgttgcataattagatattttaaatgctttacgttattattaaaagttgatcagtcaataagaggagtaatgcgacatcttatctacctgttctatccttgtcctatctaatctttttctctttacgtaaaactatgtacctctttgaacttgtggctctaaccacctccaaaccattcagttcttaaacgaattggcgagccgccaaattcaataaatagagcagaaaatattgaacaaggtaaaaagaaaataaaaactatgtacaactattcctggttgcccgggctaacgactaaggtagccattgaacttggtccttaaccatttagttggataaagttgaatttgattcctaacacattctattatgcaaccggtctagcaataatatattgtggcaatcagtctagcaagtatcgttgtttgaccgatgaaactttagacattatttcgtcgatcaatcattgcatatactacattacccctagcaacttagtacaatatatttatatctattgaaaatttggttgtggggcggataacaagtggtcaattctcatggaggccacaccgttcatcgcacatgaaaagaaaaaccgtcgtcatatgaaacacatgcttagacagcttagtgaacattacataaataaacagagacatacagtatcagagataattgttgagctcggggggcaaagaaacaactctcagccggctgcaaacttgaaagcaacctccaccgaatttgtcacgagaagaacgagacccaccgaccacacaccacacaatcacacaccacgccaccaccggagaagcggtcaaaacagctagagctcgcgatcaaccgcgagccgcgcgacgacgaaggggttaaaaccccgccgtccctatccgcttcgctgacgtggcgcctcgggcggggcccaccatacgaccaggccattgaccgccagcccccgccggcccgggatcccgtgcggcgacaggccacatggcctccttccttccttccccccgcccgtgcgggcgggacacgtgcggcggacgggaccgcgagatgcgatcggacggctggcttggctggcgcggcagcggggccctctgccgggcgaactggcctatgcgccgatggacggtggcgatgcgacggcttcgatggatgaggggatgatacacccatccttttcccctgttcgtacgccgtgctccccgaaacatgtggggccagtgggcgcgcgacgcgtggccggcgccggcgcagctgccggagggcgcggatcgtttgtgcttttctcgcggcggcagcgtgacacaagacgacagagagtcaaacagggcgtggatcgcgcttcagctttgagtttgcaaatgaaatcgtagaatctggtatgattcggtacaatacgacggaattcgagttaaaacaacgaaacacgaaatgcccgctttttgtaacaaactgttggtcgggtttaggaggggcctaatcaggaaaattgcagggtccattacaacaagccaacaatacgccagataatggcctacccgcggcaccatggcagttctcccctctgaagagaaactggttgaacaaccaattctttattacagtatcttttgtcaacatgctgttcaaccaattctttattacagtatcttttgtcaacatgctaatgcaatgctacattagggtgtgtttagttcctgaaaaaaattggaagttcgaagaaagttgggagttcagaaaaaaaaagttgaaagtttatgtgtagaaaattttttgatgtaatataatatgatggaaagttgataatagggggaaaactaaacacggccttagtatctggattccaaatctttcaggtaaaattgtttgttcacacagttgagggagtcagctactaggttgtagcagtaagaaacaagcaatcccgcagaagtgaagaatcgcgtcacagaactcagaagctaagtggtaacagaaacatagcacggatcaaacttcaagtttcaagcaggtactgtcaattagacgctacagtgacgttttggttgaaacttgaaagatttccagcattgcaagttcacaaaacaacagatcagcggcaaagctggagccaagaacgaggaccagctgctggcggataaacagttcacgcaagtggtagatctcggaaacaagaaatggaatgataccacaacttgacgtttctcccttggtagcagtctaacaatcaatcaggcaaccagcagtcaaatgcagcagccaagtgaacgtgaaaacagtctcgtctttcattttcacctcgtctagccaaatatcagaggacggaatatctgaaaatttattttcaccacttttctggatgacaaattcaactgatggacaaatcagaaataatattcaatagcacattcaatgtgataatcactttttcgcggggccaataggataatcaatatagataaattctaaattgcagatcttgttgacattgtttcagtcagttagaagcaaagacatgcaatctcatatggaaacaatcattgcttgaacactctcgcttcagaactctagatggcatagcctcatggtaaacaaaatgagggctgtttttaggctacttgcaagttagaactaatttcaagagaaattgatcaaatctaccataggatccccaaacttttttttgttgtgaagtggagatagccactaccagtactaccaaacagtttgtcaaatctattaaattggcatcaaatcatccccaactgtagcacaattcaacccaatagcagtttggtactcttgaaagcatttaatattactaatcaacaatcagaagcagcttgttgactcatgaacgcactttacacccaacatcaacaccttctagctagaactagcaatgtgacatgaggctggtcctttcccgactgactccaactagtgctcatgggttacaaacataaaagtatttcctctgcaatttcagacagaaatttgcgtggtagagacttttatttaggttaattcgccgtgctaatggagtttccactgcaacgccactactgattggatgaggctgctaattatcccattgcaacagtacgtctggaccctccagatattcctgttgtggaaaactctagcaggaaaaatcgaagccaatcgatcaatgtgacatcgacgttacacccacctgcttccaacatcgcgcacattgaagccaacatatataaacaaaaatctatcttgtgaatcaaagtactacgagaatttaagaaaacctcgcagagattggtaccaatcaagagccaaaagcactaaccaagcaaccaacaatgcaggcaaggcatagagattcaaaaacatcggcagcaaaaggtacccagattgatctcacgacgtctcgagatacatgaaaagaaatctaaccgacgaactaactagaagaatccatcaccatagagacagatcagcctctcaaacttccaggagagccccccacaagagcaccggcccccacacgttaccgtaagcgcctcaggcgaggtcggtgtcgtcgaagtcggcgccgtcgaaggagttgtagaagccggcgaaggggaggggcccgcgggcctcgttggcgcgggccgcgcggtggccggggaagacctccgcgtcctcctcgtcgtcgaggaagacggcgccggcgccgctgctgcggggggagtcgtcgatgtccatcagcgccgtgatggcgtcgtcgtccatgtcgtcgtcggcggcggaggcggcgggatggctagggtttttgcgggaccactgcggggaaggaaggggaggagcggggtggcgagggcggagagggggaggagggcccggtggtggggcgcgcccgctgcggtgccttggatgggggcgacgcgtcgtcctcgactccatataaagttgtgcttgtgccccccgagttctggagatttgtgcgtcgccttcgtcgtgtgccacgagtttttttgttttgtttttaattttatttatttattttcccttttctttttagagtgacggcatcaatgagcccctttgccttccgatctctgggcctatttgggctggccgcgtcgctaggccctctcccctgttctacatgatgctatttgtgaattcttcttttttttcatacggatttgctcgacattgttaaaaggtaattcatctcatcacctgccaaattttatttggaatgaataccgtcttccttttctcgttgcgttttgtgattgtctcgtgtgcgtttgggcctttggggatgtgttcaggccttttatgtgaaccataccaaaattcggtcgcactgagaaccagtacgtgaacaatacgatagtggttctatccggccatccggagaaataaccacgtataaaccaattatggaaagcccatgtactttacgtttacgtacaaattgttcggaaggaatcgcagttcaggattacattgaagatctgcattggcggtactcagttagcaagagtccaaacatataaccagcttatcccgtgctacgaaggatagcacatagcaggcgtcctgttatcgcacaggtcgcataaaagtgggagctactaatacttctttaagacattcacaacatcttgactgtcttctgttctggcagtgaaacctgcgaggcaaggtgctaaggtagtgagtaaagattacggcaaacgagcaaatgcacgcacaggaaatgtggcgagatagaggggaaaatggattacctgatgctaaccgcttgtggtgtccattgacgttccaatcaatttgatcgtcaatgttctcaacaatcttccttttcataccttccagtttccgctgaaatagtggtattacgttcacaagatctgcaggtatagcacagttagtcaggcatgttctgaaccagagttaaccaggctgcccaaaaatcatacttatgaagaatttactcctttgtagttagtatcgagatcctataaacaacattgaactgtatttgtacgtgacataaacaaattaacaaaagcagattaagaaatgtcatagaatttgggcggcgggcaagaatattttgctttctgaaactcaaaattgttgatgccagtggctgaagcttactagttttttaaccatgcgaagtaacccataaccaatatgcaccatacgttacaattactaacaatctgccatgtagcatgtcaattgtcaaacaaggtgacaaggaaggatataacatcagcatcatcacaattactcaaattatgtcaacaataattacccaaccataagtgaacaggttggagttctgatcacttgaaaaattcaaaattgtaagccttatttcatggaaaggcattggcctaaataaaataaaagtcttttaatgccagcaatatcgaagtgaaactgcagcttaagcatgccaaataactatttgtgaaaaacaaaagcagcgtgaaacttaattgatgtttaatcataatcaaatggcgtggatttctcttcctcctgttgtacacaactactgaatctaatgtcataccttgaaaattgtcttgaaaggccttgctttcaaacaccttcaataattcagccatagaggaatccaaatttctctggcactcagcttgtctttctaaggaagaaagctctttttgaagttcttcagattcattgttagcctgatgaaacaacatgtgtttgtcatataaatgcagatatagagaagctaattcatttaagtaagctgcttacatcttcaagttttttcctaagagaaacaagttcagcatcgagatccgaatcagaattcccatcattgagtgatttttttgcaggaatatcctgatgaagaaaacaactcatgtttaaccatcttcatgacaccattttttgaaatagaacattgaagtaaacataaaagtaaagcaaggtttcaggaaacagaattgtatgttctgcttcatcataagaacatatgaaaatgaagactgtacaactttgacacaatatgaattccaaaagaaacatgatgtagtataattaaatatcttgacttcactaaatcaatcacttcaacctcacaaaaaaattaaataaaccaatcacttcaatatgaggaacatacatcttcacgtgtcaggaatccttcaggtattgcgaaacaatgtcgaaggcagtatttctcccaattgctcattctcttatccaatacatccttcaccaagttgtgaatgctgattacaccctaaaaagaaaatcataagaagaactatacttttcagaacgttcaagctggactggtctattgggggaaacatgtgccaattgacaaacatatgaacgatatgcaatagcttccagaataaaatatactaaaaacattactgcaccatgataaaacaaagcaattgttattaaatatgatacatgataactcatagggctactaaatcattagaagtgttaaagtaatgtaatgcttccaaggagagctagcctgataggtccatagttgcttttgaccacaataagtggtatcttttttttaaaacaaaatgaacaatatccattccatagttctgaaaccaaatgaacaatatccattctatagcaaaaatatgaaaacagagaagctaacaatcgaaagaattgttatctggaaccatgctttgctttggtatttttctagctgtttcaatatttacactcagtaatccatttgtgttttaatttttctttttagaagataaatcattgattgacccagctttacaagaaagccacacttagtaattcatttggttttaaatttatgcgtagaaagtttccgcacaagtttgtttatcaagcatatatgcaaatagaaacatatgtgttttataggccattgcaaagtggtactgatggtctgatactacacactgtgcagcacggaaaagtcatctgaattgaaaaaagaaggacggcacgtcacatcctgtacaaaaggggctacaaaacaagtaatcatagttctgcagctgaactgctgaaaggcacatccacatagccgcataaattcctttgatataggatccaatagccagcttgagccttgaaatgaaccaaaattgatcaatgtctactagtcataaccgctggctgaccccgataaattggtgaacgctgagtctgagagtgctaaggctgataaattggtgaacatcacgagcgctaaggcaggtgaagctaccctaagactacgatcaagcattgttaagaacccgacgcacaaagatggaattcgtctaaaaacacaaccacaccatacaagacaccttctatcgaatcgtggaatgggaaatcgcgttccagaaccggattatttttttaaagggaaaaaaactgagggggccggcacgcttcatgaaatccagtggttggggggggaacttacccgctccagctcctcggccttctgggtcgccatggcggcgccgacggcctcgggggcgccttccctggagaagagagaagaacagcaagagggcaagttaacgaacaaccgagcagcgaaagagggggcgagcgagaaagggggggaggagaagtagagagggttcggtagccttactggaggcagtactcgaaggccccgtagcggacgtcgtcgaccgcgttgaggaccgagttgacgaagaacgaggcgctcagccccagcgccgcctccacggcggtctcgtcgctctcctccatgcctggtatgagggggtcctgagtggtggtggtgtgggtcggcggacggcgaggggagcggcggcggggggttgggcttgggcacccgcggtcgccgccgacgacgggtggggggaattcgaaattttccgcggccactttttgggaggaaaggaaacagatgcgcctctctcttttttccagagcccgagctgcacgacgccactgttcggcggccgcaggtgggcttaatccatgtgtatatgggcctagttcgacgtcagttgtgggactaaagccttattacgcatcggaagttcagaaatggaaaaagtacacccaaggtctctcaacttgttatcgagatacaaaatcgtcctcaaaccgcaaaaccagatattccgcgtcccataactaatcaaaaccggtcacaaaaggtccctcggcagttttgaccccagttttatcctacgtggctgctgagttagcgtgggacccacataggccccacatgtcagcgtaatccacgtcagcctcctctctcttctcttcccccgcttctctccctttactcatatctctctctcactaatctgcaagctagccagggcagcgagagaggaggagggcagcaccgcaacggcgacggcggtggccgtagtggggaagcatggcggaggcgcggggaggccggcgtcggcgtcgcccaggcggtggcggcgaggcgctgggaggccggcgtcggtctcgcccaggtggtggtggcgaggcgcggggaggccggcgtcggcgtcgcccaggcggtggcggcgaggcgctgggaggccggcgtcggtctcgccctgacggcgcagcggccgtagttgggaagcacggcggaggcgcggggaggccggcgtcggcgtcgcccagtcggtggcagcaaggcgcggggaggccggcgtcggcatcgccctgttggcggcggccgccgcagtggggaagcacggcggaagcgcagggaggccagcgtcggcgtcgcccaggcggtggcggcgaggcgcggggaggccggcgtcggcagcgccctgacggcgcggcggccgtagtgaggaagcacggccacggcggaggcgcggggaagccaacgtcggcgtcaccctgtcggcagcgcccgcagtgggaaagccgctggtcgtaaccggaggtggcgaggggggaggagttgtcggcggtgtcggctttggaggaggagcgcttgtggtcggggtcggggacggcgacggcaagggagcacgggaggcagagggtgaggatggtgtcctcgaagtcgagccccgatgccacggacgactccgtggagctccgctccgtctccttcgatgcggcggggaggagggccggcgtggccggcggctaacgaggaacgagcgtggtggagaggagggccgtgcggagccattgtcgtggccgcgctctcctccgtgtcctcactaccaccgctggcgagccgccccttatggcatcagcggccaagacctacctctgccgcaagcacgatcccaaccgtgccgtctccctcttcaaggccatcgacgacacctccctctcagcctcccaccgagccgcaccttgtcggtgtcttctgctcctacgccgccgtgtccctccccgagaaggctctcgccgccttccgctccgccgcgcagagctcggccggggccgtcctcaacgaccgccactccccatttggcgccgggtgcatcgagaagagagggaaagagaagaaataaaagaaaagataaaaaataagaagaaaataatgatgtggcatcctgacatgtgggacccacgcaactcagctgccacgtcagataaaaccggggtcaaaaccaccgagggacctcaaataaacggttttggaagttaaaggatctcatatatctggtattgtagttgagggatgattttgtaactggacaacaagttgagggaccttcggtgtactttatccttcagaaattttctaggaaaaagtgcaccgaaggtccctcaatttgttatcaggataaaaaaattctcgaaccgcagaatatacgcggggtcccttaactatacaaaactgattacccgaggtccttcggtggttttgaccccggtttttgtctacgtggcggctgagtcagcgtgggacccacgtgggccccacgtgtcagcgtgccacgtcatctctctctttccccattcttttttctttctttactccatccaggcggtgctccatggaggccaatggctggcgtcgctaggcggggctcgtacgcgaacacccagaaaccagcgccggcaccagcgccgccgtgatgcgcgacaacacatatatgtgggttgttgtgttcgtgtatgtgagttgggaactcattccctccacacgaaaaacggagcggtctattagtgcgtgattaattaagtattagctaatttttttccaaaattagattaatttgatttttttaagcatctttcgtatagaaacttgttgcaaaaaacacaccgtttagcagtttgaaaagcgtgcgcgcggaaaacgagaaagaagggttgggaaaagaggatgccgaacacagctgccactcctcataggtacacatggcttagttcactttgttgtccgaatcaatcatatcaaattttagtaattctatttttttataaattttagtgttgactttgttttgatgccttcgctaaattttattttgatagagtttttagagaggaagcttctgaaaataccaaaatttagtaagatagcaatggttgatatgtgtctagtttgtcacctactttaaaagcggcgacaaactgaatagtcccacaatttgccacaaacgtggccaatttgttatattaggtccaactcttttttaagagtatcaaagatggatcgagagatacgatccagctttctaagaaaacgaacagagtagggtgtattaggcaccccttttttcagccccttccccttatttttcacgcgcacatttttcaaactgttaaacggtgtgttttttgcaaaaagtttctatacaaaaattacttaaaaaatcaaaataatccatttttttaaaaatagctaatacttaattaattatgcattaatggattgctcagttttctatgcgggagggactagtttccatccctaaaaccaaacacaggctaaaactgtccgacacaacactcacaacataaacctaaaacacgctgctgtgaatttgagcttacattatcagcaccctaacaagcttaccaccaaaacaacaattccagaacccagctattgcgtgttttcaactcaggttatgttcggtaggaggggttgcaacattactgtggctacaactacagccagacatgacacaaacaactgatgttggcttacagttgcagccacatagctacagtaaaaaagagcagctgaacatactctacatgtctaatgaaagaacatctattgatccaaatttcttcatctttcagatttaatcttcagttagcttttatccaacttgcttgcaccttatccctttttcaaaccctttcacttttgtaagagagagatcattttatataccatctgtaaaggagatttcacaagtatatatgctttccaagacataatcatttcttccagtccatggaccctactccctccgtctcataatataggagtagtaatctagaacagacactttatagtacaacgaacctggaaaagaaagcatgttcggatctattgtactatgaagtatgaagtgtcacatcctatactaggttactatattatgggaccgagggagtaactaatatactccctccgtattttaatgtatgacgccgttgactttttgataaacgtttgacttttcgtcttattcaaaaaatttatgtaattataatttattttattgtgacttgatttatcatcaaattttctttaagcatgacataagtatgtttacatttgcacaaaaattttaaataagacgaatggttaaacattagtcaaaaagccaacggcgtgagggagtagttatcagtcatgtgataacaagctcaaccatgcattcttagggtttctttggagcgttctttttttaattcctatagaattatattattatgccatgcatagtcatgtaaaactcatttgtttcaaaagagaagccactgctggttataacttccatgttaaaagcaccacatgtgacaaagctcccacgaaattgacgtggaaacgtcaaacgtgaactccagcaaattagtgaaaaacccttttctccaccgtcgtgctagttgctacgctagaggtcagctcgctccttgcctccgctttaccaaaaagggcaaagacgagtcctttttccgctgccgggcgtgcgtggataagccgaagcgcctcccccccggccccaccccctcttctccccatcacccgcgttgtcctatcgtcgcagattcacaggaccccaacctttcatggcttattcggaatatagatagtaaaaacgaagaaatagaaaaattataggaatatggtaggattgtatgtgtaaaacagaggattgaaaaacataagaatttcttgttctccgtgcgcaggattcttacaacaaagaggctaaagtggattctttttttccttgtgaaaacatgggtagggaatagtattcctatggaattcaagatagctaaccctttcaaacgaatgcatctatagtacccagttcaaaggaatcatcaatcctccatttttttcttcacatttcctccattccgaatgagccctcttcctgtttctctcgcaagtggaatctccagccgtccagcgttaatgtggatagagatagagaaagagagtttagggcccctttaaatcgtaggaatgaaaaaacagaggaataggaaaaatacaatattctagcaggaatacacaggaaaaaaacaggaatggccgtttgattggaccacaggaaaaatgcaggaatcagatgagagagatggactcaaagtaaatgttccaagaggttagacctcttgctaactttcctccaaaatgtgcataggattgtccattctataggaattttaaaggattgtataggattcaatcctctgtttcaaaggtcttcataggatttttttttcatagaattgaaatcctctaaaatttctatatttttcctacaaatcaaaggggccattagagtttagagagagctgatgcactttctggcacacgactacacgaacaatcaatcactggctgagaaaacagggagctaattggctactagcatacgacgatcacaattgccggtggaccacgccggcagaggcagtgtgctgttgcggtggacaaaggcaaacgcagagggcggtactacgttcgtacgtgcgtcgcctgtgcacggaagtcagcacgtgaaacgtcgatccagcgcatcccacatgcgagcgtgtcagcgctcaggcaacacgaacaacccccggacggatgcacccccacggccccacacacgcacctcttctctgctggtaatcagagtgctttgtcagcagtacacggctacacgctaatattactactgttccaggccatagcaagcgttattgctgcagtgctgctgccagtaaaatgcatcctggtgtacgtacagtaataagctctacggtgtgttgtgtttgttttagcggcatcaagccaacaatggagacgagagatgtggcccggacggatggcgccgtccatgcatgcacccgtaaatcgtggtcccccgtctgcgtcgccgttttttgaggggatcccaggcttttcgagggtaaagtcaacacaaaagcgagcgccttttgcgctcgtaaaacgaatggcttttcgtgtagctaccggtggtggactcgtggggcgcgcgccctgcgcacacgctgaacgctgccctgtgcaacggcgacgcgcggcgcagtcgtctcccccgtcgtctgcgccggcgggcggaactccacgagagagccgagagccgcccggcgcccgcgcgtctcgacccaaactatctaccgtctccgtttctaaatatttaacgcttttaacttttttaaatatatttgaccgtttatcttattaaaaaaatttaagtaattattaattttttatcatttaattcattgttaaatatacttttatatatacatatagttctacatatttcacaaaagtttttaaataagataaacggttaaacatgtgctaaaacgtcaacggtgtgaaatatttagaaacggatggagtatttgtctaggggtgtgtttagttcacgctaaaattggaagtttgattaaaattgaaactatgtgacggaaaaattgaaagtttatgtgtgtaggaaagttttaatgtgatataaaagttagaagtttaaagaaaaagttgaaaactaaaccaggcctagaatttatttattttgttgaatggagagagtatatatgagtcacttcctcctagctcccagcttctgtaccgacttctcatggttagcgttggcatagtgcaggcacgcaggaacaatgatcagtcccagcttgagtaaccaaggcctgagtgcctgttaaacatcaagatgggctgggtcagactgtaccagatgggttgtgttgccgctggcctggatcgccaaatttgaacttcgtcaagagtggtttgatcgacaaaacgttatttatattttataacatgtttagcctgaggggtcatccgtatatcatttgataaagcttctactcttactttattggtgttttttttcgaacaagattttatgataaattttttacctatacaaattcgatttcttagtttacatccaaacacggatgaacgatgaacggatccacagtttgccttagtctctctaaaaaaccaccaccttcacaaaacccgctaaactcatatcttcgtagttgccggagatgaacattagagttggagaaagcattgcgaataatttaaccggatggttcaaaacatgtcaatattcttttgtaagaaaaaagtgtatctttcccattatttcccgtcaaatgacatttatcaaatttgaattcaaatctattatattattaaaggaatagaaaaaaaagccttcaagtttgctttaatggtctagaaatttccacattaataggagaaaaagaaaaaacagagtctatataagaatacaatttaataatagctgaaatttggaattaaaagtaaggaatataggaagctaagattagagtctaaatcggtatacaatagaactaatggaaattcagaattaaaaaaataaaaaaaattaaatgtaaaggttagagtccatctagaaatacaatttagaaataaaaaaaatcgaaattaaaaaaatatattggatgaagaatatagagtccatatagaaatagaatttaaaaataattaaaattcggaattaaaaaaatattgaaagataagtttagaatccatatataaaaatacaatttagaaataatagaaattaggaattaaaataaggaatatcggaataagagtacagaatacatataagattttaaaatttagaataaaactaataaaattaaagtagaatttagagtacaaatagaaatacaatttataaataactaaaattcaaaggaatattggaagtttgctctcataagagcatctccaacagcctctccaaatctaactctccaaacacccatatagccaactctccatttgatttggctagtcaaactagttgttcactccaatagcctctttatctacgctctctactttaactctatgggctagtttggtttgtagcctaaattggccttaccaatttttgtcaatgtcaaattttggcaacttttggcatggctaattttggcaaaagaaaaaattgtgtttggattgaagccaaaatagcctaaattaactgttgaaatggcctatttcttaggcatgccaaaatttggctccaaaccaaatagacaataaacactattgaaattgccaaatattggtaaggccaatataggcctcaaaccaaaccaaccctatgacaccgggacccatatgtcagcctctgccttcttctttctccccttccttcccctcttcctctttttttctcgcgttggctgggagcagacgacgccgacaagctgggaggggacggcggtggaccggtggtgggcgcggcggggagcttgtgccgcacgggtggccgcagcgagcggaggcggcagccgcggcgcgcgggggacagcggccccggcgagccgagacggcgggccgcgccgcgcgtgggacggcggtcgcggtgagcgggggcggcgcctcggcgcgtgggggtgttgacagaaaacacgaggcctaggagatctgcttaactccagtgcatgtccaaaactcgccttcggatgtatgagcgtgccagttgatttgatcctgcaatcaacaagaaataaaacaaaaaaaccgcaattaatcctataaatgatagccgatcagctaggtgccgatgacatatcatttatttcaagccgatgtcatgcgtacatcgatcggcaaatatcaataagcaaatcagaactaaatctactcgatcggctgtaaatattaatgatatataatccttatatcgatatatacttaaatcaagtgattgagatagatcggttgccttgccgagacagtataaatcacttagatcgaaatatatattaatagtgggattatatacatttatagcatagccgatcaaatggatctagcatgtatcggctaatactccgataccactctatattaagatgttaaagcaagtagaatatatcaaacagaagcctaatatatttagatgcgacaaaatcttaacataaagggcagatttaacatatagattaagcatatggaataaaagtagttaaatcagataagatcggctgaaactccgatactaccctgatcggcaaccagaaagcaggctagagattgcagttctaaacacgacttaatagatcaaactcaactgatgtagcattaagtatgaaaagaaaaaacaatatctagacaatcaagccgctggaagttttatagagtggtagatatatcacataatctaagttaacattgttgtctaacctaatcggctgccttccattaacagatgttagtcgattataggttagataaagatattatcgaagattatatgagatatatgataactcgacgaattacatagacaagattagagtatcataaagatggaagcactaatcctaagaacataaatcgtcgcgacaagttttacctcttgttgaagatcgaagccgatgcagctcaacccgaaagcacaaactcgtcgaaataaaagtaaagcaaaaagggtggcgatgcgccgagattgtattgaatgtcctttttttttacatagggctcgggtctatttatacccgagaattacaagatacgtccataacagacacgactattatctctaacaaactctaagataccataagtctctatagcagacttttgcccaaacatatctctaaggaaattacatagaatattctaattaataaatacaattgccttcccaggactctatccatgcgtggcaatcatcttgaagcacatcaacttaaacccgatgacgtacaccgggtcatattatcgaaattggctgtatcggctagccccgtctgactcgaactctgccgatcctgaccttagccgatttggactgcagccgattcttactttgtttccgcaacgatcttcatcttggattccacttcgatctgatcttcatctccgatgccaatagtgatagaatttaccaaatttggtcgttaacagggggacggcggccgcggcgagccgagacagcaggccacgccgcgcgtgggacggcggccgcggcgagcgggggcggcgcgccctacgccgagcgggggccggcggcggcggcgagcagaggcggcgggctacgccaagcggcggccagggctgcggcgcgcgggggccggtggttgcggcgagcggagaacggcgggccgcgccgcgcgggggacggcgaccacggcgagcggaggcggcgggccgcaccgcgtgggggacgacggcggcgagcggaggcctgcagccgcggcgagcggaggtggcgggctacgccgagcggaggatggcggtcgcggcgagcgcctcctcctcgtgcagtcgtgctccttccgtgcctggttgtcgtgtggggatggaggagatgggctgtgtggggcccaccattggccagccaaatggagtggctaaatttggctagtggagggagggttttggccagccggttggagaggctgttggagcacgatttttggctagaatggctaaattttgacttggagaatgggatggagagattgttggagatgctctaagacatgcaaaattatgttgtcattttaatatatttgaataatacattgagaaaatatatatgctattataagagagaaaatatagtaatactagccgtgcaatctacgcgggccactatgctagttactgtgaagtgaacttgcaaggaactgaccatgcatattcgcaaagtgaattattcaaccagatggttcaaaacatgtaaattttcttttgtaataaaaaagtgtaattttttcccatgatttactgtgaaatgatatatatcaaatttaaaattaaattactgtgaaatgcaaggaattgaccatattcctgtgaaattccgtattcactactgccactcggtacatgctcattgcccaggtaagcagataccatgtgatatacggtaaccggagtagatgggttatattgacgatggttcgtggtttattccttctggtgcaagtgcaatgctaaaaggcttcaaagtgcaaacatatcgcagtggtccattaatccttagtacacaaagtcggatccgttgacatggccccccaagaggacaggcttaaacagagtcatctttcttgagctgtggtaggtactaatcaatgaccttccttcatctctgaatagactgtcatatcgtagtttagcaaacgtaaacgacagctccttcaattccagcgataaaaaatgaaccaaacggcggtcaatacatgcggtttcgcatgtttatcgtttttgttgttgcaataatcaggtcaaatatattcacgcttcacttgagagcgactccttaaaaaaaaaactttggtcagtcaaactcacacgatcgtgccaaaggggtactcatctttttttagtgtcaaatcaactttagcaaaccacaacctccccaggggccagggggtggttaaaagggtgttaaacttcccgtgccatgcatgatgcaacctttttacagtcttgtaaacttaacaaagatgaatcaccccctgacatagtagataaagtccatgctactttatgggcagaaagcagcactactcctactatactgtcctactactaaaacctgggtatcaaaaaggacacctagctaaggtaagctaaccactactctcgcagcgttatcatggcagagattgcaccaacatgagaccacctgctctgctttgcatctcccagcaggagccttgctttgcatctcctagcaggagctcggctccagactccagtgcagcactgcagcggctagccgcttgcatatgcagtagacatgcagatcactttacgcgatcacgtcgcatcaaatccgtgctcgatatggcctaaatccgtaaagtaatctgccggcgctgattgctggagtgcgcgaacaagggtcaggtgatggccgaaaagttaaactgcaaatgggcaatttgggctcgaagttaaggagaatctcgcctgagttgagatcgcgctgcacgtgctcgcggtcgcggcctaaaataatttactagtagtaataaaactatacaagtaggagcatgtgcaagacggtcaaattgaaaaatcgatacaaataaccggtcgtagcgcgtgcgtgcgtgcactggcctgtctggtctatcagcttgattttcagtctctgaggtgtgctttaaccacagtataaacgtaaaaggtgtttaaatggtgctgtcaaacagagatggacgaacaataagttttttaaggagtaaagtgaacgcctgatctctaaatttgcatgtgttattaggttaacatattctcaaatataaatttaagatccagaacttatcaaagtgtgtcatcccggtttaaaattgtcacaaccatattggatcctaaatggtgccgaagcctgcaagctagctcgggaagctagcgtccgcaggtgtgtcagcccttcttcatcttctatgggttccacaagtgaaactttggatccgaccctatacttggttgtgtttagttcacactgaagtttggaaatttggttgaaattgaaatgatgtgactaaaaagttatgtgtgtatgaaaggtttgatgtgatggaaagttggaagtttagaaaaaaaaaactttggaactaaacagagccaaaagtcatggcctcacctcggtcaacccgtaggttgaaaaatcgcctcggacctggcttgtaggtggaaaccgcactgaacgaaaaaattgctatcctagtttagtatatgtaatctggcagtaattaaagttttaaatgtaggccgaaaatcaaagttttaaggcttcgttcgtttgttatggttgggaactctcccattggcagaaattacgaagcaattcattagcacgtgattaactaaatattagttagaaaaacttgaaaaatggattaatatgatttttttaaaacagcattcgtatatacatttttttaaaccacaccatttagtagtttgaaaagcgtgcacgcggaaaaagaggggcaggagttgggaacagtaagtaatgaactcagcctaagggcatctacaaccaaagccacccctagagtgtcctcactaactgagggtactctctatgaaactcatctctcaatggagaatacctctagatgggttcttcaaaatctgaggccacttgatggagaaacgccagctcataatgggtgtcccagcccaaggtaccctagtgaaaaaaataccaaccgtacccctcctcttttttctcatttcgcctgctcctctctccgccttgtctcctccgctggctcctctctctgtctcatctcctctgcgaagaaggcgacggcagtcgcgtcgagcgcaaggggtgccaccggcggttcccgtcgccgccacctccctcctcgccctctccagcaatcgtcgtcgactccctcctcttcatccgcaaccccatcttgccgccgtcaccggcctccagtcgaagtggttccggcactggcggtggccgaaggcgacagatcctgcgtcgtcataggcggatctgcgcccccctcccccccatggccagatccggatggagcggcaccggccgcgccacatcgagacattggacaaacacaacaactactactactccatatgcaagcacggggacaagagtagtacgctgctggtgcctggtgatgagcaaatggatcattgaatggagtgttggactgcctcctttaggtggtgattgaattcagtcacttaaagtcacttaactttagtctttatatttaaatactaattaagaatttttaagcctaattaatccacaattagagaatgtttactgtagcatcacataggctaatcatggattaattagactcaatagattcgtctcgcgaattagtccaagattatatctaagattatggatgtgctttattaatagtctacgtttaatatttatatttagtgtccaaacatccgatgtgatagggatttaaaagttttagtcccatctaaatagggtcttaggcctctttgggaaacatggacttgttccaagtccctgtcacatcgaatgtttggacactaatttggagtattaaacatacattaattacaaaacccattccataaccttggactaattcgcgagacgaatcttttgagtctaattacgccatgatttgacaatgtgatgctacagtaaacttttcataattatagattaattaggcttaaaaaattcatctcgcagattagctctcatttatgaaattaatttttttattagtctattaatactccaaattagcgtccaaacatccgatatgatatgtactgaaaaaattttagccccatctaaacacccccttagacaaatgccaatcctataaatgctgcttcaccagtaccaaggttgttaggatcgggataccaggcagtatcgttttgctcaaagtaatatcgcatcgtaggatcgtatcgtagtatcgggatactatgagattttctttttttaagtttaattaatatttatattaattatatatagacattctatataaaaaaatgtagtaatgatatatgtcatacaaatagagacctttatcaagagaaaccatgttggttttgatatatttaactgatttttatataattttgagtatatttatttacattattttcaaaccatgatattttaaataatattttgtagtatcgtagggatcgtagaatcgggataccacctaagattttataggatcgtgtagtaatgaatagtaggatcgagatactatgaaaattaggatactaggtgggatcggtatcgtttcagcttggtaagatcgtagtatcgtagtatcgtaagatactaggatatgaatcgggatactgacaaccttgactagtactagacatttctatgtcacctgcctatgcgatgcgcctcatctacaaaccgcaagggtaatagttcgatgtcaagaaaaaaaaaagagaaaatcccctgtgtactctcgaaagttcacctaatcccttctgtaccccttttgtacccctgaattttgctcaatcccttacatacccctgaattttagtttggatccctttcatgccctttccgctagttgaccgttagttgaccgttaaattcttatgaaaaagtccattttgccctttggtataaagaagcatataaattaatagagtatattgttagagcatataaatttgttatatgagactattatgtttatgagatagttatgcaccatattatttgtgataaatatacttagatatgacataaaaattaatacttatttattagttattaaaagattttttttagcatatgtattctgaagtaataaacaaatctgttgtattactatgaaaacacatatgctacataaaagaacttttaataactaataaataagtatcaactttttatgtcgtatgtaaaagtaaatttgttacaaataatatggtgcatcacatactcataaatataatagtctcatccaataaatttttacattccaacaatatacttcattaatttattatgtttcttcatagcaaaggggcaaaatggactttttcaaaagaatttaacggtcaactagcggaaagggcatggaagggatccaaactaaaattcagaggtgtgtaagtgattgagcaaaattcaggggtatagaagagattagatgaactttcatggatacttaagggattttcttaaaaaaaaggcgcgattattgcatgcgagaacttgacaaaatcgcattctttcttgattctttctctatgggcctaaagttgatagtatatactaatatttagagcgtgtaaatcaatgcattagctctctcacggaaaaaggaagatagtaggccaaaacaacggtctacatgctactagtacatgccttgaactggtactccaggaacattaaaaccatatttacctgatctatgctgcacatcgcaatgagcagcagagacacttccatcgttttgagcttggtgggcaaaatatgggccaatcctcccagccacaagttccgctgtgatttatgaccggagtcggcgcccaccaaccggggtgcgtgcgacctgaccagcaccgcacatcggcagcgaaaacccctccgttttttcttcatctcttcttccatttcgcttctcccaccaccataccaccacgggtcataaccccctcctcctcctctcatccacccaccgtcacctctctccctcctcaacctctgcttggctgtctgcctcctcgcctgtcatctgtccctctcatcagcagcggcgcacgggtcaaaccaagagccgcagcatcgccaccaccattcaccaccgccactcagactctccaatggcggctcctccccctcctcctcgtcaaaaccgcccctctcctctccttgtagcgggtagttgcttgtcgcgagtagggacgaatctgtgctaggggcgagaggtgtgtgcgcgctctagggggcaatggaggggatgtggaggaaggccaagaaggcgctgggcgccggcctctgcgttcgcctccccgccgtcgccggcgactgggaggacggcgtcagcgagcgccgcgcgtcggatgcgctctcccacgacgcgtcttcggcggcggcggcgcatgtgtcggcgccgaatacgccggccgcggcgttgccgggagcaggcccgctccggaggtccaagtccgggaccaagtccgccaaggttaggctcttctccttttctccctcttcttctcattgtgagttatataacctgtgccttggattgtatccgtggtagccttggttcggggtggctggatgtgaaatgcggagcagattggggtttcctccggggttaggcgcggatttggagcaatgtggcttcacccgtgaacgatttagattcagatgtgcttcccctggccgacagtttttggttgcagtaatgggcgtttcctttgtttgtgtctactgtctagcaatttttttttgtatgcatctgtttttttaatactgagttttgtcttgagcctcgcctctgctagtttggatttgtcattacctttgttactttgtctgcaattgaaatcatcctatgttgtttctgaggaaacatgggtcttgcccattttataataaaaaaaccattttgtgtgcagattttgatgattctgcaaactatttattctctaaattattcaaaggaatatccaaaaaagaaaagagatgcatccgtcattggcttcatcttgttgctccattcttcgtgtcatgttccagcaaactatcataccattttgttcttcaccattcagaaaggaatcaatttgtgttttatagcttctttttgggctctgttgtatttatttcatatcttccatagtacaaaaatttgctgcttgtttctttttctcaaatttatacgccaacagagattcttacgaatttctatcagctatcagtctgctggtatttttcccctcggtatcgcgcttcgttatgggttaattcaaataaaaaaacccagttgttttttttttctgtctaagatacattcatatcttaacgtaagcttcttttctactgttccacttgctcgttccggaatgggaaagttcgcttctttcctcagcaactccccatgtgttcacgtgtagtatcatcctgccgtctctctcttactccgttagtactactactacgtactccaactccaattaattttgtaaaggcgtgttttccaactgtagctgtcatccatcactgaaaatttgtatcaccagcctcttattagaattaccttatactgttctttttatatttatctttatttagttgtcatggcatgtgcgtgatctctttgaatggtcaatgtcaatttgtgatgttttctgatacaatactattttttcgtgtggtgttcattgatgccttttattgctgtgttcacaccttttgtttagtagcagttctgatttagcgagatattgtgtatggtagtgccctgtttgaccaactacttcacgaggatttcctcattactcattactcaattggttgacatttatctgccttggtcagaagtgaagacttgaaaagttctgataataagcatcgcacagttatttattgtgatttccgcattactgcctttgctaagcttgatttgtctatattatcaaatttgacaatttggtaaactggcatgaacgcttactgtgtttagttgaatatattgacacgcatgcaagtctgacaattctttgtggtttctctggtttaaaatgattttatttgtcaaggtaatgccgcgaaatgcaacatatattgggtgcccaaatgcaaaatatgtatttcttttaagttatcagtaaggaaaccgtaaaatcaggtgtgctgtttccattggtatttatgacgtgcatacgttatcataaaatataaaatacagttgtggttgctgacttggtgttagtcaaaagatgtatttgtttgaacatgctttggtttttatgttttagtcaaaatcaataacagtacctatcttaggtcctgtttagattccaacttttttcttcaaacttccaacttctccgtcacattgaacttttctacacacacaaacttccaacttttctgtcacatcgtttcaatttctccaaacttccaattttggcgtggaactaaacacagccttagcttatgatggcaccaatgaactaatagatccaacaccttgtatgtcacaaaaaaagatggaatggatgtgatatgacatcaattcatttagttctggtatgtgtttgtgatatatttttgtttagctttcatgtgaggccctattcgagttgccatattgatccaatgaaaataaatcaagaaagtagtaactttagtccatgaattgcagtttgtgtctatccgactatgtttcagaaataacaaacaaatatattgttcgacgtggatacactttgatgaagaattgggatgaaaaataagtctggataatggtaatttaaggtgggcctaagtaaatttgttgaacatgcagattagtggagatatctatgcagatcttggagttgattcagaatttgagatcggcttctgtcatagtatggcaaactctaggcagggcttaattctgtacagtggaattgatctgtgaagataaggacttaaataggggtgtacggggtgtggatatcaggacaaagggttgttgttatatgccagtctgttcactatgttggatgtaacatacaaaaagttttgttctcaataaagtatcattaatatcagttgaaccgtcttttcgcagcaaggctcatctttaagcccttatgtttcatgttttaaaacacatgtctccatgttgattgcacatttcaaatgtgaaggggtgagttctgatgttgcacaattaaattgatacatctttctttttttctctcaacagggaatgtgcgcaatatgtttcgatcccatgaagtcaggccatggacaagcacttttcactgctgaatgttctcacatgtttcacttccactgcatctcctccagtgtgaaacatggaaattatgtatgcccagtttgtcgagcgaagtggaaagagataccctttaaccgctcgttatcttctattgtacctcgtggtagaagtgggttgaatgtgaatcaagctcgattaccccaacaaggcacctacatggctcttctacgccaggttccaagtcaccatcgagaagcttctggttcccatacttctgagccagttgatttcaatgacgatgaacctttgcagctgatagagtctggtgacagtcgtgatgctagatgcagtagagctgtggagatcaagacatatcctgaattctcagccattccacagtcgtcatctgaagatgattttgctgttttgatccatctaaaagccccttgtgctaacccagaacaagtcacaggcagaccattcaatgccacctcaattggataccctacatctcgcgctcctgttgatctggttactgtgcttgatgttagtggcagtatggcaggcaccaaactagcactcctaaaacgagccatgggttttgttattcaacaccttgggccttcggatcgcctttcagttattgctttctcatctactgccagaaggttgtttcatctccgacggatgtctcactctggcaggcagcaagccttgcaggctgtcaacttgcttggtgctggtggtggtacgaacattgctgatgcattgaagaaagctgccaaggttattgaggatcgcaattataagaatccagtctgcagcattattctgttatcagatggtcaagacacatacaatatttcctcaaatgttaggggaacccgtccagattataggtcacttgttccatcttccattctgaatcatactatctgcacagtgcctgtccatggctttggttttggtgcagatcatgattcagatgctctgcactcaattgctgagtcctctggtggtacattttcctttatcgaggatgaaagtgtgattcaggatgcatttgctcagtgcattggtgggcttcttagtgttgttgttcaggatatgcgactaactgtggaatgcgtgcatcctagtgttcagcttcatactatcaaatctggtagttacttgagtaaggtggctggagatggacgaaatggatcaattgaagttggtcatctttatgctgatgaggagagggacttcttactatctttgagcttcccacaatctcgtgatcagaccatgcttttgaaggttgcatgtgcctatagagattcagtaacgaatgaagccatcaagattcatgcagatgaggtaaaaatcctaaggccaaagtcacctacgtctgagccagtttgcatggaggttgatcgtgagaggaaccgtgtccgtgctgctgatgctattgaggctgcaagggcagcagctgagaggggtgctctttctgatgcagtggctattcttgagcattgtcggaggatactctcggaatctttttcaagaaagagtggggatcgcctgtgcatttcccttgatgcagagctaaaggagatgcaggataggatggctagccggcaacgatatgaagcttcggggagggcatatctgctatctggattgagctcacattcttggcagagagctacaacgcgtggtgactctacagacagtaccacacttgtttactcctatcaaacaccatccatggttcagatgctgcagcgctcacagaaccaatgcccttcacctccgggcctgaggccgcagctccgacaaactaggtcactcttggagaaaccccatccaaggtagaaggcagtttgccattgtctcttgcgaagcaagtgcaaagatgatggtgtagaaatttcattggtgtcattgcttagtaggtcagtagtgcagtagcttagcattcatcctttgttcttctgttcaagtcaaggatggcggtataccggaaatggggaggtgagcttggaggtaaatatgtttttgggggtatactggagaaagtgaatgggggcttggtggtaaatacattgtgaagggggcctgggaagaaatagtagagaactggagcagtggtgtaattgctacaaggagtaagattgtgtaggttggtaatttagattgtcaggatgtttctaattgatgaacctcttttcattttgccttttggtgatgtaaagggtctggtatgggggaggtataccatagaatcttggggaattttgatttggggtggcaatgtaattccatggatttcttgtttttattcaccagttattaattgctggtgttctgctgtcgccttgccgtgaattgcaagtattatccactacatgcacgtccttacttttccgaattgtaagtattatccagttcattcatgcccttgtctttcagggtcatatatgctgatataatctttcttgtgccttattacacaaaccgcacatgagtacacacacctttaagatatgctcataagaagcaaaccccctaacctcacaaaatcaatattgactaaattcatattgaaagtgaatagactaaatttagggggtgtttagaactatgggtgtaaagttttggcgtgttacatcaaatattatatagggtatcgcatagggtatttgggcactaataaaaaaataaatacagaatccgtcagtaaatcacgagacgaatttattaagcctaattaatatgtcattagcaaatctttactgcatcaccatattgttaaatcatggagtaattaggcttaaaagattcgtctcataaattagtctcaatatgtaaaattagttatttttttggcctatatttaatacttcatgccagtattcaaacgttcgatgtgataggatgaaaaattttagggtgtgatataaatagggccttatattgaaaatgtataagcgatattgataggttgtgtgaagttatacttttatgattttaccgccagtgtaattacatgtgaaagtttttagagattttttatgtcgaaagttgtacttccaaacgaatttgctatactactatagtaatttagggaagaaactcgatatagatatttcggggaaccgtgggatacacttttaagggaaacatattcgctttttcgaccatgggatacactttaagggaaacatatcctctaactttgtgcagtctgtagttgtaacactgattatatgggccctactttgttatggcccacatgtcagtgatacaattgcacactacataaagttaggggagtcttttttacttttaagattcatgcacaggatagagagcaaaaattaaacactccatgcaaggtgctagagtcaaacccacaacatgccaacgacatgctcgcgctatccaccaccaagctacgtggttttagttataatgcaattacatagtacttatactttagttacacatttgttacaatgtacctatattagttttatattgtaattatatcttaataaagtttttaggaacttctcaatggaaagttacatgggtagttcctttataaaatctctctcatgaatccactattacgaatgattacttgaattttgagagatcacttgatcattaacaccaggatgccagatgcgtcaagaaaaaaaaacactttcaatcgtcaacatcaataaaaactgaatgcatatggatcactgactcattgtcattgtcaaataaaaacagatgaaattcattaaaaaacgaaatccttatgatgctgttacaattgatttcctcccaaaaaaaaaaaaacaacctagattagcaacctgactaccacctgaggagcctcctccctggctgcaatacctgatacagcggatacggcacgtctgggctgtcgggaaaggtcgggaaatccgtcgtcacgccgcaccgcggcgagaactccccgctgcccacgcgatgcttgcactcgatcaccgtctgcatgcacgacctgcagtacctcgccggcgtcgtcagggtcacgtccaccgccgcgtccccgcggcggagctcctcggcgaggcgctcccgcgcgaactctgggacggcgttcgcgtggccccacgccatcacggacctcgcctccgtggtgttctcgttcctcccgcagagctccggcgcgggcccgctcgccagctggacgccgcggtaggacacggccgccgtcgtgccgcgctcgacgcacgccacgctgtacctgcgcggctccttgatgcggacggtgaggtcgaacgtggggtccagcgtgggccgcccgaggtcgcggtccgggtcgagcccgctgacgccggcgacggcgacgctgaactccgcggacttgccgtcgtcgaaggaccacttgtagggatagtagagcaacgctgacatgagcaccagcgccgtgagggcgccgaggatcccctgaaggatattccagcagaaccccttcatcatcacgccgcagtcttccatcgtaagaatcaacgagccgctcgcataagtactcccgcgagcgccccatgtcgacgatttcgtaggtttctctccgtacgcgatctaagcaacagtagaagaaaggcggttttgctaaatatttatcgggtgatttttttcatagtatttgacgtttttctcgccgcacgatgttttccaagatttgtgcaaaaccacggtcagttgattccatgaccgagtcaacctgactttgtatcgatggattcctatacatcacgcatgttagtagccatttatttcttctctctatttctttctttctttttctagttacaaaaaagtttacagtgcacttatactaaaattacagtctacttacatgccatatctactatttttccaaatataattttaattataaagcactgtaattttagttataaatgtaacatttaacacttcagatatctgcatggtttctcaaacaatgtatttgtactaaaacgacaaatattccagttaccaaaatttatagcgcacttgtactaaaacaatgcacttacatgccatatctactatttttacaaatgtaattttagttataaagcactgtaattttagttataaatgcaacatttaacacttcagatatctgcacggtttctcaagcaatgtatttatactaaaacgacaaatattctagttaccaaaatttacagtgcacttgtactaaaacaatgcacttacatgccatatctattgtttttacaaatgtaattttagttataaatgcaacatttaacacttcagatatctgcatggtttctcaagcaatgtatttatactaaaacgacaaatattctagttaccaaaatttacagtgcacttgtactaaaattatagtgcacttacatgccatatctactgtttttacaaatgtaattttagttataaaacaccgtaattttagttataaatgcaactactctactaacgagcacaatcacaggctacatggacggtttctctgtactgttaatttttttttaccgttagatgcagatttgaggggaggaaaaatttgagtgattttttctcaaaaatcacacgacagatgcctagacagtcccgaagaaaggcgttatgacttagcgtccgccgtatcaaggcgtcagttatatacaggtcgcagttggaagattaatccaaggagtaatcagattgggagtttgatttacagatgagttcggcaatgatacgggagataatttgatttctattcgaatgtttcgcgttgatgcgttgtagaattctgcgtttgccgcggccgattacaattgcaaactccatggatgtccacgagtacgtgctggtaacaattgacacgacgtcacgtcaagcgtagaagcccaaatctggagaggaggccatgggtgcgttcccggagcaagaacagccacctctccttggtcgacgcagctcctttcgaccggaggaagaagaagaagacgatgagtacacggatgccttcggtgtatgcttcggcctgtttctggccatcttcgcgatcatgctggtcgtcctctgcatccgccggcccgacacggacgggatggcggcgagcccgcccgactacttcgtcgcgatcaacgccgtctcgggcgtcgacccgtccacggacctcggccggccggcgctcgacccggtgttcagcctgaccgtccgcgtcgcctcgcggagctccacccgcggggcgtgcgtcagggccggcacgtcggtgctggtgtcctaccgcggcgtcccgctggccggcgggcgcgcgccggcggacccggagctctgcgcggggccgatgggcgcggcggaggacggctccgtcgtcgcgcgggggagcggggcgcgcgtgccggggacacagctggacgccctcgcggaggacatgcggcgcggcgaggcgctgttcgaggtgacgctcgcgatgccgtactacgggcagcggaaggtggcgtcgtgctgggacagggtcggcgacgccgcggcgctccgggtgccgtgcgacgtgtccctggtggacccgcgccgccttgccggaatcactggcttcagcgatctacctagtgccgtgtaaaacgacatattcgctgggaactctaaccacttttgagtctctcgtggtttacatgtaatttaaataatttttaaaaattattaaaatatcaataatatatatgataaatcactccattttagtctgtctttttattttttaaaactttttttcaaccattttaattataagcaaaaaatacaaacaatgagaagatggttccttcagagtttataatccaatcacgagatcaacacaacagcaaccactcccacatgtgttgagttgtaactttccgtagtttctagagtagtgatcactcgtgtcctcaggatgtatctgatttggtactttcttggttttctttaaaatctctatgtgtaaggactttgggggactgattttcccccaattattttttcacactttatctaacgttcgtatagagatttggttttatggacgcattctccgtagattgtatttgaattatgttgtgcatatttgtcaagctcccaaggatatatctgttctaaaatatactcatcacctaatagggttcaacatttgtactaaaatataataacctttacacctattctcatcttgaaaaaactaatcggcacatatgcgcttgataagttataagttgctggcgtacgctcagcccaagccggcccacatgcttctcttttctccatacacggtcgcacttccattaattttgacaatttgaccctttgcaaaaaaactaattttacaaatgaaccgtcgccaaaactaatttaaaaaataaccttttgttcagcgccaaatcgtgtggcgctgaaattagacacttcagcgccaaatagcgtggcgctgaatgtacgttggcacgttgactcagccttccatctacggtggcacggcattcagcgccaggtgatgtggcgctga

SEQ ID NO: 60021 - DNA, 67165 bp, Oryza sativa
ggcggcgtacccgcgctggcgggcagccggtgaccgagtccgggcggcggcggcggctggcgcgtcgggccgcgcggagggaggacgggcggcggcgaatgggagggcggctggagccggcgggccgcgcggatgggagggcagcggcgtggcgcgcggcagccggccggcggcaactcaatttttttttcttaagaatttgtgatggatctgagaatttttagaagttgtgattcattggatatgtgatgtataatctgtgatgtatttcttgatgtattgtttcttgagaatttgtgatgtgaatctatgtttgtgatgatactttgattttgatttggggatacagggagcaacttgatttggttgatttggaagagatttgtgcagttccaactcgatttgggagaaaataataaaaaaaacagtggccggtactagcgctggcatcactatctttaatcccggttgttatcaccaaccgggagtaaagatagatttttagtcccggttatttcacccgggactaaagatgagtatctttagtcccagattgctactcccggttgcaaaaccgggagtataggggggttaccaaccgggaggaaaaacactttctccactagtgtgctgccgaacgccgtatgcgagatcacgtcggcggtcagctcctggaacttctgcccgacctccacctgcacccgccgctcgccggcggcggcacgcgcctcccacgcccgaatcacctcccgcgcgcactccgccatcgtcttggccatcatcttgagcttgtccatggcgaacgccgggtgcacgacgcggcggtgccgcacccagtcgtcgccgttgacgaaggcgaggccgttgccgatcagcgccagaaagctcggcccgggctccggtttgccgtacagccccgtccggtcggacaggatctgcttcaccatggcttagtcgccgacgcagagcgcgggcgtggcgccgctccacgagacgaacaccttgccgtagcgccacatccacgcgcggtagtgcggcagcacgcgcgggacgatgtcgtggcagcgcaggtcgagcacgtcgccgcgcgcatcgcgttcgcctcggcgtcgctgccgacgaagagccggtacgccggcccgcggatccccctgccggccgaacgccctcgccacggcgtacggcctccacaccagctgcaccagcgccgtccacagccacgtcaagaccaccagaagtccagaaccaccgcggcggcgacggcgacggccggccccgtcgatgactcaacgatcgccatgcttggagcgagctggcttgtgtggcgacgtggcgtgatgaccaaattatcggaagtttatacagggcctgttcactttgatgccatttccaaccttaccaaattttgataaaattgccaaaaaagtggctacatttagtttgctgccaaaatttgataactatataagaaatcttatcaaaattttggcataattgccaaaatttggcattaccaaaatttggtaaggttttttttgcaatggattctcatgtcctgaagtattactgtaaccttgttttgattcttgaacttgaccaagcaccagtcttcctctaaatcatttggctagtaaagtaatttgccttcttcacattcaatttacaaaaaagttaagggcctaaacagaaaatcacaaaggcacagagtgcagaacagatagaccgatctgaaataacatacaagtggaccaaaacaagaaatggcagcatgccacgcgccattcaacgcgccacccaaccggaaacaaccatcacagtgaccggcatccaaaccccaaatgcatgaactaattaccaatcaaccggcctaattaagcaggcaaccggcgcaccggcaacgcataaacatgcaagttaggccgaggagcagagaacagtaaacggagacgtgtaagacagtcagatagaaaaaaaaatcatgagaaaaatggtgagattaggggagttactgattgatgatatccatagtgtttttggtggtcatgtacaattttacttctgaattttattttgtggagcagtataaaattagcacaatagaatgaacaattatctgtattacattttttttaaaaaaaaatccatgctattaggcaattagagccgacgggaacccaaaattaaaccatgaaattggcttggagttgagccagaggatgagaggagtgctgctgctggactaaggtataagctttattcaagtttcaaagcacatgaattcatctctgtctcgggataggcgctacgactcgttcaagacgtggtccgggaagcttgagcggcaactcacccatctggctagcgccggggacggaggtccctgaggaggaggaggacggttgcgacggcgatgccatccgcagccaccacatcaagtccatgcctcaggttgatcgcttcttcgccgcactggagggccctaaactggacaaactccgggtaagtttcttgagctaattcttccggaactacacatcgatctatgtgctttgatttgctggaacactggagagagctcatggtgtgtgttgtgtcgcatcagtcatcggaggagctggtgcttctgtcggacaaaacgtggccattcctgctctgttcccggtgtcggcgttcggtatctgcctcggcatgagcagccaggagatcctgtggaagacagtggcgacgtcaacgccgatgagattccttcacatcactaccaaggtgaaccaggtgctctggtgcgctttctgtcgcgctcatgtgcgtcaccgcggccatctacgctagcaaggtggtcttcttcttcaaggccatccgccgatggcacggtcataccaatttcgaccgttaatattgtccatttaatgaagactagctatgcttgcaatgcataattttcaaataaaatatatacttccactatgtcctatgctactaacatatatgcaggagaagcacacataaatagaggagaattgatggaacataaatgaacaattaatcggaagccgtcgagaggtagacttatggatggttgggcctctaaacccagtaaaataatatcaattgggctcaaccattacaactactgggctgaggaatcaatgaggagtggaataagttcattcgaggtcccttaacttgtcaacgaatccgatatttgtccttcaaccagaaaaccagatacaacgcgtccctcaactgtcaaaaccaatgccgatgaggtccttcggaggttttgatggcagttttcgctgacgtggtgcctgggtggctattttgacttggtcttcacatgacgtggcgcttacgttgcaattcaaaataataaacttcatgggacacacatgtgacatcccggcccagagcttaataggattaatagaatactcatatcaacaagttgcaacttcttttccggaagccgatttccaaagaattccaggttaagcgtgcttggtctggaacaatttgggatgggtggcagaccgggaaattattcctgggtgcgcaagagtgacaaagtgtgcagaaaagacttgtgttggtctgtgagggcagtctatgacctgtgaaagctgccagatgtaagcgtgcccggcctgggagaggcgggacgttacaaagtggtatcagagccgactctcgcggtttcacaggcgcgtgtgtcgcagttgcgcaggcatggtgcacatgtctggtgtggacctggagtggtcacacagcatggcacatgcgctggcactggacacacggacgtgcgttcctggcctggggttgaccgacgtgcgcatggctggtgtggacccactcctgtcgcagttgcgcaggcatggtgcgcatggctggtgtggacccggagtggtcacaaagcatggcacatgcgctggcactggacacacggacgtggccaagaggggacgttcctggcctggggttgaccgacgtgcgcatggctggtgtggacccggagtggtcacacagcatggcacatgcactggcactgacacacggacgtggctaagaggggacgttcctggcctggggttgaccgacgaggacgtcggtgtcttaagggggtgagcattgtgacatcccggcccagggcttaataggattaatagaatactcatatcaacaagttgcaacttcttttccggaagccgatttctaaagaactccaggttaagcgtgcttggcctggagcaatttaggatgggtggccgaccgggaaattcttcctgggtgtgaaagctgccagatgtaagcgtgcccggcctgggagaagcgggacataaataaataaaaaatgatgggcccacatcttcctcctctctctccccaactcagtttcacataaataaataaaaaatgatgggcccacatgccagctcaataaaaaatgatgggcccacatgccagctcttcttcctcctctctccccaactctacaggtctatcgcagagaatacatcacgatccgcccttctcgccaccgcgagcttcttccgctgggggcactgcggcgcgaggagtcttgatacgggcacgaagtacggcatcaccgcaccgcgctcgccgtccccggccatagcacggatccgaaatttccgagaggaggaggcatggtgagtttgcaggcgacgcgtggtggccgggggcacgagctcccgttcatcgtcttcacgccgacggtcttgctcgccgagccccgacggcacctggagcaagccgctagccaacctccgccatcgtctcgtggttctgccgccggccatggcgccctcgactcctccgcaccctccaccggccgaccgtcgacctgcgctcgccgccgaccacctcctcgactccgccgcccgccacgacgcagccgaggggtaccgagctcgtctccacctccgctggcccggcgccctcaccgggatgcgagggacgagctccctacgccgcctctcgtcgtccgtcttgctgcgccggcgccgatgccctccatcggcatctcccgtcgacccgattccccaagtcccgctgttctctcattcactcctcattctgtgtctgctcacatgtggccggcgacctcctcctccggccacctccgccgcacgcggcctaccgccgccgctccactctgccccgcctcgcccggccgccgcgcgccgcctccctcctcgctcggtggagaggacagaggagaagggagaaaaatgaatacagggagttggggagagagaggaggaagaagaggaggatgagaatgacatgtggggtctacgtgggtcgtaccatctttatttttttagatgacatgtgggcccacgtgggccccaccatttttttattaatttatgtgtaaactaacatgtgggtcccatgaagtttattatttttctggatgaattgccacgtaagcgccacattaatggcacatgatgcgaagacgagtcaaaatagcgacatatgcgccacgtcagcgaaaaccgacgtcaaaactgccgagagacctcatctgcactggttttgacagttgaaggacccattgcatctagtttttcggttgaagggcgtagtccgacatcaagcaaacaaaagataaggattatactagttcaggccccttatcaggtaatagccctagtccaggttatatgggatttatgatgatgagaatagattacaaagagagtagtcgaatcagatgataccggtgagatcgtagtcgagggatttgacgagatctcccgacgagttggctccacgtactccggcttcgtaatatatggtgggtgtgttggcgattgaattggatgcctttcacccctccccaggggtcccttttataccgtggagggtgagcgagggcctaagcggcgatagaggatgtgcaggagatttcaagtagacgatacaacaggacctccgtccctcaccactggcaaccccactgacctccatccttcgctcgccaccgccgcaccgacactcccctccctccacgtctcctgcgggtccaactgcctctccctgccactttttcctcgccttcgtacttggctccggcctcaccgtttccttctctcttgtcctcaagctgtcgttgggtgactccgccaacagaggagacagctcggcgccgacgatgtcgaccccgtcgtggccattcgaaggtgacaatgaggagcgtcatcccggtgcggggtgacacgcgatggtaaggagagagaagggatgagaggaggaagatgaggacatgtatgacccacatgccaatgacccccacaatattttctgtgaatgacagatgggtcccacgtacttttttgccttttgttttattataatgccacaaaagcgccatgtcgatgtcacgtgggatagagaccaagtcaacaacgccacgtaggcgccacgtgagccaaaatcgcttcctaaaccacccagagacatagtttccatcggttttgatagttggaggggtcgatatacccggttttgtggttggaggacatgatattatactcaggcgatcgttgagggagtcaaaatgaactttttacgattgtttatacatatacagcccctttacagagacagcccaaatagcggcccattgtgaccctttttgtcaaggtttgtgaaaagcggcccattgatcctcagtaaacagagcccctttcgcgagagctcctctgaaatatcggctgtgttcggcacagcactttcccagcgcgctacagtgttttgccccgagcacgctttttaaactactacacggtgtacttttttacaaaaagtttctatacaaaagttgcttaaaaaaattaaattaatccatttttttaaaaaaattagctaatatttaattaatcacgtgttaattaactattccgttttccgtgttactgtagcgcgctgggaaaacgtcgaaacgaacacagccggtccgtccagacctagaaaccatctgtccctcaatcccgcgacgccgccgccgttctgctccggtgctagggcttgggagctgagctccaccctgccccctccattctccagctcgcctcaggtcagtaccctgcagatccgcttgatcttaaccctcttttcattgatcaaaagctaatttattatcctatttctcatcgcctttgtttgttattcttctcttgtttgtttggcttttgtgaagccatcccttccttccgtctttaaaggcatcgctgccgggcggctgttagctgaatcgatcgcaaggaaagacaaaggaggagagttcagtcgacttgggatcgagtagaatcgccggcttctgctgctattgcggtactcttccttccttgaatgtcgtttacttctccaggtgcatagcatagcttttttttttttttttggggggggacggagaccgacgagattaattgttgtttctgttttgaagctgaccattatatccaatcccaatccaatcgacgatgggcctctctcgtcggtttctgaacctgatcgtggacaaccgcatccctggagccaaatcgctgcgctgcatcgacctcaccctcgcgcgctacaagttgttcaacactacaacacctgctgcactgacactgaatgggaaaataaacggattgaagaaaaggatggagaagatttgtcttcccagcccaatcttcaacttgggagcaccaggcgaacggatacacatgttccctgctttggagcgcagggctttctctttggaccagtcggggcgtggcctccttctggaggcagacacatcccgtctggtggtgatgccaaatctccacaagcccaagttggaacccattgccctctacatccccggcgctgagatagatctggatgaccttgatggcggcggtggcggtactctttttatcatggatagaattgcgaaaccacaggaggctgactatttgttcgaggctttggtgtaccgcatgttctgttccagctacttatcaaagtcctgggactgccaactcctcccaccaccgccgccatacgtcgtcaaatgtggcgttgactttctaaagatcatctcatatggtttggttaaaggtggctctgagatctgcatatccatcgacggggttggtacttattgctttgacactgtgaaacacacttggattgaagtgggcaagtggatgctacccttccaaggcaagtttgagtatgtccacgagctcaagctctggtttggcttcactcccaacgatggccactttgctgttgctgacctctctgccatggacgagtacctgcaaccacagatacgccactgctggaacgaacttgatgagtcactcatccaaggatggaagcagatacgggaccctcagcttgtcaacctggggtctgccaagttctgcattgcaaggttctttcacactggtgactttggcgatggattgagtggccagaatgtttctgtcctgactggtgtagagtttacccatgccaatgttgaccatgagaatattggattgatcaagcacaaatcgagatgtcacaagtctagctgcggtgaggagaccatcacggcagttttctgattaatttaagggctgactccccatcctttgaataattttctgtctctctctttaagagaacttgtgtctcgtcctaattttactttagcataataaaaatgatacttcctccgtttcataatgtaagactttctagcattgtccacatttatatatatgctaatgaatctaagcacacatatatgtttagatttattgacatctatatgaatacaggtaatgctagaaagtcttacattatgaaacagaggttatgaaacagaggtagtaccttcgttgtccgcatgttgtaattgtctcctgcacttaagtaactgtaccatttactactactagtaactactataaacttactcttaatttatgtgttgtctactgcaatggtaaaattcgtttcaaatgctttcttggttttggttggagcggaaaccaagaaggaatggtaatcttgtgtgcttcctctgtcccaaaataagttaaccgtgcgggacttttccagaggaagagaggatgatacgtgatgcggtgtatattccttttctgaaaaaagtctaagttatactacggttaatttcaactttttcatattctatcttgatcttaaaaaatatatttggaaattatcgtgacctcagttttcatcttctttcatagactttgattttctaaagaaaattggtttcttaattctaaagatgccagtacgtcactgttcattttgtagttaactctggtacatgtttatgtgaaattttgattattcagcagttgaaaggaatggaggattgctttgtgatttataatcacctgtgctgctacttgtgctgcagtcaatagtctgatgggaaaaatggaattgaaccactgcaagtgcaagatatactgaaatcaaatcagtgggtaaagtctgacaagttatctgctgcactgaaatctcctcatgcgtttgtgagcaaggtatccagtagcattattatctctgtatattttcagagtatatattagttgcaacagatagtcgtcacatatataatctatagatggccataaggctcgcccggcacggcccggcctaggatcgggctaggcacggcccaccagcgatcgggctggaacggctcagtcggcacttcgtgttgggccgtgctggcccatgggctgcacctccggcctaggcatggcctactagcaatcgggccatgcagtgctagcctgaaggcacgggtggtccatcgtgccttctttgaaataagtctatttctcctctctcctctttgggctgtgacatatatgtagctaaaataagtctattttatgtccctattctttgggccttgttatataatacgtctatttttgctccctcgtgccctacatatggttgaaattaagtctgttatgcatccccacactctcgtacagggcctagtcgtgctgggccggcccagtgtgtcggtggggaagcccaggcacggctcggcggtaaggccgtgccgtgcttgggctaggccaaaatgccgtgccttgggccgggccatcgagcctcgggtctatggctatctataataggaaaaagtacaccgaaggtccctcaacttgtcatcgacttacaaaatcgtcctccaattgcaaaaccagatatatgacatccctcaacttacaaaactgttcactttaggtccttccgtggttttaaccccggttttgtccgatgggacagctgagtcagcgtgggacctatgtgggctccacatgtcagggtgtccaactcagcaccttctctctttcccctcttctctacctttctccttcactttcctttcctctctcgtgtctccgacgagcaatccggcgaggtgtgccatgaactcggtgttggtaacgcacgcagcgaggtgcggcggtgtccgccgggagaatgccgggattgtgccgacaagggtcgggttcaggcagacgcatcgcggcggctgcaacggcggcggcaggagggacgacttgagcgcagctggagtcgctggataggttcaattgggcggggtatagagccgtcgtcgacatggcccgcgacgaggggctcagcctccgcgtcacgctccactctggcgaccccgacatcctcttcaccgactgctccagcggccgtgactgccacttcttcgccgtcgacgagctccccgttatccacggcaaggcgccgctcgactgctacgacgccttcttcctgttaacgatgaaatttggtaagtccaaagtcatcatcagctgaaagtcactatcggcttccgagttctagaagcagccgatgggagttgtcaagtcgccatgctatcatgttcttagtggagtcgaatcaattgaaggaagcttatctagaagagtccgatttcaagaaggatgcggcgtggcagtttatctattaattaggaatagtttgttagtttccttttatctttaggaaagtgtgtttagtgtccgataagtactttatgttttccttttatctttaggaaagtttctttcttgtccgacaaggacttgtatcaacccatgggtataaatatgtacacccagggtctatgcaatcaatctctcgatcaatacaactactctcggcgcatcgctaccctatttaccgaggttttacttatcttccggcggaatttgggcacctgacgcggggctgcatcggctttcgatctccggcgaaggggtaagtcctacgttccgtcggaccctggtgaatctgtcatctacgtcggcgtcgctcaaggctacatcgcttcgatctcttggatcactctggtttggttgattgatttgcctacctgatatctcaattctatctctaattgcattgtgtttagagacgcatcggtttagttggaactgtctcggttaggtctgatcttctatcttagccgatatatctctacaatcgcaatgctgttctaaatagatttgttatatccatcacattagacagatctatcggcttatcgagtattagattatcatatacaatctcgtgctgcatcggttaggttcgacctactagattgttgttgataatataagtcttgctaagctgataggttcatgctaatgttttatcggagtgttagccgataagttatctgcacgttgcatcggcttagaaggattacatatacatattagttggatttagccgatgacaacaaaggtttcactgtttaatctaatctgtggattttatggcatcggacctccagccgatgtatattttaaacttctgatcagtgcttattctatcatatcattgctagccgattgttttctattggattacgttattgtatattatattattgacagccgattgcctttatatcattatctacattagacatatagccgattgcttaaaccctatcgctatcggttggtacatcggctattatcggctatcggctgggattgctccatcggctgtttagccgatcagttgtttgatctactgtttacatatcttgtcagttgcaaggtcaaactgactggcacacccgcatctcattaagttttggacctgcacaggagctaagcagatctcctagaccggtgtgttcgattttttcgtcaacacttccgtagcttcgccgacgcgttccaggacctctccgactccaccatccgtacgtcgttgattgtgaacaccttcacgccatggatgcgcgtgtgcatgctcggtgacgacaagaagcattacaacatcgacgccggcgccatcaacaagtttgtctttcattttgtcctccacccactctgattcaggacaaaatgttgtaactgaagtgtgctagaactaaaacaaaagggacaaaagggattgttgacgagcaagcacacgaacaaacgctcagcatctcactctgcatcaaattatgagcataaaatcctgcagcttgtgagatcgtgagatctagatttttgaattggacagtaggtggctcttgtcggtgaagcacgctgaatcccacattcccagcaggcatagagttcagctttcacgtggagtatcaccgggcagtcctcgagagtgtgcttggatgtcctatgcacaggacaccaagatctcggttttagggtggtcgttcttgtcggctctgattttttgtttagaggacaaaattcggccgcttgaggattcctcctgggtattggggccgtcgatgttccattctccacttgagtgggaggaattatcggcggtgcgtcgtttctcggagtcgtaaccgtgcctttctcgttcccgataattattgggccagtcgagatcggcgtgatggtgtagaccggaaagaaaatggatctgacttgagtccacaccagcgatgtcgaggtagaggctccttgatcgacgccggtgttgatactgctgtcaggaagtcttgaagtcatactggtagatccttgagcaccaagtcctcctacctggcgtgccactgtcgacaagcgatacttgtggaccggatgagttgagtattggggtatgttggaacgagggtctacgtagtacgacatcaagcaaacaaaagataaggattatactagttcaggcccccttatcaggtaatagccctagtccaggttatatgggatttatgatgatgagaataggttacaaagagagtagtcgaatcagatgataccggtgagatcgtagtcgagggatttgacgagatctcccgacgagttggctccacgtacttcggcttcgtaatatatggtgggtgtgttggcgattgaattggatgcctttcacccctccccaggggtcccttttataccgtggagggtgagcgagggcctgagcggcgatagaggatgtgcaggagatttcaagtagacgatacaacaggacctccgtccctcaccattggcaaccccactgacctccatccttcgctcgccaccgccgcaccgacactcccctccctccatgtttcctgcgggcccaactgcctctccctgccactttttcctcgccttcgtacttggctccggcctcaccgtttccttctctcttgtcctcaagctgtcgttgggtgactccgccaacagaggagacagctcggcgccgacgatgtcgaccccgtcgtggccattcgaaggtgacaatgaggagcgtcatcccggtgcggggtgacacgcgatggtaaggagagagaagggatgagaggaggaagatgaggacatgtatgacccacatgccaatgacccccacaatattttctgtgaatgacagatgggtcccacgtacttttttgccttttgttttattataatgccacaaaagcgccatgtcgatgtcacgtgggatagagaccaagtcaacaacgccacgtaggcgccacgtgagccaaaatcgcttcctaaaccacccagagacatagtttccatcggttttgatagttggaggggtcgatatacccggttttgtggttggaggacatgatattatactcaggcgatcgttgagggagtcaaaatgaactttttacgattgtttatacatatacagcccctttacagagacagcccaaatagcggcccattgtgaccctttttgtcaaggtttgtgaaaagcggcccattgatcctcagtaaacagagcccctttcgcgagagctcctctgaaatatcggctgtgttcggcacagcactttcccagcgcgctacagtgttttgccccgagcacgctttttaaactactacacggtgtacttttttacaaaaagtttctatacaaaagttgcttaaaaaaattaaattaatccatttttttaaaaaaattagctaatatttaattaatcacgtgttaattaactattccgttttccgtgttactgtagcgcgctgggaaaacgtcgaaacgaacacagccggtccgtccagacctagaaaccatctgtccctcaatcccgcgacgccgccgccgttctgctccggtgctagggcttgggagctgagctccaccctgccccctccattctccagctcgcctcaggtcagtaccctgcagatccgcttgatcttaaccctcttttcattgatcaaaagctaatttattatcctatttctcatcgcctttgtttgttattcttctcttgtttgtttggcttttgtgaagccatcccttccttccgtctttaaaggcatcgctgccgggcggctgttagctgaatcgatcgcaaggaaagacaaaggaggagagttcagtcgacttgggatcgagtagaatcgccggcttctgctgctattgcggtactcttccttccttgaatgtcgtttacttctccaggtgcatagcatagcttttttttttttttttggggggggacggagaccgacgagattaattgttgtttctgttttgaagctgaccattatatccaatcccaatccaatcgacgatgggcctctctcgtcggtttctgaacctgatcgtggacaaccgcatccctggagccaaatcgctgcgctgcatcgacctcaccctcgcgcgctacaagttgttcaacactacaacacctgctgcactgatactgaatgggaaaatatctgaatcagaacgcccacaagactccaccccatgggcgggtgccgacaataacgagaaggaagcggcagcaacgttaaagataggaacgattcagcttcctacaccaatcatgaactttcgatcttcagctgagtacttgagttggtatatcaactgtattccgcttgcaggtcgcaaggtgctctgcacagaccaatctggccgcgcctgcctcttcgatgccgatacgtgcaaagtggataccttgccctctctccacaagcccaagtgtttgccctactccatcttcatccccagtgccgatgacaaggacgaccacgacgacaatagtaatggaggtggcagcgtctacatcatggatacttgtcttaatcacataccaagagacaacatacagctgagcagtcagtttgaggcttttgtctaccgtaggtccaccttgacctccttcaccaagtcctggcagtgccagcgcctcccgccaccgccattcgtctgtgaccccaagtacaagcatgccagcccccacaagatcacttcatacgcagtggtcgacggcggctcccacatctgcatatcggtggatggtgctggcacctactgcttggacacggtgaaacacacttggatccaaattggggagtggacactacccttcatcggcaaggttgagtatgtaccggagctgaagctgtggtttggcatttgtgccaatgactggaagcaatttggtgccgctgacctctccaccattctctccaccatggactctcagccacagctagtaggatcttggaaggagctggaggcaccccaagagtggacagagatgcagcatcctcatcttgtcaacctggggtctggcagattctgtgtcgcaaggttctaccacagttggacacccacggcgggcttatttggttctgatttaggtgagcttttttttactgtgttgaccggtacagatgtggtgcaatgtgttgtccatgacggcaatgggactggcaatgcctcttgcaatgacagttgcaataacccttatggcagcaacgggaaagtggaactccgaatgatcaagcacaactcaaaatgccacatgtcttatggcaccgatggtaacattaaggtattgttctgaataataacttactttggtgtattatcttacccatcattatcgtctgaataattttggcactttggtatgtaagagacaaattgttctttgagtactgtcatgaaatttaactctccctgtgttatttgcttcgcttagtatgatgatataaatttaactccctgtgttatgcgctttgcatagcatggtgatactgtttcccgcaatgtcacattctgagttatcttaatttaggtcattctgagttatcttaggtcatcatttatgtggtgactcatgtatgttctcatagttttgagggctttgtcatgaacgtagatctccccctgtaatcctttttgtactatgtatgtatggtatcaatctattgcaatggtacacttgttatcttcaatagtcctaccatttgtggtcatcttattattactccctttgtcccaaaatataatataagagatccattactaggatatgtctcatccggtcaaaatctcttatattttaagccggagggagtattgttttttgcctccatctgggttgctaaaatcccttaaatatttaatatttttttggacggaggtggtaatgttgtgtctgctgcatgctctatgtttgactcccatgttcaaccagaaagcattctttatcatcctggtgccatctgcgagatattttttttttggtttccattagcacgctttttaaacgtctaaaaaagacgcgaatattagggaaggacctaatatcaaataattagaaggggtgaggtttcgaatccaggtcgtctagtctatcaccttgtggagctagccggaaaacctccaagcgtttctcgctttttaaactgctaaacggtttgttccatacgaaaactttctacatagaagttgctataaaaatcaaataagttaattttacaagtttttaataattaaaactcaactaatcatgttaaggacttgtcttttgcgtgtgcaattaatcttcatctttcattagattcgaacggggcacttaaaagcaagccgtgcccatcgtcctggattcttctgctcatgcgactactcgtaagctattacaatatgtgctgtgcacttgtgtattcatctcactattacaatattgtgttgtgcatttgtgtattcatctcacttgggttctaggactttggcctctcttcttggatacatgggacgcaatagcacaggcccctcagtctatcagagagtttatggctcttctgacttttccttcttcacgatctgatttttccttcttagcgtcaactgcaggaaacagatcaagcaatcagggtcaggcagagcaaaaccacaggggaaaaaaagggagaatcagagtgggatgcttaatttcttaacctttacggctctctatgaattgagcagggattgggtactcagtctgatatagggggcattcgtggcggaaggacttcatggtacagaaagaaaaataacactacgaaatatataacaaaggctaacaaatttatgacacattggttgttagctcacctcttatttgtttgtctaatatagcggcctttccctcacgttttgactcacaaaaaatatattcgacaggacatggacatgatgttaaggctatgcactcacccaaatcgaactggttcttaacacttattctcatgcactgatgtctggtctaacctagatggatttaaggaaacaataattcaagagatagaagtaaatacatggatagtagcagcacacacagctagagtcaatgtgcagatagaagtaaatacatggaaatggtcctcctaacacaccattggatgttctatattttgcatcttgcatttgcagaactttcattggtagtccaatttaaattgggcaacaaaataatctgtcacagaattgattgttcattccaatttgagctaaattttatatgtaataatgaaaaacaacagatacaactattttgcatcataactcataaatttaggtgcagtccatacatgaatttcttgatctttagagttcagtcctcttggaaaccagcacaatgtagccctcgagcttcggatgcctgaatctcaaccaggtgtcctctaaaaaatgtaactactacataacatttggtttaactaaacggaaggtcagcagcaggctgagcggaggagacgtagggaatctggtgtgtcggcaacactacatgactgaaaacaacaatgaccggaagaaataggtcaggcgcagaaggagaggattaaaggaggattaccacggattggactttcctggaggagcctgagatagttgagaagcagcaatggctacgacgacccgatctttagatcgattgtgggggaatcgaacttgaagggacaacagaaatagcttggagggactacgaaggatcttctagaagttttgaggagcttcgagggtggcgaggagttgagctcagatcggcagcggcggtggtggcgatttccccagtaagatcaaagtgtgttttgattcctatttttgtgatgaacaattgacatcagtgattattggttttgatatttggagttaatctacgaagtggattttgagatgattggattttacggggtccggtcagaccgggctagtgtggctgatcagaccggtgctatgcgacggccaacgttgtgtcggtttcggtttcgggttgtttctttggatatctgagtttgtttcatgtttatgacttctagatggatactatacatatgtattactattgtttgctaacaatgagtcaagttggtgatagcttggtctcggaatatggtttctttgtttgattcatgtgtaggtgactcgatgcctcgggatagtatttgcggtgatggatcgggagtcggcttggtggtaagacgatgtccgtggtggtcagatatcatacgggatacttaggctagagttgatgcacatggttggtgaagattccatatggcatacgatggaggtattgtgtgcgtatgggatgcggagtcgaatttggtatgattggttatgtagagtttgtttcttgtactaggaggtttcctattgggattaggatttctagtatgagtttggttcgtggctttaggctgcctacctcatgtataaatagagggggagcgtgaggcttcctggtatctctttgtgtatcgcttgagagagcaattgagttgctagtttagttagggtttcgagtttagtcgagatttttgtaaagattgctgttgttgcactttgtaaacacagagagaagcaataaagttgtcatttacttcgagagttcttcgatttgtgttttatcgggttcggcggtccgaccggcaggataccggcggtcagaccggcggcaagcgacgatcagaccggcgggtacacggcagtcagaccggcggcagcaggcaagcgacagcaggcatctcaacggttcgaccgatcgatctacatcggtcagaccgacgttcatcaggcggtcagaccggctcttacacttcggtcagaccgcgatccgtcgaatttgagggtaacttttatttccgctaaaagttttggtttttgggcataccaaccattcaccccccctctggttggcttagttcttgtgtttcgatcctacaagtggtatcagagccatgttttcttctttggattttaaccgatctaaagtttttgccatggctgctaataggttttcaactaagcctcatgtttttgatggaacggaattttctcattggtgcagtaggatgcagtcttacattatggctgaggattgtgatatttggagaaaagtttctcatccttatgtgatccccgaagaaattaatactgctgctttaaaatatgagtttgaagaaaattgcaaagctcgcaatattcttttgagtgggatttctcgttcggattatgatcgtgtttcttatcttcaaactgccaatgagatttgggttgctttgaataattttcatcaaggaacaaataatattaaagaacttcgtcgagatcttttcaaaaaaggagtacataaaatttgagatgaaacctagagaagctttggatgactatctttctaggtttaacaaaattttgagtgatcttagatctgttgattcttcttatgatgttaattatacacaatttgagatttctcgtcactttttgaatagtcttgacatgtctatttgggagatgaaagttacatctattcaggagtctgttgacatgtctactttgactttggattcgctttacacaaaactaaaaacacataagatgaatattctttctcgtaaagttgatcttaagtctagtgctttggtttcttcctcgacttctttggatgttcttcatcatcgaattctactgcttttgctttgattaatgccatgtccgatgagcaactcgaacagttcgaggaggatgacttggttttggctgctaacaggttttctcgagctttgaataatgtcaggaataggaaaagaggaggtcataatcgttgctttgagtgtggtgcacttgatcatcttcgttcagattgtcctaagcttgggagaggcaagaaggaagaaaataatagagtcaaagaggttgaagtgtgaacatgctgatgaagcccaaaaggggggggtgaataggctgtccctgaaaacttaaaaacaaatcgcagcggtaaaattcaaacagacccggaacttcctggtatggaacaccggaacttccagtctgccaggcccgggacttccggtgttctagtgtaggaacttccgggtaacagaacaagaataaaattcagatttcgaaacaggagactaagccaatcttcacaagatgatgcacaggtattctaagcagaggacagatcacagaaacatcacataaagagacaagagcgattttttcctgaagttcggatcttgtgatcctactctccgttgaggagctccaaagagctgggtctcgattaaccccttgcctcacttgtgcaaaaaccccagaggaaatccacagcctttaaccccaaacactcctaagcaaatttctagaattaagtgaccaccaagatccaattcaacctacttctagaaatccgccacaagtgtaggttgctctacttggaaagcctctaaaatctcagcacaagaacttcattaatttacctcgttcccttttgaaggagaggagatccttcacaaacttacccgggacatccacaatatgcaacggattctcgtggatgacacctaaccgtctaggagatcatctccaagagtaataagcaccgagatgacagcccacgagatattccaagtgctcacccaagatcctagtctttacacatctccaaatcttcctctctccctctcaatctctctttctcacaagaattaggctctagattgagtggagaaggcaagaaacacttgggagaggctagcaacagctctaggttcgaaaagtaaaagtggaatagccaaagaacgagctggaaacgagctggttatgtataacggctaggtgacgtcatctagccgttactgacaattttgaactggaaactagacaggaagttccagacctggaagataggaacttccggactacacttaggaaaatctttttcacaagaccggaactttcggacctgaaagacaggaagttccggacttgcatttttggacagatggagtatttgcaaaaataactcctagggaaacttgacacttgggtcacactaagagcacttaacatatctcagagcatcacctggaacccctcttaatagtacggtttttcctaaaaaactcgattgcaataaataaactatcctatgcacttctcgagtttcggtccgctttgattctatacttttgggggggtctccaagcatgtgtaacgctccgcttctcgtgggacgttaaaaactaatttggcaaaatcctatatgcgaaaatttcattttttgtgtgcgagtctaagtcatgctgtagatctcaatttaaatctccttgatcctcctcctcaaaatccctattccaaatcaagtctccgaaatcgaacttcgaagttcaatcgcatcctttgaatcctcgccaaacactcactcccaatccccaaaaatatcaaacactaccttgagtcttccttgattcctccctgaaccctcgagttcgaatatcgaatttaaatccaaatccaaacttcaattctctccaaatcagccctctctatgaaagtctaaatcgcctccctcaagttttgtgggtcgattttgtccccctcggcccatctcccctctgcctatctcctccctcctcctcacacgtgctatgcatgtgcgccgcccgagagagtgtcgtcgctcttcctctctctctctctctcgccggtcgaccaccgccgctttgccgattcccgccgccgcggtttgaaccctcccgccgccgccattcgattttcgccgccgcccgtcggtttcccccgcgcgcgcgctcgcgcgtggccagtcgcctggtcgccgcctgtgcccgctctgccgcctggtcccgctactccacgccgcgtgcttccaaaaccgtgagacagagcgcctctctcacgcgctctcccccctccctctgctcgcccaaattggcaaggcgcagagctccctttttccctcccttttctgctttttcccctgaccaccaccgccatgccctatcgccgcctggtcacttgcgcctgtgaccgccagctcacggtccttgcacccttgaccgccctatgtcggttccccctcccaaaccgcctcttctccatctataaagcccaagccgagcctccccatctcattctctctcggcatctctcttacaccgccgctgcgccattgttgccgcctcgcagctgccgacctcacatccttcgccgtcgcgcgtgctggtgaagcctgcgtgcgcgcgaggagccgaagaggactccgggcaccctccttcttccccttccccggtccgaggccggagagcccgcccgcgccgtcggccatctcccaacgcccgtcctgatgcggtagccttccgttccacttcctcgctctctctcgccacctccagctcgcgtggtaggtcagctagactctcgaacacgcgtagacgaagccccaagccccgccgccgccacccggcatggcctcgccgccattgccacccgctcccggaggccgccgccgtcgctagccctcctcggtgctccttcgccccacccggcgccggaaacggattccccgacccccatagatactcccaccgctttgaatcgagctctcgttgccccgtcgcatttcccctcttatcttgccgccggccgccgctgccgcaatccgccgattccggccatcccccggcgaatcagagcctatggctcgctttctcttgtccctcccgccactctggtgtactccccctcccttgaacccccgcgaatcgctccggcgaacgccgttgccgtccgccgtcggatgccggcgccccctttttcctcctcctgccggcccgcgtggctgccacgtaggcgccacatcggagccacatcggccgcgaccgggtcagcacgaccagcctgccgcctccccctccctcgaccggtgcgcgcggtccacggagagccctatggctgcgcgtgggcccgccgcctctcggtccatccgacacactacccgtgcgccatcttcaccaaaccctagtgccgcccccgcgtgaacccattcctccgtggacccagccgccgataggtgggcccgtcccgggaccccgcatggtggaccgcggtccacccggtcggtctcctccccctcctgcgccccattaggccgccctcctcgcggccgtgccggcccattaggctcgcccgagctgcgcaagtccctcgagccgcgccaatgccacccgagacaagtctgattcacatctctcgtccatttccttttccaaaggatttaataaatccttttcctttagacagaaaatacaaataatcttaggaaatccatatctcctcaaccgctcgcccgattgaccccgttccacttccagtaattccataaaattgagatctgtctaatggcactataatttagtctaaataggatcttttattggtcttttgtttaggttctgattgtttacgtatagttgcggttaccggattttcgtcaatcgtggttttctcgaagattcgtgaagcttcgtgaagaccttgagcaaggcaagtcaccctttgatcaattgctcctataattggaaaatcattattattttgtttgcaacttgcattattagaatcacacacttaacttgcttggcctcggtttgcgtgccaaaccgacggacctacccagtagtcgcactaattcctgtaggctgtactaccctgattccttgtcgctccacccttgtggtacctcggtatccgtgctctctaagcgcgtataccaaatatcccacatacaccgttgattgtcgaaaacttggaaaatgggtttgagaagccttgaaaacccgacatgtggtgtcggtgtgtttgaaaataaaatgaattgtgaaaactcgcgatgcgggtgttgtgcctatgtggcgtcatcccgtattcgcatataaggaccgattcctgtgggaaattcatcaagcataacaagtgcaaccacatggtggtatgggacaccctggctaagtaattagttgcttttgggaaatcttgtatgccaatagaggtggaaagccgggatgtgggggtagaggcatcctgggagtccgaaacagaggaaggcacccgggagtcctaagggaaagccggagttggcccgatcttggtcagggagaccctctatgtggcatgaggtgacccaggattggctttggaaaggccttgtcacgaacctccgacaccagccagtgtctggagtaagttcgtgtcttgtgggtaaagtgtacccctctgcagaggttaactaactgttcgaacagccgtgcccacagtcaagggcggatgtgaggtgtttcccgttgcgtagatttgtttgccagtgctttgtgaaaagttgttgtggtgtgggaatcgtaaccagaatcagcctatgtggcagatggatgacctgagtggtcagaaacgaatttgtgtgattcggaatgtctacgagcatcatagactaggcttcccgagtggaagcggattgctttgctgctgggcagctggactctgggagtccgcaaaaatgaaaaaggctctgggagccgcctaatcaagtgaaatggctctgggagccgaaaagtaatgatctgacccgggaggttggtacattaccatttgagttgttgaaaatcatctcttaagtcgaatcgagacgcaagtctcctttcgacccaaacttaaaaagaaataaatcacgtagtgatttcaaaaatgatttcaaacaaaggatttgcaaaacaaccttgcctctcttccaagcttgcattaaacacctaagttcccgtgacttgctgagtacgaaagtactcacccttgctctatataaatatatatagttcctccgtcgtgaagtgaagatgaagtgaagtgaagattagggttttgtcctagttcccagccgtcgcctgtggtgttgggtgttagaccgttggttccgctgctgctgttgttgctggtgtttcctcgtctgtgtcttcggttgtattctcaggctgtcctgagctgcaacctaagttaaggtaaataagtcatctatttgttttaaggatttgcaatgatccatatttgtcaccgtgggtaccagcactatgtcctgggactggtactgagatcgcggtttcgtaggaagctgtcggtgacatggggctgggggtatcgtgactagaggccggggtagccgcgatcacccacgtggcctgaccccctcgagggggtcgggcccgagggtgacgtggccacccctccctctgtctccccgaggggtcgggccgctcccgtttcggccccgaggcctggaacgccccgaccccctatggttttggcgccacgtgtgtgggataggtgagcccagcggggctcacctaaccgcatttatagcggattggacgagcgcgccacgccgcatttaatgcggcgcagcgcacgcttatccggtccgtgaccagtcgcggtatgtgaccggtcacagaccggtcagatcgcgggttaggtggcaacaggcggcctgtcgcacgcctcgccccgtcccgtcggaatgatgagagcttcctggctctcgtctctagccggagctggcgtgctgactcctggagttggtatgtcagtcccggtcagatccattctaggcttcagcgcaagcatgggaagaaagtcgctggccattgaatgaaggttgaaatgggcgtccaccgggagagctgacgagcggagcagaaggcgtgtgctgtgcttgtcagaggtcacttccggctatagactagccctcattgtaaaaagcatgtttcctttcttaggcagctagaggcccatgtggtgacccctgaccacataaaaaggaggcccaggcctaggagaggggggtcgaactctggccacttggttctagagcctgagctctctctggttctctcgagctgtattccttcacacacagatccaccagaacacaggagtagggtattacgcttctcagcggctcgaacctgtctacatcgcccgtgtcttatgcgattcttctcgctgacattcctcagatcgagggcgaagaacctcacttagcgcccccggccgaaccggcaaaggggggcctgcgcggtctcccggtgaggagccccaagctccgtcagaagcggtttgcgccgttattcctacgacacgctcctgtcaagtgccgttgtacggcgatgccggattggggtgtgacagcatgcatcttccacaccttggactaatgcacctgaaaattagctcaataaactcattagtcccttaaccacatttgtcattaatcaccaaaacccactagggggattaatgcactttcaatctccccctttttggtgattgatgacaacatggttaaagcttacaaaagattgatataaattttgttttgaatggttagaggtgaatgaaactcccccttagtgtatgcatatggaagatatgagagaaactcatatgcatatgaataagggaacaactgtggagagtttccttcatcactactcattcgtgggatgcaaataagcagtaagaatagatatgatatgcaaatgatatgacatggtgagcactcaaaaagaataaaatcaacatcacatcacaaacaagaaataagacactcatagcataaatgaagtgcaatatatataaggagcagctaagagcatctaacagtcattacatccacacaactagagaaatattacatgtccacaagtccataagagtagaggccaaaggactgccaggtccggaacttccggataaaatacccggaacttccggacaagctgacaggaatatagagcgagggagctgccaggtccggaacttccggataaaaggatccggaacttccggataaacagacagagcaggcagcaaacaacaaaaacaaaattttgaccctcttcgattgcaattttctccccctttggcatcaaggcaccaaaaagagacaaaatcacaagggaagaagaggatcaagcctcatcaccatctccatcagaaggaatgatctcggtgtcgccggagtgaggtgagtcaatgtcttgcccggcggcgtccactgcctcatctggatctgtaggcacattctctgtaggtgcatcggactctgggtcagggatatcatcaccaccatcatcattgctgctctcctcagagtgggaggactcctcattgaagaaatgagcagtgccagagggtccctcaccactagcaatgtctcgagcagcctcataagcagcaaaaggatcagcaaactattcatcatcagaaatatcagagacctccttgcctgctgcaatccaatcttccttctgacgcctctctatcttcttcaccttcttagctgtcttagcacacatgcaaaagatagcccggagagccttctttatgggggaggaagactcagagcgctgtggagcagcagaagaagaaggagcagctgatgtagaagcacgagtctccctggcagaaggagtagctgaagaagagggagcacgaggacggaaagacttgtgctggttatccttgaaataacaaatcccagcctttgcctcaatcatcttcatgatataaggagcatagatgcaacccctctttggctcacacactgtctcatagatctcactccagataagcttcatgatgctaaaatctgacttgttgtagcgcatgcgactgaggagaagcgcatgcctaccaggaagagctgtagcatctcccactttgaggagcaatgaccacctaaagatagaataaagcactctatagtatggaagcaacccacaagtagtccccaaacaatccttgggagcatccttctcatacaagaaagtagtgctggtcactgataaagcatcctctgcaaagagatgtggacaactcaggtcatcatcatctaactccaaagctgcagcaaactgagccatagaaacctaggattcaatcaccagacacaaacatttatttaccgacgtgaactgttagtattttctcccttgatgatagtatttcaaactcgccattctaaaaagtttccccgaaattgcaccatatgcaagaatattctcaccacgtacgatttttataatagatccaatatattgggtttttttacaaccgataagaaaatggattattgctctagctaacaatctgatccaagactccaagcaatttatagtactataaaaaaaagaaagaagtttcttggaagtttctgaacatgaagcttgtccagattagtagtactaggatacgtcacatccactcaaaatcccttatattttaggacggatggagtactctagttcgaaatatctagtaactagcaaaatgcccgtgtgttgcaccggataatgatatggtgactgaactttgatttgaactatttatatgaagaaaatgaattgaaatattttttgatttgaactatttatttgatttgaaattttcttggaatttacatagcttaattgctaattttgataatacaaatatcatttcagcatttatttaaataaaaattattttttctctatgagcctttttcagcccattttcttcttcagcccgcaagcgaccgacggcccgcgtgcggcccaagtgatgtagcccaagtggtgcggcccaaactctcgatcgatctcaaccgttcgttttcgttttgatggacggctcaaatcagtttgaaattgataaaaaccctaaccctccccctccttcccagccgagccgagccggccgcctcccccctccccatctccccaccggcaccgcttcccctcccttcccctccggcggcgccgctccctctccgcctctccccctccccccagccgaccggctcccccgccaccggggtcgtctctccccccaccggcgccgcttccccttctcttctccctcccttctcaccggtacggcgcggtgacggcggggtgcggcggaaacggcgccctcccaacggcggcgtcgacggggtccgcgctccctctcccgctctccttcttgtctcgccggcacggtatagcgacgacaggtgcggcggattttttttgcaattttttccatggctattgctaaccaaatcggattgtgtacggatgaaaattagatgtgacgaaagaaaaaatacaaatatttatattagttatagatatagatagtatcaggcaagcctcctatttaggtggtattattcgtgctacagtgcttatttgctacggtatcacacagaactatgttgtactgggctactgcttctctgctctgtgggctggctactgggctacgtttgctttttgttgggccggcctgctgccgtcttggctgggctgctcgcttggtttttctttttttcgtttctcttttgtttgcggagcgtcagagatcgatcgccgtaatgcatccggattcacggattagcggcgtaataatcacgtgggcccaccctttaatgacggacgaaaaaaatcaaccggaagccttacttattttttaattaggtactagcaaaatacccatgcgttgcattgggggaagaaaaaatagtaattagtgtgtgggagcataaaaccaccaggttcattgaggtctttatagtcgaatcgaatctttgtagtgcaaataagacgctaacatgatataattatttgttgctctaaatccactgacatggatactaaactttgaaaccacaaaaaatatttacttttttgtcatgtattattatgagtcaattgcagtactttgttattttttttggtactcgatattgataagcacttttttttcatattgtaaagagtagccataatataagaaatattttttgctagctatcagatcaacctcactgcactccaattgcataaccactcacttaaataatcagaaggaaagaaaaaaatgtggtatatcgcagaataactttcactctaaataatagaagaaattatacaatgaatgaaaaaaaaagtgatgtgattaggtgtcctgtggcgaatgagcaattgatgagcggaaaaaaatccaaatgtaaacatgattcaatttgttggtgattactctttctaaaaaaaagaaagacacatgtgattatttttatttttaaaaaagaatttattttgtcggtaaataattcattttattggtgactacatgttttaagtaataagatctcttctttttcctgcttggcgtgagtccaaactttattcgtgttcggttgctacagtgttgcgcagtactgtgctgggctggtgggctgcttctcctccgctctgtgggctcgctggtgggctgcggctgctatctgggccggtctgcagctgctttggatgggctgcctcgtcactaatccaatccgggctgctttggatgggctgctccacaaacaaggttttctctttttatttttattttctcctttatttgcaggcgtaagagatcgtggccacgctttcggatcgtggattagcgacgaattatcgtgtgggcccactcttaatgacggacgaaaagattaacaggaagccttacttattttttaattaggtatagatatagatgtcaaccatgaagctaaaataaaaacgttccacatctcattggtcaatctgatctgaccgtgacaggttccacatctcatgtgatctgtctgtctataatattgatcaaggccttgtttagttccaaactttttcttcaaactttcaacttttccatcacatcaaaacttttctacacacataaactttcaacttttctatcacatcgttccaatttcaaccaaacttccaattttagcgtgaactataaacacaccccaagattcgaattgtcaaagaatagcaagaagcaatcagaattcagcagtctgtcttccctgaaacttttcttcataaccaagtcttggttttcataggtgactgactgaatgcatgacttcgcaggcactggacacgtgtatgcaatttctcagaatctctagacttctggtctagttccatggtcaggtctatagacttgttcttgcagttctgattctgactttctgaccagtttgtgatgcccccaggtacatatataagaaaaatctgggtattgatcaatcctacagttaaaatttcaagatatcattcatctggtaggctggaagcaaatcagtagtttttttatctgcagagaaattataatacaagagtagatatatatttttttaggaaaacaagaatatatatatttcctttggaaagtagaagtgatagttacatttttgttaaagaatatcaaatgcaaatgataaaacataagacgtgatcagttactaaactatgcatagaactatctaatccaacacggcctgcggtgaagcgtagctatagttgctgaatgggaacagcccagactaatctttgcagcagattattggttaatacctacaatagatgaagagatggagcattcttgattttacatttccagagcacgctcagcatgaccatgtaattcatactgtctgggtggaatttgcaggcacagagccattctgaattggtcgaggctctttgccatcagcacgttcagacactcccatggatatcctgggaactgtcgtcaattctaatttcacggagaggtctatcagccacaaagccattgcccatgctgttttgtgcttgattagatccttcatgagcaccgtttccatcatccacaccaggactttgcacatcagaaactctaatttttgtgtattgggcaagaactgacattgaaatgcttatcatcagcatgagagctgacataaatccatagatgataaaaagaccagagaaactctgcaaagtgagaggtgtcgaatctgtgttggggatcgcattacttggagagacagcctctgcaccaaaccaatttcacttccatacgtgagccctcatccccactcgttacatccaacatggcagttgaaagattatgcaccagtggaaaaccaggaggaaacacctgaagggaagaaaacatgatgcaatttaggccagattgtagcatagctcttaaaggaatatgagtgaattcgccaaagcaatggagtgagagacttacgaaaccaaatccaggcgtcttatatatacgtttaagcatctggaattcgttctcgtaatgagggtctgagacaatagcggttaaaaatgggatctcatcaacgatagcagacacacctccattcttggaccccttcctcaaagattctgcatattcctgcttctttgagtaggatcttagccttccttcactgaaacctcgtcttgtcaaaaatgagtgcacgaaggatccctcttggtatccaacataatcaccattacacaggagctggtcaagatctgtcactgagggctggaacctcttaacagttagaatggatgccaagctagctccgtagctctgcacaagaaccaacaccacgaagcaccagcttaccacaacaattttcgacaacggacttttaataatttgacctgtgcatagtaaaacaaagatagtgggtaattgaagaactattgtaagaaaatagctaaaccacttaatactgcatcaaatatagcctgaaagctgagctccaaatactaaccatgagaaaatgtcaaagtggagaaagcaaaatagagagcagtgcagaactgtcttgttcttgatccttggaactccatgtttctgggacgttcaatcatcgaaataaccaaggcagtgaataggaaaaagtatcatagtggcaaaccaaagttcttttgtcagtggcttcaagaatacccatttggttgttgattcagattcattcttcgcaagcacaagcattgaaaccccagactcggtgtacggcatcgtgaactccacctggctagctcgatcggcagttatggttatatcccccactgcagcatcgttgatctgatagtaagaaccagcagatatagtgtaagaattcggttctgttacaatgtcatcaaagcacagggagtaaggctttacccctgaagatacactctgtactagctggtcataagaaccattgaagacaacaaactcataactcagatgatttggtaacttcttcatggcagcctcaaagacatcaatgcaatagccagtgacaccttgtgttatgtggggcattcagtatcagcgccggaaccgatgccaacagccagagcaggcgccgtgaggttggattaagttgttaggattagtttcagtgattaagtttgttaggaagattaagttgttagttcctggttagtagctgtttggttttccattgtaagcctatataggccattcggtttaagtgattaatcaagaaagaagttaatcccagttcctgttagtttccaccacggctccggggaggcgaggcgtgcgccctcgccctcccgtcgagcacagctacgcgctacgccacttagggccagcgcctaacattttggtatcagacttccacgatcctctccctcgccgccgccgcgccatgtcttccaccgtcaccaacgtcgccgacgattggaagaagggtctcgctgaggtcctcgaccgcttggactccatccgcggcaagctctccgacctcgacaatgaacagcaggcgcaccacatcgccatccagcgtttggaacgcgctggccgcgatcgctcgccgcgccgtaacaatcgcgaccgtgacgacgaccacgacaatgacggccgccgcggtgatcgtccgccacgctaccacaagattgactttcccaaattcaacggccaaggtgacccactccatttcctcaatcgctgtgaacaattcttccagggccagcgcacgccggaggaggagaaagtttggctcgcatcctaccacctgctcgacggtgctcggcagtggtatatgcgcatcgaacgcgatttgggcacaccgacatggcgacgcttctccgacttgctcaatctccattttgggccgccgttacgccaggcgcctttgggcaaactcgccgcctgccgacgcaagactaaggtggccgcctacatcgaccgcttcctcgacttgctcgctcgcgctggccctctcacggaggagcagcaagtagacctcttcaccaccggactccaagaaccactcagcatcgacgtacaactgcagtacccgaccaccttggagttcgccatgaatctggcgcgttcgtttgagcgccgcgagctcgccgctcgcactacaccgtgacacaccgctcgtgaccaggcgtcctcttcagcggcgccgaccccgtcgcaaccggatgcagcttcctcggtgggacaagcgtccacacaggttgcaggccgcacggttcgccgcctgtcccagtccgagatggacgaacgccgacgcaaaggattgtgcttcaactgcgacgagctctacgcccgtggccacaaaaaggtttgcaaacgcctattccttcttgatttggcttatgatgatgatgatgacgaggtggaaggcgctgcaccggctgtcgaaccggagacgcttcgcatctctctgcatgcggtcaccggcgtccgtccgtccaacgccatgcatctccatgtccgcttgggcgacgccaccctccacgcgctcgtcgacacggggtcgacacacaacttcctgtcccaggaggccgcagcacgggtgcacttgccgctcgtccaacgcgctggcctgcgcgtgacagtcgccaacggcgacaaggtgccctcgccagggatgttccaggacgcgcgcatctccattgacaccgaggtgttcatcaccgacctctacgtccttccattgggcggctacgacctcgtcctcggcatgcaatggttgtcaacgctgggccagatactatgggactttggccaacttaccatgtctttttggcacaaagatcacatggttctgtggcgtggcctgcccacgggcgcttcaccggctgcgcacgtcgccaccacccgcgacctgctcgacgacctcctcaccgagttcgccgacgtcttcgccacgccatccggccttccgccaccacgccatcaagaccaccgcatcactttgctgcccgacaccgcgcccgtggcggtccgaccttaccgctactcggcgcgccacaaggacgaactggaacgccagtgccgcgacatggaggcccaaggcatcatccgccgcagctcgtctgccttctcctcgccggtcctcttggtcaagaaggccgacgggtcgtggcgcttctgcgtcgactacagggcgctcaacagccgcactgtcaaggacaaattccccataccggtggtcgacgagctcttggatgaactccacggcgcgcgattcttctccaagctggacctccgctctggttatcaccaggtacggatgcgcgacgccgacgttgagaagacggcattccgcacccacgacggcctctacgagttcttggtgatgccctttgggctgaccaacgcaccggcgacattccaatccctgatgaacgaggtacttgagcccttccttcgccggtttgtgctcgtgtttttcgacgatatattgatctacagcccgtcgtggtcatcgcacctacaacatctgcgcgccgtcttcaacacgctccgcgcccacaagctgttcgtcaagcggtcgaagtgctccttcggggacacctcggtcgcttatttgggccacgtcgtctccggccagggcgtcgccatggacgcctccaaggtgcaggcagtggtggactggcctcgcccctgctccgcgcgagctctccggggcttcctaggccttgcggggtactaccgcaagttcatcaacgatttcggcgccgtggcggctcccctgacacgcctgctcaagaaggacggcttcttgtggtcgccggaagccgaggtagcgtttggacgtctcaaaaaggcgctcaccacggcgcccgtcctcgccctgccggacttcgatcagccgttcatcgtggagtgcgacgcatcaggcacgggcttcggcgcagtgctgcatcaggatggaggacctattgcctatttcagccgcgcctttgcgccacgccaccacgccctggcggcctatgagcgggagctcatcgggttggttcaagcagtccgacactggcggccgtacctttggggtcgccggtttgtcgtcaagaccgatcacttcagcttgaagtacctgctggaccagcggctagccacgctcccgcaacaccactgggtcggcaagctattgggctttgatttcgaggtcgcctacaagccggggcggcagaacacggtggcggacgcgctgtcccgccgcgacgagccggctgcctcgctttgcgccatcaccacgccggtgtttgactggctacaggatctgcacaccgccaacgacacggaccccgcgctggtcgccctccgggaccagattctggccggcaacaggacagcaccatgggcactcaccgacggcatcgtcaccttcaagcagcggatgtacattcccccggcgtcagcccttctccagacggccctggcaatggtgcacgatgacaagcacgaaggcatccagaagaccttgcatcgtctccgccgcgagttccatacgccgggtgaccgccgtgtggtacaggaattcgtcaaggcttgcgccgtctgccagcggaacaagacggaacatctccaccccgccggcctgctcctgccactgccggtgccgtcggccgtctggtccgatgtgtccatggacttcgtggaaggatttcctcgcgtcgcaggcaagtccgtcatcctcaccgtcgtcgaccggttctccaagtacgcgcacttcatcacgctgtcgcacccatactccgccgagtctgtggcgcgcgccttctacaccgacatcgtacgtctgcacggcatcccaacatcgatcgtgtccgaccgggatccggtgttcacttcgacattctggaatgccctcttcgcggccacaggcaccaagctgcacatgtcatcggcgttcctcgacgacattcgctaccggctggagcaggcccagcagcatgcaaagaagttctacgaccgccaccatcgggagctgcaatttgtggtgggcgactgggtttggctccgtcttcgccatcgcgttccggcatcattagcaactccggtaaaaggcaagcttgggccgcgctattatggaccatacaaggtactggaaattatcaacaaggtggcttatcgcctcgctctgccggctggggcgcgcctgcatgatgtgttccatgtcggtcttctcaagccgttcgtcggcacgccgccgacgtctccaccggcgctgccctcgacactacacggagcggcgttgcctcagccagcacaagtactcaagtctcgtatggctcgtggggtgcatcagctgctcgttcgttgggacggtctgccggcatctgcaacgtcgtgggaagacttggacgatttccgtactcgctatcccgcattccagctcgcggacgagctatttgtcgaggaggggagagatgttatgtggggcattcagtatcagcgccggaaccgacgccaacagccagagcaggcgccgtgaggttggattaagttgttaggattagtttcagtgattaagtttgttaggaagattaagttgttagttcctggttagtagctgtttggttttccattgtaagcctatataggccattcggtttaagtgattaatcaagaaagaagttaatcccagttcctgttagtttccaccacggctccggggaggcgaggcgtgcgccctcgccctcccgtcgagcacagctacgcgctacgccacttagggccagcgcctaacaccttggtcagatacattcacaaaagcgctaaaaccatgtttcagtggcacagcaatcttgaggtttctcctcactccaacatttatcctcccggtttctgaattaggaaaaaaaaaggttagttcatgtcaattgtagatccaatattaaaaaaaaaggttggacaccaaggaagaacttggtgtcaatggttttaagaaaggagaggtaaatatttccctggtgagcgtgctcgataagggtcgaacccgggccgacggggtgcgtgccagcgacccctgccactgctgcgctactagcgcatctctagatccaatattctctcgtcctatgagcaaaactaaactacgtggcacagcaacaacaataattctttgcgtatgtttgcaccatgttctttaagcattactgctaggcatatttcataggagtacattgttaaggatatatatcaaacgaaaacatatccctccactatatttttatggatgacagctgggatgagtgtgagaagttaaatcagattctcaaatctgcaagatggatggcatcttggatgaatagaatctctggttgctccaggcgggttgttggtcttttgatcttttctatcttttatttttattattgtttgaactaggtcaatcctgtatgctcatttctgatatatggaaactagcatagtggtccacgcagattgcgcggctagcatcattatattttctctcatataataacatatatgttttctcaatgtagtattcaaatatattaaaatgacaacataattttaaattttatactaactttacgaaactactaatgtgcaatattcatattgtattttatatacgtgttagttattaattattttcaatataaaattttagttatttgtaaattatattatatgaactctagactcgtctttcaatatttcttttttttaattcagaattttagttatctatgaattgtatttctatatagactctaggctcttctttcaatattctttatttttaattttgaatttcagttacttctaaattgtattcatatattaactttagactcttcttcctgtgtttttttaatttcgaattttagttatttgtaaattgtatttttacacgaactctaaaatctacttttaattttattatgtttatttagaattttagttagttttaaattcctatatggactctatactctacttctaatattccttattttaattccgaatttctatcatttcttaattgtatttctatatggactctagtctcctcttccaatattccttgttttttaattccgaatttcaactatttctaaattgtatttctatatggactctgtttttctttttctccgattaatatgagaatttttaggccgtgagagtgaacgtggagactcatttttctattccttcaataacttaatagattggagaagggatcgcgtcctcttatatcattttttttaaaaaattaaaggataccaccgtaaatagagccaataatggatagatatggcaattgatatgatctgctgaaaaaattttgcgtactgcttgtttgattctacgatactgtcatggcaatcactatcaaactggccccgcataagaaaagttaaaaactaagaattcgtggagtgaacaatctatgaactccccgcgatttttttttaaaaatacaaactcttagaaaaattaggatgaacagcgaacctcctcaacttagatggaagaatggatccacggcctttaggggttggtgcggcggagggaccatgcgcgcagcgcgcatgaatgctgcagtaacggagctctgactcaggcggcgcggtgtggttggggaggtgggggattagagcaatacgggtagaatcgcacggtatagcaaccggtggcgcagccgcgcccctccataggggtggaccaccggcggcggcggcgacggtagcggcggcgcggcattgggctctccgtctgaacgatggtgagaattgagaactgacaaagaggaagggaaggggatgagctctgattgaggaagaattggccggtggatttggatgtatggctcagatttcacctcttagctaccctatatcttccactctgggttcctccaagaaggctaatgtacgggtgatcgcgcgaccgcataatcaggtaggcttttcttattttggcaccgcatgactttttttttaagatatatgtatgaaatttgtatataaaaggttatctatcaaatttatactctatgttttatttgtttgacgttggttaaactaaccaacttcatataaaaaggaaagaaaggggtatatagaattttgctaagattctagtacattttatacctatagagtttcaatgtatatatatttatatgcataaagcacatgaatattctcaaacataattgtttttctgttgttagtacatttttttagaaaatcttatttttgaatttgttttcaaaaccaagttttgtgcgtgcccacgtgcgctaggacgagggcactaggagcgactgagcaattcgggagtgatgcggtgggggaggaggagaggggtgccactccatgcacgatcattcgcgcgttagacatccttaagtttctcacattccattctctttctactagtatgtgttaagtaatttaacatgaacttaaaaataagttataatggaagtgtcaatgcaccctagttcccagatctttagagcatctctaaagagtggctaaatgattttccatactaaatttgaaaaagaattgctacccaaattctgtgcatgccagaacttagcttttacccaaattttgctatgttatttatagttactcttatagttatgacctcatcatcgaatctcttatccacaaccgtacatatatcctctacggctctaccattggagagataagtactattgcacaaaatatgctaccatttgtaagtaagtacgtgaatttattgtctaacaaccctatgtacttacttctgttccttttaataaaacatgtgcatctcacgtgttcccaaaaacattatcaaaatacaccttcattatgtacttaattagacgcaatgaacccgagagtgatagaattttatcgtacttacttaccgaaacaattcaaactgtaactaaatttacatagaaatgctcatcgaagtagcgggggatatatagtaaacaattcgtgcatgcagcgacgtactccctccggttctttttatatgacgatggctagttcagtagtacttaagttgcaaatacaaataactttttttttgaaaggaatgttgcaaatacaaataataagcttatatatctcttcactcatattagcattaccattgccgtttaggcccaagcggtgcgccaccgtcgccgccgccgacgccgccattgccatctccggtgaactccaaaccgtgagcagcatgatgagcatcgcggcgcccatagccaaccgaggcatttcctccatagccgtacagtacgaaaacgtgcaaattaactgcaaagcaagagcttagtcgagctagctaattaaggagctaacacacagcaattaacagtgcatggcatctcgagacgaactgcatgtatatatataggtagaagtatacgtatacacggtttttttaaaaaaaaataagtatatgtatacaggcactactaattaagcaattaagtaatagtaattaactaggacactaacacgcaaccaacgtacacacggtttatacactgtcaaaatggctagttgacagtattttttttaatactatttgtgtttggtaatgtacgtagccagtcagaaattcggagtgtttcccaagtatagtagtatactccagatcaggtacagactgtgtcaatgcatgtcagagaacgtctcgattgggtattcagttatactattcctgtaactacctgctccttactatacgtttatataggccctgtttagttcgcgaaataaaaattttttgatgtcacatcggacgtttgatcggatgttggaaggggttttcggacatgaatgaaaaaactaatttcacagctcacctggaaaccgcgagacgaatcttttgagtctaattaatccgttattagcacatatagattactatagcacttatggctaattatggactaattatactaaaaagattcctctcgtgattttcatcataactgtgtaattagtttttttatctatatttaatgcttcatgcatatatatacaaaacttcgatatgatgtttttagaaaaaaaattttagaactaaactgagccatacgttgcagaatgtagaaataataatcaatcattgacttgacttgacttgaaactgagattgagttaatttatgataataattttgatggtacatacaaatagcttaaatgctactaaaaagttaaaaaaaaaacgttggtttaaaaaaattttctaataaaagtagatggaaaaagttcttaaaaaaaacatactatttaagagcttgataagcatatataaccacaataaaataatctaaaaagaatggaacctatcgaaacccacatgcagagaatatgagggtgtaagtgactaatccactaaatccagttataaactaaaataagctacgaatatcttattatgatctatatatgcgtgggtttgtggcataccaacttatacacctagtagagaacagttcgtgtatacgaatacgagtagagcagtctggtgttctttcttagaggctaaggttagtttttgtagggatgaccaaatcattgggactccatgattagcaccaaacaggcgcgtcgtcccctgtaatacggtgcaaacgacgatgcgttgtctcgatcggctgacgaattcactggtggagaaaccatctttggtcggtcgcccgaaatccacaatagtctcggttccactaaaaaccgggactaaagatgatctttagtcccggttggtggctacagcgggcatatttgatctttagtctcggttggtgttaccaaccgggactaaaaatgatctttagtcccggttctaaatctgtcaggcctttgtaggcccttcgatatctttagtcccgggttgatacaccaaaccgggactaaagataggattttgagtcccgggtggtgttaccaaccgggactaaagatcccagggatctttactcccggttgataatatcaaccgggaataaagcgtacgcaccagcccacgcacaagcgcatgcgtagcccctctctctctctctatctcctatccttatctctttttcttctccttccttatcttcatgctctccccttcctcttctctcaccccctctcctcctcccctccccctcttcctcttgcagaggcagccgacggcggcgggatgggggacgggcacgagctggcggcggccggccggcagtggcgggatggaggcggccgggcgcgggctggcggcggccaggcgcgggctggggctggaggcggccggccggcggcggcgggattgcggcttggcgcgggccagcgggatggaggacaggcggcggcgacccggcgtgggccggcgggatggaggccggtcgccggcagcctcgccctcccctcctccagatccggccagaggggaagcggcgggatggaggacggccggcggcggcccggcgcgggccggcgggatggaggccggtcgccggcggcctcgccctcccctcccccagatccggccggaggggaagcggcgagatgggtggccggccggcggcgggatgggaggccggccggtgagtcgattttttttttgattttttttaatttgtggtttggatgttttgatctgtgaatgaatctatgaatcgatattgtgaatgaatctgtgatgttgtgaatgagtatgtgactcgatgttgtcaatgaacctttgaatcaatattgtgaatatatttgtgatgttgtgaatgaatatgtgaatggatattgtgaatgaatttgtggtgaatctgtgaatcatgctgtggagttgtgatgtggatttggggtttgatttgatgatatgcataccactcgattcgggagaaaataaaaaaaaaggactagctgatggactgccgctaccctctctttagtcccggattggtagtcccggtttgaaaaccgggactataggggggttacgaaccgggactaaaaagcacttctccaccagtgattccttccctatccatttcaaagaacttgaatgttctacacgtacttctaacgttatatgtcttctcgattaatgttcaggtcttcggactcaacagcatgcaagtgggacgggctagcccgcaggttttaaaactcgtttaattttgcactggttgaagaaaaaaaatagtaattagtgtgtgggagcataaaaccaccagattaattgaggtctttataatcgaatcgaatctttccagtgtaaataagatgctaacatgatataattgtttgctgctctaaatccactgatatggacactaaagtttgaaaccataaaaaatatttatttttttatgtattattatgagtcaattgcagtactttgttattttttggtactaaatattgataaacactttttttttcatattgtaaagagtagccataatataagaaatatttttcgctagctatcagatcaaccttactgcactccaattgtgcgagcagcggtggcagtgccctcctggctatggcggcgcccttcctccctccccgcgagcggcggcggcggctccctccaccccatattgcctcccaggccccctgttgcagtcctcctctcccatctcccccttttcctcccgtctcgccggaacggcacggcgacggggagggaaaccaccggcagcgctgtttccccacggccactccctccccttcctccaccggcctccctcccgcagcaggtagatctggcagcggtggcggcctcgcggcagctactggtggcagcggcggcggctccctccacccccggcagccgcaggtggcgttagcggcggctccctccgtcccctgtcgcctcccccccccccccccaacttgctaaaacgatggcggtggcgggggcggcggtgcagctcggcaagccactgccagcggccactcgccggatctggccatgggaggcggtggcgactgctgctacggcaaactccgctcgatttttggttgatttgtttttttttatctccgtttgctattcttctattcttgtatttgggatctaacatgaactggattaaaactttgtatgttatttgatgcgaactcgtatgtatatgcttctatttgtctgattgaatttcgattggcatttttttggtttttttggttggggggtgatgcaattccaactgagatttttggggggtggggggcggacggacgaaaatttgggcacggacaatgtaaggattgaaaaaatatgaatattttaattagttaagattaaaattaagatttcttcatgtttatactagtagattaaaattgaatgtacatgtaaagaaaacgggacacaagtttattcatgtttatactattagattaaaaagaatgtacatgtgagttgcagtggcgaaaacgagtgcgctgccacctagaaaaaatggtaaagaaaacgagacacaaatttagtttacacatacagtggcatatatatatcaaagtgaaagcacttcttttttttgtataggcaaattaaacatggtaacatttttcgcttgtgtgtcaagctgccctagctggatataataagcaaagtagcaatgccatctgatctgctctgttgtctctcggtagtcagtagatgcacggatcaaaaaagcccaagacaaacatcagctgaacatcattcatgctcattcagcatgaatctgatatcatgaatgaccagattatttgtcttgggacaaataatctctagacttctggtctagttccatgttcagatctatacacttgttcatgcagttctgattctgactttctgaccagttggtaatgcccccaggtataagaaaaatctggacattgatcaatcctacagctaaaatttcaaggtatcattcatctggtaggctggaagcgaatcagtagtttttttatctgcagggaaacgataataaaagagtacatatattttttgaggaaaacaagagtatatatatattgcctttggaaaatagaagtgataattacatttttgttaaagaatatcaattgcaagtgataaaacataagacgtgatcagttactaaactatgcatagaactgtctaatccaacacggcctgccgcctgcggtgaagcatggctagttgctgagtgggaacatcccagactaatttctgcagcagattattggttaatacctacaataaatgaagagatggagcattcttgtttttatatttccagagcacgctcagcatgaccatgtaattcatactgtctggatggaatttgcaggcacagggccattctgaattggtcgaggctctccgccatcagctagcacgttcgacactcccatggatatcctgggaactgccaattctaacttcatggaggtgtatatcaaccacaatgcaacccatgctgttctgtgcttgattagattcttcatgtgcatcgtttcgaccacccacatcaggactttgcacatcagaatctctaatttgggtgtaattggcaagaattgacatggagaacctaatcatcagcatgagagttgagatacacccagtgatgataaaaagaccagagaaactccgcaaagtgagaggtgccgaatctgtgttgggaattgcattacttggagagacagcctctgcaccaaaccatttcgtttccatacgtgacccctcatccccacttgttacatccaacatggcagttgaaagattatgcaccagtggaaaaccaggaggaaacacctgaaggggaacaaaaaaagaaaaaaacatgatcatgccagttaggccagaaaattttgtccagaatgtagcatagctcttaaaggatgatgagtgaattaagcgaagcaatagagcaagaggcttacaaaaccaaaaccgggagtcttatatatgcgcttaagcatctggaattctttctggtaatgagggtctgagacaatagcggttaaatatgggatctcatcaacgatagcagacacacctccattcttggaccccttcctcaaagcttcagcatattcctgtttctttgtgtaggatcttagccttctttcactgaaacctcgtcttgtcaaaaatgagttcacaaaggatccctcttggtatccaacataatcaccattattcaggagctggtcaagatatgtcactgagggcttgaacctctttacagttagaatggatgaaaagctagcagtgtagctctgcacaagaaccagcaccacgaagcaccagattaccacaacgatttttgacaaaggacttttaataatttgacctgtgcatagtataacagagatagtaggttattgaagaagtactatgagaaaatagttaaacctcttaatactgcataaatatagcctactagttgagcctctaagtactaaccatgagaaaatgtcaaagtggagaaagcaaaatagagagcagtgctcaactgccttgtgttcgatccttggtactccatgtttctgggatgttcgattatccaaattactaaggcggtgaatagaaagaagatcacagtggcaaaccaaagttcttttgtcagtggcttcaagaatacccattcgattttttattcagattcattctccgcaagcacaagcattgaaacaccagactcggtgtacggcattgtaaactccacatggctagctcgatcagcaattatggttatatcccccactgctgcatcgttgatctggtagcaagaaccagaagatatataatattagtacttgattatataacaatgtcattaaaacagagggagtaaggcttacccctgaagatacactctgtactagctcgtcataagaacggtcgaagacaacaaactcataaatcagacggtatggtaacttattcacggcagcctcgaagagatcaatgcagtagccagtgacaccttggtcagttacattcacaaaagctctaaagccatgtttcagtggcacagcaatcttgagtttcttatgataaacttcaggcaaacctcctaagttcctcctcacaacagcatttatcctctcggtttctgaatcagggaccaaaaaaaaaaggttagttcgtgtcaattgtcaatccaatattctcatgtcctatgagcaaaaatgaacttcactgcacaacaacaacaataattctttgcatatatttgcccatttctgttacaataattctttgcatatatttgcacatttctgttaggcgcatttcataggagaagtcaagtacatatggaaaattaaaacatttccatttttccctcctccactatatttttatggatacttgtaaaattccgtgtactgcttgtttgattctacgatactgccatcgcaataaccattcacaaacttggcccacataagataagaaaattttaaataaaaaaaaactaagaattcgtggagtgaacaagtcaggatgaactccccgcaaacttttaataataaaaaaatcctcaaaaaagaattaagatgaacagcgaacgtcctcaacttagatggacggatggatatgggatccacggcctttaggggttgggtgccgaggagacacctacaggaaggtagctctgattcagacggtgtagttggtgtggggaggtggggatgactttgcatgtcaaattttagcccaacataaaaaaaatactctcaaattccgtgcaggtggaattatccacgatcataaatatatccttctaccagatgagtgttatcacaacaaatatgctactacaatttgtaagtaagtatgtagagtgctagacaataaattcatagccaacattgtcaaaatataccttcattatgcataaaattttggggcaattgtgtttttgaccttgttttaaagcctaactcccaatttaaccctgttttcttaagtttgctcatttgaccctcttttttaaaaatgaagatcacacttgaccctattacgagaaggcaacataacggtgttaacctgtaataaaaatatcatttatgcccttgctcatttgaccctactttatcaaaagtttttatttatttacccgattttgacaaaggtttgacaaattaatttgtcttagatttgacgaattttgataattaaaggtttgacaaacgtaaattaaaggaaacttgcagacaaatgtgagacacaagctagtgaattaacaggaacttggcaaagctttaatttgcacttcacgtacgtaaaccagataaacagatatctcaccatacagagagttaatcgcaaggacatagcattgtcgcataattcagaaaatctcgttggataagaaggttcagaaaataattaattctttcaaacgagattagcaacacatccatccagccggcgcatggagatgatgggcgcgcaggagaggatgaaatgaagcagcagaggctaaccataccggagggcaagacatggcacggcacaggggcgtacgtgatggaggcggcaggggcaggcaggtatggcgcgtcgtcgtccctccctccgccgcgcgccagcctccgtcgtccctccgcgacggacggccgagaccgtagccgtgcgccctctgcgcgccgcctccgccgaaagcgcgcttgcagctagctagccgcgccgccgagaaggccgagatgagtgtggaccacgggatgaggaattttggggatagggttgaggggcattttgaccagtttgagctataaaatactccctctgtttccaaatatttggtatagttgacatttttagtatatgtttgaccattcgtcttattcaaaaatttttgtcaaatatataaaactatatgtatacgtataagtatatttaacaatgaaccaaatgatacgaaaagaattaataattacttaaattttttaataatacaaacggtcaaacatatttaaaaaaagtcaacggcgtcaaaaatttagaaactgatgaaatattttattattattattttttaagtgaaatcctaacggtgtacaccctccgtcccataaaaaaccaacttctgtagataaacctggacaagcatgtgtccaagtacatctcagaagttatctttttttttgggacggagggagtagggagatataggtcaaacggtagcttcgattttaaaaagtagggtgaaatagtcaaagttaaaaaaataagtatgaaatagtcaaaattaaaaaagtaagtcagattagtagttaagatctagaacatgatcaaataagcaattgtccctaaaatttttagctacgtatctcaatatattgtgatagaattataacgtatagttatataaataactagctgggtggcccgcgcaattgcgcggctagcacccaaacaaaatcatatatttttagtatgattttacttaaatattattaaatagataccttgttgtcttaagattttgaaagaccaaaccttatcacccccgtatttctaattaaatagtttttaaaaatcacaccagttactatcccttacttttgtcatatcttacttttgtcatatccttctttatttgtttgctcaatctatcccgggcgggggagtgatgtgggctgaagagaagggagagggagggggaggagaagaggacttgggaggacttgggaggaagaagggaggactttggaccacatttgacctaaagagagggagaggattatttttgcgttttttattttaataaatatggaattggtttttgttgttttaaaataatttcttatgctcttatacatgtttgattatgtcttctagtatttaacagtaacttttacccgtagggaagtatgggcattttgctattgagttaataaattaaaacccgttagataattacgagaagaagctagcttgatttagggctgaaaaattctttccgtcgaagaattcagggacgttcttacttatgttgtcaatgctcaggcctacactcgcttaatttatggcctgatacatctccatgtagagactgaattcagttcccatcatcgaaaaaaaaaagaaaagaaagaggtcaacgtcttgtgagcaaaccaaaatgattttcttgtgagcaaaccaaaaagaaaacagagagtatacctgtcaagccttgttatctagctaattaaggatacattacacatttattataaccagtagcctattgacattgctaagtattcaaccatgaatataacttaggtctctcacggtccggttaatcttatcgcacgcaataaagaacaatttttcgggaacgcgtaaaaaaaaaacagttcggttcattactttaattactgcccctttcgtactaaaataaacaaacacatctcacggcgagcaccgactcactcaacccttttatcggcaaggcgctcctggtctgaactgatatgacagtgtgacactgacatactctagtaaacgcttgtttattttagtactgtccagaagaaacattataccattctcatgcaacatgtcaaatcatctagctgaaaaccatagcaaaacaggctttttactagtagaaatactagaaaccatcgtaaaattgcttcctggttatctgcaatggaaatccaggacttcttcagagctgcactccaatgaactgggagacactgacttgaatcaagtctggaggagtgcatatgcatatgcacgagagtcttacttgtatgatgtcactagtagctacgctttctaacttttaactgcagagaaatgtctctttcttttctaccttgtgttgtgtgattcaatgtagcatagatactagcacagaagcttcattttaggccgataattccttctctcgaagaattcagggctctttaacgttgtcaacgttcaggtcacaatcagcctcgcaagttcaggtctacagtcttgcaacctaaacaagctggttttcttcattctgattctggaagtaagaaaaacagagggcatacttgtcaagcctacccggatttaatgtgttggcaacttttttgacaagtcgacaagcacaattgcaacacctaaacaccttgcggtgatatagagtctctaaccacctcgatctagccaaagggccaaatcaagatgggttttgcaaaaagaaaagctaaaccggctagcggagccgatttagagatcaaaatcagcctctaggccgatttagatcgatatgaggataactacccgtcttgtgggcaaaacggaaggttttcaggacaaacctacaaagaggtgtcacactctcgcagcggcggcggatggtttacggcgcaaaccgataaagatggactaaaactagggtaaaatagaaaacatagtaaaagaacgattcaagtagattgtattcgggggttttacaatgaaccggccttatcctttaaataggggttggtcttaccctctacaggctcttctccacgtccaactcgggatagaaaccaaaggaaatacgaaacatgccttcccgagcaaggaaacccgagacccgatgaaaacagactcggactcggaccctgacggtctgactgcccacatatctgcggtcagaacggccctactagccggtcagaccgcccacacacctgtggtctgaccggtcctatgaaggaaacccgtcactttccaaactttgtcaatttttccctatttcgtccataggtgccaaatttgggtgtaaacataatgttcaacaataaaagacgataacatctgctttaacatctagggcgtgtttagttcacaccgaaattggaaatttgattgaaattggaacgatgtgatggaaaagttagaagtttgtgtacgtaggaaaattttgatatgatagaaaagttggaagtttgaagaaatattttggaactaaatagtagaggtgaaaacggtacggaaacggacagaaacgacctttatcgtttcgttttcatatttttttcggaattgaaatcggaatcggaaacccccggaaacaaaaacggaaacgaatattatcgaaaccgaaaacggagcgaaaacgaaccggcgcggatacggtaacaaaaatttatcggaatacacaaacccctcaaactgagggtcaaactttgtcaagtccaaatctcaagtctcaacattcaacaatacatcacaaaacacaaccatatcaaatccaattgtttctctcagcagtaccatcataaacacaatctatgcagtctgtaacttcatatttgcataacaaatattgcatggagttgcataacttcaacaagcaacaacagcaagtcagccatagtacatagttcatcacaaaacattgctgagaattacatagttcagcaatagtagaagtataaagtcagccactatataaacatatgttagtaaaacaagcacaaaccagggacaccaaggcacaaaaatttcgctccaggttctccattcaccagtcaccaccactccaccagtggggcttgagtcggcggcggtgacgaggacggcgcgagacggtggtgcccgggacgacgcaagacgtcgggggcggggacggggacggcgagcgactacacgagacgcggtggccgggacggcgcgagacgttgggggcggggatggcgagcaacggcggggtcgaggacggcgcgagacggcggtggcgactggcgaggacgaagcgtagggggcgatggccgggacggcgcgagacgagctgacggcggtggcacgagacggcgacggcgtgaggggacggcggccggcagcgccagatctggcgcgtggtgtcgctgccgccactgcaaatcctcacccggcggctgtgtctctcactctctcggctagttagtggccggctagacagtggagtagtacactagttactagtgtgttgcagtgttgggctgggctagtgactactgctagtactagtgtgttgggctggccggttggacacaggaggttttatggactttgtaatgtcggaaattccgagaaagttttcggaaagtttccgaccgattccgagtaccgtcgaaaactgctattattattttcgattccgttttcgaaaaattccgaaaaaattccgaccggctgattccgttttcgaaaaccagtccggaatccggaaatattccgtaccgttttcacccctactaaacagggccctagtaaaaccatctgaattgatatcaacttgtatctgcattggtgaatctatctgacactgacaagtttcaaagttcactgtcggtccagttctctgtctcactaaggctgtgtttagttggatccaatgtttggattttggttaaaattgaagatgatgtgattgaaaaattgtgtgtgtatgacatgttgatgtgatggaaaaagactgaaatttggattcaaactttggatctaaacacagcctaagatcatttacaatgcaagacgaggcgtgtggcaatgtagagccacgtaggcggagtgcatacgtggaagagaggaaggggtggggctcccatgacttgagctggttcgcgtagcctcgtttggctccgataacctcatcgaaagaaaccagcttttgtcagaagaatcgtgggaaaaacaagagaggaagggtagagactcgaaggaggaggacgaggcggcggcagcagggttcatcgccagagacggcgaggaagcggcggccagggcgtcggcgaggaaaccacgaccacggccatcctcacgccgcgccccgacgagccgcaccgttgtccacgtcgccgcagtgaaggatgagatggcgcaacaaaagctccggtacagagcaatttcagataataaatgcattcactaattaaaatatctacataactagtacataccaaaccaaattaatgccctatttggactgcaaaaaaaattcagatacagctattcaggccctgcaaaaatcagttcctagctgcatcccaaacaaggccgaaatgctctctgtttttgcaatttcaaaggggtactgtacataagtatatatcatccagtgttcatgagttcatctgcatctgatatgatgttcaggcatagggccattgtgcatgccattctgcattattggatgaggcctttcatcaccaccctgaaacccatcgtttccaactttttggacagcttgatcaggtgcagggttgctgtcaatgacaatatgaagtggccttgattcttcagtggcagtgctactagtactgcctccatgctccacatcatgaacatgagcttcgatcaattttacggtccttgagatgagaaagtatcttgaggtatctaaattttacagtaaaatttttggtatcttgagatactttggtacctagaggtatcaaattttgcactagaaaatataataactctaggtactttctcaaggatggtaaaattaccctactaattacacaaaaacttgttgaattcctccatggatgcaccgtgcacatctgaaaattttcagttgagtggtgtacagtaattcccagaagaaaaaagtgaggtgattagtactactggttgctaaatccatggggttacaccggctaatagttactgttgacagtacaaacatcaaaagtttaataacatgttaaatacattggtttctagcaaaatatatgttggttattttcaaagcatataggtttaggttaaaaaaagagtctagtcagttataactgctaaccaagttagtttcaaaaatcattagtaacttctatgaacgagggagtacatcctaactgctgagaaatttctctcttgctacgtagcttgtgtgatccgatgcgtcatagataattacgcagaaggttgattttgggtttgaaaattccttccctcgaagaattcagggttctgcacatttcgctatttagagctgtcaatgtttaggtctacaatcagtatatcttccaagcgaagcaacctgactttcttgcaagcagaaaagagtggacacacgtactgattccctgattcaggctgtgtttagttcacgcgaaaattgaaagtttggttgaaattggaacaatgtgacggaaaagtttgaagtttatgtgtgtagaaaagttttgatgtgatggaaaagttggaagttcgaagaaaaactttggatctaaacacggtgtcaaatgatcaacaagaaaagttagcattgcttcaacttatcacagcctgtatctgcattggggaatctcatctgacaagtcacaaagttcatcatcggttcatgtttttatctcagtaactggtaatttacacaatattttacatatttacatcgacgcaataaaaccgtcaaaacagaacaactctagatggtgaataaacccactaaaatatctactcctacataactatatccaaccaaattaaggccctaatttggattgcaaaaacattcagatacaactattcagaccctgcaaaatcaggaaaaattcccgggtcccaaaacaaagcccaaatgctatctgattttttgcaatttcaaaggggtactgtacataaccacgctgacacatatcatccagtgttcatctccatctgaggatgatgttcaggtaccgggccattgatgcaattctgcactggatgatgcctttcattgccaacacttgcctgcatcagttgggcatcctgacacccatcatttgcaacttcttggacagcttgatcaggttcagggttgctgtcaacaacaatctgaagtggtcttgattgttcagtggaactgctactagtactgcctccatgctccacatcatgaacacgagcttcctttgcgcatttggcgcaaattaccctattcacaacgcttatcaggagcatcagagcagagatgcagccactgatgatgaagaggccagagaaactttggagtgtgagagggtttgagtcactgctgctgctgctgctgctagggtttgcatcacctcctgtggactgttcagatgagccaaaccacttctcttcaatttttgaaccttcagtctctcctgtaaggttcaagatagctgtagagagatcatgcaccagtggagaacctagaggaaatacctgaatacaaaaacatgatgcaaactaattagacaaaaaagaacatattgaatttctccatgtaagcaccacacatctgaatgtttttcgagaacacgcaaaaactttgcgcgatatactaattgtcaaaaagaaaagaaaattgaagaattctgaatctaccaaagtgaacaagattgagaagcttacaaaaccaaatccgggggtcttgtagaatcgattaaccatctgaaattctttctgatattgggggttggataaaaaagaagttaaataagggatctcgtcgacgatcgccgacactcctccattcatggacccctttctcagagcttcagcatactccttttgtgttccataagaccttaacctggatggcatgaaccctcgttttttcaggagtgagccaacaaatgatccattttgatatccaacatagtcaccggtaaggaggagctgatccaagcttttcaccgatggtcggagcctctttgcagttagcatggatgacaagcttgccgtgtagctctgcactaggatcagcactacaaagcaccatatcaccacaacaatttttgacaaagggctcttgataatttgacctgtttgaacattgaaagaaaccaagtaaacctctaatgatgcaattacaaaggagcaattttatgatctttggtgaggtaccacaatttccggtatgaaataaccatacccttttatactaaaatactaaaaatatacctaaaggagaccaaaatttacactataaatgtcatacgtctcgttacctttttcaaagtaaaaaaagatctcgttataataactatgtgctttatttatgtttggaaaaaatgtacaacaagctgtactctctccattcatgaataactagcactattgactatacaactgtcttaccttgaccataaattatttttaaatgatcatattgtaatgaatgaaaagttatatggttatatttacgatgcaacacagtccgataatataactcgttttcaagtatttattaagacaagatcagcgatccaaataaaacatgaatactaccggcgtcaaatatttaggaactggaggagtaaaagtagtaactatattaccatgagaaaacgtcagggtggagaaagcaaagtaggaagcagtgctgagctgcctcacacttgatccttggtactccgggtttcttggctgctcaatcatccacacgacgaagccggtgtagaagaagaagccgatggtggcaagccagagatccctggtcagtggcttcacgaaaatccattggattggcttggagtcgttctcctccggcaccagcagcgacacaccggacgacgtgtatggcatcgtgaattccacgaggttttctcggtcggctgtgatggtcacgtcgcccactgctgcgctgaacttctgaagataccataagacagaagatgtatgtcagcgagaattcttagaaatgtcattcaaagggacttggcgtaaattattagtccctgtttgacaattggcacatatatatatttttttaaagctagctatttctagttccagaaatctttatacctaaatatgcgaatatatttatagcaattgaatgagtcattttgtttgtattttataaaaaaatatacaatttcaattcattataatttgactttacaaactctagttttaaactgatttgttttacaatttgtatgctcttatgttgaggctgcgatattatatgatacttcttaattagatttcccaaggaacatacggactttactaattattttctataaaattttcggtaaaattcctcaattacaaatgatatataatgcggttaaatctaatatctcccatataaaagtgaaaaatataaagtgctcttttcctggtaaattggttaagcttatgcctttgatttgttttagttttcttatatttaatataatcagccttgttaggaaaaaataaatgttttagaaacataaaactattgtttttactactatctcaattttaaattaattattgttttagttttgtcttaattccaaatatgtttatctttgaacatcaactgatttctgtaaaatcgtaataatttaccacacatgtgaattatatattatgaaagtattattcaagttaaatctggaaacataaaccttattgtgttaactatattagattttagatttttagaaatattgatagtcaaagaccaaagtttgacttaggactacaaaactagaatgaacaaataacttaaaatggagggagtatagataacataattttataatttttaataaggtaccctggagagctatcatattttttacatgtagtaccaaaaattttacagccccggcatatttgtaaacgaaaattaatttgtgaataaaactttttatatgtgtttttaacaatataaaaacaaaggctgaaaaataaacttcaatgaaaaaaccctaaaatcagttgcaaatttaaggttgagatttcaaattttagctgataaacataagcataagtgaaaagatgaggcccctcgtgtaaaatttaggtatctcaagttaatttcttaaggactaaaaaattcaactaaaaataaacaagttcgtgggagtaattaaggcttacccctgaagatacattgcgtacaagatcatcatacgatccgtcaaagacgtggaactcgtacttccggcgaggccgcactctagccatggcggcgttgaagacgtcgatgcagtatccggtgatgttctgcctcttggtgtccgggtcgattctcacgtcgacgaaagcctggaacccggtcttccgcggcacggcgatccgcagcacctcgcctgatgatgaccttctccccgccaatcgccggcggtcgagacgacgaccagtcggagcgccggcgttgtagcggcggccatggggcggcgagccggcggcgcgccgtgctgatgagaatatggcggtgaggatgccggtgagcgccgccctggctgaagtgtgatcggcgccgaacggcggcgccgtcgccgttgcatggtggggtggatgatgtgatgacggcggaggagcaccgccggagatggggaaggtgaggatggggacgcggtggtggcggcgaaggcgggcaaccacggccgtatccgcctccgtggtgacgatgatggcctgcacctgtgcgttcttgataaggtcttcggctgcatacacaaattaacacagcccatgcacatacctttcgcataagttacacccacaaataagttattaatcaaaatatatgtcgatcgagttagtagctagaaaagatgtaacgggatgtaagaggtaatttttaagatggtactctctccgtcccaagatataacaatttttagtcttcagaatttgtgccaaaatataacaattttttcactaacattttcttcccaaccaatcataaccctccaccgttcacttttctcatctacctccactactcattcaatcacaaacctctaccactcacttctacctactttcttaagaaccgtgtccaacactaaaacttcttatattctgagacagagggagtatcatgttctttagtgtaaaatttgatactttaacatattgtacatcgagatactaaggtttttgcatattttcttgagtactgtgaagtttctctctatatatgatcccttaatttaccaaaccaaaataaattctgaattaactacatagtagcataatactctctccgtttcattttaagtgcaaccatgagtttccgcgctcaactttgatcgtccgtctaatttaaattttttttataattagtatgtttgttgttatgagatgataaaacatgaatacttcctccgtcctaaaatataacaacttttagccttaggatttgtcctaaaatataataatttctccaccaacattatcttccaatcaatcacaacccttaacattcactttttccaactagttccactaattatccaatcacaaccatccaccacttacttttacctattttcttaataaccgtgtccaaccctaaaactccttacggagagattaatactttactcgtgacttatgtttttaaattttttcaaaaatttttcaattaaaacaaacgatcaaagttgagcatgaaaatcatggctgcacttagaatgggacggagggagtataagggcagtcccaacccataacactagatatagtttccataaacaccacatcatcaagaaactagtactagacactactcttccaatgcaaacaccactattccatacttcaatttaatgctacttatctcacatgatatcttggatgttgggtagaaaccatgtctcatacaagacatggtttccttctctttcctcatttattcacttgccacatcattttttatcctatgtgacaacttatttaatgctatggacatcatcctagttattgggttgggaatgccctaacataacagtttagaatttagttaggttccttaattagtacatgatgatattcatttatgtgcatcctttatgggagacatgtatgtactgtcaacatgaactttttttataaatgaagttttgtttcgacgcctgcaacgatgcgcttgctactacctcgctcacgttgcaaattttctttgactttacggtggttacacacgcgatttattccagtttggctgtcaccatctgccaacgcggttgtatatatgcagtttaattttctatggtgtactgatatactagtactaaattactactaattaattaacaagtgtgaggggacttgttgggttctgcagggcatattgtatttttggctaggccgtatctgtaaatttgtactgattctaatcacctttagttttatattttgaagagaaatatactactccagctatatatagttttttagaaacactggtttgcaaagaagtttcaatggttttgctgaattgatgtccaagagatgtattcctaagatgggattatatataccataatatatggtcccttatacttataatatactattctatcgctataactcttcaatgacaaaaaagaacttaagagacctggtacaactaattaacatatttgggtttttctacaaggtcgcaattttgaattttcattggtgtgcatgttatcttcaacttacaatcttacacacaagtgaaaaacatcgtgattgcgacattttattacttatttaatttgaaattttctccaaactcattactggttttagagacaaagcctgtgggtcatgatacttctggtcggttccacagtctatttatacacactactaaaaaatcgattttccgacatggcgatatgtgtttttttcccaggcgggcatcgccctcagagacaaaacggccgcctacgatattagcaatcggggccatgctagccgtccatctgcgaagattgttttttgcaggtgaaccatataagatgccgcctgcgaaaactatcttcgcaggcggaccgtatttttgtgacggtattttggcctataggctagctcttgagtctggtagtgactctattgtccgtttttctcactctaatatactgtttatttaagttagcttaatgcatgctatgtctgaaatttgaactacgaaatcaaaaacgaaaaaaagatgcaactattttaccggcgcgtgcagctgcagcaccatcgtctccacgcgagtccctcacccgcagctccaccaccgcggcggagcccggacgatgtcgccgccggtggaagtcctccaccgccatggaaatgccggcgaggctcctcctcccctcgccgctcgtcatgtccaccacgacgcccaccctcaccggcgccggcgacgccgccgccgccgcattccggagagcgagcagcgagaggaaagcagcagcaacagcgagcagacggcgacgctgcctgatccccatgcaatgcgacggcagattaattctcgcacacctttgatcgagtgataaattagttgctgtgtgtacgtgaaaatgcagtgattatatatacacatagctatatatagctgttacagcagtggagaaatttcgtcgaaattttcggtttcgagctgaataggatgacgtttcaccagttcattttcttttacatggggaaagaatgtgtgatggcgttttacaattgttttttacgctggagacatatcactagattttgttagtagttcgtattttgatcaagtcaaattgaatttatatacgtacgatcttatcgatctgttagaaaaaaagatatgataatgtttgcatataacgtagcaactaggggacctgatattatatacgtgttgcgttgcatgtgtgacagctgggaactagaggaaattaaattaaggttcctagtcgaacatttttttaaataatccatttcttggtgtttaatggaacattaactcctataaaacatgacatacacaaaaccacatgatcaacaacttttgaccttaagatcatgttagtaaaaaataacagccattggatctagaagttacttaattaggggtgtccgtgttcggtgttcctatgttgtgctacctgaggactgatgaggtcactgagacccaaaaatttttaatcttttgttgttttaacctatattaagcacattattagcttaaaattagaatattatatatatactatcatatgtataatatttttttgtttgccactctaattacttattatctatttaattcaatcattaattagtcatccttttatcccccgcgcttctagcaacatagtgcatataagcatattaatgcataaatagcactaccttttccatcgtaatctttcttcatacggctatgattttttttgggttaattctcagagtactaagtgcgctaactataatttagtttatatatttttcacaatagatccaaatttattagcatgggaatgatgaatggtaaatgtctttcctttctaacaacctaactcaactggagcaagcacctaaaaatatgccactccatctctccattaattattaaatttttaaagtttttagaaagagttccaagatgtacttaaatcatcgcaaatatcgatcccacacgtaatatataaatatattttgaaactaatattttctattttaccaaaaagaagtttcgcagcaacgcacagattctcactggttatacttaatttgctcaaccacacccaagaacagtaccatgcatgttgcgtgagttcatgaaaggacggcaaattattttcaagaaagaagattttcaagaaagaagccagagggaactagctagcgtggaattcttacaaaatccctcatatataaatatgattatatttgtcctgatctgtggtcattgccttgcagcatcgctgtcattttcagaataacatacgacataatgtacaagaataaattactaaactataggatttaatgaccggacacaaacatttatttaccgacgaactgttagtattttctcccttgatgatagtatttcaaacccgccattctaaaaagtttccccgaaattgcaccatatgcaagaggaatgttttgaatattctcaccacgtacgatttttataatagatccaatgtattgggtttttttacaaccaataagaaaatggattattgctctagctaacaatctgatccaagactccaagcaatttagtactataaaaacgaaagaaagaagtttcttggaaatgtcaaataattggaagaactgttttatatactcttattctagttccgaaatatatccagtaatgtcaactatgaagctaaaataaaaacgttccacatctcattggtcaatctgatctgaccgtgacaggttccacatctcatgatctgtcattcaatctctctcccccagtttgattttatctgtctataatattgatcaagattcgaactgtcaaagaatagcaagaagtaatcagaattcagcagtctgtcttccctgaaacttttcttcataaccaagtcttggttttcataggtgactgactgaatgcatgacttcgcaggcactggacatgtgtgtgcaatttctcagaatctctagacttctggtctatagttccatggtcaggtctatagacttgttcttgcagttctgattctgactttctgaccagtttgtgatgcccccaggtacatatatatagtaagaaaaatctgggtattgatcaatcctacagttaaaatttcaaggtatcattcatctggtaggctggaagcaaatcagtagttttttttatctgcagagaaataataatacaagagtagatatattttttggggggggggaaacaagagtatatatattgcctttggaaagtagaagtgacaattacatttttgttaaagaatatcaattgcaagtgataaaacataagacgtgatcagttactaaactatgcatagaactatctaatcaacacggcctgcggtgaagcatggctagttgctgaatgggaacatcccagactaatttctgcagcagattattggttaatacctacaataaatgaagagatggagcattcttgtttttatatttccagagcacgctcagcatgaccatgtaattcatactgtctgggtggaatttgtaggcacagggccattctgaattggtcgaggcttttcgccatcagcacgttcgacacttccatggatatcctgggaact

SEQ ID NO: 60022 - DNA, 68532 bp, Oryza sativa
gatttcatcggaatataattaatgtagcatgggagaatgtgtgcatgctaagggtgtaattggcatggtgttttaatcgatatatacattgtgggagaatgtgtgcatgatgtcttgattgatgtgatttaaattatcattggccttggcgtataaacatatatgatgatcaatttgggatggaaggagtaatgaacaatgaatcccagttctagccaggcaaaatattcttagaatcatagaaatggatggggtattacatcttcgattaaatttcacaaaactacagatactatgaccaaattatcacaaaactacatatttaactcagtgtatcacaaaactacacatttaacatcaaatttatcataaaactacacatttaagatgaagtgtcacaaaacacatgtttagtaactaaattatcataaaactacgggtttagaaccaatttaatcacaaagtaataatgtttatagctccaccataacaatggtgctagggatttaaactccaaaagttgtagttttgtgataagttcaatattaaatatgcatttttgtgatacttaacctaaaatctgcagttttgtgataaatttggtactaaatgtgtagttttatgatataactccttaaatctgtagttttgtgataatttggtcaaaatacctgtagttttgtgaaatttactctacatcttctgataaaaaaaacacatgttaaaacatggcctgccctgctatcattttttttcttctgttactagttcctgccaagatttcattcaagtgacagtatatctgctggaacttgacctctctcattttcaccctctctgctagttgtatgggggcattaaaacattcacagtggtgctgttttatcttcattctcgaatgtgactaatttcgtttatacttatgtgtatgaaataacttggtgtgtgttcctattgcagttgcaagcttggtgaaggtaagataattctctgcgaggaaggcactaagcacaagttgcagaagcttcagcttaactatccaaggttagcttgcaagattgtgtttgccattgaaattggcattacaaggcacctttatgccgactctttacttactgccttttaaagactatcagagtcatcttttgggggaaaattcaatttgaatcatttacatgtttaaattatacatcgtgtgtattgttccctcgtcaacttaactttttgtttgaacgaattaaagcctagaggttctagttttaagacttggcacttagctaccccattattagtgatccacttcggtcattggtggagccttgacgtgagcggagaacttttggttaatctagctggatgaaaacttaatatgcacctcttttatcatgtaaaactgtactgatgattatttttcttgtctggcagtgacgatgtaacttttgccctgaaggaatccccagatattccatggttgtccaagtacctgtgaagtttacacttgcagcggttgtactttcccagcatttcattcatctactcctggagttggagagcaacgatcgcaactacttgcccttgatcagcagtaagtttgaacatgttcccttgttcattttttcgtacctttgcagaagtttgaaggccatctagtattttcttgtcatgaaccatactccacactggagcatgcaacactaacaagcctagcgcatcttctgcagaatctcggaatttatgtgggtccaattgttcatcttccaaaagatatcgactcgaaggatgccgctgcaacaaaatgtaaatgcagtgtcgcaccaggactgtaacatatgtatgattcgaaggagattgtaggtcgccattttattttcgccaatctgttgttacccaagaaactttgctctggcagtgttgttttctcttgcatccctctgttacgtactcccttcgttccaaaaaaagacaaaccctggtttccgtgtccaacgtttgaccgtccgtcttatttgaaaaaattatgaaaaaaattaaaaagacaagtcacgcataaaatattaatcatgttttaccatctaacaacaatgaaaatacgaattataaaaattttcatataagacggacagtcaaagttggacacgaaaactcagggtaaaactcagggtttgtctttttttttttacggagggagtacgtgcgagctgattgtactactgcacatttgtaactggttacctacaaatcatcatcaaattatctgttgtgaaacattgacaaatgtatgatggattgatgatatctgttaaaacattgacaaattatctctttttcgcttgtgaattcccgtgggatattaatctctcgtttggaattcacgcgggctctctcttcttcgttttatagcttggacccatcgccttcctctcgccgccggcgagcccattaccaatggcgaacgcgagtgcaacgcccaagacccctcgccgccgccgccgcgtcacgttcctggctaggacttgccaccgcctcctccgcttgctcgccactcaccgcctccgccgcggtggccatggccttaactccatcagcgccggtgacgactcccctccctccggtcagccgccgcgaggccgggacgcggaggaagccgaagcgacccaggcggcggcggcggcgcaacggcggcacgaggagcgacacggcgacgacgacgccgccgccaccgaggaggcggaggcggccgtggcggggaagtactgggcgcagcggcgcagcctcttctccctctacgaccgcggcgtgcggatggacgcggagggctggtactccgccaccccggagcccatcgccgccgcgcaggccgcccgcgcgccgccgggatccctcgtcctcgacgccttcgccggcgtcggcggcaactccatccagttcgccgccaggcacgccgccgccaccacctccatctctctccatttgcaacctcgctcgctaaccaccccgtctcccctgcaggggttgctacgtggtcgccgtggagatcgacccccggaaggtggagctcgcggcgcacaacgccaggatctacggcgtcgacgacatgatcgagttcgtcgtcgccgatttcttccacctcgcgccctccttgaaggtatgctcatccctttactcaatgatactgaaaaagaaacaaaaaaaaatgaagcgtcaatgcttcgcatttaggttcaactcctaaatttagtttcaggagttaagtttgaaatggagttctgaagcggcctaaacccagctctatctccctagtttaatttgtgagaaagcttcacccggcttggctcctattttaggtgaagctgaaactgttcgactgagagctatgccaaacatgccataaatgacgaaacttgagcagagctccagttcgtttattttctcctctaatttatttactctagttgtaaacttgcaataacgttcggatgtgcgtttctgaatttcaagctggatcaaagttttttttaaaaaaaatggattctgattgttcttgttgcattgatcaggcagatttggtgttcctttcaccgccatggggagggccatcctacagccaagctcaagtttactcccttgatatgctgaagccaagagatgggtatgttgttttttttttttgccgatttcctgtcatatccacaatatgaaaaataatgtgtttaatcatgcagatttacaattttccaagctgctcaggaaatatctccaaatatcatcatgttcctgccacggaatgtggacttaagccaagtagagcaactttcttggttgtcttctccccccttggattttgtggtacgatctgtttcataacctttttcttttttttcatcgagcatttaaaactttcaatatgtgaaaaaattgacatggtattcctgttgttttatagagcgaagagaattacatagaacatagattcaaagggataaccgcctactttggaggtttggcacaagaagttctgaagcaaggataaatttctttctaaggtttcaatgtctagcttcccctgaaattctggtctaatatcttgcaaatgccccttagttggtgtctcaacgcaagagaagctaaggcttgatggtagcccaacgtttttatttgattcagtatatggaaggtatatcccatatttttggttcactacaaggtctcaactgtgtcggtggcgtggtgggagatttggtattgtgctgctccacaaatttggcttcgattatttggcattctggccttttagcaaattgctaccatcattgtcaagattgcccctaactccacatgcagcgaagcagtcctatctcgtcaatgctaaatttagaaaatctataagcaaccccaatttactggagaaaaatacatagagggaaaaccaccatcactgcttccattcccttcagcaacaaagaaatagttcttttgggagatggatttttgtccctagagagaatgtccaatgtcgtctaaaaagtcattaaaagagctttaaaaaaatttggtaagatagaacttttaaatttgacttgtacaattagaattttacaaaaacaataaaattaccgtgaattacgtgttctatttgaagtcaaatttattatttttgtttctgaattgaccatgagtttattattatacagagtcaaatctattgtttttgttttcagagtcaaattgaccgtgaattatgtgttctatttgaaacctgtatgtttatggtgtggtaccatttttattattttttgtgcgacctaaaaaaaccccaagggaatggcccctcgagggataaataaactttcccattcttttgtcaatgtaaactttagaaaacctataaacaacctaatttacatgacaaaaatacaacaagggaaaaaaaattaacaaaagaatcaattcctccttccatccccacaaaccccccaacaacaaaaaaaacaaaaatgttcaacacatatttatatattcactaatgctaactatactaacaatttatataatcgtcatcacaagcggctcctgaatgcgtgagttcctctgttgtagccgtagtaggagaggtaccaccggacgaacttcttgagccccatctcgaggctggtcgtcggcttgtacccgagctgctccctcgccaggctgatgttggcgtgggtgaagggcacgtcgccattgccgggcatctcgacgacgtgcctcctcgccttcaccatcaggcacctctccagcatcgccaccagcgccggcaccgtcaccggcgacgtgttcccgaggttgaagatcctgtacggcgccgccccgcgcttcctcccgcccccgcccgtgctccgcccagccgtgtccagcgccgccaggcacccccgcacgatgtcgtcgatgtaggtgaagtccctggtgttggaatataaagtgaattgtccatcttttctcaccagctcaagcttttgagttgaactagtcggtgcatgcaactcaatatggtatcagggttggaaatttcggaacgaaattttcgaaatttgatcatttcagacccctccgatacgatattatttcagctgaaatttttaaatttctacgtgaaattttggtaatatttgctcaaattcaactaaattttgttcaaaatttcggaccgaaattgaccgaaaatttcagcatttcggtgaggcccgatcaaatcggcctaaccgataggatcaaccctgactggctgactcaatatggtatcaaaagttagaggtcttgagttcgaattctggctgaattgcagcccacttctattccatgcaacttaatacctggcgatgtcgacgtgatcacggccccggtagacggtgaccggcttcccctgcaggatgttgcgggtgaagaagaagtaggccatgtcggggcggccccagggaccgtacaccgtgaagaagcggaggccggtgatggagaggccgtagatgtggttgtaggtgtgggtgatggcctcgccggctttcttggtggcggcgtagagcgacgccggcttgtcggtgcggtgcgcctcggagaaggggacggcgtcgttgagaccgtagacggaggaggaggaggcccagacgacggccggctgcgggtcggcgtccttgcaggactcgaggagggagacgaggccggcgacgttggagcggacgtacgacgaggggttctccatggcgtagcggacgccggcctgcgcggcgaggtggaggacgtgggtgaaggggacgacgtcgaacagcttggcgaggaggcggccgtcgttgatgtcgccgtcgacgacgaacacgccgtgcgagcccaggagggcgcgccgcgccttcttcagcgacgggtcgtagtaggagttgtagttgtcgatgccgacgacgccgtcgccgcgcttgcggagggcgagggagcagtgcgcgccgacgaacccggcggcgccggtgaccagcacggacagcccggcgccctccgccgacccgggcggccgccgcggcgacgccgacgccctgatctgccgctcccagtgcagcccgccccacgacgccgccgggaagtagcgcgacgacgacgccgcggcgtcgccggcgagggagcggaagctcaggtacgtcgccgtcatcgccaccaggaacagcgcccacaggaacatggtccccgtcgacgcgaagcaccggtgaacctgccggctcatcgccgccgacgaccgctgctccaccttcaccttccccggcgtcgacgggtacatcacctcggcctcctcctcctccaccaccacccgcatcctcctcctcctcctcctcctcctctcctcacgcaaccaaacaacacaccatcgattcagctcgaacgagatcaaatatttttgagttccgttgctcgaaaaagaattagaattttgagttcttgctgaattttggtggttttgttgttctgagaaatgatttttttttgttttctttaatttttttggccgtgggaaatgggcgggagggattagtggagcgtgcgaaggatgttgcataaatagcggtggttttgtgttcggaggctcggcgatgatggtgggggtccctgtaatttagcactgtttatttttaggccatatggtataacatttgaggatgttttgaaaatggcaggaccatcatccattgaatgcattagggcatctacaaaggtagagtcagatatgagctctacgttatctggagactagcatcctacaacagttagagacaatatggtctcaactttttcttacttttattttctttctttcaccaccatgcaacaaaatttgctctaataaatgctaagagtcgactctgagctgttgtcatgcataacaaccatactcctttctctttcttccatgtcatcaaacttacttgcatggcaatagagagagaccactaataaacaccgttgtacatgcccttatgcatgagatttgcgaagaaatagggaacatatgtatcgaggtttgtctagcattttaatcctttccttatgccattaggccaataccatatgccattagttggtttcagttttgtagtataacctaaacaaaacccactatatttagacttggtgccaatgcaatgatgtactccatccgtcccaaaaaaaggcaaactctgggtttccgtgtccaactttgactatccgtcttatatgaaatttttttataattcgtattttcattgttgttagatgataaaacatgattaatattttatgcgtgacttgtctttttaatttttttcataattttttcaaataagacggacggtcaaacgttggacacggaaaccagggtttgtctttttttgggacggaggtagtacctattatcatgtcatgcgctgaaaagtgtagtctgccgtttccgagcatccgagtgcctctcttttagcacatcaaaatgtgatggaggctagaacaaatttataaaaccgttgaacttagtttttttacttgatatatgtgttaagaaacttagagcttgaccaatgaagacatgaaccaaatatatttattgggtccatcaccaaacttttcatatatggatttgcactactgtccaaagaggagaggaattactcatttgtatacttgatgaaaggattggaataagagaaaataatctcacctctaaattttgtatctccactttgctcttaaattatacaaccgtgttgtactactctctatattatcaagcacgaagctataagggagaccaaggtagaagaaggaagagaaatctcttatacgatttgcactttaagaattggactaagggtgtgtttagttcacgcaaaaattgaaaatttggttgaaattggaatgatgtgatggaaaagttggaagtttgtgtgtgtaggaaagttttgatgtgataaaaaagttgaaagtttgaagaaaaagtttggaactaaactcggcctaaaaaatgaatttcttgtatcctccttgtttcgttttggtgccttctgacgactagccgattcgattcaccggcgactagccgattggggttttgggtgtgctccatggtaaacaagaagtcgatgttgcatgtatggagcagagacgacgtcggaccgtgccatcgaacgatcaggccatacatgacggtggaaatccaacccaacccaaatgcaacggtagaaaaactgtactgtacacctctccgtgctcagcagcatcgaggagtggacaagatgagcccgggcgtcctcctcatcatcgccatcctggacgtcgttttttttttaaatgagggtaaaagctttgcctcgtatattaatagagatggagaaaaaacaaaacaaaattagaaagggaaatatttacagggcaagccaaaagagctaaacccgcaagaattggccaagagactaagtgatatctccaaaaattccaaactcttgaagctttgaggctccagccttgacccaggctcgagcctcctccttgatcttggcgatgatggaagccggcgttaaggtggtgtttcggaagattattgcgtttcgttcgcaccaaacttcccatgaaaccaagatcaccagtgctcacaaaggaaagcggggggtgttaggagtgtctaccactacgttccaccattgctccaccgagtcgcagtccaccgagtcgtcttcttcctcttcggcattctcaacctgctggtgcagaatctcctcagacagacttcagagttcaaaccaaattggccctaaattttcggcatatcgagtggtgtgctctgacgctcagactccgcttgttttacacacaggggttcagactttcagttgcccctctgcagcaacagccaacaagcccacccttgcagaagctttgtcgctaggaatctagtttctgaacttttggaaattcggaatgtcgtcgagatgaacaacacatctgcaatctcacctccctcttgcagagttttagtgttctccattttttatttttgcccttgtctagatccacatgtaccaaatctagaacatgaacttcaatctgagtatccagtaaaacctatgacatggaccctagccaaattattcatgcttttaccaaatttcgagtagacttcaaaccgaaccacactaaattttgagaaaattgcatatctatcattgcataagttaggattcgctcaactactatcacttaaatgggcttagctagaataccataattaaccaatgtgtatttgctaaaatactatcccggacagaaataccctggatcttcttcttcatccctccctccaatgactgaataggtcgccagtggccaccgccggctccactgccgcgccatcgctcacgtcgtctgggctgggcaccgttgcgcatcgccgccccaccctgactcgccggctgacgacaacctcgccccgacaccttgctgccaccggcaattagggcgttgccctccctaccatcggtccatcctggtatgtgtcggcgaggcagcacctgtgaagccggcggtggccgccagcaacctcttcaagcatgggagggaagaagatgagctaggggcatttcatttctagatagtattttagtaatgatcgattgtggatggtattctagcgaagtccattttgaataattgtatttttatccagtagatatgcaattttctcctaaacttttggcctatctggacgtgtcaggggatggggtgacacattgatgaatggtgtgttctgactctgcttgttttacgcaggattcagattttcgttgctcccatgcaacaacaagcccacccttgcagaggtttgtcgctagggaatctgcaaaatttgtttctgaacttttggaaatccggaatgtcgtcgagatgaacaatacacctgcaatctgcagtatcagtatgctccctcttgcagagttctccaatttttttttactgacatcgtagtttgatactctgtgcaaccataagtttacgtgaccaactttaattgtacgtattatttaattttttttataattagtatttttgttgttatgagataataaaacatgaataatactttatgtgtgacttatgttttaaagttttttcaaaaaaaaaattaaataagaaggacgattaaaattgagcacggaaaaatatggctgcaattaatatatagccgcaatcagtagtttcattgcattgcgtacatcagcatgacgtcatcacctaccatctcttcttctctacgacgtcgcctcgtataacaacaagctcttcttcttctcgtgttaccatttgtgacaacaatggacacgtcggcgtccacctcgccgccgccgccgcgctctgtgctcagcaccatcgaggacaagatgagcccgggcgtcctcctcatcatcgccatcctcgccgtcgtcttcttcctcttcggcttgctcaacctgctgatccagaacctgctccggatgcgccgggcgcggcggcggcggcggcgcgtgggcgacggcggcggcggcgtcggcatgggcagcccgacggcgttccagggccagctccagcagctgttccacctccacgacgccggcgtcgaccagaccttcatcgacgcgctccccgtcttcgtctaccgcgccgtcgtcggcgccgggctccgcaaggacgacccgttcgactgcgccgtgtgcctgtgcgagttcgccggcgacgacaagctccgcctcctcccgacgtgcggccacgcgttccacgtgccctgcatcgacgcctggctgctgtcgcactccacgtgccccatctgccgcggcagcgtcctcgccgccgccgccgccgccgacgacgacgacgactcgtcggcgtccaccccggtagcgcggcgcgtgctcgactcggagagcctcggcgagacgttcgccaacaatggaggtggggacagcgaggggtcttctcccaaggcggcggcggcggaggaggaggaggtcgtcgaggtgaagcttggcaagctcaagtgcatcgacggcaatggcaatgccggcgacctcgccgtcgtcaaaggcaccaccaccagcaacgatggcgacatcggcggcggcggcaggggagatcttggacagagacggtgcttctccatgggatcctacgagtacgtcatggacgagcacgccgcgctccgcgtcgccgtcaggacgcccaagcggaggccgccggcgaggtcgaggtctcgccgccggctcgcgctgtcggagtgcgacttcgcgggctccgcctccaagaagggcgcgtgggaagcggcggtgatagaggccgcgtcggcggacgccgcggcggcgaggctgaacagggacagcttctccgtgtccaagatctggatgacgtcagccactaggaaggaagatgtccggacggcggcggaattggccggcggagggaggcgtgcggcgtcgttccggtggccggcgatggccgaggccagcaagaagcatggcgggatcaacgacgagcgccgcgacgtcgaggccggcggcaatggcgactcgtctctcgccgacgagcggccgtcgttggcgaggacggcgctgcagtacatcgtcggcggcggcggcggcgggcggcagcagagcagccgagttggaagccattcttgaaccatttggtttgcacattgaacacagaaaaaatgtccccttattttttttcttttcattgattttttccctacttttcttttcttttccaaaatgattatagtgattgcaaagcaacaaatttgtgaagaaaaaagcaattgaagcaactgcatttgtgtgttagtcatggtcatattaattagttaaagagacaaaaggcattcttggtcttcattggtttgaaatatcagattgtagtgtaacataagccaggttgatttgcttttaaagttcagcagaataggaggaacttggaagacactcatgaacaaaagaagcattggttgtttggatttgtcaggttgacagtgatggaattaaatcaaattagcaaaccttataacaaccactgaagattaatatttgtatcatatgtggcaatataatttgtcttatgcatcattttaggatggcacgaaatttttatctgaataaacaagtgcagaacacttggcttagctgtctcaccactgcatctgatctactcctaacttactaagcattcttggtttaaactgaaccaagaactggctaatacagacaaagtgtatacaggcatggcaatgcaactatgcaagtgagagaagtggattctctctaattaatgacataaacaaatcagccagtcaaatccctcattaaagaagctgaacccagtgtctgtttgcataattgctactactactactaagcatttagtgaaagtgctggcaacatttgacttgcaactgcctcatcagggtctggtgtgcatgtggtgagaaggtgagaggaagcttgattatcggagtttcaaatacaaatccatttttcttgccatgttatgcttgatttcatgagctgttcttctgttggagctgagtttctgtttgagtagtggactcgtgtgcaagatagtaatactgcatttacaggctgttgcaacttgcaacagtacaagcacttcgctccttttgtccgcaggctgttgcaacagtacagatgtgcaatactacttcactgtgatgtaggtgcacaaatttataagagtttaaataccaaccttgatgatgctgcggcaccgtcagatttttgtctgtttagtcgtcaggtaatatttttggcagatcaacaatttcattgtagcatggatggaatgaaattggatctccctattaaagaatggtggctgaatgcctctacctctgtaccttccctgaaactttatttcagaagatagaggttcagacttcagagttacaattctaataataggtttgctaaaaaagcttaagctgacaagaaaatgtggatgatataaagtagaactttcatgaacttttgtagtagcttgcgttgtgacaagtcacaatcgatatattttgcccttttcaatctaagaaccttcttgtaatatctgtgcatagaatatatttaatttgaaaggaaagtaaaacatagaattgcagaatggtagtttgtattgtgcatttgtgccacctaggtcactaagctaagctggcgagtcaaattttttagagagcagaggaccacatacagctacagtaaagcgaacttttgaattcttttcgcttgttttaacccaagttcacggtgtgttcatgctggatgcatcattagttcacaaatccgggtgagctaaagctgaatgcgaccggtcaatcggcacaaaagcatgtttggaattgaccatgttaggagaacaggagcaaagctagcatgcatgcatcatcttgagtagatgacaaggttcggacacaacaagcaaagcatgagtagttcagtattagcaggtctgaagaccatggagaattggagatagaagaggtcaagaaaaggagaaacaggtctgggccatcttcagaaaaaaataatcaaatataagtaccagtttacattacacaatatagaagcttgagagatgatcagtgaagtagcttaaaagattggagatttaagactgctagttgcacatgagtagttgaggaactgtcagcaattaccatgacaggttggagattttaagtttgaaatgctatccaataaacaagtgtggtcactcctgcgcatcgttttttttttaatatagtttgatattaaagtactgaaacatagttttagttttttttttgttagacaagttgcaagtgatgaacgtgagttttctggttttcttccacaattcctgcaattaaattgattcatgtataaatccagcaaagttaatgcataatatctactccacgaagaccctaaaaatttctaccattctgacagactcgacagaggttctctattgaggtaatattgcaaataaatgcttgcataaagaacagaactgatgcaaataaaaaggttctgcatattatctttttctatcgaaaaatgtgctccattgtcttgcccttcactggatttctgtacaacaattttaaattttcttttgaaaaagaattcatggattgaagtgtgggctactagatttaccagtggttaatcactgacaatgtttttctgccttgccatggcaagattgaaagaacaaaatttataactaagttattttcggtttgttaccctttacttacaaaatcaaataggctattcagataagcatatctggtgtgcttgtaaactcctgcatcctccgaaatcaaaataaaccaaaagaatccctgatcaaagtgatcatcaactcaatgtgccatagcccataactactactcctccgtttcaggttataagatgttttgactttgatcaaagtcaaaccgcttcaagtttgacaagtttttagaaaaaatagtaatatttttgacctaaaataaatttattaaaaatatacttaattatcaatttaataaaactaatttagtaatataaatatcactatatttctctataaacttaaaacagtttaactctgaccaaagccaaaatatcttataaacggagagagagtactggtactgttcatcatcagttgagcctgcaagctgcaacaacccccttgtcccatgctgccgtccccaatctgaacctcatattctcatcccatctgtgcgatcgatcgatgcacgcgctacatcactatcatccttcgaccaaatccccaaagcgtcactaatcctttttttttttgtcggcgtggatggagtcactcgcttactcacccctgcactttgacaactgacaacatcaccaggaaagagaagattatggccccatttgatttgtacgaaaaatattgaaaaattagatgattttaattctataagaaaaatagtacctattaaggtctttgaaacaaatgattgaattatttcctttcaaatccctatggaatagataatactatgaagagattttaaagaaaagttagcaagagcttcaatatgttgagtctatttttctcatctgattcctaagtttttcttttagcttattcaaataaccatttatgtattttgcaatcgtttattttgcagttacattcatgtaaaaatattacgtttttcctgttcttcctatttctttttttcaatcttttgcttcaaatgagccataagggtcccgtttggacgataagattatagattattctaactttgtgataacaattgtttttccattacacgagagacgcacgtgcacacacaccactacataggtaacaccatactcatacacccacgaatgtgttatgcacatgtttaaaggaacagaaatcaacgtcacatacttggactctgtggccttcacttattgggaggcaattatatagtaataaaatattagtattccgcgggagaagagaaaggtccccattgtttggcttatttcctaataagccaaaacggcttattaggaaataaaaatgaaattgtgggtaaaacttttgtaaatgtgttttttttgacttaaaagccaatttgaaaaaaaaaactacgttgaaaatatgtcaaaatcaatcttaaaattaagcttgaaaatttaaaatttagctttttctttggtttattaggccatccgatgaggctgaaaaaataatccaagacggcttggcgatgaacagctgcaaccagtagcagcaggcaggatgttccttcgtacttccagtgtagaccagccttgttttatctgggcctcttcggcctgggataagcccaggttctgctcctgcaggcaggaaagccggatgttccatacttccattctcgaataattgacacggttaattatgatcatgtcattttaaccgcattcttttaaaataattatattaagtaatgaatagaagttatatttatgattatacaacgctcaataatataacatgtttaaagtatttattagaaatgaaaattagttaatgctaaaactaaaataatatcgatatcaattattgaagaacagggacgaaatcatccagacaacactaatttacactacacaccacctttgggaagaaatcaggccagaggaaggtgtgctctgctttgggatcctttggaacaacttacacttgacaccaccttcccttcccttcgttctgaagcccttagagaaactgaggcaacggcgaaagatcttagggctcctttggaacaaagattcttagaggaattcaattctataaaaataccttcttatgtggtcctttgtatcaaaatccttgaaagttcctttggattaactaaaggcttcatcttttttgcttatgtttattcttatcaaccaaaatttaaattttcaagcttaaacttggagtttattttggggtcttttcatcatagtttattttttagcttttttttagaacacgtgtataaaaaatttatttataaattagttttcgtttgcaaatataggtattttaactgatgtggctttaaaaacataggtatttgaaccaaaggtccagtctcttagaaaaagaatcatatatatcaatcggttcatgtgtttttcctacgctccacctaactaatgattcccataactttcttattttttttaatctatagggacttctttaaaacatgggaatatgaaaaacacatgattcaaatgtcatcgcaccttgaatccaatggaatgaaaaatacataaacccgttaggatgaagcataggaaaacacataggatttagagatgtagacagaaaggaaaatttctaagaatttggagttaatgctaggaatccttcaaaattatcatgaaacatgtcatttcatagaaatttcaaaggagttctacagactcaatgctttgttaaaattagtctcataaaaactttttctatatgattcaaatctttttaagtttctctacttttcttttgttgtaaaggagcccaaagatttaaggtgataagacactttaattctgtatttttttttcctatccaacattataagaagggaaaattacaaaattcacctcataagtcacttgaattttgacattccacctcataagtcattttgctgcaaatacacaccttctatttagtttattgtaaaaatcacccgaatgcacacgtgcgtaaccgaatcaattcgttatcgctgatgtacagttaccacaggctaagctagtcaaatcaatcgtgtccaagtgcttgcattagacttagggggtgtttagatccaggggtgtaaagttttggcgtgtcacatcgggtattatatagggtgtcgtatgaagtgttcgggcactaataaaaaacctcatccacgcatggcacgggtcgcgtactcgcgtggccctcctcgctgccgtccattagccgccggaccttgctggccacctccatgtaggggtggtaatgggcccaacattttggcgtagaaattatgagggttgggtaaaaaaaggtttggctgaaatttagtagttttttgtgctaaaaaaatttaagggttaagatggattgtgaaagaacccacgggtcttgacccattaccacccctacctccacgcgtccgacaacaacagcggcgttcggcccccggaggaggcggtccacgcgaacgccagcgcagaggatgtccgccacatgcttcgcgttcgccgcctgctccgccatcaccggccacgtcagcatcggacgaacggcggcgaggctctccagcacggagttccagccggcgtgggtgacgaacgcgcgctgtggcacccagccacggacgatcttcccgtcgccgccactggaccggccgatggcccagaggcaggcgtggccggagtccactaccccgtgccggccgtgcgcgagcgtgccgaacgacaattctgtacttttttttattgagtgatttctatagttttcttgttcttttcgaataatagtattttgacacgataattctgtactttttttttattgaggtcctgtttggttcccacgcaaaaacttttcaccctgtcatattgaatgtttggacacatgcatggagtattaaatatagaagaaaacaaattacatagattgcatgtaaattgcgagacgaatcttttaaacctaattacgccatgatttgacaatgtgttgctacaataaacatttactaataatagattaattagacttaataaattcgtctcgcagtttacaggcgaaatatataatttgttttattattagactatgtttaatacttcaaatatatgtacgtatatccgatgtaacgcaccaaaatttttttatcccagtacaactaagggctcgcgaaaagaaaatttttggcgtcacatcggacgtttgaccagatgtcggaacgggttttcggatacgaatgaaaaaactaatttcataacttgcttggaaactgcgagataatcttttgagcctaattaattcatcattagcacatgtgggttactgtagcacttatagctaatcatagactaattaggctcaaaagattcgtctcgcgattttccccctaactgtgcaattatttttttaatttatctatatttaatactccatgcatatatcaaaaattcgatgtgatgtttttagaaactaaatggagcctaataaacagtgcctggcgtgcagcgatccggtgcaggcgtgcagcagcagcactgccagtgccagatgctgagatgggggaagtataaagtacaatctccccattcagcccaatcatgcaatcttcatcttccatcgttggattgagaaatagacgtctaaaattcgtccacgtcaccatgagttaaaaattaactcgcagattcaccgtgagttaaaatttaatgagagttaatttttattcaaacttaaaatgacatgacgtcgatcactcacagttaccactgtgtcgacgtgttctacagttcgctcaacacttgccactgccgccattcgccgagctcgccgccgccgtgccgtcgccggcgacgacgtagcttgaccgcagctcgtcgaccagccgccgcagcgcctcccgcgacgcgccgccttctcccaccgccgcgcgcgccgcctcccggacctcctcggccctggcgcggatcgcgcggccctcctcgccgccgtccatcagccgcccgaccttgccggccacctccgcgcgcccgacgacgacgccgccaccgcggaccgcgcggacgccggccccgatgatgtccgccacgagcttcgcgttcgccgcctgctccgccatcaccggccacgccagcatcggcaggccggcggcgaggctctccagcacggagttccagccggcgtgggtgacgaacgcgcccaccgccgggtgggacagcacgcggcgctgtggcacccagccgcggacgatcttcccgtcgccgccggcgtccaccggcggcgaccactcgccgccggaccggccgatggcccagaggaaggcgtggccggagtccactagcccgtgcgcgagctcgtcgagctgcgcgtcggggaggtgcgcctgcgtgccgaacgacacgtacaccaccgaccctggcctcgccgcccgctcgtcgagccaagcgacgcagccttccgggtcgtcgtcgtcgtcgtcgtcttcctcctgcttcgtctccggcgactcgccagcggcgaggaacagtgggccgacgagccacgcgcgggatccggggtggtagaacgactcgaggatggccgcgtagtcgccgtcgagcgcggcgaagctattgacgaggacgccccagctccggtggtcccagtcgcggacctcgtcgtggaggaactgcgtcaccgggtcgtcggggttgcccccctggatcacggcgtccgggacctcgtcggcggtgatcctcacgtcgtccgggaagccgggcacgtggaactccgcgccgccctcgacgccgacgtgtggtcgcctcgaggcgagggtgaagcagagcgccagggagaagggcgacatgccgttgaacgtgaggcggcggacgccggcgtcgtccgcgactcgctgcgtgaacccgaggaagaagtcagagacgagcacgagcggcggcggcgacgggagggacgcgaggaactcggcgaagggctcccggagcagcgccgtggcgcggaggaacgccgggaagagggactgcgacgggagcgcgtcggtggactcgacgccgggcgggatctgcgggtgcgccgggaacgggatggcgacgacgcgcaccgacggcgacggcggcaggcggcggcgcgcgaaggcgaggttggccggggtggtgacgagcgtgacgcggaggtggtcgccgtggtgcaccgcgagcgccgcggcgaagtggaggagcgggatcatgtggcctttggacatgagcgggaagacgacgacgtggtcgcggccggccagggtggcgccgtcgttgccgccgacgccctctgcggcagggcgtgtggcggcggcggcggaggcgggcatggtgttcgacgaagcgttggacaatgggtagtttggtgagctacaataattggcaacaaagtgcagtaacgaaggctttatattgtgtaacttgtgtttgcatgcttatggttctatacttctctataattttatatattatgcggtgtttgaaaaggagggattaaactcacaaaaattttagtctctatgggaggggcaaaagctgtctagtctctactttccaaacaccatcttagatgatgccctatatggcaatatttcatatgaatttttgttaatattatactataaacgatggatagaaatattttgaaataatgtgaaaatgacatggtagatgaggatttgatatgcttgcatattagtaagctttaaaatatacccactttatcccattgcataataatttctagagtttagattttggttgttctaatggtagatacgcacaaatgaatatgcatagtgatagtgttgacaaactttaagttgctcaactgtaatgaatatctccgtcaagtaaactgtgacaacacctaataagtcaatttagtatattaaaaagacaatattgatgaggtcactgaaatcgtgagagcataactctatctctcgatttctcgattaaattaatcgtgatatctataaatattaattaaatatgtgaatacgctttaaatagtatcttaaaaaaatccaaggatttattgctggtccaagcatgcattaattaagaaaggtacactcatatgcctgcgatgccgacttattggctataaagttttttttcagccttctcttaacccacacatataatagttagctatttataattaatacatgacccacttgtctttctcacaattttttggttattgtgtccaagtcggctgtaagtttacagcccgcttctactctctctcttctcttctctcctccacctcagcatttagccgacttacagcctcttattatacttgctcttagtcgttattactacctctgtccccaaatattataattctagattatttagcatatactcacttcatccacaaaagttgcacatattatttttgtcacaaaaaccaagaaaaaattaaatcatcttcgatgttacaaaatcaaggagtgaatgcaagcatgcaaccagtgagtatttagatgactccttaagttttaatcaaacatttaatttatctcatcatttaagtcttgaatgtataaagactacaaataagaacaacttatttgaaaaaaaacttaaatatgaaatatgtcaaacttttgtggatggagggagtattaaggtttcaaaagaaaaactatggtgcccttcgtcaaatggtgcataggtaaaagttggggagtggttgagggtagaatatagagaaatttggatgagaaatcattgatgagaccattagtactttactatgacaactgttttggggcaaatttgaatactaaaaatacaattattatgagatggacgtagtactctatataagtacaactacaaacgaacatgaaggttgaactccgagttccaaattaacttgatactaccttctacaccctttgttccatagaaaataaatcatagctataaatctggatatgtgtgtcaggttcatagctatagttgaactttttctcagagggagggagtatgctgagtacaactataaatcttcaactcatttgatgtgttgtagtagataatctgcagtggacaacatactactcactatatctcaaaacataagaaactagtactggatgtgaaatttcatagtattaagattcgaagtactacaatgtacaatgtgtcacatttattactagattcttataatttgggatggagatagtacctccgtcattttgggacgaatggagtagttattaagatcggaccgaatcagtggtccaatcggaaaaaagacaaaaccaaagcctcagccgattcggtctagctaaaagatcggccatgcaatcagatcggagaaaaaccggttgaacccacgttgacgatttagttagagacacgtacatatttgagccgtgttgaatcggtggtcgaactggttggagtaccatactcattgtaaaccgagggctcaccggttcgacttctggtccagtgctaataactatgatagagagaattgcttaaggcagctagttgtattactaaaatgtcccatttttaggatcattcttaattattaacttctcagcgagtaggttattagcttgtattttaagagcacgtttttcatggtacgtacttccaatataatttttctttaaaaattaaataaattcaattttaaatttataataaataatatttaattaattactcgttaatgatcacctcgttttatgtgtaccagctgattagctcagccttgcctctgtgtccgaactccgaacggggcctcatcgtcatagttgaccactaatttcaaatacgaaacgaggaaatccaacaaatgtgagatttactcctgtccggcagcatgtaccggccagtagtaccgggagatacaagatcaaatctgactgtccatcttgaagggatacgattggaaatagaaagagcaagaggagcggaacgattccggagtcgcgccgccgctttcctccttgcgctctttcttttttccctccctgaatcgcttctttctcatctgttcctccctccgagcacagaaacggagcagttgccccgccggccgatttgatccccatccatctgccgtcggcggccacggtactggagaaaacctcacggcgcgctcgccccgcatgcagtgtcaggagcacaagcagatggtggttctttgccttcatgcatgcttaagctctagcaaaccagatgatgacattgtatcaattgattcaggcaggaaagaaggcgctccactcgctggtaccgtgacttcctcaaggatatatggatgctcctcggcaatgggtttggggcagagctcgggaattcggtcactggggagttcgttgttgctgagtggatgtggagccacagtcgcgacgggaacgggatgaaggtgctccgtagcagtgacgggaagaggagacgccgctgcgatgggccgccgcgacgacgggaagcggaaccaccgccgctgcgatgggcaggggagccgccgctgtgatgggccgccaccgcgacgggaagcggagcagccgccgctgcaatgggcaggggagacgccgccacgacgagagccggagcagcagccgccgctacgacgggcaggggagatgccgctgcaatgagccgccgccgggacgggaagcggagctgccgccgccgccgccgcccactggatacggatcccgccgccgccgcccaccggatgcagaccccaccgctaccactgaccggaatcggatgcatccctacacgaaaagacaaaattacccatccacccctctatctattccggtaccacctcattggcaaatttgtacctgaggtaccggataatttccaccgtccgatcgagctgaataaatggctgagatttggtacctggctagtaccgtggtacctgctggataggagcaatgctcaacaaatgtaccttgttcaacgtagctaaacctggccaaatgggccgtgccaagccgggccggcccgagcacggtagtactgtagccggcccaggcccggcccggcacgccagcctgtgggccatgccggcacggcccgttatcccgtgccgtgtttaggccgatgcctcagcccgtgggctggcacggcacggcacgtttactgtagcgtaccggcacggcacggcccaggcatggcacggcccaccggcccatttatttttcctacgattttctaatttttcccatatatttctcatattttttatttttttccacattttatcctatttgtaccatatattttatgatatatttcctaaattttcctcacatttatcctatatttatcatttttttcctttatattatgttttttctgccttttttcttttttttcccctcaaatttcaatttttatgggccacatgtactagtgggccggctaccagcccacgtgccactacagtagccgtgccggcccggcacggcccagcaccttcttgggccgtgcttgggccgtggccttggcacgtgggccggcacggcacggcccgctataggagccgtgcctaacgggccgtgccctagtgggccgtgccgtgtcgtgctgggccgggccgcccgtttggcctgctataaacgtagcagtacactagtacagtactacaaacttgacgagggagaggaccgaatatgcagcaatcagcattggtaaaagcttaagcgcatgtgcgccaattgacatcccctgtgatactgcagacgacatgcgcaagtatgagcattatcaaccttcgagacttctctcccaccagtacactaactaaaagttatgtaatgttcccaaccttttgaaatgaataaaggtttaggctggcaaaagccagccgtagttcccttccgaagggtataagcatcgagatttctgacatggctctgtttggatttaagagatattttttagccctctcttaaatagcccaaatagctcaaaaagattcaaaagggtgagctatttgagagctatttggaaatagcccacccaaaaaaactatcccacccaagagggaagaaaatttggtaagacttaagtcctacgcttatccgaaagactctgcttcccgcacgacacctgtccgcacaaatcttaagagtagcgaatatctcttttgtaccctttcttcttcctccggccagggacttggcgacaaatccaactcgctcttaggaccgagggtccagcatcttcagacgtagcaaggtccgggggcaaggtctggagcagagtttccggttgccaccgcacccgtcatgcttcttccatggaaaatattcacctgacattgttgttggtcaaaggtaatggatgaacttgcaatgcactagaacttgggaaaacatcaaattgatagatgtcgccatgtcgatgtgtgtgtgaagcctctgtatacgttgcatcctagtaaatgattaggcctggttgtcaaaagagaaaaatgattaggcctgaccttaaaacctattgacggcggttgggttgagcacgaggtcgatgccgctgcgcctccttggcgccccctttcttcaacacatcgtccagtgctgctagctgtgacctcgccgtggccagagatgccagtcaaactgtgggcttgatgccttgccggcggccggccgggtagtacgaagatgggagattggagaagagagagaggaaagagaactgttgggagaagagacttgctgctctaagattcgtttggacaggtgtcgtgtgaggaagcaaagtctttcggatgagcgtaggacggaagtcttaccaaattttcttcccccaatagatgctaattggggctattttaggtggggccactgaaaaaatgtcttttctctttatctctctccatgagaagttacgttaaaagccaaatagctctcaaaatagctattggatccaaacaactcagagttattttattggaggactatttacttgtgctaaaaaatagctctcaaaataactcttggctagttctctaaacagggctattaattgatggagtcatacacccacgactttattcatgaggccaccatctaccacacaaaaactgtttcgtactattccaccgtaccgaaattgttccgctatagtattaaggctgtgtttagttcagcgcaaagtttggattttggttgagattggatatgatgtgactgaaaggttgtgtgtatgacaagttgatgtgatggaaaaggactgaagtttgaatccaaattttggatctaaacacagcctaatttttggtaggtgttgctggacaactaaaaaagtcacataaatcattgttgccacttgccatgctactattgcttgtgcaataacatttgctgtgcttatcacatagggatgaaatgtgaacaagttattagaagttttttttatgaaaaattaaataaaaatgaactaaaaaaacaaaaatcaaaatgtatagtatcatattggctataatgtatattttcgcttcaaattaataataactagtccaacctattatggcagtggtagtcaaatcaatcttctcacaagtcttaaaaataaataatggagtgtttagatctagcggccaaaagttttggcgtgtcacattgaatatatggacacatatttgaagtattaaacgtagactaataacaaaacaaattacagattccgcatgtacactgcgagacgaatttattaagcctaattaatccgtcattagcaaatgtttactttagcaccacattatcagatcatggagcaattaggcttaaaagatccgtcttgcaatttacatgcaatctgtgtaattagtttatttttcttatatttaatactccacacatgtgtccaaacattcgatgtgacagtgtaaaaaattttgccaggggatctaaacaggccctaagtttgttactatactctataaaccttgtggtcacaaattttaagtttccatgcacattggaaattctcatctcccaaccacggatgcaggtcgtttgcagtactgcacatacagtactgcaggggatctcaattgctgcccaatcacacaactactagtagcaactagcataactgcaagatagatgttcagatggcccaaccgaacaagccaactatctctcactctttctcaaaaaaaaaaaaaaagagaataagttcaccgatcgtcactcaactttatgttgagtttgtttcacatcccttatctccaataccagaaatcttcacccctaaataatacaaaaccatgcaattagagttccacaacagtatgtatctccggtttcgctaacgtggtatcctagtcagcgataaaaaggcccacatgtaagttataagagaaaatgtgtggtcttcatatcttctctattctattttcttttctttcttctcctttctttggtgagcccgggaggtcgccgctggcagaggggggggagaggtggccggcgagcccggccgagctccgccgctatcgacgccgcctcgagcgcccaacaaagccatagctaacctcgcctgcgtcttctcggcggaggcgaacgcccctgtggcgggcgtcgcaccgcaccactctagactacctcgccagcgagggagtcggaggcgagctccttgcggatgccgatctcgctattgcagaggagctcatcaagccgatccgctgatgtagccgctggcagccctggccagcccggccgagctccgccgtcaccacctcaagcacccactgaagccgcaggtgacctcacccacatcttcttggtggaggtagcggtgaacacccctgcggcggtcgtcgcaccgcaccacatcggactacctcggcggtggggtgagttggaggtgagctccttgtggatgccgacctcgccattgtagagtccccgcccgttgacgaggtcgacgacgtgaaaggatacgagggagggggcaggcagacgcgagggaggagctcgtcaagccgaaatgctgtcgctggtggtcccaacgtctacccctccggcaccggcaaccatgatgagatcccactctagctcgtggaacacgagtgggaggctacagagggcgaggcgacatgaggtgtcggtagcacggcaaggtttggttaggatgtgcagagctggtggtggtggagggcaatgagttcacgagcggtcgagggtgccggagctgctgctgtcggtggtgccatcctcctcaccggctgctcttcctcaccgtctgttgctgggcgctgcccgatgatatgagcacagaggagagattgagagagagaggggggagggaggggggggtgaaagggaaatggtcattgacaagtgtgcgtcgacatatgctacgtcaacaaaaaccgaggataatatggtccatattgctaagggacttatttaacatggtttcgaatacttgaggggtcaacatttctaacattgaggattagggggacgtcatgtagactcgatctgaagttgaggtactgagagtgaacttattccaaaaaaactgaaaacaataagcccactatgagtccacgggcccaaagacccaggcccaaaccgcgtgccgtttccctgcacaagcccaaccccacacatatcatctcatcccatctctcccccgtcttctcgaactctccatctcgggatctcgcccacccaccactccaccccctctcctctccgtgcgccgccgcagaattcctcgccgccgccgccgccgccgccgccgtgaggtccatcgagatcgcgaccggagcaggtgggtgatccgctcccgcctctcgcctcccccctcttacctcccctccttcgtgatttccccggtcccaaaccctagatccgccgcacggccccttgcgggattagatctatcggtctcggggggcaggtctctacgtcgtttttgtgattcgttgtttaatccgattgtatttttgttttcttttggcgatttgataggtgcaggttgcgatggcccgcgtgtacgtcggaaacctggatccccgcgtgacggcgcgggagctcgaggacgagttccgcgtctttggagttcttcggaggttagtgactcgccccacctgtggtatgtattgtgtgcgattgtttcggttttctgctagagctgcgtgcgcatgtggaatcatatgggggaacatagctttagcccaccatcggaacagcaaaactcgttctagggccagggcctgagtgacctatgcagccacatttatgtaacttttggggaagacgattggccataccagcagtgcacggtgaaattttaaatgttgtaggcttttctgaaatcctgttccgaccctagtagattttactgtaatagaagaggtagagagggaatttgatggattcattttactcaagattatcttattacaagtcgttatttatttatttattttgagatgtattgatctttctagagcacaattacttcccagctatggcatccaggctttagattgcagtgtacccatctacctgacatcaatggcctccaaccaaacactagacttcaagcaccttggattagattttatcaggatacaaattcaactcattcagatatctacaacacttatttggctaatttactgtatgctggagatgcttttacggtttttctgttgcctaactttttcttattttcttgatgtgctgccaataagtttcttacctgaggccatgtatttgtattttgcacccacaattcaaattatgtttgatgctgattgtcctgatgcagtttgcttatttttgttttgtgcaagcagtgtatgggtcgcaagaaagccaccaggttttgcattcattgattttgatgacaggagggatgctcaggatgcaattcgtgatatagatggtatgtgaatgcttttatgagaacatagcctctgtcagttggatctatcacctctgagaatctttctgctctgattttcttttggtgagttacagggtggtctttgcttgcaaaaatatcttgtgaaagttaaacttctttcaaaggccatgatatatgcctattagtgacaacatgtgttaccattatatctatactttgttttagtaccagaattatgtgaatgtgatgtggcctgctgtttagattatgcttttcctcccagtccctctctctcatccaccaaaacacctccttgcactgttatgttagagcaatttcatgtttgtgcattaatcacttggacgtataagctgtttggacattgtcaagagggtcaagatcctacatttatgggggaagtggggtgaggcgataaggcgtaaaacaaacagtagtgacaactctgaatttctaatttttaaatggcttcttttataggcaagaatggatggagagttgagctgtctcgtaatgcaagcagtggtcgtggtggccgtgatcgatatggtagctctgagagcaagtgttatgaatgtggtgagactgggcactttgctcgtgaatgccgtttgaggattggttccgggggtctaggcagtggaaggcgtcgtagcaggagccgcagccgcagccgaagtcccaggtaccgcaggagtccaagctatggcagaaggtaatcaaaatgtcaaataactgttacactgttgcaatagttaaaagctttttgttactataagttaatggtcacaataccattgttgggactgttggttctgctatggatgtgaagtgttagtggtttgcaaccctactcactctttgatacaactaagttatctttctgtattcattgtaaaacattatatgacatgcacacaatttgttaatttagggttgcctatggtccaaatttacaaacactaagataaagcttgcaattttttctattcagtatttatccacctgttgccatttcccaacatctaggatagtaagtgctagcaaagaatagtgtagcatttatgccctgttttgtgtatgtaactagtatatttacacgaagaagaataacatatctgataatgttataaatgatttgctatgtgagcagaagttacagccctgcagggcgctctccaaggcgtcgtagtgtgtcaccggctcgtgcacgcagctatagcaggtcaccacaatacaaccgtggccgtgatgaatctcctgcctatgataacgggtaatgcagatttcagtaagcagttgtcattttactgtttctaactgagttaaccattttcatcgttcgctcttcgacaatctctaatatgttccatttatggtgtcagatatcgccgcagcagaagttagagctgaacctgatgtctaaagactgctgttacaaatgttactttgtgggttgtcagctatgaacaatgccctactccaaatatcatcatcaactctggactttgattaaggttctcataacttatctaccttattatgctttgtgtttgaagttatattactcgagaaacttatgattggatgtgtattcaactaagttcaactgtctttctgtgtgtcaataaggcatcggcctgcactgcttaaacgactcggccgactacggctaccagttatatcttcgtggttgtgttcttcgctcttcattctacgcgcgccctcgcctgcttcatgcaaacgtcatacagccccattagttgctgcctacaacacctcttcgtgatccatatacttcgttgaagatgctgctcatcagaaaacagtaatcgccttcttttatcgtaataaaaatttggtcatattgtcttcggaacaacagtaagtgcagcatctggaagtattggtgaaacaaagttcttcgtaggcatagactccagaaaatgaatctgcaatccgaggagctgcagtattcagttggatgatttacacccctgcccagtccgtcacgccttgtggcaggtaaatgaggtcaccagaggagtgctttttgacaaggccgatttcagctcagcaagcactgtatctgtgcaagcctgcttaagattttgttggatgcagccagaggttttgctctccatgatcttccttctgcactcgctcagcctgcctcagcctaccctgcgtgctgccgtctagccaagagccttcgccaccactgcttccccgacgtcgccttcgtttccattgcttccccgacgtttgatttcatttgcttagcatttgttcgtcaaattaatgtggtgaatggttatttcttagggatctacgggtgaaaaatgccagatgttattctatttcgtcgtcgaaatgtgatcattattcatatcatcgcatgccctttgcactgcattgccgtttcattatcccgactcggttggttgtgtggccaagatgcctaaccgaccatcaacgtcaagatgctcactgtagtgtaagacacgagcacatccaaaaggctggtggtgacatgaagaaagctgacgtttcttgccgatcaactgttggttgccgttcgcctaccggttcatgttgcgcgaattgtcccaagatcgtgacgctgttctccgttgcgccgttcgggttaacctttggcacacgatacgtagcgttcctgaaaaaaaatcgatacaatctcgcacgaaaacggggcaaattcctccgcgttcaaatccaaacagctctctcttgagtcgcgactcgcgacggcgggacatgagccgacgaccgggtggtttggttggtgccgcgcacgcagatgatgcaggtgggcgtggatggatgatgtatggggagaagaaagtagagtatggaaaggaggatgggttggtgatgcgaggcgccgccgcatcgcaccaggacattatcccgatcgaaacgggctcaataaacaaacggctcgaggaaggaggattaggtagatgatgatcgatggacgatccctttgctttttttttgtcgaccttagctggggctctgccgccgatatattgtattaaaaaaagttccatccgatgttaaatttttatattttgggaagtactactccgtcttaaaaaaaagacaaaccctaacttcgaacctggagtgttagacacgcatatgtccagattcatattgtcgaaacatgaattcggcaataataaaaggaggtagcgcacgagacctaaaagtggatggatgcagagacaaaggatttagacaggttcaggccctctcgatgagaggtaataccctactcctgtttggggatttgaatccgccgggtgtagtatagatctgacgatcaggttgtctcatgccccctagagggcctcctgcccaccttatatagggtggggggcaggattacaagatagaaaccttaaccaatacggtatcggtttcctaaatctactttacaatattatcaaaccaggactttaggccgttccgtaacatacaaggaaacgtaatacccaagtcatgatctgttacatattccatagatataagttatcccctatagccagtcggataactatgccatgtgggtatggggtacccataatctccacagtagcccctgagaccttcacagtcgaaaagataatcttctctcgaactagattactccaaagctgagtgcttcaatcatcttcgccatggtctccgaagtacttttaccaaatatgaagactgtggagggctgaaaaataaagtcagatgcatcaactagatgcacctaataggtgtagccctcgactatgcggttaagtgaacaaaccaagcatatagtcaaggaataaataatccaaccaaccgagtggcttcgataattgtagtcaaccaagcgacttaatattaatatgtagcatatgcggtgtgaatccctgaataatatgatccaagtgatataccgactgctttgtaaaatatgatgagtgtaacctaaagttggctacatcattgaaaattcacatagcaaaatagctataaagaagcttgtatgttgtgaataaagaaatttccaaagtattgggcatacgccatgcgcacactgctttaacagatgtgcttgagtccctagaagacacatggttccaccacacctggaaatatatggcatatgtggtataaaatccgagtaaataaactcataaaggatttaccaaccgcctagaaaatgaccacaatatataatcagcctaagccataatattggtcaataaaaatgcacacttacgtggcgaaaagcaacgatattgtatccaatcaattgcttaaaaacccaaacagcaccatgactatattaaaaagtcagcggggcagctatataaagctttactgtttgacaccttttaagatgcactgtaccaactcctaaaaagttgagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaaaatatgccttcgacaccctttaaaggatgacgcatgtaacatgcttccgagtaataaatcttccgggtaatatagaccaagtgtagctcatatgaatagcttctgatctgaatgattatcccttatgggatactccaaaataggtgtaacaattgaatcccgactggcgcaagtattcggttgatagcccttacggggaataataattggtccagtctttgagcatagaaaatagactcatgactatgaatccatgtggaatgtatccggaacaagtccaaattggagatataatcctcacgcttgagttgatgagcccctgagcatatagcttgtccttctgtcgtagtcacaatcgtccattgatggtagctgacgcagttggcatatagacaagacgaccaatatagagataatattgcccaccagaggtggcaacaatactggtggtagtgaagatagtgataccaatctaaagtaatgaagtcgcatagtcatggaggcgaagaaaccagtcggcggcagacagatcaactaacaatgaagatgaaggaacccagcgacaaaattgtgtagccatggcagcaaaataatcagtcggtgacagacgaggtagatcaaaggtgatgacaaaatccaccaatcatgaagatgaagaaaatagttgacgacgacaaacgcaaccgacatgatgaagaagacgatgtcggtgatccagccaatagcagtgtaccaaccaatgataatgacaaagacactcatcagcatttgcatagtaggtcaaccgtgaaggtgaaataataagtcggcgaaaacataatcatccattagcaacagcggagatgtcagggtcgatgaagcagaggtgctggtgatgatgtcagtgacaataatccatcaaattaatgttatagctgttgtagatgcttcacttggaggagagttgatgttgttgtccaactcgttcaaaccgaaatatttgaagttgttgaagtagaatgtctgttccgaagcaaagatgaagataatgactcctggagttgactcattggcttatataaaatttgtcaaattttgagccttatatttgtgtagcccccgactctttggttagttgggaaacaactgaacatagagtcgagaacacatatctagaaatggattttttttttttagaaagatggagtatgtagtaacttgggggtcatattattttctttttcagatacttcaccagattattacaatggagtgctccacgtctttaaaataccttttcagaatgaactcttttctacttcctccatttcatattataagccgttttgatcgttttaaaatcaaacttttggaaagtttgattaagtttatagaaaaatatagcaacatttatagcactaaattagttttattgaatctaacattgaatacatttgaagtttatttgttttatgttaaaagtattgctatattttttataagctttatcaaagctaaagaagtttgacttagaaaaatatcaaaacgacttatagcatgaaacgaatgtagtacaatgttgtttgagcatatcacttgtttaaattatttatataatttacttatcaaaatatgtaatctattgttataataaaattaataatctgattcagatatggcctacgagcgtatattttagttataataaaatattgaaacaatagattaaataatttacttatcaaaatatttaatctattgttataatagagaatattatctccaatgcagatgcttactcccttcgtcccataaatttcagttttagtattgaagataatatttttaatacaataaatctatacatccaatattagattggatggagggtatatgttggagcctggagaagaaaatgaacttcacatgcgtatgcacaggcagacaggctcatatgaccacacggatccatcacagcctaaaaatgcattcttttaacaaaagagtagttgaccaggtctccgtgtcaatcaatactactactagtactagtagtctagtactggagtagtaccaaaagcagcagaccaaaagaaagaatctctctactcgactaaaaatcacaccttcacccttcatgtcagcacactaaccgcgatatttaccccaaatcccaccgatttaacagcggttagtagtaataataaagtaaggtttggatgcatggacttaactttaatctctatatttagacactaatttaaattattaaatatatactacttacaaaaccaattacataaataaaagtaaattcgcgagataatttttttaaacctaattaatccataattaaagaatatttactatagcatcacatagactaattatggattaattaggctcaatagattcgtcttgcgaattagtccaacattataaatatattttattaataatatatatttaatatttataattagtatctgcacatacgatatacgatatcatagggtcttcagcgaaaaggcccccatcgtcttccccctttccacggtagttttcgttttccgctcgccttcctcctccctctcccttcccctcctcgaactccgcgcggcggccgcggcctccctccctcccgctcgatcccgacagccgccgcagctccccgattcagcgcggtctctgctctcctgctcctctggtggctcacgcggggaaggatccggcgctggatggatgagaggaggatgaggtagtttgtttggtggtttggttgtggcggaggtaagcccatgtttgggtcgaggagggtgaaggacgagatggagctcaggaagcagaggaccgtgaggtgagagcggctactacttgctttgctttggggaatcggggtctttgagttttgagtttgtttttagcttggggggaagttggggggcgcggaggtgaaggcatgacaagggcagtctttctcccacttattagtggggaattcaagaagaattccatttcttgcgaggagaagatgaattcttgagtggatttggttgctggtggtggtcagttggtcactgctgtatttttggactagtgtttagctcatcagttatagttatgttcgatttaaatggttaggtttaatttcttgtgttggattatggataatcttgtagtgaatcccacaagttgtttgctaacttcaggcttaactttgatgagcacaattagagatatatttataaatgagaatgagatgggaaaggtagtctgataagcctaagaagatcatgtcatgctgattgctgatcatttcttgcttttagaatcactctaacaatttctctctctactcctgtataaaagaatctagcaaattaataatagtcttactttttgagtgaattctaatgctgtcttcgtccccagattccacgaggagagagcaaaaccaactatacccactcaccagaagcaggctgggctagctactagtaagcttggcctggggatttcggagaagaacaagatttttctagcagggaatgagctttggtacaagaaaattattgacccatcaagtgatttcatcttgacatggaactatgtcctccgtattgcatgcttcgtggctctatttatggatccactgtacttctatgtacctaaaatctattatggcactccgaattcatgtatcgggagagatacacgcctagccatcatcgttactgtcttccgatcaattaccgaccttttttatgttcttcaaattataataaagttcaggactgcatatattaatccaagctccacgttaggggttttcagtcgaggagaccttgtcacagatcctggtaatatcgcaaagcattatttgagatctagctttgtggttgatctagtggcttccttgcctctaccgcaggtaacttggtttcttccccctgtttttctgtcaagacataacttgagcctttatccatctaattcattgcataattgaaagcttgggctagcaagaacgctcttaccaaacatggaagtattggatctcaaatttcatatactaagatatttcctgctttagttgcgaggttataaatctttgtgtcttttaggtgaaacaatccacataggctgctcaagtccttttagtgttgtattattacttctttaatgcaactgattacattctcttgcattagttaaaaagggcatctgcacttttgtacctgaagttcgaggtatagaagttatctgacatatttctccctttcttgcagatcatcatctggtctgtgataccatccgtcaaatattctttgtcagaacatgacgatgatatactgcttctgattgctctttttcagtatgttctaagattatacctcgtattttcattgaactctaaaattgttgaagttaccggagcattttcaaagacggcttggcaaggagctgcttacaatcttctattatacatgattgctagtcatgtacggtactcatgcgagttctctacaattttactcctttcgccatttaatactagctggcatggttacttcgaatttgtgctaccgttttcttctgttttgctatttggatagtcaagatgcacttatccttttcaggttttaggagcattatggtacttgctatctgttgatcgccagaccgcgtgttgggaaaaatactgtagcaaagaagcgggctgccaaaacagatacctggcctgtgatatacagtctgattcaaattggaaaatcagcaccgctatcttcaataaatgtgatgccactaacaaaacaattgattttgactttggtatgttcacaccattattatcaaatcaagctcccgatcagggcttcctgaagaagttcttctattgcctttggtggggtttgcagaatctaaggtttgactctaaacacatcttctctgagacttgtaattaaggagaagaaatttgaatataagacacatcgtgctcactgttaaagcaaaagaatatacaattataagtcccatcattattacaatttttatctgattaatttgaactattatgatctgattcaataatagctaatatgaagattctaatatattctaacatgcactgtgattcttttttgttaaacagttgctatgggcagactctgactgtgagtacttatattggtgagacgctgtatgctatattcttggcagttcttggtctcgtcttgtttgcgcatttgattggaaatgtgcaggtactttcatggtgtaaactccatttacaaattgttaaaatgctttagttatgaagtaactttgttgttcatttttgatatcccattcctttgttgtctgatatataaatattttttctgaacaaatttctgtattgtaattttacttgcttttgtcaaactattttctagtgcctgcctagatttggtggtgataccatcattttccctctgaactattaatttctgattattattattttttgcattgctacaaactcctttttttgtttgcctaaaaaaagtgcaagcactagaaaatgtatgtttgcaagatgaaacgtaactccttatttcttcgtcactagggctagagggggctattttatgatgttttatatacatgcaaatttaaagtattgtttttaaaaagaacagaatatatatttattgaggctttgggtgagcatatcgccaatactaagtttgttcattgcaaattgtgattcgttttcttgcttctataacatttgactatggctttaggaatggtgaaacaaatttttcctggtgtccaataatggtgaacatgcataaagttttttttcccctgtaacaatcttatatttttgcactcacgcagcacattcctggtacattgtattatattgtattcgaactgatgtgtgatagtaccatagtggatttaaatagcagatgtttgggtttttgtcttgaaggaagctgatataaacaaggcttccaataatatcatgcaatgcattaattagaattgtttttacgagataacatcaacagctgtttatttgggtatttctatgacctgttctgttctagtaactgatttatgattatactagtaaataccattacaacctcttagcttcaaaggcgtacataattttctttaagaaatattgagctcatcacattatattgtttgctagacctacctgcaatctatcactgcaagagttgaggagtggagaataaagcaaagagatacggaagaatggatgaggcatcggcaacttcctcagaaactaagagaaagagtgagaagatttgttcactacaagtggcttgcgactagaggtgtggatgaagaatctatattgaaggctttgcctgcagatcttcgccgtgacattaagcgtcacctttgcctggatcttgtttgccgggtaaaattacctttcttccctttgttttctttacaaaattacaccagttttgcaagctctcctattatcaagtgaccattttaagaaatttagctgtgctgccaggttatttcattgccatttatcaccacatttgaatggacaaaagaagttgacacaagaaaaataaataggagaggaaatgagaaaaatgacaggattggaacgtgcctcttttcgttctatttttcctttccttttcttgaagcaacatatttttcctttctttatttcacattaaaaatagatgggataagataaccaaaaaatggcaaacaaatgctatggatatgctattgttttatcccgtatttttttttgtgagaaggatatatcaacgtcatggttgtctctttctcttctccaatccatgctaatgcaatgacctacacaaaatttgctctgcacatcgaacatattttggagcttgagtttgaatctgctacagccgacatgattcatctgaatcctattgtttgggtactcatttgcagatgcaccttttccttcttcccttttttggccagttacacacttgatactggcagttttttagtaacaggacaattgcaattgcctgttaatgtatctcttgtgaggttgtcattgccattaatgtagcatttcatttgatagtgagatctcgacattctatatcacttactgattctcaccaatctttcataccgcaatgcattaggtcccttttttctcccagatggatggtcaacttctggatgccatctgtgagcgtcttgtatcttccttgagcacagtgggcacatacattgtccgtgaaggtgacccagtgacagagatgctttttatcattcgtgggaaactggaaagctccactactgatggtggccggacgggcttcttcaattctataacgctcaaaactggcgatttttgtggtgaagaattgcttggatgggctcttgttcccaagcctactgtcaacctgccatcctccaccaggacggtgaagacaatcgttgaagtggaggcatttgccctccgagctgaagatctcaagtttgttgcgagccaattcaggcggctccacagcaggaagttgcaacacacatttcgctactactctcaccactggaggacatgggccgcttgtttcatccaagcagcttggcgccgctacaagaggaggaggctggccaaggacctaagcataagggagtcattcttttccaggagatcattcgaagatgatggttcccctgagcacagccttgtgttgaatgcagtcaggaaaggagcccatatcattaaagaacttcctaagtttaggaagccttctgagccagacttctcagctgagcatgacgactaagcggagagtagcttacattatttgctactgtgaaatcaccgtttgcgctgcaaatccttctgcttgttgtcgttccatgatcacgcttcagagtttgggttgacaggtaactgattgttgataggtgaaatgctgaagctcaacttaacacggtgaaagcatcattggtggtatgggagttaggatcttggagacagaatgatagatagtaaccacgttaattttcttttcttcttggtgattgtgttgctgtaggcttagcttagtgattattgtttaccctttggtcatgctgttaatccagttgtaaacttgtaattgtgttggatattgttggcaacagcttgggacctcgtagtagcatattgttgtattttgactcgccgagcaaattctagcgtctcggcgagtacaccatgtttctcgtttttgagtgtatatgtaaatcacaggaggaacactgaaattgtttttcattcattctgttctactgcttgctggtaatagtaattaatctctgttctactgctcctgttcggcagcacagaaattgctctgttctacttctatatgaaatttgtgcgaaatttctactactaaaccgctgaaactctctgttcgacgcaagctttgctcaggctgatttggattgcgggtcaactgaaatttggattgaaagatacaagataaagactccatgcgaaacctgtattactactattgaattactgggactgatgttggagtacactacagccaggtgatcaactggtctttcacaaaaaaaaaagttaattagcttccttcactgcaccagctattttgctgatgttagaatgggagtcaggtaaaaattggattggaactggtatggcatttcaataatttatctgcttaaagatgaagcttaactacatagctactatatctatgcttcagagctactgaatgatgttacttgtgaggatgtgcctctacatcaggtgcaatcctctttggcatcttcctcttctgcatatacttcgcatatgaataccagacacctccaaatgtattgatcaccaatccagtaacgttgagagtatgcacttccacacctcccagcagaacgaaacccagggtctgaaagagccgacgaagtgagacggtataagatgtcaatgttttggaacttcgaaaacacggtgtttcagtaatttggttagagatagaactgcttacagtagatccaacacccttgagaactcctactattgttgtcgtcagagcggagttcactatcgtgcaccaaaacatggtgaaattcaggacgatacccatcaccagcgaaacaagaagaatagcactgaatgttagcgaggccgtctgcattgcaagtgacaccaattatgtagattaggaaattggatccaggaaagcactgcaaaacagattgctatctttgatgtcctacttaaatttgataagcctgtattggtactactaaccttttcagagagtactgaaagagaataggggaattctcctgttgctataatgatgaaaaacagaaagggtagtgataatacgctgttataaaacatcaactcaacggaggaaagaccatcctctgctcctgatttctccacaagaatcaaatacattgtctgcatacacactcaattgtcagttacagttagaaatccaaacaattatctgagagcaacaatagtgaacatattacaacctggaagaagactgatgttagagccatggagtatccatacaagtcaaaggaaaaatctccaagagctgcaataaggactccagcggccgtgcagatgactgaaagggacacctaaataaatttgtagtagtgaggaagagcaaaatatttttgaaggaaagagccaaatatggtggtaaagatatattccttcccaaggggatactaatatactatagttgagtccattgaaaatcttcaaaggattgcatggtaaatcttgcaattcagtggcaacattaagttgacctattcaatgttgtttagtgctctcgtgattttataagcagcatatggatccctcaagtagctgactggcaaaaaaactaggggagtatgatttatttatttttttttgcggggaaggggagtatgaattgatgatgacgccatcttagaaggccaaaatcttgaattgggacttctatcgaaatatcctacctaactttattaggacaattcaccttgtaatgccactaaattgactttcacaatccaaaagtaacatcttgggtaggcattggcatgtgtaaagtaaaaccataactctgtaaaacctagtggagaaaagaaataaaatgactaaaaaaaatgcactcacctgtgttggtggtttcccctttccccgtaaacacccagccaccagtacagcaaggggagtgagccttttaattgcaatatacataggaatgttaaccccttttaggcttgccagcgcaaatgcaacatttgcattgtagaagatcgacagcggaagaagcttccttcctgttgccatactgaaatcttttcttttagacactcctagaatttgaccaaaatgtatgataagtgctgtagctatttgctgcagaaatagtgatattgaacaaaataatcaggctcagacaaacataggaaaaaataactttttttttgttgtcactgatgaatgatggctgatgtttgttcataattatacctgtaaggtgagaagagtcattgagtgagcatactgcataagaattgctttgttcacgaataccattgccatagatgcaattccataggagaaggcagcagataagctgcaagagaagataaagagggaaatggtcagaacttccaatacatttcctacttcaattaggtctgaaccaacagatccataaatgtatagaaaactgcaatatttgtggctggcctctcatcttctgcttgttgtcttgttagccacaacaaaaaatgaattttaaaacttaattttagagttgattttgaggtttttttcattgtagtttattttctagtattggcttttaagctgtaaagaacacagttataaacattttgcccataaattgtttttggttgctcagtttatttttccacgtttatcggtcagtagaccaaacaatcagagcttaaatctcaggaattgatgacatgataacaaatgcagtaatgatgttctctagtttccaataattaaataatcaagaagattccccccacggcatctttggcaatatcattatatcaatagctcgggatgatgaaatctagcgcgttttatttaatcatcatgcacaggcatccgtgcagcttaactaaaaaaatactagtagaattgcaccacactgcgaggctagatagttgactacctattccttttaagtaatgaagcaacctgctttctcaagtgaaaataagtacttgtaaactctaaagcctaatgcaggatgttcttaaggggaaaaaaaaaccattctgccacctccattagcctgcagaatgctcattgcctcattgcaatgccagatgggagatggccttgggccttggcaggtcttgatcgatgtatgcataatgcacgtgtttgcgtcttgaagaaggggactgacatctcaagcaaccatcactcactggaatacactttttgtcccctctttcttggattcgtaattcacagtaaatcaagaaacaatcaattcaatcaccgaatgctacagcccgcgagccgacgcagcgatttcccctcattttcttggattcagacttcagaatgaatcaagaaacatcctccgccgaatgctacagcggtaagtccaacacagcggctgtcgaaatcaccgcaaagaaaaggaaaaaaaaaacagaaatcttgacgagcctcatccgccgcctacgaagttcttttcccaatcaacaagaacatggccaagaagaagaggtgggggaaaggggagagctgaaacaagaagaggaaggagaagaagaagaagctgacctgaggaaggagctgggctcgccggtctccgcccccatctctctctcctcgagctcgcggttccgacaaggcggggtgctctacatggaccggagcaagacaggtgctggggaatgtgggtggggggagatctggagacggagggggagcatcggaattggcgggggctggggttatatcaacaaaatgcgcccaagtgtccttctcaaattaatccgttaattaattgactaaccttttctctcttttttttttccaaaaaaagaagagtattgcattctacaaagtacaaacattctctttttttaacttctaaacgatgtattgcatgtagaaccttttcttatatagaagttatttctaaaaaaaagttaatttaaatctgttttttaagtttatataaatcaattgagtagattttcagtaaaccgttcaacctatataacaggtattatgactggtgttatataaaactcatttattatggttttataaaaccccgctcctatatatatatgtgtgtgtgtgtttagcacacatttacttaagtttttaaaatataatctatatggaatttttaattgttgattttaactacgatttaactcttcactactttcaatatttttcacatatgataaaattaattacagtttgaataaatgtgagatttaatggaatacttagaccatgaaacatgtggttatatgtcacaagttataacaatatggctttctaccattttttaccatgaaagtaatgatttctaaaatttattactttaattaatactcagttaattatgtattaatgaattttcttgtttcgcgtgccgcttaaaatcccaaccaaaccttacgaacgaacgcagccttaattaactaattgaaggatcaatctaacatatgatttgatcatgattttgttaatcggtattatgatcatctggttacatctagatataaactttagcatttaaatcaactaagacatgtacattctaaatattgaagagtgttccaaagcgtctaaatcgaacatgtatataatattaaaatccagccacacaaatacacagataccgtgccagtggttatatttaaaaggagagaataattgttctgaacctgaactatatattctaatctggaaatgagacagtggcttacaagctattttagagaacatattctctaaatctttgtaaattcaactaaaagatggaaagtatccatacctgttaacatgaaaaaatcatgtcaatattttcacaaactgaattacatattttggcatcattttacggcgcattgtagtataaaagaattgcactgcccatggagtatcaagaagtcatttcaactctgccgtttcttctctaatctcgaaaccgcacatgacctctgaggctctgaagctcttctacgcaatcatcacattacatgctagtagatgtttatgcacgatctatttctaggatgctctcaaattcttgcataagattcagaagcagctactagcatttatctttgaaatggaggtaccaatcgtgctctttcaaaaaagatacttcctcagttcctcttgcttgattcatcgatcaccagccgtagcatctaattaatctagctttcttcagttgacttgcagtaccaatgccattcctcaaaggatcaacgtgtcgcctccatgaagaacacatctacctctgaacccaaggctggatgatgacgagtcgacgcagctgctcttgcctcgcagcctcgccggattgtgtgtcaccgaaccatttcctatctatccgtgccatctcctcctgcaccgagggcagcatgaaggcttgctatatatatgtcgtgcacaatcggcgatcctatcggaaatgcctgaaagaaacacatcacaaaattgatcaaatcttgttcactaacccagtaaattaactggagtagatgatgaagtattttaacagacgagagagacttacaaatccgaagcctcccaacttgttaggtcgggccaaccatgctgtaaccttgacaataatttgagaggaaggccttcaggtagggtatctcgtcaaatacagtagataccgcaaaaaaacccattttcgagatatttaactatttatcgctcttagatataacaattaactatttatcacctgtattcatatgccatagacatatggcacataaaataaatagttaaaagtcaaatatatttttagagcccctcctaagggagtcatcatactcctcccaacgaggcataaccgcacaaattctctccttccggaagcccatttcctcaagccagtgcaccacggtgtagcccttttgatacccgacgtttgctgtctcttaggagatcttggacgttggttgctgctggctggagctgctggaccgtcagcattgattgccaggtttgccgtgtagcttgaggtcagaataagcgcgacaaacacccatacgatgactcaaaatacaaaacctaactttcccatcgcgtcgcccacgcacaggcgactcaggggcgacaacgaaccctagcagccgccatctatagaaaaatctaattgttgtattctgatatttcctgatctattacattgaccctctcatgaggtatatataggagtacatataggatagagacttggagtacaatacaaataaaaatagatttatctctatgattctatctctagtactctatcttatctttaggatatatcttatctctataatttgtttttgactcttatctctaactaacatattatacttctaacaccacccacaccctctcctccacctcgctgctgctggagctcgccgccggaaatatagcggcgagcgaggacaacagtggtgggcttcgatgacctctcaattcaggcgcgaagaacgggtggcgcaaggcagcgacgaagatggtgcggcagtagcgacggcacgcgacgcggtggcttcccctcgaccttggcagcgccagatccaacgtctccttgccgtgacaacaaggttggcggttgcggcgacaagtcacaatgcacttcagcgagaaccattacggcaacaacccttgcagctgtggcggcggcccttgcagtggatgcacactgaatgcgcagagatgtagcctagagggggggggggggtgaataggctttcctgaaattttctcaacaatcgcagcggttaatttaacagggcccggaacctcctggtgaagaacaccggaacttcctggcagtgatgagcagcccggaacttccggagttcttgggccagggcccggaacctcctggtgaagaacaccggaacttcctggcagtgatgagcagcccggaacttccggagttcttgggccaggaacttccgggcaacagagaaaattgaaatcggggatgtaaaacaggtcctagctagagacaatcaggcacaaggtagcacaagatgtaaatcacaagataccagcagattcaaacacagatcatgcacaagagagacaaaggcgattttttcccgaagttcggatcacacggatcctactctccgttgaggtgttcaaagagccgggtctcgattaaccccttgcctcacttatgcaaagatcccagaagaagtccacagccttcaactcaacacttctaggtcattttctagaattgagtgaccaccaagatccaactcacaattccttctagaaaagaccacaagtgcaagttgctctacctaggacaacctctgaaaactcagcacaagaatctttactcacttacctcgtttccttgcggaggtgaggaaaaccttcacaaacttttccgggacatccacaagatctttggaagctcacaggcgacacctaaccgtctaggagaagatctccaagagtaataagcccaagtgacagcccacaaggtatccaaagtgctcaaacaaacctaatctttaagccatctccaaaacactcctacactctaatctaatctctcaatctcacaagataggctctagatttgagtggaggaagcaaaggaagcttgggagtggctagaaaaccctagaacatgaaagagctgaagtggaatggccaaagggtgacctggggacgaaatccatatatataacggctaggtgacgtcatctagccgttactcacaagtttgaactggaaacctgccaggaggttccgggcaaaagtgccaggaacttccgggcagcacttaggaaaaaatctagctaaacttcggtgcccggaagttccggccagaacctccgggtagccctctctgtcccggggagaaaataaactttggtgtccggaggttccggccagaacctccgggtaggcctctctgtcccggggaaaaacatttccaaaaaagattccaaaaacctttagactcatggatatgactcagagcactttgaataccctagaaccacacttgaaacccctctttatagtacggttttttctaaactcaatttcgaaagtgaaagacctagtctaatcaccttcggtgtttttcgcacttaggaacattcaaattggggggtctccttgcattcttagccatcacaacttgctttgggactaaactcctgtgaataaacttgataaacacgttagtcccctttaaccaccttgtcattaatcaccaaaacccactagggggtttaagtgcaccttcacacaccactctggcggcggcggcgcttgtggcggatgcagatgcggcaacaggggcagctccgacgaatgcgtagtgtggcgttgggaatggatctaatagggatgaacgatgacacaaccgctagccgctaaaaaaaactttggcaattgggaccacatgtcgtgtcgcgcacttgtcacgtcctatcgtatccctcaacaatcaacggacggattaagattggtacctcacggtacatgtatctcgagatacaaaacaagacaaccggatatatgtagcctttttaaattaggaacttagccctcaaacaacccagtctgaaaatcgctcctatgaagatttgaactcagtaccttagcatgtgtttggttgcaggggcgggacgggtcagaaggaatgcatgaagtgggttgaacccagatggaaatattcctctcagatccgagtttggctcatccgccaaaatctcccggaccaattgaacccacctgggtttctctcccatgttcttccccagggcggcaacgcgtggggcgaagcttgctgggcagcacacggcgcacgggacggagccatatttattaagaccggaccggatcgggaaaaactggaaccagagcccttaccggtctggtccaggtaaaagaccggcatgcaatcgacccagccatgaaccggtgagaccgcccggttttgaggtaaaaccgctattaaaccggaaataaaatcggcgctgaaccggtctcatactgctgtatgtgggatgggcacgcgtgcatgggtgatggtgggggaaaacggtctcgtggcgctgaaccggtctcatactgctgtatgtgggatgggcacgcgtgcatgggtgatggtgggggaaaaacggtctcgtggctgctgtatgtgggatgggcacgcgtgcatgggtgatgctgggggaaaagtgaggaaaaatatgggtaggtgggattcgaacccaggaccacataggagggagttaactcgccaaccatcaggttactatgcttcttgtgtttttgatagaatgagtaatgcatttaatagttattgaaccgggtcagaccagtggttcacctggttgaaccagtgaaccattgaaccaagagcctcaccggtttgattaccggcccggtctcaataactatggacggagctcgttactcgtggacgggcgcgcggcgcgaagctcgctgggaagcatggcggcgcaaggggaggagctcgctgctcgtcgacgctcgcagctcgcggacgggtggcggtgcacggggcggagctcactactcatcgacgctcgttgacactcgtggctcgcggacatggggcggcacatagggcgaagcttgcggctcgccgatggatgccgacgctcgtgactcacagacgtgtggcagcacgcgggccgaagctcgacaacacgtggacgggcgccgccgctcgttgctcgcggacgtgcggcgacgcgcgggccagagcttgatggcacgcggtggagctcctagcgcgcagacgggtggtgacgcgcgggatagagcttgacggcgcgagcccgctaaagtgcggtggagctcctggctcgtggacgtgcagctgcgcgacaaagcttgcgggagcacgacggagctcgcgacttgcggacgtgcagtggcacgcgacgaagcctgcaggagcatgactatgtacggcggcgcccgacgaagctcgacggaggtcgacagtgcgacgcttggcactcgcaatgtgctcaatcaaatgccttcgacttgatcccacctaatcctccaaccaaacaaaaactaggaccatcccatccctcttcaaccaaacaagcaacttggatggacctattccaaaaagagaaccgctagcgcacgggatcccttgagggattgagagtcatgggatagttaaatgaatctgcccacaccaagctttagtctcctagcacgctacctttttttttctttttgttaagacatcgcatgcggtctcctatcgtaaggccatggtgtcagggttatggatatcacatacccaatagtgatcaactaagctcggtagggcccaccacataccatgccttatacggaatcatacctcgtatatagaagaagttccggataaggaaggacaaatagagttctatatggaaacgacaaggactactcggattgtatccatattggtctcccaagttctacttggacaagggggcatctatgggtagaaatacaagccccccctaggaggaggggacagatcaacaagacacaacatatacgcaagccaacacacgctggcagatctcgacatcagagattagcctaaatataccccatccggtgcctacggaggccggcaagagggatctagcgccatctctgatcacgatgagttcatattcgaggaggagactaccccgtcgttaactacgagttggttatccatgccgccaagtcgacgacaactagataggttatcccaaatattgaacttgtgtgattcagatgaataaagagcaacaccggtttaggccaacaggatgtaggggtattacatgttaaataaggggctcgaacttgtataaaaatccttgtctccatctcttttacctcaatctcgcatataccctggtaccgacgatccccataccatctaaataccatagtcatggtaccacccgtcgacaccacgtgtagccaccactcactgaaaaataagctagtgttgtttctgatgtgaggtacaaggcccgacctagcaggctagcaccatacacaatatatctgatgcctatatatatcagatctggaatatatcagatctggtatcaaatatcatgtccggtatctatgagtaccaaacatgatacctatatataccagagctggcacttagatatatcatgcttaatactcatgatacttatatgtaccatatctgggtaccaggtaccatatccgatacctatatgcaccagagatgatacttagatgtatcatgcttaatacttaggtatcatgtttgatacacacagttaatgtgctagtatcatccttggtatgctggtaccaccactaccctaaaagcaaccaagatccaaacaacccatttatctgtttatccatccatcgatccaaaacaacaaaaaacaaagacaaaagaaggttcaagtctagcaactatggagctagaaacgctgttgccgacattatacctgatcggcgttgtcggcaacggccatgctatgcctcgcaccgtccatccatccatccatccatccatccatcccaaaagagaagacacacaaagacaatatctaaatccggtagcaatagagctaaaaggcatcgtcgctggcaaggaacctgccttgcttgtactccctatcacctacatagtattccatggcaagctctccccatcctccattgtcagcatcatcatctccatcctcttcctttctccaaagaagacagagggcacgccatcaaagtggaagaagcataggacaaggagaagggggatcgagcccagagcaacactagtgtgggggaggtcgacatacacggtggatttgcacgaaccttcaccgacatgatggagtagggggaaagacgagcatgaggggaacaaggagagagagagagagagaggggaggaagatgagcttcccggaggtccagaggataaggccccgtttagttccccataaaatttccccaaaaacatcacatcgaatctttggatacatgtatgaagcattaaatatggataaatgaaaaaactaattacacagttagggtggaaatagcgagacgaatcttttgagcctaattagtctatgattagccgtaagtgctacagtaaccccacatatgctaatgacagattaattagtctcaaaagatttgtctcacggtttccaggtgagttatgaaattatttttttcattcgtgtccgaaaagcctccgacattcggtcaaacatccgatgtgataccaaaaaattttcttttcgcgaactaaaccagccctaagtaatgtgtgtgtggtggcctgatactctgatttgttaaatgaattgcatcattaattaatttatcccgttgggacatgacactgttgtgtagattttctgttccaaaaaacagggtggcgccaacctatcctaaggagtctccaaaccaaacatgcttagggtgctactcagatcaatataaccactaggctatatgcactctcacggtttcttgtctttataggtaccagaaaacagaacttctttaatgtacgtgggcacgtggctacgtattattgcttcaagataatatatgatgaatctcgctcgcctagaacgtcattgcaaacattattacattgccgttcatcctaattagtatttgccgcttgaaataaaactacacgcgttgacgcaattaaaaagacattgacttgatcggtatacgcatcagagagcaagaatactacaggcgaactatctcgatccaatagagtaattcgctgctatatcgaattctatgcatacgttgttttccccaacgccatgattaataattttatcgtaaaaacaaacactcaccttctctcaatataacagtgttttaatagctggttagctaagacatttaaagatcaacgttctcaaatactcctctccatctacttttgataatcatatttccagatctaaaaaaaaatttttgataggcatatttcaattcaacaacttatcattttaatgactttctcggatttaatgcatgactattcattcttccacacatgattggctacatgggtattgagaaatataaatattaatgaatcgcttgtttacgaggaatgactagtagcatgtttaaatggataaatagaattaattatccttagtctgtgtgccaaaatgaaatataactatcaaaagtagatggagagagtactaactaatacgactaaataaaattatagtaggagatttgcgttcggaaaccctgtgtttccaacacaagctgtgtgcacggaaaacgaaacggctcattagctcatgaagtatttgctcattttttttttccaaaagtggatcaatatgatttttttaagcaacttcgtatagaaacttaaaaaaaaaaggtcccgtttagcagtttaaaaaacgtgcgcacgaaaaatgagaagggaaagttgggaacacaatgttccaaacacagccttaatagttcagagtttttttttttgacagttaatagttcagagttgagatcgagcatgttgatattctacaaaattaacccaccggccagcggaagaatactccgcgaaatttcctgcgacttgcattgtacaagtcgcacaagaccaaccgcgtgtctccagttaaggtactcctacgtgtatatgtatgccattcataacacgatcatcgatcgagtaaactaacttaattacacccgatcatcgagcgaattgaaagaacaagctagctagctaaacacgatcgagttatcggttatggagaggtggccgcttcccgttgctgcttcggcagctgcagtagctcgcctttctcttctggtcgtgctttgcggtgccatcagtagggcggcggcggcggcgccggtgagggtcggagttgtgctggacctggcgagcggcggcgagggaaggaggagcctcgcctgcatttcaatggcgttggacgactactacggcgccaacgattattctaccgccgcggccgcgcgcgcgagggtggagctgcgcgtcagggactcgcgcggggacgtccttgcggcagcgcacgccggtgagtgcagctactatacacatgaagctagctagctaagctagatgtaacgtatgcacatgctactggagaaatggtttgtagtcccggtttgtaacatcctatagtcctagatagcaaaccgagactaaagatccgggacggttcaaatacccgggactaaagatcgatctttagtgtcggttggtaaaaatttctatattctttcttccctacgaaaaatttctctctgatcaacttccatcaaaattacagaggcaataatgtatacaaaacatatctctaaatgtaatatgataaccaaaaaatattggaggatgaagttactgaccttttagatacctccaatttgtatataatcaccaaaataaattcataaaaaatttcggcaacacctcccctcctcaagaagaaattttgaagcttggctcaggttggataaaaaatactctctccgtcccataatataagggattttgagtttttgctcgtaacgtttaaccactcgtcttattcaaatttttttgaaattattaattattttatttgtgacttactttattatctacagtactttaagcacaacttttcgttttttatatttgcaaaaaaaattttgaataagacgagtggtcaaacgttgcaagtaaaaactgaaaatcccttatattgtgggacggagggagtacatatataaaggaagctaactagtcctggttggcgttaccaacccggtgtaaagatccccgggatctttagtcagttaggatctttagtcccggttggtgttacaaaccgagagtaaagatcccggggggcctgacatagcctaccaaccggaactgaagaacacatagtctcgttgcgcttaaaaagaatttttagttccggtttttattggaaccaggactattatgtaatttggtcgactgatcaaagatactttctccagtagtgacagtggtgctggcttacacggctggtcggctgcacatgcatctgctagctacctcagtataccggagaaaaccaacttctgatgataaatttgtacaagtgtttatctaaatttatttttaaaagttgctttttttttcttttacagagaaagtatgcaccaaaccgtttttcagttttacttaattttgtaaaaatattccatcatatttattattttgattacatgcatctgtttacaatgttattgctaactacgtatcctcgatctattcctccgtgtataagtaatatgtgtatttctcatatctcttagttaaatacatgttgaattttttttaatatttgttgagtacaaaaaacgttttttaattattacttggtataatatctccttaatctgtcgaagtctgtttgtagcttctaggagtttgtttgtaccgtctagaagaataattgttggaaacaagacgattcatttcgtcgtgtattattctccttagatcgacatccatgttacacgttattggggacgttgcaggagtgtccatgatggaccccaaatttaggggaaaagatgaaccggtgcgcatgcctgtgtatcgtaagtatcttcactcttttttgttctctggcattcatctagattggggagatctttttttgggaggggggaggggttggtatttggggtagtattgaacgaggaggaggccggatgcaaaatttctgcctacatggagtgccatgtcggtggtcatctccggtcaaatgaagtttgaacctgctatgattcattaaaccgagttgatggatttagatacgtattttacaagtttatagatctaagtgacacctccgaattttgataagtagtatctatattctttaatatttgacgttgattagtttaaaattaaaataaccaatgtaaaaaaaagcaaaggaaatatatttttgcttatcgaattgtcactcagcacgtacgtcaaaaccacttgggtttggaccaggaagaagaacggttttaagagttaagggtggttcaatatccgatattagagtttatagttgtttataaacaaacgctaattgaaggggataaaattaaattaatggactacttatcccttctcgttgtccttgcagttgaggagttgatgaacaagaacgcccaggtcgaagccatcatcgggcctcaaacctcagccgaagtcgagctcttcgctggcatcgcgatccgcaaccacatcccgatcctctccttctcccctactacctcaccggcgttgagctcaccgccgacacgcttcttcgtgcgcaccgctgccagcatcgcctcccaggccgcgcccatcgccgcaatcctcgatgtgttctcgtggcgcgcggccgtgctccttcacgaggactcgctctacggcatcggcatcctcccggcgctggttcacgcgttccaggtgcaagggcagctgctggcagggtcgtacggtgcgcgtggcgtggtggacagcgtgtccgtgccggccgacgcgacggatggccgcctcgacgcggcgctccgtgccgtcaagatcatgccgtggcgggtctacgtcgtgcacatgctccccgccctggtcgcgcgcctcttccgccgggccagcgtcgccggcatgatgtcggagggctacgcgtggatcgccaccgccggcgtcggcgccgcggcggacggccttagccctgacgacatcgagcacatgcagggtgtcgtcagcctacgcccgtacgtgcagccgacgggccaagtcaggagtttcacgaggcggctcaaggcaaggtttcgccgtgataacccgggcatcgacgacgaagacgacgacgacgacgtcgcgcacacgtcggcgtcgctgctctggctgtacgacacggcatgggcagccgccgccgcagccgatcgatgtctccaccagagcagcaacgcgagggaagaacacaacacgacgacgtttctcgatgctctgctcgcgaccacgtttcaaggcctggccggaaggttcaggctggtcgacggcgagcggcaggtgtcggcgtacgaggttgtcaacatcatcggcagcggcgcgaggacggtgggtttctggacgccggagcttggggtctcccaggacatggcgcggcgccgccccaagagtggcagcaatgaggagctgaagcaaatcctatggccgggcgagacggcggccgtcccgatcgggtggagcgagtcggcgaacgggcggccgctccgcgtcgccgtcccggtgaaggtcggattcaaccaattcgtggcgatccgaaggcaacaaaaccagacgagcgccggcggggcaatgatcacaggcttctgcatagacgtgttccaagcggtcatggcgaagctggcgtatccagtcgcatatcagtatgtgccagtcactgacaacatgttatcttatgacaaaatggtgaacctggtgcatgaaaaggttagtgtctacttaccacctccattaatttgcgtttacttggcagcattaacttttattgcttcaactttgatcacaaaatttatttttaacttaaatgggtagaataccattaatatattttagaacgaaggaggtacgaaacaatatgtgctacaagtataggccgataaagggaaactattctaatccctcgaggggatgttccctcgtttgctaaaaaaccatctaaatggttatgaaaaattctggaaaaatttgacaacattcatacaacacatatatacaacttcacaaaatcttaagtccaaactcaactcacacgtcgagatataaaaaagacaaattcagcgtatgaatagtagcgtactgtttatatctaaatttgtcttttttgtttctcgatgtgtagatcgaatttgaacatgaattttggtggactagtaggtatcattatactctacattgtcaattttttttagattttttcacaactatttgtatcgaatttggaagaaaaatgtatacgaggggatatcctttcgagggattagaatccactcccgccgataaacaatgacatgccactaaaataatttatcctgaccttgttgaggatagaattgtattaagatagaacatttaaatatactaaaatttaacaaatgcatccgtctcaaaatataccaatctaatactattgtattgtagaaagccgatgtggttgtggctgatatgacgatcacggcagaacggatgaaactggtttcattcacgatgccattcaccgactcaggagtgtcgatggttgtggcggaaaaggagaaggcaaacaacatgtggatcttcctaaggccactaactccgggcctttggatcactagcatggctttcttcttcttcaccggcttcgtcgtgtgggcaattgagcacaggatcaacccccgattccatggcacgccatgtaatcagttcggagttgtattctactttgcattctcgactctagtcttctcccatagtaaaccccgttcttgcccccccccctttttttaagtactccatcattctaaaatatagtaatttagtactccctccttcccatattgatcatcatataaatttatacaccaagatcaaagataatttaaatcacaacaatcaagataccatgcacacgttctctcacaatgcatgcatcggttaaattataatgccaactacacaccttagcatacacacattctcccgtgctgcattaataattgtattctgatgaaatccgtgtccatgcggttatatgatgatcaatttgagaaattttaaatttcattgtatgatgatcaatttgggaaggagggagtattgaattagaaacaatctagtactacgatatctgtccaagttcatagtactatattatatcaaattcaatactcgattactatattttaagattggggagtatattattatatgattgcacaattttgttactattcccttttgatgacgacactaatcctgatttaattttcagaggagaagttggagagcaacctgtcgaagctcgtggtcatcgtatgggtgtttactgttcttatcatcacgacaagctacacggcaaacctaacatcgatgttgacagtgggacagctgcagccgacgataaacgaattaaagaagggcgactatgtgggttatcagcagggatcattcgtccaaaacatcctaaaagacatgggattcaatgaggacagactaagggcatatgccacaattgaccagtatgccgaagccctaaacatggggtcagataacggcggtgtctcggcaattattgacgaagtgccctacttgaagctctttgtgtctcagtactgccaaggctacgccatagttggtccaacgtacaagagcggtggatttggattcgtctgtccttatcatccctttcaacacatttcacacaacataatttagatagaaaatggatttatggtacttgagaaattactgaaagttatcaaaattttaaactacaaaatatggtactccttaattcctcaagaatcgtagaattttaccaagaaattaacacatatagaaagtggcagttagctcatactttgttcttatacggtaattctttttttctaaatttaggggtggccacgagtggagcagcttgagcttaagtcccacacgtgccaaaagaaacacaaaggaatttgctgatctttagttaaaatttgtttaagaagctcatactctagtgatttagccctatttatggttcctggcttcgccctttactaaccgatggggttttttttctttttttttcaggataaccgaggaatactgttgtgccttttttaacgtagctagctgggattttttttatatataaaaaaaggttaaaacctggactatgcatccctttggatgcacacatccgagctagctaggatgtatacagaccatggtctatgtttttttaactatctgaaacacatgcgagacacgagggcgcttaaatccatttttttaaaacgattcatagggcacttagtatttatgtatttttgttctttcactaagttgttaatggtgcagtaacaataaaactaacaagttatatactaccttcgtcctaaattataagaacttaaaattagattagatatttcttagcataatgtattggaataggaagtattagaaaatatcttatttatttatacgttcttatattttgagacgagagagtaaatgtttgtgcgtgtaatgtcatccaggttttcccggtggggtctccgctggtgccggacgtgtcgcgcgcgatcgtgcagctggccgaggaaaacaggctcgcgaggatcgagaacaagtggttcggcgagcccggctcctgcgcgagaaagagcaacagcaccggcgacgacaagctccggctgaagccgaggagcttcggcgggctgttcctcatcaacgccgccgtgtcctccgccgcgctcctggcccacctcgtcgccgtctcgtcgctgccgacggagctgcggcggcgcttcgccgtcgtcgtcgctttcggtgtatccggccggcgtggaggtggagcgccggtggcgatggctggtggcggcgcggaggagagaataagcgagccgcatcagttggttggggaaccaccgaaccagaaccactcagctgcagggaccagctcaacagtagtagtacagtagttgagtacacaatagtcaaatagtagtagtaatcggctgatgcaagatatcacctcggaggcatcatcctgtcccgttctgtagtagtatttttcttgttttatagatgagtattggtaattgttacacgatcctatcaatacttcaataggttgttgttttataaatactagcaataacagcgcgctacgctgcgcgtgtgtttaagatgatgaataaaaggtagttttcagctggtaatttgtaatcatacatgagataagatttatatgtaagctagcaatttgttgtgcacacataatttagcacaaaggcggaccaaattataggtataaattagctagtatggatgtatgattttctagctaaaacatcacctcattgttcctgagcccttgcatataatgattgcacatgtaatgaacaaacattcatctagtgaacatacacatctccagattcctatcaaacaaaataaaacatatctctagactccacatatatagcatgtgcattttttggaatcccatgtcatcagctccaattgttttggttatctagatacctacaaacaaaggacttccagaaaagataaaccattaataatattgattggcaccatctgagaacaaaaagagaccataaataagagtgatagtatcaagaacacagaataacccataaggtacatattgaacttgatgatttctcaagcagcactgctagtgataacaattgagaagagcatgcatctactacagacatcacacctcttgatctgtctctactctctagtgtacctactacacatatatagaattctaaaaaagtaaatactatctaaatgcccaaaatgtagataaaaaagaaaacatggactattcatatcaacaattttagccatttacatctggtattgatactgccatttatattcagcgcatatctcgacatattgccatttagcttgttatacatagagcctgactgacctaacgaagacaatataaatatgtatatttgtgatctagtaaagttctagctaatatcaaaatcttcaaccgaagtatagatttttttttttgctaaatgtgcaacattccttgtaattgtcagtaagttccataacccttgattgacacagtagtattggttgttgtgtaagaaagatcatataaagatgtagccttttaccataaagaaatgatttgttggtaccgaatgcaacatcttaaaaatgtaatcaataagcctaggattgggagaatggactcagaataagcttgttgtctcataatggatatagagatgaaggaactaaggccccgtttcttttagcttaagattattataatctagattattgagtcagattactataagctagattgttataatatgtagtagaataagcggttagttgtttctttcctagattattagaacctagattattaggtttgcaagtctaaaaaaggagtggggtggcatggtgggtaatttttcacccaataatctgaaaaaagctcacctaaatgagcttatcagattataataagctaggctcgagattataataagctacttcaataagttgtctgtttctttcagcttactcctaataatctggattataataatctcaagctaaaagaaacagggcctaagctaataaaaatggagatacaaatgcacgaataacaatacctttgaatggacaaactgaaaggttcaatgcgatatataccaagattgccaagttcggagaatctttgatgacatatcaatcaatattcccaacataagattgtccaaaagtatatcatacatactctgtcattctgcatataaaaatagtgggcagcaaattaataaataaaatactatctgatgaaaagggaaggaagttgaggagactcaagagatgcagcatctgcccgtagcatactatcatggaaatgcggtgagtatttagaagaccaagattattacctcttagagaagacaacaaagaatttccatacggtccaaatagaagcacaacaattggcaagtggctgctgaaagaagatatttcatcaatatggaacttacaataagtagcaaaccaagaacagagaagagatatcatgggattcgtatatatcagctacatatacatataatatgtgaaacatcttatcggaacttagagggaggatcgatggtttaagtagtggtgcataactgcatatcatgctgtgttagctgactgattcgcagaaggggaaagatagtggatgcgtaggaaatggcaacaacaggccagattaattacaacctgcatgaaagaatgaacacaacaaagaattaggactgcacaagggggaagaaatggctgttgaaatgaactatctgagtttggaacacaggttgctgagaaaaaaaataatttcatatggtcaagtttgattcattctaccctggcacattatagttaaaatctggattatataggcacttaagcctcctttaatttgcattcagtgaaacattatcaatggatcgtagttcctacactaagaactacctcatcccatatcctattatccccaactggctgtcaataactgaaagcctacttggctgttgaaataaaatatctgagttttggaacacagtagctgctctaatggtatataggcttcaatttgaattgtcacattttagctatatgactatgtatgtagcatgttaagcatattctgctatcaataactatttcaattgtagaaaaacactataacataagtatatggttttttgaacgcctgaatttgcacacctcaggagagatatcctacttccccaaaatgcattagtgctcctaaagagagaacctagctagtgcttctcagtatacctctagctaagaggacaaaccaaattaaggaacaaaaataacatgcaaaaacgttccatggccaccgcataggtcaatgatagctaaaatttcagttctaaataggttaggatgacttcatatgatgttttaagaaaagtaactaattcgtatggagggaaaacagaatttacatagatatgtaccactccatatgcactggaggaatacctgcatctagagagggatacctgcatctagagaagcttaataagcactgataaaaaatacagtagggcatttacattatgctctgaaacgctttgagatggatctgcactgtaatctttcttagtgtacatcttacgcagggaaaaaaaggagcacaaatatgaacctcaaatcagtccaagaaagaactttaccttggcaaccaactgcaagctagcagagaacagctgggacttgaataaatgcatgaaagtcccaactgcaagcagagaaccacatgggggcagcggcgttggtactgcaaaagaacagatgccaatcaggaggaagcctttggcagaagtgaggatgtaagagccagaggagagattggaggtaccagaggaagcgatgacgtgaacatggcctttgcagcgtcgagctggccatctggctgcgggagcacaggcaagggatgcggggaggtcgtccggccgtcggggtggacgcgagatcgacaggtgcacggaggagctgagggagcgcaggaatgagcgcgtgcaaggcggcgtgtccctggcaccggaggacggaccaagggcgactggatcaactggtggggcgtcctagaccatcgcttccggcggcccctgaaccagatcgagcacctcacctagcggagtggagagcgcaaaggagagggaagcggtggccgcatggggatgaatagggataagagggcggtggcggctcgcgttcctctcgtccacgcagcgacgatggctcgaagagcgcgggctgcgcggctgcgccggcagcggtggcggcggcgacgaacgcgaggggaggagaagggagaggctgcgaagcgggcaagagggctagggtttggtgtgggctagcgaaatctctgccgtccgttcgcgatccgacgatcccacgggtgtgaaagggccgccatggcgggacacgtgtatggccagatcgatcgcaacatgagatcggacggtggggagcggagacttgcgcgtaattaactggaaattc

SEQ ID NO: 60023 - DNA, 12269 bp, Oryza sativa
tcgaataagccaacaagcaaacagccaatcagccaaaaaaagccaatgcaatgcacagtcaaatcgacacgacatcaagtatcggtaattttatcgatatcgataagaaaaaagataatcttaattatcgatcgtacaccattgtagcacatacagagtactataggagtatttacgcaaacctgcggctggcggctataaagtgacagcattgatgcatcacttttcaagacaggaagtacatgggcagtactatgaatcgatctgcttaaaataactactactccaggctagtaccactcataggagtacgataaaataaaacaagaagggttaatggactccagagtaggaaactggtcagccaaatcttacgtaggtacccagcatgtagtggagactggatgcatttcaaactaatggccttttttagatcacacctaaaattttacaccttgttatacatcgaaagtttaaacaccttacagacaataattaattgctacatcgaaagtttaaacacctaaagtattaaatataggctaaaaaataattaattgcacagattacgactactttacgagataaatcttttaagcctaattgctacatgatttgacaatgtggtgctacagtaaatatgtgctaatgatggattagttaggattaataaatttgtcttgcgatttacagacgaatacagtaattagttttttattagtacccaaacacccgatgcgaacaccccatgcgacaccctatataatacctgatgtgacacgccaaaactttacacccctgatctaaacacccccctaaaacaatatatacatggattgatcttttgtgaaagaactccaactagttcatttcaaactaattaaactataaaaagttgaaacgaaaaaaagagaaacaaatttgaaaaatgaagaagcaaagtgagttcttgttagaggacgaatttagcttattagctacacggaaaacgagaaaaacaattagtatatgattaatcattaattgtgtattaattattaaaaatttaaaaaatatatttattgatttttaaagcacttctcatatagaaagttttcacacgagacacactattaagcagtacgaaaaacatgctaatgggaagtagttaattaatctcaaataattaagcgcttagaataggccctaaggccgagttcatatatgtgcttttcactgcatggaaaacaaggtaaggattgaggtatatgattatttatttgctttttaaaagaaactttgattaaaaaatctcaaaaatttacactgtctactaattcggaaagtgtgctaacgacaaaagaggaaacttactgtttggagctgaaaagaatgcagcctgaggcgaagcttcttttagtccacagagtggactttctatctaattaaaggagggtttgttcttggaaatcagggatgcaatataagtatatgtggattataaccatgtctttaatctcatggaagttaggcagacttatttaaaaaaacaaattcgacatatatatttcgtgaacatcatgcatgcatgggttttaagattatgtatattgtatctcaacacacacctagctagttattaagtgaagtaatttaattagacctccaagaaatacaggatttttccaattttcgcgccgattggacagattcctacgaaagtactgcgaattcttcgacgaaacatcaaattatacatcgtgaaaaaaatattagttactaaaacagttaaaagaaaatttataagaaagtagcatacaaagaagcaacatcagaaatatacagatgaaacatcctgatgagaacggagggcaacattaaaaaaaatcataagattaaaaataaaaaaagtgaaaaatagtcaaatcgtatcctatatatttgaaatgtttctctctcatgcataaaacatagaaattcattggtcgaaagatatatatttctttcataaaataaaattatctgatatatttttaaaaagattttgattacaacaaatacaattaatatatttgtattaattgtaaataaggtatatatacttcataattaatacctctatctctctatatatatgtatgctccctaaggaacaaggatcacagaaaaatatgcaagttttgtgcagcgtgcaggtgcttttttgataatgaccatatagctcctagatatacggtggtgtcagtgccatatcgctttacatgaattttgtagcaacaatataattagctgatttccatagaatttctggacaaaaaaaagaaatccttttgcttccaaagcgctgtaagagatggctgcttgtgttcatgcctctgttaaaagaacggccaaaaaggaaaagggaaaggtgtatagctagattgcattttgttgtttgaattatgcctacctagcatgcattgttcagatatctatgcatgtccttgtttgccagaggccgaccagctagcccaactagcaaaaccgaaaagaaaatgttgggtcagtttctaccaggggataagaaaagcagcgagcatacaattttaaataaaagcagggagttaggattcaggaagcatcatgcaatagccggtagaggggaccaaattaaaagaaaacatatgaaaaaaacgagagtgaagaaagcatggtaaatgcaatagagcagagagagagagagagagagagagagagagagagcaacagcagtagcaaaactacggccaaccgtgcatgactgggttgtgttacattgcatggttcatactgcaaatggaagctaaccacaagcaagctgagccgcaaagcgagcaaggtagcagtcacaaaccctatgtccctagtccctacctaatcctagcttagcttgggaaccagaaaattagctagtgtagtagctgttgatcgatcaacaaacgtacgagtagtagtactaattaaaagaagtactacacagaccacaggtttcatggtagcgagatgcatggaagctaagaacacactcaaccatgggagataattaaaccatggttcatggaagtcggtcgatcagctcccgatcgagtcgatctcgaaggatctatctcacactctccatatgcaatttgcattgcagagaaatgcatgctcgctcactggccgctacagcctacagagaccgacagaaagcaatgacacacatatgcacgcaacgctagctgcaactgggaggggagtactctgcatgtgtctgtgtagcgcgcgcgcatgcagagacccggcggcggcagtggaaatatatatatatacataatcaattgggcagggagaggaggcttagcttagctgtgtgactggctataggattaggaggaggaggcagccgtgggtgggctacgtagtggccgcggtagtggccgtggtagcgacgctagtgtgtgcctctacctttatatatagctctctctctcccgcgcttcgctttgcatgcgcttttccacccagcgtccagcgattgacctcgccaccaccaccgcccttgtctgatcgcgtgcgtgcgtacgtgcgtgcgccgacccatccacccatcgcgccgcgcgcgcgcgcgatcgagagccaccatgcgcgcggcgatcgaacagctgagagtccaggcggcggcgcgcgcgcgggggccggcggggcggtggatccaccgaggcgcgcgcgactaccgacggggcggacagggggatcggtcggccagccgaccggccaccgaggcgggagaggcgcgcgcatacgtacgtggagcatatggatgaatatccctgtatacatgcgtgcgtaggagtatgcgcgtgtggccaggttgagtacttgagttgcggctgtaactttccgtccgagtccctttgaaaaagtcaaacacctgctctctcatgctccttaacgctttagagtttcatattataagactttatgtatagatttattagtatctatataaatatagacaatgctagaaagtcttataatataaaacggatcggaagcactattatagacagtgacatgtgaagtaataaaaaggtgggacccacatatcagtaacggtaatggtactgatattatgatagaggattctcacccggtctaaacataccataccaaagctaaaaacatcaatttttttcatccaaacagttaagtctctaacgttgactaataatgaaccggagggagtatatttttacgaatggactaacttagagtggtggagcttggccttatattaggaatgaaaaagaatgagatttggagaaagagaccctcgctccaaatattttttaagaaaaaattataaacgtattagggattgaaccgcacatcccttaccattgccttataagtgcatgttcgacctacaactgatagggcttaagcgctatacttagcatcataatactatttaaattttacaaaatcatcacataatttcttaccaaagaataaaaaccccggttccttcggctataggcgtacgtggattttacctgactccaccctggctaaaaacttttattttcttgctggatcgactgaacgcataataatcctgataaattagaaaatggatccacaggtcaacacaagcatcgttccaattccaacaggcttacaatgttggcgcaaagactttggaacctatagtagttctgccgctatatatagttttttgaacgactcgcacgagacaatgcaaagttctattgatagagcaggaaaaaattataagattacaaccctggagagtcataaccaggagaaagaaaaaaatataccaccacccacacactggcagcgccaacacacacgaccaggagaaggttagctccggaccggctgccgctaagcgtgaccggccgccgctagaccaacaaaggaacacagacgagatcgccctacagcaagggggtgccaaaacgacgtcttcaagaagagaagcgacggaagaccgccgccgccgtccatcagggctcaaaggagccaagactgggctttcgcccggcaatcacccttgaggggtgagacagcacgacaacgccttcaggagggggaattcatcgttgtcggtccggccaaggccgagctaggttttcacccgccgctcaccacctgcgaatctacggctgatgcaccgatgctccaccaccactcaaactctgccgacatgtggccctgcaccgacgcccccgtcggccagccttcgtgcgccgaagaccgtgccacacccaccggcagctccaccacgcaccgaggtcgcctcttccaccaccagccgcgcctctcgcgccaagccggtctcctccaccggacgcgcctctcgcgccaatccggcctccctccatcggctgcgcctctcgcgccaagccggcctccatctccgccgcccgcgcctctcgcgccgagccggcctccgctgccatcggctacgccactctgtgtccagccggtctccgacccctcctccaaacaatgctgcgctagccgatgcaaccgtctgccacgccctcggcaagccgtccgaggccgccatgcctcctcccaccaccgtcacggtcaccacctcaccgtcgccgccgtcacctcacacccaactccttccccgcctccactgccgcatccttcgacgttgccaccgtctcctcagtcacggccgctgcaagtcggccgccgtcgctgatgccgctgttactagccacgacgccagcagtcgtcattgcaaaccgccggcaccgccaacgcaaccgccccaacgccgtcgccgagctctccgctgccgtcgcgaccaccaccgaggcaaaaccatctccagcgcctggatccggtcgccgatgccagcctcaccgctagatccggcctccgtcgccaacctcaccgccacctccatccccgccgccatctccaaccccgccgccgacgcccccagcaagagaagcagcatgccaccagcacgcacgccatccctgtcgccgtcgccgcctcccccgccaccgtcgtcgccttcctcggcgccagccaccaccaactgccgccgccaccccaccaccttccatccccgccgccaccaccaccaactgctgccaccacctcacaccgacccaccaccggcggccttcccgccagatccggccacggcggcccggatctaggcggtcttcaccgtcccgcgcgtggccccccaccacgatgggagaggaagacgaagacgagggtgaagcctcgccgccgccgtccttgcggccgcgcggctttgccggcgaccgctcgggcggcggcgaggcggcggagggaggaggggggaggagcgggcgacgccggcggtttccgcctcccgtttcgcctgtgggggaggacgacgcgggggcgcggtcttaatagccgctatatatagttgctggcgtggccaagagaatcgccccgccctgtctgacctaagcagaagtactaagtcttagcaccgtcttcattgtcaccgagcttttgcagcttgccgctaaataagctaatcttattttgctcaaatatcgatcttacaagcattaaatgatattgtacttatatatggtcatctaatttaggcttgctagaacgaggctggcaccaaccattttgaagatctcaggttagaacgagaacggtggtaaaccttgggatgtcatttatagaagctttgactgaaagggcttcgacttccttgccattctggttaactggcacatgtaaaataaacattgaacggagttctgtcacaagtgccgccaacagtagtgggacggattctgcaagaaggacggcaataggtggaggctaatataccaatcctgtctaggctagccatgaagtagctttttcaatcctccccatcccacacccttcggtgtgttatagatgtatgctatttttttctaatatattaacatgtaaagtttttttatgttcgcggaaaaaaaatctcaagttgatagtaaggctatctataggtctgcattgaccctgccatgttatcatagctatttgtaattgcaccgtcagaataattgacactgatatacattacattctaaaatacattaattatatgtagagttgacctccggtttatctccagggataggtttcacaaatcagtttgttaaattagttttccaaaaggacgaaatgcgaagattacacaggtgagtgcgacctcctcgattgagacatgcatagttacaagcatatcatacacatgcacatgcggtttgggtgggaattgtgagtggcggtcggagattgcctcggggacggggctccttccaagattgagtgccgccgcctctcgcatagcatgcctatactctcccagtgctcttggccggttatctgatctgtccatgtcgatgtctcctgagacctgagtgcctacgtgtcatgcgctgctattccaacctggcattctggcagttcataacgaagataccaaaacattccatgcatccaatgcaagaacattccatacatccaatgcagtatgcatattactccctcgatcaacaaaagttatacatattgggttggtttggtttgtggcctaaataggccttaccaaattttgtcagtgccaaattttggcaagttttggcatgactaattttggtaaggcaaagttgtgtttggattgaagccaaaataacttaagttcactattgaaatggcctattttcttagatatgccaaaatttggcttcaaaccaaatagatactaaacactattaaaattgtcaaatattggtaagtctaatttaggtctcaaaccaaaccagcacattacttttaacaccaagaccaagaagaaattaaatcaccttgaatgttacaaaatcaagtagtaaatgcaagcatgtaaccaatgagtatttagatgagtccttgaggttctaataaaacatttaatttatctcttcatttaagttttaaattcataaagattacaaataggaacaacttatttgaaaaaatttaaatgtgaaataggtgtaacttttatcaatgaagggagtacaaagtactgtacatgtactagctaagctactgtaattgtctgcttcggtatctatcttgtcgatcgtagtgtcattgctagtggctcgtatagatcgtgggtttgcactacttcatgcaaaaaccggtttgttacgtacgctgacgtcagatgatgtccgggcccggcagcaaattatgctccaataatcaccggatggagttcatcaaatcattaatcaattcgagcggcttcttcgactgcaaatctatgttgattacaaccacacaaaggcaaatactatatctaattaattgacagaccacagatgaattgccggcagcaggggacgactcatggccatgacgagcggtttgttggtgatgaattgatgattcgcaataatttacttgtacaccacaaacataaactgcgaattgtcacctcagtggtgcattagctctgctacccaattcagtgctccgtaatgatacgagtatctggtctctgatacactactgttcctctacttgggcgcacaactctgaaccatgcatctccagagctcagccgctagctcaccgatcagatcgatcgatcatttcctgatcccacttaaacctggcttagtttcctaaattttttttctcaaaaacatcacatcgaatctttgaacacatgtatggaacattaaatatagaaaaaaacaaaaactaattgcacagttagtggggaaatcgtgagacgaatcttttgagcctaattagtccatgattagctataagtattacagtaacccacatgtgctaataacagattaattaggctcaaaagattcgtctagcggttttcaggcgagctatgaaattagtttttttattcgtgtccaaaaaccctttcaacatctagtcaaacatatgatgtgacactcataaattttcttttcgccaactaaacaagcccttaattcagcgcaagctatagcttcaactgtggtcgctcgtgcacaaccgtatatactaccgccctacctagtaagctactaccatttccagccagaaccaaacctaattatggaaccaatcatggatgtaaaatgcaacttattcttcatgctcacctctagttttttttttttttgcctgcccaactgttactggctatgactcatcagagacgattggtatagcttcaattctctctctcccttctcgctctctcccgctttaatttgcgcccacaagaacactatccacggctttattttaccttttttgctgcaaaagaacatgtttgagcaggtatttcttagttggttaggtgatgcttgtttcttggcccatctccacaaacagggaaaaatataatggcgtacgtacaaatcagatgcgtctctctgaagcacttgatggtagtaaaaaacaaggtttatgtttggagaaacagttagtttactgttgatgacaccttttaagtcgtcttgagtcgtcaaattctgccttgtggatggcattattaggacagaaagttatttggcgtgcgtccgtatagcccagagggggccctgaaagtttttctttaactttgtgttcttgttttctgccgcttaattatttaaatggcacctagctttgtaatagtacgttgtacgaaacttttgattcaactttgaggcaatgaggccatctagctacccattattgcaacttgccataatctgagatcgagcgtaatgttgctgccttcagcaaattgctaggcattgcggcctcatgcgcctcccactccttaaatgacaattaaatagttgttgaaattttagagtttgattttagatttaattttaggattttttttatagctttcgttgcatagctctctttttattatcgctaagaagacaaagaagtagtctaccttaaattgtttttaaacatcaaacttcataacctctgcagctagcataactaagcatatatattaccaaactcacaaattgccaatctaaaattcaacaagatctctatggaaaaacatgatattgtgtacgacatgtgtttgtcactgtcacaccagccacgcatgcaagcatgtgacaaacagtactgcttgatccatggagcaaacataattaagcaaaccattctacatatatttcattagttctcgcacaaatcatatattactattacatttttcgtctttctatatacactagtaattaatcctttagttccatgctactagctttttaatcttccttttaaatttatctgcactagtttaattactttctctctcttcttttttttaattcttttttcctctaattaaacaagtcgctgcatgcagggatgaccggagatgatctctatctcaggcatgctcatcacatcatcagtaacactggaggtcctttttctcggtgtagttggggaagccggagctgaggcacgacaccggcggcacggtgggcgtggcggcgttgccgtagacgttccagcagaagggctcgtcgacggtgtcgccggacgccggcagcagctcgacgtcggagagcgtgatgttggtgcacggcacggcgtcgctgcagccgaagtggatgggcgggccgcgcacgtcgtaggtgccccggatgccggagtaggagacgccgttgacgaacacggcggtggtctcgttctcgcagctcttggagaggcagtagtactggtcgatgatgatggggttgcgcaccgcgtccatcctcacgttctcgaacgccaccgccgacacggagccggacccgccctgccacgtcttgatgcgcacgccgttgtccgagtgccggatcaccgcgttccgcaccgtcacgttcgccacgcacgccttggtcccggccttccccaggctgccgatgctgatgccgtgcccgggcccgcaggtgacgttctcgatgtggacgttgagcgtgccggcgccgatggagacgcagtcgtcgccgttggagacgacggtgttggtgatgaggacgtccgaggtgttctcgacgtggatgccgtcggtgttggggctcagcgccggcgagctgatggacaggccgtcgacgcgcacgccgttgcagttgtcgaaccggaagtggaactccgggctgttctgcaccttgagccctcgcaccgtcacgttgttgctgatggcgaaccgcatcgcctgcaaagattagcatcgtacttagcactgattacactgtcactaatcagaggcagttaatacggttaaaaggtcgttgcgttaggccactcaccactgggctgtcacatggtccatgagtgtttcccccctgaagaaaaaaagaaggaaaaaaaatggaaagctattagattcagatagatatgtactccaatattgcaagagtagagatgcaattaattagttgagcttatataccttgtgaggcttgcagggaagatcccaccatttctggcccttgccgtcgatgaggccggcgccgacgagcgacacgccgtcggcgcggtagaagacgagccagttgcgcttgttgttcgccggccacgtcgccggctcgctcggcgcgacgatcgtcccgtcgacctgcagcgtgacgctgccctggcagggcccggtgaagacggtggtgtggatcaggaacgagcgaccggcggcggccagcacgacgcccgcgccgtcgtccgcgcacgcggtgtcccacgccgtcttgagcgcgtcggtgtcgtccgtcacgccgtccccggccgcgccgaagtccttgacgatgtcgtacacggtggccgcgccggccgcgggggcggcgctcggcgccccgccaggcattgggtcggacgacggcgggttggccggcgccggggccgggggagagcgccgccccgggtgaggagccggcgcgccgtggtgcctcgccggtcccggggcgtgcctcgccgcggggcccggcgcctgcgacggcgggtgcgcggcgttgcgcttggcgtgcttggcgtggtggtggcgggcactcctcgcgccatcggcggcgctaatgaagctcgacgcgaaggcaagcgctagaagcagcgcaatggcggcggtcctaccggctgcggcgagctccatcaccgcggaaacctatgaaaaactctaagtgcagaggcgttcgtgcagctctgaactgaatggtgaatcttggatggatggatcgatcgat

SEQ ID NO: 60024 - DNA, 4817 bp, Oryza sativa
agacattgccacactgtgtggaacaattcaacataaatacttccaagtttttcacacgaggggataagtaatagatccctgttatatcaaaaaataaaaaatgttctattttgagcaaagggtgtgtccccatatatttttacgaaagagtgtgttgttttttacccgggggggggggtatgccatgcgtgcgttgcgaaattcgggcccgaatcttcctctcccccgtcgtcgccggggtgaccactgtttctactagtctactagattagtactagtctttctactgccaccgttgtttaatccaaatcgagcagaaaatggacgtgaatctggcgaccagattggccgatcgagcaagatgcgtgcgtgcgtgcgcgcatccttcgcggtcagacattgcagctgcatgcgactactgcgagtgcatgtgtgatatctactactagaattaatcgtgataaagccaccactagctagagaggaggagatcaagagaaaaggctaagctaggtggcgcgcgctttacaactgaattattaaccccgaggggcggtgctgatcactgtactggaagtacatggtagcattcgtgtgcgctggccaaaagtttgattgctcggttttggttttcattgcggtaattcgtcgtggccactagatttctggtggtgctgccgtggtccatatgatccatttggttttaaccatttttctgcccgatattggtgtgcatccgcgtttcagtgcagcactcagggctcacatcaggtcggtacgtacgtagctgctagagattgcacggtagcataaatatatactgtctagctagtagataggtagcaagcctagcatctatcattgcagcttgatagtgttagttagtactagtttaagacagtcatttttgttttgcataaacaaaagcaggcgttctgtcttggcaactcgctcggtgcctggccgaccaaccatcatatcagtaaaattgttggacattttgcaaagtgaggttgtaggctcacatcaaaattgactaggactaggtcaccagaaaacaggcaaaagtctgaaacatgagtatcagactgaataaattgtatagtggaggagagaaacatatggtgcatgctgtacattcagctgtgacacttccactgaaaatagttgaaacaagcagagaaacataaggcttggcttcccctgacagatctgaactgaaccacctcttggtttctcttttttttcactacaagacaaccaaatctaaactgaaccacctcttggtttctctcttctttcttttatatgcactacatgacagcacattcagttgcaaaatcagatatctgttcttggcacacttggcagtattggggagaaaaggattctcttagttcagtgcaagcagctcttgatacggaagtgtttaaactaatggagtacttggttggtggcagaacaaaagagcatcctttgttggaaactggtattgtcaagctgcacgccttgggtggatggatttccggaacaaaagcaaaaggtagtatagcaaattatatagtatatgcaattatatctagaacatactagctactattcagaacataaatctagtcatccgtataaaaacttgcgcacgcaagacgcaagtgcatgcatggcgtgagtgcatgggatcccattgtattcctcaagaaaaacaaaagcacaagaaacaaacgatatggcgtgagtgcatgagatgcatcccattactcttcaaacaaaccaaaaaaaaaaggcacaagaaacaaacgatgtaacaatgctataaaatgctccgttctagcaataacccagggattcagctcagcaattcatgattgaaacggtcatacagacagacactgcctctcaccaaaaatgggttttcattcaggagtgatatatgcgtaccttgattagtactttgacaaaaaacgagacattaattggaatgctccttacgcccttatccatcttgtaatcaaacattcaagctaacagaaatcagggtaaaaaaatggaatcatcgaggcgcatcggtatataaaatatttaatcatttgcttgtaatcaagcattcaagctaacagatatcaggtgtacaaaatcaacctcgaaataatgaggtgatatgttgatacatgccaaacatttcaacattgaacagagttgtttaggtgtttaaaagtggcacacaactatatcacataacaatagaattaactcatgtaagtttatcagagtgttaatacaaaagaatgatcaaatacaatcaaatagcttgtaaccaaacagatgtctccaactcttcacacatagaacttttttggcttagccctacaaactggaagacttaaatctgatggtcggtgaaacctgatagaggctctggaatgaaatatggctcaagcatacatacgtgttctttcttgcttgatacagcagagtgaataaagttctcaagtcaagggcagaccaatatacaagccccaatcaataaccactcactccatgtcttcatctgctttacagaatatgatggtagaaggcatgcccaagcagggtgcacgtagaacaaaattagggcccattcaataatactgcaggccatgctgttctacggaaccaagtagaccaacgtaatacccgattagtgtatgaactgtctgctcataatcctaagaaggcacattgcttcttagcatgctgtggaaccaacttcacaagaaattccattgatgctcctttcagctctgttcaagttcagtagttagcaaatcaggatattgctgtcagggtgtttcagttggtctggcattgacaaaaatcttaacttaccacgaggcttgaaattgaatagtgggggaagagtacggccatttggtaagcgagcatttggatctcgtagttcatcgaagaatggatgaattaacacctccaactggtgcgaggagaaaaaaaggaagatgtaaaatgagtacatagaaacatttacaagagatttcctgatatatgcattaatacttactgcactgcaccggaggtgtggtgagtactgcagaagccgagacacaagatctacagcttcagatggcattcttttatgaaagatctggtgaaagtatgcataattagaatacacattataatttataaatagtaagcaggagacattaactctgaaaataagaggaacaaaataaatgtgaaggctcctaccttgtgccatgggtgagctttgatttgggggaacttaaactcagtgtagttcggattcatatgtttgatttcttcccttgttggagtacccagtacctgaatgaagtacagtaagtctcctgcatgagctaaaagaaaagggggaaactacatagaataatattccactaaactaaatcagatgttaccttgataatttcaacaagttggtcgacgccactgtcaccaggaaaaacaggctaaccaacagcaaataattcagagaagttgcttcaagaaattgggtaatgtatgatgacaactaggttgacttcttacctgccctagaagtagttcagcaagaacacagccagcagaccacacatcaatagctgtcgtgtactctgtagccccaaatatgagttctggggctctgtagtatctagaacagatatatgaaatatttggttcccctttcacctatggacacggcaaggtaaatttaagaatttcagatagcttataaaagatatgtgacctttttttatgaaaacatatgtgagtgaagattactctaattgatacaagggatcataccaggacttttgcactgccaaagtcacacaatttcaactgatgattatgtggattcacctatgacaggaatatcttgtcagacctcattaagctgaaattatcatatacggaaaataatgttgctagtatgcactactcagacaaatgataaccagttaaccacagtacataccaatatattctgtggctttatatctctgtggcatactcccacacagttatgaatgtatgccaaagccctacaaatctgaaagaacagaaatgacaatgaacagttttcagttaaaatcattatcaaaactaatagtgcatagctatagttgtgttgtaaggcgcctgcaaccttacctggtacatataaagtttaacataaatcaatggcatgcgttggctcatcttattgtaatgtctaataacacgatgaacagtttctggcacatattcaagaaccaagttgaggtatagctcctccttcgcagtagtcgagcaaaagtaatgcttcaagcatgcaacatttgggtgatcgagaacttgcatcgtttgcagctcccggttcttgtatctcgcatcttgaagaactttctttacagcaactctctcaccagtttctagacacttagcctgtcaaagataatttaattagtaatctctaaacagaaaggtaatgacagaatggcatataccaatggcccacctggaagacaactccaaatgaaccacgcccaacagcacgctctgcgatgtaactaattgtctgcaatccaataaaaatccagtactataagtttttagaaatagacaaataatggcacataacggcaattttttaataatgtggtagtgtttgccacataaattctatctattgcaacatgaagtactacagtacaaacatagtagtgatcaccatagaccaatgctatgtcagtacctgctttggctgcccatttcttccaccaacagttgtcacaatagtgtgacctatgtccatacta

SEQ ID NO: 60025 - DNA, 24483 bp, Oryza sativa
catcaatagttattgtgtcaagagagattttgagatgttcttcatgtcatgagatatggcttgtgggctgctgaggcctgagagctgagagctagaggctgagggcttttgatttttttttggttgcttttccacacctgtgacgggtggtgagttgaaacctgtcggaggtgtttatcacctttaacaggtatagctcctccttcgcagtagtcgagcaaaagtaatgcttcaagcatgcaacatttgggtgatcgagaacttgcatcgtttgcagctcccggttcttgtatctcgcatcttgaagaactttctttacagcaactctctcaccagtttctagacacttagcctgtcaaagataatttaattagtaatctctaaacagaaaggtaatgacagaatggcatataccaatggcccacctggaagacaactccaaatgaaccacgcccaacagcacgctctgcgatgtaactaattgtctgcaatccaataaaaatccagtactataagtttttagaaatagacaaataatggcacataacggcaattttttaataatgtggtagtgtttgccacataaattctatctattgcaacatgaagtactacagtacaaacatagtagtgatcaccatagaccaatgctatgtcagtacctgctttggctgcccatttcttccaccaacagttgtcacaatagtgtgacctatgtccatactattgccactgaccactacagcttcaacttcctggtacatatgtcaataagagtcaaagaggatggtatcatcataagaattgagtaatattgtgattgatttccagaataaaattaccttatctcttatgctcatctcgctgatatcatctgtcagacgatcagtggctccactagtactcgtttccgggaaacctgatgaagaatctactagacccaccgatgtcataatagccaagaagttttgtaccttctggttcactcctatggaccaagatcctttgttacagagctacacacaatccacctgcaacaacaatcattttagcaggacacataacctaggtactagtagaaaattgcacattagaaacatatatccctgcaaatctactaaataaaaaaatgttaatggttagtcctaactcctatgaattagaagggccaaaacatagttggatcttcaggtacccatgatgccaaactgctgagcacttggttacaccaaacaatttgataagaaataaaacaagctcatattagctttgttgcgctcaattcgtatatcgatgaccctatgaaacactatatcttcccaagttttgagaaatgaatatcttgacagttgggtatacagaagtactgcaaagaaatatactaaagctggagacttttcatccgaatccagatcatcaaactttggtcaaaattaaaagcataacttaactaacagctacttattagaactcatacttttaatcgtcaataaaccttacatccaaattgggggcttttaggcaatgcatcatatttagtccttaaaaggagatggggccaattttgcttgagaccctcactttggaggatcttttgaggctagttttatgtagacatgttgtacacatgatcttctgtaatgaaagtgtacccttttgtacagatgtctactatctgtgtggttcattggtctcatgcgatagtgtatataacacatttttcagatttgagcatagtaccccccagacgcccccatcctcacattcgacatgtattaacatgaaggacttcaccaaagctcgaactttctaagttcttaggtttatacactacaaagaaatgtgtgaggttccgcccccacacactaacaagcaaaagtacatgacacagaacctaaatagctgaattctccctgctcagaaatttgagccgtactgttatagcacatagagcctcttcggcattccaattcaaagcagcacaatccgaattatccctgctcggtaattcgcctctcaccttatagtgtaaagaactctccttggtttttccaatccaaagcaaccacaccactctcttttttaaggtaccaattaccgacaaagacaccattccgaacaataactaaccaagcagatggagattccaaacgaatcgcttttgcaaaacaaataactaaccaagcagagatagatagagagagagagagagataccaacggatcgcttcggcgacggcaacgcaaacccggaggaggaggtagccacggacgcgggagagcgccgtccagcagcgggcacgccctggaggccggatctggagcctggagccgagcgggcgtagtacgtcggcgatgcggcgggctagggcaagcccgcagctgcggcgagggagcggggcaagatcggcgcggggggaggaggaggaggaggaggaggcgggattcggattcgatctaggcggagggcgatgagcaaaatcgccccccttcacctcactaaccctagttcgactcctctcctctctctcccgtctctccgcccgattccaatcgggaaggggattccaatctctgtagccgccgccgctcatgcgcaggccgggctgggccgaactgggcctgtattgggcttctgcattgctgatggccccgaaacggcctgcgacgtggcccaacaagatggctacactgtcactcactcactccgccgcttttcccttgaccccttcctctcgtcgtcgtcggtgcggcgccgccagggaaaatggagtcatcgaggctgcggaggcggcggcgctgccgcgtccggtgcctcctcgctcctcccgttgccgcccgtgcgcagcagctgcagcgcgtcgcatatttctccaaacccacgcagatctccgctttttcccggcggcaaccacgccgcggcaagcaggtgagaagagctcaactcgctgcatgcaagttgctcgatgaaatgcttccatggagccagcttctagtttctcgtgtacatgtacaatttactttttttccgttttctttacaggaattctctgcttcctagatctctaatcatttactttggagttcttagcaatgtttttgggtattggattctatcacttgagaaaatgagaaccgccatcccgcacacaccaaatgatgaagaaatggtatgcatacgtttagtgtgtttgtagcgttgttgacctttgagtaatgtgctgcaagtgagatgaccgattctttgttagttcctcaaggcaaccaacacatgatccgtatcctagcttagattgaagcatacggaactaagcagaaacccgggcgatagtaataagtttattgcatattttctgcacatggacttaggaaggtttcctcaatttttttaatgaactttggagggacttcttcagtttgtttagctcaattttaattcctcggtcagaggaactaagcagaaacccgggcgataataataagtttattgcatattttgtgcacatggacttaggaaggtttcctcaattttttaatgaactttggagggacttcttctgtttgtttagctcatttttaattcctcggtcagaggcttttaaccaaacacgctcaaagtcaagagtccaaatataactatcatagtttcacggcacgttgacagttgacactagattgccagcttgctcatcaaccaaatatcaccatacaatttccagtaggaaaaccaactacatactctataattgtttaacccatcttgttgtactttagtctagttaattgatagttatacatgctaaacccaggactagtattagggtgctagctacgcatacaagatccagaaactgctcacacgttacaggaatcaaataccaaagcatccagtgactgtgtcgctgttcgttctttggtcagaagtcccttacatgcatatatctcattctctttggctctcctcctcgcaacctaccacaaaactcatccttcaagtttccgtgtcttctcgattcagtctcacaatccccaacatgtatttgccatggctcattgtgttactctttgtcttggctgctgcaggtgtggatgacttcatatatgatatactttggtatatgatatacttcatatcttcatcatgttgcatatgtgttccctcataatttgttgtgcaaatgtgtggttttcttaacaactaaaactgtgggtttgtgaaactgtttcttatgaatgtgtggttcactgattgccttttgcattagaacttatagttttctgaaatttatcttactctgtttgttgttcttgcagttctagttataagcctgtgcagaatatgcagaagaaagaagtacaagatacacgacgcaggagatttgcagcaggaaaacatgttctctgtcttaaactttgatggtggaaatgcatacgagcaaattattgaagcgacggagaactttagtgaaaaatattgcattggagcaggtggttatgtgtctgtctatgtagctaaattatcaaatggtaaaaattttgcagtcaagaagataaatgcaacagagaatggccgtttgataaacgagcaaatgttctatcgtgaaatagaggccacaatgcaaatacgccacaagaacattgtaaaagtctttggctactgctgtacagcacgagataagtttattgtctacaagtatatgaaaggaggaaacttgttgacagctctcaagtcctacagaagtgcaagcgagttggattggaagcgcaggttatgtattgctcaggatgttgctcatgccctatcttacttgcatcacgactgttcagatcctatagtccatcgagatgtaacaaccaaaaacattctgctagatctggagttcagagcttgtttatcagactttgggatagctaaaatactggatgctgatggatcaggacacacaaggctcgctggtacaaaaggatatcttgcaccaggtaaacaaaatttattatgttgaacctactgttttgattattatttttcttatcttatgtatttttcttgttgcatgaagctgcattatattactaaaaaatatgctctacgctatacttaatatgcatgaagaagttaccacaatattaacataaattaatatttagtacattttaatctgactgaactcctgatacttcagagctggcatacactacgaaggtgacagagaaatgtgacgtttatagcttcggggtggtagttcttgagctgttgatgggatctcaccctggagactttgtttcgtcgatctcatgccctagcaagaaaagcacaccgatgaaggatttgttggacaccagactcccgcctccagcaggtgaagttgcaagcgagatatttggattgatcacggttgctatacagtgccttcaccccaatccatcaactcgtccgacgatgccatccgcaattcatttgttctccaagttttctagggcggttgatcttgattatctgcatgctgacatcatggagttctgccttctttgaaccttgacctttgtattcattttctacttgtggaatgttcccgaggataaagggaactacacaggtattctacatcttatgcctttgttgatgtgggaaggaagggagctaataggtgtgttgttttacaagaattgctatcatctttctttccccataattgtggtgttgtttatagttgaatatttgttttactttgatattgtatatctcatttaatatgcaagtttacaaaataatgtttaatgatgtaacctatgtttaacaacgttgtagaattgtttcataaattttgaaaaaaaaatcattttacttctcggaactatttcaccggagcacttaaccctctaaactattgttgggttcattttacaccctcaagatattgaaagcggttcacttcactcctctaacgctatctctcttttttgtttttatctatagaagtcatcgcactgaaaatttggtagaaaatatagttgcattcacaacttacgcctcaactttttttatatttttttctcactgtttatgtacgttggaagcagttaaaactgatttaaacatcaacattttaaagttcaagcaaacagccatgaaaaaatttcaaaatatttttgaactttgataaaggtgtcatctatggctctaataaattttagcttaaaatataacttttataaaagagtaacaaaaaaaatagagctgttattaaggagtaaactgaatcatttttaatagtttaaggggtaaaatgagcccaaaaaatagttcagggttaagtgatccattgaattagttcggggagtactaaaatgaactttttttctaaaatttttatggcaattaggaataaatgcaaagtatatatgggtgtaattgcgtaaaaagttgtgtaaattcggtcatgtcagacaaatgtcagcccaaactaggcccgtttaatgctaagacttgtcagtccgaaggcccaatctaacttgcgggcttgtggcctgtgcgaaaactctcgtggtcaaatctgaatatccgatacttccgtttcaaatgcaatccaaggccgaagctgagagagtgcaaagccgagccacggtggaatggcggccactcttttccccaccttatcgccgccggtctcctcctccgacgcctcatagcccccgccccctccccgccggtacggtctcctaccttccgctccctctccacaatgccctccgccgccggttcacgggccacccccgatcacggcaacctcctcatgctcggcatcgagaccagctgcgacgacaccgccgccgccgtggtacgcgcggctcatccccccccccccccctccctttcccccatggcagaccgcttgtagctgtggtggagccatgtctaggatttgttcttagtgccttggctctctgttgcctttgttggttgcaggttagaggcgatggcgagatcctaagccaggtggtatcttcccaagtgagacactatgccccccacctccctgtccagcacacttcatttctgtatatttgtcatgttatattctgtgcgctgctgatagtattgctttgtgcttacaacatttggaaggaagatttactcgtgaggtggggaggcgtcgcaccgaagatggctgaggaagctcatttgcttgcgattgatcgggtttggctttcagtttcagagtttctgttcagaagttgtgcggatcttgctgttttttacatttatgttaaagagttgctaactttttgtactttccttgcaggttgtccagaaagcacttgataatgcaaatgtgtcagaaagtgatctttctgcagtggctgtcaccgtaggaccaggacttagtttatgcctcagaggtatttgatgcttttgtatgtttactcctgatcaataggattatctggtatttactgttatgtcttaaatgctggcatggttctgaattttcagtttgttacagaatcttgtttgcatctttcaatcattccccacaaccaaaaccccgtgttctctctattagttcgcttattttaggtgcagtgcatttttcatcactaacttgtttgccctttagatggtgttacttgttagtagttctttatcttgtgcagtcactcgcaatgtcaacctgtaaaataatcgactgttgaaatgatacattgcatatactactatttacacagtcagagtgaactttattgaatttactttttaaccttgctgagtctctcttacatttctttaaaggctatttaacgaaccatataaattgcagttggtgttcacaaagctcgaaaaatagcaaaatcatttcacctgcctattgttggagttcatcatatggaggcacaggcattagtttccaggtatcgccttggtttttatttctgagttatgaagatgacattctcaactgatgaagcataagttcctttaccagttcaccgccaagcaatagtagatttctttagctcaaacgatggaatgttgtttactgttcatttgttagggattttacgtttttctctttatttttgtggatttagttctagagcacgactagtttctgttgtgaacttttgcacttccacttttttctattgtaaatttgtaatgtccactgggtagatatgttgtgttatccacctatcgtgactggtaggtcaacatgatgtttgctttccttctccttttgtgaacttccaggtttcgatgcgacaacacaaagattgcaatttctcttatgctggtctgaagactcaagttcgattggctattgaatccagaaacatgtatggctgttttagtccttgtgccattgtcttcatcgtacgattaatatgcctgctggtgtgtcaaataaatagtgtatttggcatgctgtttgctctccttgactacagtattctagattaacaagcagagacttgactttaactctcaataatctacaatacttgtttttttaattttactgaaatgtttttatatcaatcactaggaaattaacatgaaactattgcagccgttcctacaagtttagtaagtctgtctcaaccatgcaaggtcattgttctttttattaattaaagaacacctacataggcattatatacaataacctgtgctggaaatgctctagatcaaataacaagaacaacaaagtgggaacaataatgttaacaactaacaagaggttgcaagttgctagaaaactgattgttagaataggtatagaatgtttctgtttctttattggagaaggaacatttttcattattacatgaaacagacatgcaatctcattgattgtaacatttggtctcgtaactcttctgttgtttttgtgctatggtagatcaacagatgatattcctatttcatctgctacaaaagatgacagacaaataagggcgaacattgctgcctcttttcaggtttttacattataggggatgcattttcattattcattaagattttggtagttttctgatgttgacctctgcagtgagttgctgttttacatttggaagaaagatgccaacgagcagttgaatgggccttgaagatggagccttctattaaatactttgtaattcagatatcttgatgttaattaattttaaaatatttacattttacattagttcatccagtgtgttattgactcagttattaaaggttgtttcaggaggcgttgcatcaaaccagtatgtcagaactcatttgaatcagattgctgagaagaatggcctacagctcgtatgccctccaccaaggctttgcactgacaatggtaaaaagtttatttgcatgcccaaaatattcaatcatattattaacaaaagtatttaggatttaatgctattttccatgccactcattgcatatcttcattttttatgtcactctacattatttatttaattttgtgtcttggccctatgttgttgttatactgtttattttctgtccttttgacttgttgaactcgagcatttgaacttatttttgactgcttcttccgtacagagtacagattcctcctaattattcttaagcaatttgcacataattctggcatatgcttttgcaggtgtcatgattgcttggactggtattgagcatttcattgcaggcagatttgatgatcctcctgctgttgatgagcctgatgatttgcaggtaacgtgacaaataaatatgctcagttgatagagttgaacaaaacaaagttcaccatcaagcacagaaaacttttttgcttcttatgacttggtagtttaaaaatgcattgatacacgatcaactctttgctgctacaataaaaaaaaggtcttattaaaaggcaattggtgtggctactgacaaggaggaagagtataaagctaaaccgatggcatttcaatgaacattgaaatgtgaggcttggatagattatatcgtgttcttgatcttaatttgggtagatttggcatatatgtccttgtagtcccaagtaactgcatttggcactatagttgaaggtcggtaattccgtttacctcaagtcatccagagtcttttttttttttcaccctcgactcccaaatctcaatactcaaatctcaaaagtagcaaattacctgccaaatttggttttgttggcattttcatcttgtggtctaccatattataagctttgccatatggtcatcgaacaggtgagcttgtgttatgtcaaaatcgaatccaagccagtcaaacagtcaaaccacattttcaccatcttccccatccctatagctgcctttatgttcctcctcatgtctccttcaatttgacacccagggggattgatcaaatcggcttggcctgtgagcagagctagtcagtatttatgatatcagtagccatgtgatggtggcaggtcacgaagatcaatttaggagttattttttatccaaatgtttcctataattaatatcatagaagatggaattcgcacatcgtcagaacttagaaccatgccgtctaattttcttacattaaattagaacacacttcagatcgacctgctgtgtatttatgttatggaaggaatcttatacttggtaattttactctactcctgacgttaatacagtgtaagttctatgttttataagactgactggctgttatcatgcctgataattgtcttaactggtacagtatgacctgcgtccaaggtggcctcttggtgaggaatattcagatggaagatgtgttgcacggtcaatgaaaactgctcgagtccacccatcactcgcatcgatgatacagggttctgttcattagtagtttagtgaaaattgcaggagcaatacaaagatcctgttgatatagaaattggattgtgtttaggaagtatgctatactacattgatagtttgtatattttggtatattccattcacttttatttagttgactcactctttgaggtatcagtaccagacacacaaaagttacttctggcatttgtattgtttggactgctatcctttacattgataatattagcaaatacactctcctaaacaagtggcgttcactggagagaagacacttcctgtttgatttcagttgaatgcttgcattgctcttttaatatttttgcgtgtaggatccctcctcttccgttgaaaaagcaaaggcaatgccactcatccaactgttgtgaagctaagaacttgatgcatttgcccattgaagctagtgtttccatgtgccatgtggtttatcagtttcagttttagtgattactgaggcgcggcttgtttcgagtgaatagaatagctcgcaatttttagtcgcagtttagttgaaaccatggggcctgtgtgagcagtacaatttgtctgaaactttgatgttggtttcggggctttgggcttgtgcaactgatattagtgcttaatgcctgaaaatgcaaaatgctttctatactttaaacagaatcccaaaatttgttttcttttgagtcatccttatccagtccttgatcattggataggcatggaaaccagtgattaggaaagtacgacagtgcttgctttccctagccatttcagttttcagaagctcgaggcactattgaagatagtatctttttgtttttaggatcagtgcccgataagaaattagaccaaagtgataatgtgtgcagtgttgcatctcctttgggcagagttgcttctcctttatttgcatccaaagcagctgtttgtgatgtgccatcaaagagcgcgagcacacacatacccatgccgctaaacagtgtacgtcaaagcttaatgagttggatataccacccaacagttatggagaaatcaatcataatatctgaatatctgatacagttttggatatagcatcttcaaagattgtaaccttatcttgaaatatgtaaaaacaaaaaaggaaattttttataaagaaaataagaaagggataaaactagcccggagaggtcgttgttgtgccttcagcatatactattcgacagagatttgcatccaagttgcaccctgtgagcaattgcctgataaacaaccaccgaaagatcaatcacaatatctgattctatttggacagaatctttctcaagagctcggagagtttttttaaaaaaataaaaagattccttaaagaaattgtagaaatgaaactagagatgtcgatgaagttcttttcaggagatattttcccagcagaaaagcaggtatcgttactattccaaaaaagctaggaagcatttgattgacggggtcatgccccaataatgccgcccttaagtggtagctgtgtgcctgtgtgtattcgggtcggggatcccctggagttcactccaaccccacccgatggatttgatcaaatctcagtcgtctctttataacaacggttgagataaactaactaattcccactagtttttcttcttcatcctaatatttgtaacaaatcaacgaatactatatatctgaagaatatacaaactgattttacttgcataacctataaattttatggttcatccacgatataaaaatcatattgggcttgtggctctaatgttttagcaatatttttgtgtggatatggtttgtgcatgtttacacgtacttcctccgtttcagaatgtaagtcatcctagtatttttcacattcatattgatgtagattcatttaacatcaatataaatgtgtgaaattctagaatgacttacattatcaaacggagggagtactaaatgtttaacatagttttatacatgaccatagcttcttgtttggagaagaagagagcgtgcaaactttgttaatgttgttggcacttggcagaaacatactcattaggaacataaaaagaagaaaaggtaagtaattttcattcaagcatatgtgattgagggagttaattaatataagttagccataggaaacaattgatggtatgaatttggtcaaatccacctggtgaagttatagctaactctagaggatctgaagttatagctaactctaggagatctggaccgtgtgtattcatgtgtttgatattttgctgctcagttgataccctaattcggatgccaataccttttcgctattattatctttctagcttgacaacaagtgtcccctgcagtctgaaagagatttcaggaaaagaaagcaaacaggaagagtacaagatacagcagaggatgaaggaaaagaaaaagaaacggagttacgtcagcagggcgtacccaaattcaacttgcaggtgtgcaggtggattagttcactatatggtcaatgagacgatgactctccatggattagttcgccgcggcgcgctaactaaatctagtccaataatgtgtgtgattgttaggtactagcaccaactgtttgatctttgggccaattccctatatgcccatgtaatttcacctaatcccttctacgcccttgaaatttgtttgatctcttatatacccctgagtttttatttggatcccttacatacccattccgttagttgaccattagtttgaccgttagttattgtagaaattactttattgtccttgttatattgttaaaagctagaaatgttttatgtgtaaattatttgagttgtgaaaaccaataaggaataaattactaaatatttgttatgaatttttgaaaataaaacattatttcattaaaataaaaaaagatttattgtaaaaaaaagttatgcataagatttgaaaattacctttcaacaaatatttagtgaaaaaagattcgttgtgaaaaaacaaaggggatataattagtttatcacaaattagaaaacaaatttaaaatttttaaataaatttcagatcaaatttgatgaatttcgtatatcttcccaaaaatttaaacctaaataacatttagtttttgctcttaattttctggtgaaactaatgtatggatttaatcataatttttaaaaaaataaaaaataataagttttattttttaagttgggcattaaatgattatattgcttgtattttgtataagtttatttttcatatgaaaatttattgggtaggtaccacacatatgtataatatgggtaatatagtcattttaaaatatttaacggtcaactaatgatcaactaacggatatgggtatagaggagatcaaaatgaaaactcaggggtatataagggataatgtcaaattcaggggtattgaagggattgagtaaattttcaggggtatatagggaattttctcttgatcttttgggtgtgcagtgtgctaacatcttggtgataaactatgtgcaaagctctggtttacccgactccgttggccgggtatacgcatacagaccgatccgcgtgccggtgtcaggggctctgcctgcgcctacccgcgctgtaggctgtagcgatggcagtcatgtcaccacggtgcgacacgaatacacgatgctgccgagtgcgaactcgctctgcctccaccgagagagcagcgtgtggcacacgtgtcgtgcggcgcccgacgagcaaagctgttgtacacgcggagtacgcacgctcctctcggcgcctcgccgaagcgcgcgagttgcggtggtacacttgttcggacgctacgctatctgcttcggctcatcgcgcggttccgcgacacgaagcgtaatacacgcgcgcgagccaaaatcgaatcaaccaaccttctgcaacgccttcttttcttttttttcccggtgaaacgcggccgggcaggcaggcggccacgcacacgcacacgcacacgcacacgcacgtacactggcgcgcgcggacgatgcttttcccgtgtggcggcgggagagaaacggcgggtgggcgggtgggcggcgtgggtctccgtggcgccgcccatgcagatgatgcagtgtagcacggcacggggaacaccgggaagaggagaccgaagaagaggaggacggtgtggttccggcggcgcgtggcgtggcgtggctgggcagtggccacactgctctgctttgactcgggggtcgcgggaagcggaagctggtggtttttgctttcgttgggcgccccacgtacggggttactagtacgggaaggcgcgggagaaaacggagaatcgcaccggttgactcgacgacgacgccgccgcgtagggggggaaaccgaaagatgaggcagggtggcgtgcagggtacgcacgcactgaggggcgccgtcctcctgcgcccactccacggatgacggatggatggagagctgccctgcgccgagggggaaagggcccctctgacttttcgcatcggctctaattaatcccaacaccgttgaaaagttacgcacgctagctacgccttgatccttttgattgtttgattgattgccatttgaaaaaatgcttccgtgggtgtccggttgtatataaagaattactgaccatagttcacttaaagtagaagtgcatatcaaacttacggtgaatattggatctgtaccctctaccaactatagctattagcagacttggcaaattgatgttagggggataggggcacaattttctctccgccgtttttcttctagtcaatatgcctagttattttctgagtattttcgttaataatcacgagaggctccccgcaaaaaaaaataataatcacgagaggcaatcggtcacgaatgaaactatgaaagcatgagctcaattgtatatagcaacaagaaaaggctaaggctgtgttcggacccagggttcccaacacctctccatcgttttccgcgtacacgcttttcaaactgctaaacggtgtgttttttgcaaaaagtttctatacaaaaattgcttaaaaaaatcatattgattcatttttgaaaaaaaaattagctaatttctaattaatcacgcgttaatggaccgctccgttttccgtgcgaagaagatttgttcccaacctcccccagcaaacacagcctaaatactcatgtgtttatgctagtatttaggggtgggcataaaaaaaccgaaccgaaatgactgagaccaagaaattcggtcctaaacagtaaaagaccgaattttattcgatcaattcggttagtctcatcgcttaattgaatagatcgaattaacaaaaaaaaatctaaatgtaacctataatccactaagttcaatatgattaaactctaatttccacaatcctacttcttctaggcatgcaacctaataagagtctttactcatacgtgcttacttttttttatgttgaaaattttcattatttctttgcatataaaaaaatattgtggaattttagtcaggaccgagaccgaatttgtcgatcctaatatttttgtgttgaaattcggtcttcacttttcaaagatatcgagaccgaaattttcagtcaaaccgaatacccacccctacttgtatttcgaaattaacatacatcatttttttaaaaaaaatatagccgttatgttaataactgccagtgtaaatcctttacattcctcaactactaataacgacgagtataaccgtacgctaaaaattcctacaccacataacggaaataaacggcattcctaatcgagtttcttcattaaaaaaaagcaaaataaaacccctaaaaacggacggtctccggtctccacacgcgaaaggcgtgaaaccagtgcacgcatcacccatctcgtaagccttagccaaacgaaacacacccaacacaacaccacacaaggtcggcaaaccaaaccccacacacggccacaccgtcgcgcgaacgcgcacgtgccggtaacaccggtacaccccccgcgcgtcgccacttagccaagccggtcgcggccacctgccggtcacctccgcccgccacccaccggctaccgcgggtggggtttgggtgcgcgtggccccccacacgcgccaacgcgcgtaaataggggcctccctcttttatctcagccgctttgtttgtttctttctttctttctcctcttcggatcacgcaagaagaagaacaagtctccgtgttcgtgttcgttgtatgttttccccggaaagaagctttgattgcagccgagtcaaaatctttcgagagagagtgctttgcgtgtgatcgagagaggtgttgttggaagcttggttggttgggggagttcttggtttggtttgtggggggtggtttccggttggatttcgcggttggggaggacgagcgggttgttgagcggttcgggggaggaggcggtgatggtggccggggcggaggtgatgcatcaggtcgtgccgctgctggaggcgtcgttccaccgccggtgctccgtgaagggggtcgacgaggtgtcgccgccggtggaggagatgtcgccggaggctgcctcggaagccgccatcgaggtgcctgaactggtgagttcttttttctttttcttaataagctaatagggggctttggctatctttttcagtttgacgattcgctaattctagagctgggcaataactcgtgtttcttgattttttggtaaataaatattctaataattgttagtgttcctgttgttaattctagaatttttcttgcttatgagttgaaaaaacaggagttttttcttttgctttttaatcttggtggaatttttacttgtgattgtggcaaggtggtgagtacttactcgagtaataaaaattaatccaacaaaattggcagtacggacgcaataccgtgtcgtggttggattagattacggttataccttatttgttcaagtattgcggacttttactttgaaattgaaattcgcacatattgagtccatatttgaccaattcagtattgaaatgttcacgtggctaaactttttggttaatctagccagttagatattttcatgaaacatccctaagaaaggatgaaaactatttgaatgattggtcggtgtgatggtgggaaactcaagactaacttaaaaggtggaaacattttccacgagatgcagtgtagaatttaaaagctgaaaacgtttcccacgaaatatagtgcaggatgtctctgtttttagtcggcatactaaagagggcatgctgttcaccttggatgagcgtcaccataattaactcctttttgtgcttaatgcagatggttaaggcacccgtggaatcactacagttttcccccaacattcgatctggtagctttgccgatattggacctaggcggtacatggaagatgaacatatcagaattgatgatctttctggtcatcttggctcactgttgatgtgccctgcacctaatgccttctatggggtatgcaagaaactaataagagcttcaaccgatttttatcatattttgtactgcgaattagttgattacgccgttgtatttttaggtctttgatggccatgggggtccagatgcagcagcctacatgaaaaggcatgctataaggctgttctttgaggattctgagttcccacaggcattagaagaagatgaatcattttatgaatcagttgagaaatctatccacaatgcattcttgagcgcagaccttgctctcgctgacgatttggctatcagccgatcatcaggaacaacagctcttgctgctttgatatttggaaggtaatgtgaacatgcaatacatatctgtgtatgctgcagatcaccatgcattatgcttgtatgtgtgctcatttctgtttccatcatatgtgcaggcagctgttggtcgcgaatgctggggactgccgcgcggtcctgtgtcggaaaggtgtagctgtggagatgtctcgtgatcacaggccaacatatgatgcagagcatgaaaggattaccgagtgtgggggatacattgaggatggctacctcaatggagtactatctgtgaccagggcattgggggattgggacatgaaaatgcctcaaggctcgcggtcgcctctcatcgccgagccagagttccagcaaaccacactcaccgaagacgacgagttcctcatcataggctgcgatgggatatgggacgtcatgagcagccagcacgcggtgaccatagtccgcaaggggctccgacgacacgatgaccccgagaggtgcgcgagggagcttgccatggaggcgaagaggctccagacctttgacaacctcacggtgatagtcatctgctttggatctgagctcggtggtggttcaccgtcttcggagcaggcgccgatcaggagggttagatgttgcaagagcctgtcttcagaggccctttgcaacctgaagaaatggctggaacctaatgagtagatgatgatgataatgggcaggctttttgtttcctgctgtgtaaataccttatgacggctgttctcacacagccagcaattttgtagggagtcgtttttttttttttttttgttgtttgccccttcatcgatgtacatatatactttatcgggttcacccgttcatgtattgttaccgtgccccctcagtgaaaatttgcagtacatttgtcgacttgttctttccagtttattctttattgtcatgttcaattggttatactgcttgattagacttagctagattgcctatccaaaggattgaagacaatgtggatttttgtccttcattgtgttctgctcttggtttgcatccaccttagatgtagacagtactttctgtagcatagtagcgtgctactctagaacagaggaatatgcagtaacctgttggatgtagaatgggttgtgacgagaataggagatcttatgcaaattccgacagagaaatcatggagcaggagtaacaggcgaaaaaggtttctgctctactccacggtagctgccatcaccgtgatggaaaggaaaacaggggcagccgcgttgtttgacgaggctgaaaagataaggagtttccgcgaccgcgcgacggcgcagttgagttgaagatcccatggctttgacttttgatcgactcgcgttgtatttacctgcctacttggtcatcagaagtacacctcggaagtgttacaaggctgacctgaatttgtaatgcttgcaatgagcgttattttcgcccccaaaacatgcttacgaagtcaagtctggccgtcaccttgcaatccaaaagaaatcgtagaaacattacatacatgaatttatatacaagttcaccccgaaacctagtcagagtatgacaatattgcgaccaatattgtctttttggtgtggtgtggatctctcataggtaaacttgtccaggcacataaacttgtttgattgttgtgcaaaagacttgagtacttcagattcaggggacaggggacgcgtcacggcaaacgtgtggaccgggggctctgcgaattcgtcgtcggccatcaccgaccgcggtgctccctgagggctgggccatgctacggccggcgcgcgtcggctggcctggttggagttgggccgcatgggccgagatggcgcaccgtttatttgctgcaagcaacggcagcaaccagtccggactccggacacaacacctaccggtcaaattgtcaagtggtaactcgacaagaaggcagcaaagccagcaactagtccctgtgtggctgtgtgcacttgatcactttgatgagcgatcgctcgcatgatctccttgagcttaaacccagcttaattagctcctatggcaaccctcagctatgccctctgtttcgccatcgtcgctggcgccatcgcggcgtccctctgggcgatgctgtcctcccgcaagcgaccgccgtcggatggatcgtcaccaccgcacgcggtggacgacgccgccgccgcatcgatcggttcggccggggcctccgcgatgtggagcagccgctggagcggggtgcgcccggcgtggctgctactcgcgtccagagccgccgccgcggtcgccctcgccggcgtgctactctgggacgcgctgacctacgacctcaccatcatggtgtactacacggagtacgtgtctagtgtcaacaataaatcgcgtagttttcttttcccatacctctctatctcgacaacaatatttaatttagtcttatttacaagtaaaaatgaattgatttcgtcccatcaaccttctcgcagatggaccttcatgctagagatcgtctattttgtggtactttctccacctcttttgcaaagttttcacgtactctatccgtcccataaaaaaatccaatcctagagataaatctagacatagtgtatgtctaaattcttccctagaattggattctttttggtacagagcgagtacgactcaatcgatgcacgcgtggaacttgcagatagctacgctcttttctgcatacggatgcttcatgtactcaatgcaccaccgccatgtcaccatgctacccgagatcgacgagagcttggtaggactcagcggcagcctaatggagatcaaccatggcgccgatcagaagggaggagctggactgaaccagctggggcgcttcatgcagattgtctaccaggtcagcagttatatattttaaccttgatcgtttgtgctggctgccgcagtgcagcagcagcccagcttcaccctgttgatgctgctgcaaatcaactgttctgtgtagatctgtgttggttggctgcagctgccgcagcaagcactaccgatcagaccctttgcctctccttcaatttcggagtgacacggagatgatccatcatccatggaactcgtataatctctctggcgtttcgtcttcaggtcttgggcggcgcggttgtgctgacggatgtggtcttctgggctctgatagtacccttcatgtactcctctcatttcagcctcaatgcagtgagtgacagtatgttgcagtagtcagtgtacatatatatcagctagagatgtgcagtcgtgtagaaaataaaaacaaggattaggcttaacattctttttgcgaaactaattaacctaaccattgagatatgctccatcgatatccatattttcatctgacctcagttttgcaggtgatgggctgcattcactctttcaaccttgtgtttctgctgatagagactactcttaacaacttggtactcaaaatcgaactaaacaaacttatgcccaagcaatttcgttcagaataacatatttcgttcttttctgaatatatcccaggagttcccttggttcagaatgacgtatttcgttctttggacatgctcgtatgtaatcatccaatgggtcgtacatgtttgtggcttgaaatggtgagatcaaataataattccatcggttgattctatttggtaaaaaaaaagttaacaacaaattttagtttgcatcctctcaatttgacaaacaatattctctataccgtcctattaccatccaatatttcagtggacaccaacggaatgggctacacacaatattcaagtagtactaataattcttaagaccaggttatttcgggcttcaaaatttttcagctgcatattaattttctttgaaaaaacgtacgtgcaggtggccgtacccattccttaaccctgcagcaccatgggctccactatggtacgtcaaacctatcatcggggcattagacatgtggtaatttggattcaagtcgattatgcttgaaccttttgaaattttgaataatcatgcaggtatttctgcatcgcactactccatttggcgtgctacaccgtgtattgggccattgtaaggggaacgaattggtggcttagatcttgtactatccccacgcgttaattatagtgtggatatataatggaatacaatagtactagtatttgtaaagggactagctatacagttgtgatttgtcgtcaaattttataactaaatttttttgacaaatgcaaatataatacaatcttaatataattacattgtaacttgcatttaactatagtgtaactttcaaaaatctctaattgacatgctattttcgtgaaaacggaggcattggtaccgaatcccctcacatgtgcgtgggttgtgattttttcctacccccgcacaaattttaaatcatttcgaacggttcaaaatcacattataattgcatgcaagttactacatagtagttacatacaaactacaaaatagttacattgagattgtactatatttctatctatcaaaatttttagaagaaaaattatcaataaatatatagcaaaatcgtttgtaaatgccacaatacagagactgcatccatatccattgttgatcaggtttatgtgtgtgtatatcttcggcacttcattgttttctgtaagcatgcttgttaccaaagatcgatgcgtgcagggcgagatacaaagcacgaagggcgtcgccgccaacagcgggcagcggtgggcagccgggcaggagcacctcgccgccggcatcgctgttccgagcccatccagcgtgctatgtggctggccaaactgcaatgggccgcagggaaaattaacaaacggcccgacaaaacttttagacccattaaagatggccctcattgtatcgcgaaccaagaccagcccgtggcaaattaataaacggcccgataagtgttgcggctggcgtgtcgcgtggaggatttcacacgtacttttttatttgtaaagttgcaaaaaaaaaagtctacgtttagtttgttaccaaatttagtaaatacataagaaatcctgctaaaagtttggcaatattgtcatcttgccaaaattttagtattgacaaaattttataaagtttattttggctacaatctgaatgggacgatgggaatcatgagccaacgtagattcactcccaacagtgttaatctctcttataagtcattttcatttccctttgtacatttttttcccgattataacttactctgcataacttcaaatataagtcgatttcgatttatgaatgaaaatcaagaaaagtatactacacaaaaagtttaatattttatttgtcaaaaaataaacattggacggagaaaaaggcaatgctaataaattcgaaagcaattaatatttgtgagtctcttttgttcacataagacacaatggcacataaacacccaccgctaacacatgctaaaagagaaatatacaagtggcaaatcctggctaactaatttaatttattaaaatcgtacttacgcgtgtgtaattattattgatacatctaaaacgggagagtaaaaaaaaagcaccatgggtataccgtagtcattggtaaatgatgctccctccgtttcgaaatgtttgacaccgttgactttaaagcacatggttgaccgtcgatattattcaaaaacttttgtgaaacatgtagaattatatgcttacatccaaatatatctatcaagg

SEQ ID NO: 60026 - DNA, 25792 bp, Oryza sativa
  unsure (1)..(25792): unsure at all n locations
agtttatatgcacacgcgtacacttatctatagaaaacatattcgagagactgagccaatcatatatcttcaaattagtgaagtcatcataaacgcctcgctattgatagaaacgttgcctactaaaaaataattagccataaatataagacccatgtcaagtctagatgttaaacctaggtgggtaagttccaccataggtaactaactagccacactcactaattgcagataatgtggagcccctgttccctctccttaactccttttttccatacattatttgagataaatgtagtatataaataataaataaactattgtaatttttaaattatatatacaattttttttattcgaccacaattatattctttagaattaaatcagttcatatcgatttgaccaattgcgttatatctcacagacaaaaaaaaacatgaaaacatatgttatagtgtcatatatcacattataatcataaataactaaaaatagctctaatatgtttgaaaataaagtttactaaattatattatttaccattaacttaatttatgatctatattgactatactttaatctgtaaaataaaattatattttaggtcatatttttattcttggtctgtaatccaaacggacatgaaaattataaaaaaagatgacagtatggagtatatatcactatatattctttatcggttataatcactatgtaccattaaattagatttacaatataacaagaaacatgtcgtatctttgcgctttacatggcatttgagaattataacaaaacgtgaaaaaacaatttaatgatatgggtaatatcatcacataaatatgcttactatgtagggtgcactctatttggcccaaatcagttcacaaatatgcgcgactgaattagatttacaatatcaacaagtagcaagtcacatccggggccttgcatggcaatcgagaattatgacaaatcatgataaaaaataacaatatgggttatatgatcatataaatatacttatcatgtggattccaatctattcggactatacgaggataatctaaaatgtcaattcaatttaccaaatcatgtataagttgtacgttttgtagactacaccctaaatattaagtaaaataacggatggagtacacgtcgtgttttctcccctttgatttctattaaatacgtatggcgtgtgggtattttgtatatactaagtttggttaattaggaaacataaacaatactaaagttatatatgagaattcatgcattaaaaatacacttcataacaagaacttacttaacaaaaatgtactttagtctatggtgcttaaatatttataaattctctaaacatactaattatttctgctcttatttcaaactaaattcattttctccacataatataagagatcatatgagaaaaaaaaagaggagggagaagaagtaaatagaagtctgccattgaacagatagaataaagacatctataacatacaagaaaatttgttgattaaggtttataaaccccaaatgtaagatatgctaatttctaaaaaacacacacacatggtacacataatagttccatatgaagcaacactattgttgtgaaacaatagtttctcataaattaaaaaccacatggtttaaataaatttgatttagaatttatatgttgaaaggtaattggaagaaaattaaaagcaacattcacaacaatctcaaataaattattgataaaaaaacatgttcagaatagagtaaaaaaatattttaagaaatactcatccacacataagcattcataattaaaattcaagcaacattaaataaggtgtcccgcgcatgtgcgcgggctacctttctagttaaggtaaaagaaaaaaaaactacaattgaaatgcttgctccaataaagcaggaaggtggtggcagagccccactacacttctaacaagcccccaaaattaagcaatagcgccagcagaagaccatatacgaccttccagaaggattggctccagaaccattgagaccaaggaaagtgaaagatcataaacactagaattcagctccttccacagctgacaagagactaggaggactaggaagtcaaagacgatgatcaccatacctgaagtgagcaaccacagggaggagtgaggacaacccagccaggggacgacaacacagggtgccagacctgacgagtgaacacacagtcgagtaggatgtggttcgccgtctcaagatgttgagtgcaaaaaggacagactgagtggctatcgataccacgtttttgcataacaacacgtccaatagcgctgctgaaacataaatcataataaaaacttacatttggcgggaccttttgcttgccaaagcagatcggcacaaacaaaggagtgctgaccgagaaagaacacctggtaagacgagtttgctagtaacattggtcacttgttcaacaccagacaagacgatcctccatgcccgacgagagttggataggaagtataacattccaaaccaccgagggtatgtatgctcgacagtcgctgcagctggtagccacgctggtacgtgatactcctattatgtaattggaagtaattttatgatcaattccaacttctgaactcactttgtctagcatgcatatgtgtgaatacactttctccgttccaaaataactttatctttaaccttgggtatttaaaacaaaatagaagaaaaaactaaagtatcctttattaataggaaagtagttttatacttttagtgtgtgggttggtaaggatgagtaaaaggtaagtacaaattcctcgatttgcggattaagagttaaaagtgaatttattttaacacaaaggttagaggctagaaataaaattattttgaaacaagagcttgtccaaatattttaagacaaaaacttctctatatttgttgttatacattatgtcacattctagattagtacaaagtactccctttgtctcatttaaagtgcagccataatttttttttttgctcaactttgattgtttgtcttatttaatttttttaaaaaaaattaaaaatataagccaatatttatgttttattatctcataacaataaaactgttaattataaaaaaatttaaataaaacggagaaagtaagaaataagacggagggagtaacaagtgaaccgtgacagcgcacagaacatttcacctgaactctgacaacacaactgacattattccgtttgctccctgcagaaattagcctggcatgcagcagtggcctgagataacactattatctgaaagttattttttctcctaaattaagttgagtttaaattggaggtttagtatgaatgtattttatgcctaccatctatctctaataactgttttataaatttagagaacttttaagcccctttaaatcgtaggaatgaaaaaaatagaggaatagaaaaaatgtaggattataataagaatacaagtgcaaaaatagaaaattgtaaaatacagaaaaaacaaaagaatgaccatttgattgaaccgcagaaaaaacacaaaaatcgaatgagagaaatagactcgaaggaaggttttcaagaggttgaagttcttgctaaattttctcctaaatctccatagtatagtctattccataggaatttcaaaggatatgacatgattcgatcatttgtttcaaagggctttataggaaatttttctataggattagaatcctctaaaatttctatgttttttctccaaatcaaaagggcccttagttctgttttttatgggattttctatgtatatttccgctacatatatagctgcatctctgggcatgatcttcacaaggcacaagacatatattatatatttatattcccaaaaaggagaaaaggatgatccaatccaacatggcctccaagcaacaaacctgcattattagagagctgttcagatcatgaacagggaatagcaaaccaatcgcaggaccatacctctgccctgatctcttggtgtgctcttctctcttttgccgctgtaagcaagcacgctggatgcaagcagcactactgtgaaatggaccacatgtgattggacatcaaaggagagcgactgattggcgcgcatgttttcagcgaacttcttgtctgaaaacattcgtcgtctgacgggtagacttggatgtgttttttccttctgacagaaagtgttactgttcggtctatctcaacttgcaagaaaggagctgcaggttctgatttctgaagctctttttttttctcaggtaaagagcaacaaatgttcgtgtttcccagtctgatgacagtatataattactgttctaattcagttagctgagaaaacagtagaagaaatggattctaattatacagtaatggcataaaagttcagccatttgttaggaagtgcatggactggccgtaccttaatgggactgaaatctttatgatgcctgctacagaagttataatagcaaattagattgcttggcttgcacgagccacatttttctttttgtctgtctacctgtgagtataatagcatccttgaactaattattgcatccctaaagcctaatcatgcatcatcaagagagatatgcaagttgttgcctacttgtctacatgagttctacatattcagatagacatggtctcaactacattaattttgccatgcattatcaaactgacgcttgcctaatgctgctgaaaattttcaatgataggcctgcacccaaccttgcaacaaaactaagctagattagatgaaccatcacttgagcctagtcagatgcccataaaccgatcaagatatgaaaaaaataagcattgttcacaaaagagatcaagaagaaataagcagacaagcaggtacagtgacatcaagcacggaccgcaaagcctgaatgtatggtgtgcatgcataaaggcaatagaacttttgtgctatgctgcctcactgtttggctttacaggctctcccccctctgtttgctgctcatttcaaagctacaagatcaagcaaatctagagagagagagaggagaaagaaagaagaagctcagctaggttgccagataatgtttctttggtgaacaaaagctgcaaaaagatggtctcccccataaaaaaactcacaaaaagggggccatatcgcagattagagaatctcacaaccaaagtttcacaggagtgggcatgcaagcgtagcttcttttattttggagcacttcaaccaccgggcaaatctggactgtagccattgttatcttgggccctcggcaaattcatggaccggatttctagtacctgcttgcctggcatgcaatgcaatggttgattgtgaaatgctccaattttttctttatcattatattcagagaggagcactcgttcatgcatggagaaaaaggttgcagtttagagtttttgcaaagaagatgaatgtggataataattgcatcagaggagatgaacctatgaagcgatatgtagcgttaccttaaaaaactgccacaattttttgagtgaaaaactttcagacgtaactataatataactgaaatgtatttagatggtaactacactgttattgtgttgttgcttacattagaaaaatataacaagcgcatttacgcatttagacgaacaccattctagcttggcaccaaagattactacgttcttaagaaaaacactacctctgttgatttgaagatatattgtaattttaatattttgagactaaactttgaagattggtttttttaaatatattgttaataattatatgtcaaatattgtgagaaaattgcgatccctatggtccctacatcactactaaggggcgtgatatgggtggcgatccatcccaccagccaccactgttctccttccttactgctactggaaactgcatggctaaaaggatggcgccggtgatgcctcttcttcttccttcagcaggtaggggtggtgagctacggtttgggagggggggaggggggggggggttaaccttgtcgggtcagctatgtgagtgagccagcttccacggtggtgaaggaggcagctgtggcgactgcaggacagtgtcggatggatacgaggtctccttttctgaatctggaactatagcctatatctatatgactacctatccctcccatggcgagggtggcacttgggatggggagaagatgtttcaactggataaagaatatagtttttatagcactccatgcgtgttttgctatttttttcttaattaaccatgcatttgtatgtttttcgagtccgttttttccgtaaactaggttaattcttttttcttcatataaaatataaaacatgaactccatgtcctccagcaaaaattaccttgaaaaaatattataagtaatttaaaatataaacatattgatatactttctaagcacttaatagtaggcgcacatgcacagatgtcattaatttatcgttatacaataataataaaattaagtaatatcatatttgtttggatttaaatacgaatccatctataatatcctgatagctgggtcctcaatcctcgacgttgtggcgttcatttcaaaaccgtatgtggacttgacagttggcaggccagagaggaacaaagtagagttgggcctccactagccggactcgtcggcctcatactcatcttcaggaatatgtgtactgtatgtttaatcagcctaacatccttgactaaggtgaaaatagcttatgttgagcccatcatcctccagccgtccagcgatcgatggccccccaacacgtcaccatcgagccatcgaggtactcgtgtaaatcctctcgctcactttgtccccaccacaaaatgcgcagcccaaccggcaacaatgagcttgcttatagtccattaattatggttctgtcccaaaataaaagaatataacataatctaatacaatagattttgaaaaaaaagtcagatttgtggtattagattgtgtgacttgtaacacattcttattaaggttggtttattttgtaatggagggagtactactttttttttaagaacaattcagtactaccttcgtacgtttctttctagcatataaaacacaaattaatagagaatataaataacatatgtccttcaattaaactagcttattaagttgtgcgttcacgcaactgtaaccttcctctcttttagatgtattttcattttgtttatagtaataagtttaaatgtataatgataattaacaatgtaaacaagtgtgtgactctgtgtacgcaaacaagtgtgtgtacgatatcattaatttcacatgaagtgtagctgtaaagccatatatatctaaaccgtaatttatgataattgtattatactttaaatttgatttatttatctttatttataaatcataggaccctaaaccctgcacattcatttaaaatgaggggaatgaaagatctaaatgaggattatgggcatgagcctaaattaaccgaacaactcctatgaggagcaaacaaacaaacaaaaaaaaaagattacggcttgactcaaggagagatggtacactgaaaggaaaattttgatgcaaacaaaaaggaaattagagagcttaaggtattgcaatattgttcattgatggaaatattaacgtaaaagcatggacagataaaaattgaactactattacgacagtttggaagctagacaaaataaaagctatttgtgacaaattggaagctagataaaaacatgaggaccatacaatttagcattctgaaaaagttaatgaactaaatgcttataacagtattcttctaatatactgaacaattacagtcaaaattatatatgctaaaacttcaattacatgcatgactgaacatttggcaagagtccttatcgacaacttgatcttgtgaaaaattgttgtggttagaattaggtatgtgcatccaatttaggcattgtaaatcacatccaccatccgatttagtgaaggtatcaccaataggggtgaaaacggagcgaatacggacggataatgctcttaccgtatccgttttcatattgttaggcggatacggaaacgaatacgaataactcggatacggaaacgaatacgaattatcgcggatacgaataaggatcgaatatgatcggacacgaatacgaaaacgaatatttctcggaatatagagaccactcaaactgctcgtagatacaaatgcaccacatatatttatctaatttaatataaatatcatcgttgtaggacgcatcacagattaaacaaagtgtatcgtgttcaaatcgaaacacgttgaaaagttcaacacatattgagttctagttctataggtaacaaagataagatcaaaatagtaattagcccaaagcaattttcagtacacttgcagtctgatgcatgaaaactgcaacatcattattcatccatttcatccatcagaatatcatcctattccatgttgtcggtgacatggggccggaggtatcgtgactagaggcttgggtagccgcggtcacccacgtggcctgaccccctcgggggggtcgggcccgaaggtgacgtggccacccctccctctgtctccccgaggggtcgggccgctcccgtttcggccccgagggctggggcgccctgaccccctgtggttttggcgccacgtgtgtgggttaggtgagcacagcgggttcacctaaccgcatttatagcaggttggacgagcgcgccacgccgcatttaatgcggcgcagcgcacgcttatccggtccgtgaccggtcgcggtgagtgaccggtcacagaccggtcagatcgcgggttaggtggcaataggcggcctgtcacacgcctcgccccgtcccgtcggaatgatgaaagcttcctggctctcgtccctagccggagccggcatgccaactccaggagttggtatgtcagtcccggtcagatccattccaggcttcagtgcaagtatggcaaggaagtcgctggccattaaatgaaggttgaaatgggcgtccaccggaaaagcgggcgagcggggcaggaggcgtatgctctgcttgtcagaggtcatttccggctgtagactagccctcattgtaaaaagcatgtttcccttcttaggcagctagaggcccatgtggtgacccctgaccagataaaaaggagacccaggcctaagaaagaaaaaaaaaagaggagaagagaggaggggagttgggactctggcgaatggtttctagagcctgaactctctctcgctctcggctctctggattccttcactcacagatccaccagaacacaggagtagggtgttacgcttctcagcggcccgaacctgtctacgtcgcccgtgtcttgtgcatttcctttctcgctgacgttcctcagatcgagggcgaagaacctcacttagcgtccccggccgaaccggcaaaggggggcctgcgcggtctcccggtgaggagccccacgctccgtcatctggcgcgccaggtagggggcgcgcgtgtctttctaagcccttgtcctctttcgtgtgcgccaagcttctcccgctcagcccaatggccgaacgggcagtggcgcacagcctctctccgaacgctagcggtgacgactgggagcagaacccgcaccatcgggctcgcaccccaccgtccccctctcgccgaaatcttgggcggggggaggcgctcggggaggtcggaggatccgcgacttcgccgcccgcgggcgacgggggagggcggcgagacggggcgcgtcgccgcctcgtctacggcgatggcggcacgccctagggcgcgctccaggctgcgggcgcgctcctgcgtcacccgcccgtcgtccccgatccagagactccagcccgacgttggctggatgatgtggccgacttggtcatgacggcgcagcagcgcctaggcgccggcgggcggtcctctgccaccgaggcctctggcgctgccgccgccggctccacgtcgtcgaggcggagggcgcggcgagcggcggccgttacccgccgttcgtccgccattccttcgtcaacgcctccgacccaagaagatgtgcgtggggggccggatgcccgcctcgatatcgagcgccggcgtgacactcgtcgcgccgcccacgcaacggagggcgcttcctcgtccggagcgccacttcggtccgggcacgggggccggccccccgtgtccccggttggcggtaccggctgtcgagcctttgtggcgagccttcggaacgtccgttggcccccaaggttccggcccaccatcaccgaaaaatacgacggaagcgtcaaccccgccgagtttctccagatctacacgaccgggatcgaggccgccgggggtgacgacagggtcatggcgaatttcttccccatggccctgaagggtcaggcgcggggttggctaatgaacttgccacccgcgtcggtccactcttgggaggatttgtgccagcagttcaccacgaacttccagggcatatatctgcgcccaggcgaagaagcggacttgcatgcggtacagcgaagggacgatgagtctcttcgctcgtacattcagcggttctgtcaagtccgcaacaccataccgtgcatccccgcacacgcggtgatctacgcgttcagggggggcgtgcggcacaaccgcatgctcgagaagattgcctccaaggagccccagaccaccgcgcagctttttgagctcgcggaccgtgtggctcgcaaggaggaggcctggacctggaactcctccggttctggtgtggcagctctggccgcccccgtgtccgccactcggtcagggcggcgggacaggaggaggaagaaggggccggcccgttctgacgacgagggtcatgtcctcgccgtcgagggtgcttcgcgggccccccgaaaggggaggcctgcgagcgacaaaaagaaggaggccggcgctcccagcagggagcgcccaaccggcaagtggtgtaccgtgcacaacacccccctccacgacctcgcggactgccgcgcggtcaaaagtttggctgagcggacgaggaagtgggaggaggagaagaggcaggagcgccgtgagggcaagaccccggcggctcccgccggcaaccggcgaggtgaggccaagcagaaggccaccgccgaggacatcgacgatggcgacgatgacctggggttccaggagcctgaggccaccgtcgccaccgtcgatgggggagcatgcgctcacgcttctcgccggagcctcaaggccatgaagcgagagcttctggccacggcccctacccatgaggcgacgcggcgggcgcggtggtcggaggttgccctcaccttcgaccagaccgaccacccgccgtgcgttgcccggggaggacagattgcgatggtggtttcccccaccgtttgcaatgtgaagttggggcgtgtcctcatagacgggggtgcagccctcaacatcctttcccccgtagcctttgacgccatcaaggccccggggatggtgctccggccgtcccagccgatcatcggtgtgacgtcggggcacacctggccgctgggtcatatcgacctcctggtcaccttcggtggttccgccaacttccgcacggagcaggtggacttcgatgtggcggacctcagtctgccctacaacgcggtcctggggaggcccgcattggtgaagttcatggcggcggtccactacgcctatctccagatgaagatgccgggccccggtggccccatcaccgtccatggcgacctcaaagtcgcgcttgcttgtatggagcagcgcgcggaccacctcgccgcggcgtccaagcccgcgggtggcgacgagaggctcgccacctccgtcccggccgccccaaggcagcggatggtcacgtgcgacgaggtcccggtcaaggaggttgccctgggcgacggcccgtccaagaccacacgaatcggtggtcttctggacgacaaataggaagacgcgctcgtctccttcctgcgggcaaacgccgacgtcttcgcctggagattggcggacatgcccggggtccccagggaggtgattgagcaccgtctcgccgtgcggccgggcgcaaggccggtccggcagaaagtacggcggcaggccccagaacgtcaagccttcatccgcgaggaggtggcgcgacttctggaggccggattcatccgtgaggtcatccatccggagtggctggtgaccccggtcatcgttcccaaggcgaacggcaagcttcggatgtgcatcgactacaccgaccttaacaaggcatgtcctaaggacccttaccccctgtcacgcatagatcagattgtcgactccaccgcggggtgcgaccttttgtgttttctagatgcatactctggttatcatcagattcgcatggctagggaggacgaggaaaaaactgcattcattacccccataggaacttattgttacaccacaatgcccttcgggttaaagaatgcaggtcctacttttcaacgtactactcgaatttctttgggtagccagataggacgcaatgttgaggcctatgttgatgacttggttgtgaagacgcgcaaccaagagaccttactctcggatctagcggaaactttcgaaagtctccgctccgcccgcataaagctgaaccccgataagtgcgtgttcggcgtgcctgcgggcaagcttctcgggttcttggtctctgcccgaggcatcgaggccaaccccgagaagatacgagctatagagcggatgcgcccccctagcaagcttagggatgtgcagtgcgtcaccggctgcatggccgccctaagtcggttcatatcgaggctgggagagaaggcgctacccctatttaagctcctcaaacgctccgggccgtttacctggacggaggaggctgagcgggccttcactcagttgaaggcgtacctcagttctcccccagtcctggtcgccccggagccagatgagccgttgttactctacctggcggcagccccgcaggtggtcagcgcggcgttggtcgtggagcgcgacgaggacaaccctcactccgcgcatccccaccctgcgtcgactcgacccgggagagagcagggaggagaggcccccgagccgaacggcggcccaaggcccccgacggccggagctggccctccgcctgcttgtccgacggtgccaggcgcccccgacccccaggatggccccggggccactgcgggaaggccgcgcctgtcgccctctgaccccgaggtcgtcggcacagaagccgagtgcgccccgcgtggcctctcggacgaagagcgccctggagatgcggcccctggcgaagaggatcggccccgccgaaaggtgcagcggcctgtctacttcgttagtgaggccctccgggacgccaagacccgataccctcaggcccagaagatgctttacgctattctggtggcttcgaggaagttgcgccattatttccaggcgcatcgggtcacggtggttacgtcttaccccctcggccaaatcttgcataaccgagagggtactggacgggtggtgagatgggcaatcgaactctctgaattcgatttgcgctttgaaccacgccacgcgatcaagagccaggccctcactgactttgtggcggagtggaccccagctcccgagcccgtctccgcccccgaggccagctcgggcacatcgcagctgcctcacaccgcctactgggtgatgcagttcgacggctccctgtctcttcagggcgccggtgcgggggtcacgttgacctcgccgagcggagacgtcctcagatacctggtccgcctcgactttcgggcgaccaacaatatggcggagtacgagggactccttgcgggactcagagtggcagctggactggggatccgccgcctcctggtgttaggcgactctcagttggtcgttaaccaggtctataaggagtaccggtgctctgacccgcagatggacgcttacgtgcgccaggtgcggcgtatggagcgccacttcgacgggatagagcttcggcacgtgcccagacgggataacgcggtcgccgacgaactctcaaggctcgcttcctcgcgagcccagaccccaccgggcgcctttgaagaaaggctcgcccagccgtcggcgcgacccgaccccctaggggagacggacgcgcctgaacggcccccgaggcccatcggagtccaggcctcgggacccgaggggagcgctcccagctcccctagattgattgcttggaccactgagatccagacgtacctcgcagataagactctacccgaggaccgcgaagggagtgaacgcgtccggcgcatctccaagcgctacgtgctggtggaagggaccctctatcggcgtgcggctaacggagtcctcctgaagtgcattcctcgggaacaaggcgtcgagcttctcgccgatgtccatgaaggcgagtgcggagcccactccgcctcacgcaccttggttggcaaggcctttcgccagggtttctattggccgacggctctcaacgatgcggtcgacctggtccggcggtgcagggcgtgccagttccacgccaggcaaacccatcagccggcccaggccctgcagaccatacctctttcgtggccgtttgctgtctgggggctcgatatcctgggtccgttcaggcgggccccgggcgggttcgagtatcagtatgtcgctgtcgacaagttcactaagtggcccgaggcttatccggtcatcaagatcgataagcactccgcccttaaattcatcaggggcatcactgctcggtttggggtgcctaaccgtatcattacgaataacggcacccagttcactagtgagctcttcggtgactactgcgaagacatgggcatcaagctctgcttcgcctcccccgcccaccccagaagcaatggccaagtggagcgcgccaacgcggaaatcctcaagggcctcaaaaccaagaccttcaacatcctcaagaagcacggcgactcgtggatcgagaagctgccagcggtgctctgggcgaaccgaaccacgccaagccgagcaaccggggaaacgtctttcttcctcgtctacggcgcggaggcggtcctcccatctgagctcaccctgaggtcccctcgggtcaccatgtattgcgaggctgatcaagatcagcttcgccgagacgacctcgactatttggaagagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggactgagcaagctctcaccaatgtgggagggtccgtatcgagtgatcggcgtcccccggccgggctccgttcggctggccacgggcgacggcacagagctacctaacccgtggaacatcgaacaccttcgtcgcttctacccctagtgggggtcgggtgtcatgtctcgggctcgggccaaccccgcacccctctccggggcgtgcagggttggccgggggctaccacatgcatatacttaccttttttctcttccgtatttcaataaaagcattttcgatttcctgaggactgtgtctgtgccatcgtttccttttgaagaatcttggcttgaattagcacgctcgtgctcgaccctgccctcggtggcccgggccggctaaaatcgccaaacggggcccagaaccgagccgtgccccggggcgtggtgaactccgggggggaatcggcaaaggcccacaatcgggtcatccataaccctcggtcaccgcgctcccggcctggccagtctcgacacgtggatctccccaggcactagccccgacccgcgccgtttgaggctggaacctgggcacgagcccttgttcaagccaagacacagaaggaccgcggcacagaccatcctcgtctcatacacacaacaaacagagctgacgcagaaatttcctctttacttgattacagattaaatcagtctatacaagaagggggcccgaaggcctcggaagaagaagcaaaagttattaagactggcgggggcctggggcctcactccgacgcgcccgggtcgtcggcctcgtcgtcgctgtcgtccgcaccgtcgtcaccgccctcctcgtcggagtcgagcgcgaacgcgagccgaggggctgtaccctcgaagctgtggacgatgtggtcggcggcgtcccggacctgcgcgcgcgcgtcgtcctcggttccgggagggaactcttccagcgctgcccacggggagaagtcagggtccctggcctggtagcttgccagtacaagctccaccgccccctgggcgaggtccctcgaggatgacttgatcgtctcctcgagctcctcgggaagccgctcgagggccccggtcatctctgagaggcgctaggcgaggcccccctggttggcggcgtacttcgcgtgccgcccgccccagaggcccgcctgccgcccggcgcggtctagacgggagacggcgtcccgaagtatgccgggccctacttcgctcgccaagcagagggcctcgacctccccggcggacgagtccagcgccctgcagctcggcgatggtgtgttcggcggctgcgaggcgggcgactaggtcgccgtggcccgcggccgccccgccgctgcgcgctctcccgtccaactccttcgcccgcgcctcgagctcagcggcccgctgatccagtgcggccctctcggcgcgggcgccttccagattgcggcgcgcctgctcctcccgcgctgcctcgcggaggaacaggctgtccgccagccgctgcgccgcggcctcggcctcctcgagagctcgcccccgctcggtgagcgcgtcctcgcggaagcggagtgcggactcctcttcggcgcaggcggcctcgtgcgccgccagtgttgcctcccgggtggcgacggcggcctcgcggtccgccaggtctctctccttcgcgtccagggcgcgggcgcgctccttcagcgccgtggcgcgagcctcaagggcctcttcgcgccgccgggacgccgcctcgttctccgccgcccgccgttcccgggcagcggcggcgtcaaggactccccgggcggcgtcgagcttctcctccagctccgccgccaggctcccgtattggaggcggaggtcgttccgcgcctcatcgagcacggcggtggcgatgagggcagtctcccgctcctcctccacctcccggcgatctccgccaggtccctacgacgggcctcgagctgtgaggcgtgccggcggtgtgccttgcgacccgcctccaccatggcctccaccgagcgccgcccctcctcgacgcgcgcccacgccgcgtcgagctccgcccgctccgcctgcagggcctccatctgggcacttaacccgtccagcaccgtgctgttcgcggcggccaaggcctgcaggaagggctccgcgctcagtggggcagcggaaggccgaggggagagccccctcggtgtgggtgccgcgcggctcggcccgccgatcgacgtgccggactcgggggcgccccccgaacctggctcgtcccaagcgtcgcccgaggggtcgggcccgagcggcgcgcccgcggcctcgtcgtgggtggcctctgaagtcgtcgtcgcctcgggcggagtcgagtcgggggtttggcaggccgcctggcgtgcgcgcgccgcctctgccacccggacggactccccggcccggcggagtctggcctcctcccgagcggcctcctcagcctggcgaactcggacggcctcctgggcagcctcctcggcttcccggaggcggtccgcggcttctcgccggtcagcttcccgcctccgggcctccgcggtcaccgtctcctcggcctcagaccgaccggacttggaatggcggggggggggggagggggggcgcgacgggatctcgctgaggcagaagaaaaaccagaagacaaaaagaaacgggtgagtgaaaactcgccttgggagatgggagaatgaatacggccgcggtgggcgcggggacgaacctgcggggaggtcggctaaacgaccaccttgggggcgagatgaggttctgtcacgccctgaagtgacaggttcccccggcatggtacgatccctcccatcttgcggagccgtttcttctttcgctccccctcgggctgcggcgtcggcacggctccctccgggcgcctgctgctggcacgcaccgccccgccccctcggggaggagatgggggaggagtaccctcctgcttcctcttcccccgggcgtcggcagggcggctaccccccgggcccccgtcgcggggcccagaagcacgaccccctcccggggtagattgttcccccctgcggctcccgcccgtgccatcgtggcctcggggggcccgctcccccgacgccccgaccacctgcatgatggtcaggatcttggcgcgctctggatcgcagcagagggggaggaccccttgggggatgagggatgcctccacggagctgagatttagcacccgttggaccaccatactgaagtcctcagggtcctagtcccatttgcgcccctggtgggtcctcatgtagtcctcaggcccggtgtactcccaggcgccccgggcgcgccgctggagcggcgcgatccggcgacgaaggtagtctccgaacaccatggcccccgtgagcccctgggatcgcagacccgccaggcggtcaagaacggcgtcgtagccgtctcccagatctaccgtcgcccgccagctggaggcctgcgccgggggctggctcggaagtcggaggcgcgcttcctcgccgaggggggtgtagaaccaatcgctcttccagtcgtcccactttttgcggaggacgcatggaatgtagcggttcagcacctgaccccgcggctggaagtagcagccaccgactgccgtcggcggcgacaccggctgtacggtgaagaaccaccggaacagccggagagatgggcgcaccctgataaacatctcgcacaggtgcgcaaagatggccaacgtcattatcgcgttgggggtgaggtgcgccatctggagatcataaaactccagaatatccatgaaaaaaatagagaatggcgggaccagccccgccattgcgaaagagaggaagaagacggaccaccccgggtagtgtggcgccgggcgtcccttgcccagcgcgaccacctcccgaccggtggcagattccggcatgaatcggcgcggcagcccggcctgcctctcgctcacgatgcgggaaggcggcagcacgctaccgtcgagcggtgcggagccccgtgccatgacgccggcggaggaggagcttgagagcgagcgagtgcggcaagggtagggcaccagaaacgaagagttagagcacaagtggcgaaggcaaggggaagagtggcgagaggaaagaaacgaatccctccctcggcgtctttacacccttgaaaacgctatgcccggctcctcgattcccgcgcccactacctcgcccccttgtttctcgcgcccacgcctccactaaccccgctcgcccgtttgcggcgcacgcggcagatgtgcggccgtggcggtcgagatggggcagatcgtgcgcgcattaactacgcccgccaaccgtgaaatgcgccgtcatcatgtctccaggcgaaacgaaccggctcgtcccgattcgcgcgctgctcgagtaatgtagcggtcttaaagaggccgctcattattgtcggtcggttttcccttgccgatgcgcgcgatttgcgaccgctgggtttctgcccgcctgtagggaccggccccacctgtcaccgggcctaaggagtggcgtcacgcccgagcgcttccctcgaggggggcgatcgccctggcgtaacgccgggggctactgtcggtgacatgaggccgggggtatcgtgactagaggcttgggtagccgcggtcacccacgtggcctgaccccctcgggggggtcgggcccgaaggtgacgtggccacccctccctctgtctccccgaggggtcgggccgctcccgtttcggccccgagggctggggcgccctgaccccctatggttttggcgccacgtgtgtgggttaggtgagcacagcgggttcacctaaccgcatttatagcaggttggacgagcgcgccacgccgcatttaatgcggcgcagcgcacgcttatccggtccgtgaccggtcgcggtgagtgaccggtcacagaccggtcagatcgcgggttaggtggcaataggcggcctatcacacgcctcgccccgtcccgtcggaatgatgaaagcttcctggctctcgtccctagccggagccggcatgccaactccaggagttggtatgtcagtcccggtcggatccattccaggcttcagtgcaagtatggcaaggaagtcgctggccattaaatgaaggttgaaatgggcgtccaccggaaaagcgggcgagcggggcaggaggcgtatgctctgcttgtcagaggtcatttccggctgtagactagccctcattgtaaaaagcatgtttcccttcttaggcagctagaggcccatgtggtgacccctgaccagataaaaaggagacccaggcctaagaaagaaaaaaaaagaggagaagagaggaggggagttgggactctggcgaatggtttctagagcctgaactctctctcgctcttggctctctggattccttcactcacagatccaccagaacataggagtagggtgttacgcttctcagcggcccgaacctgtctacgtcgcccgtgtcttgtgcatttcctttctcgctgacgttcctcagatcgagggcgaagaacctcacttagcgcccccggccgaaccggcaaaggggggcctgcgcggtctcccggtgaggagccccacgctccgtcacatgtcatcattattctcctctttttcctacaggagtcgaataatattgttgttatattaagaaaaatattcatagaggtaaaataagaaaatagctcaccactatcaataagtttgccagatgcctctctacgctttcaatgtccaactcattgatgatagcctgagtcttataacctaagaatgatgccagatcagatcatggatcagctatacatatattgatatatacaaaaaggaatggccaaataagcaatgaacacagacacaaagtgtaccattgttagctgctttaatccaatctttggtgcaaactaaagcttgcacagcctctggatcaagacgggtgcgaaatggatcaacaacacggccaccagcactaaatgccgactcagaagcaacagttgacacttgaatacataagaaatcacgagcaagtttgcagaggataggaaattctgcttgtttgagcttccaccaagacaaaatatcaaatggatctttggaagtccatagtaacagtggttgttccatgtaaatttgtaactcggttttatcactacaaattggctgacttctctcaagcaaaaatctttgaaaatgttgctcatgatcatggctactgtcattctcattaaagatatcatcaaactcatcagtattatgaacaggatcagattgaatttgaagttgatgcacatgcatttcagcacctttcttctttgatgttgcacacgcactagtagcataaacatcaaacaattttttgataaccccattgaactcatcaaatttttctgcagcttctaaaccataaatcttcataccatagtactctattgaacttgttttgtaacgtggatcaaggaagtatgcaacagcaagagccatattcgacttctcccagtacttatcatatttagtttgcatggcgtttgccatggtttttattgttccatctgtactgttacaccaatcagcaatataaagcttgatggaacaaaatttaccgaaaaaatgatttgctgttggatatgtagtaccagagaatagttcagttgcttcatgaaatggcttcaagcacttgcatagtgctattgccatagaccagtctaccttggtgggagcacactttgcatactttctaccatgccgaagaaacaacctatcaaaagcatttctgtagtagatagcattcttcaacatgagaaatgtggagttccatcttataggagtatccatggaaaggccctttgtgttatccaaactaacttccaaggcacacttctgaaatgcctcaaactgcagtggcgagtgctttagaattgaaatagtatttctgatctttaatacagctcctgtgatttgtttcagaccatcttgtgcaacaaggttcaagatatgattgaaacatctcacatgaaagaagatgccatcgcaaattaaaggagagattttacggagttttaaaataacacccttaacacaaacatcattagacgatgcattgtccaaagtaagtccaacaagccttctatcaagattccaatcaactatgctgtcataaaactctttgcacatattacttcctgaatgatgtccttctacatgcataaacttaatgatcctcttttgcatcttccaagtgtcatctatccaatgaactgtgatgcacatataacttttattttggttagatgtccacatgtccatggttgtgctaaaacggcatgagagtgtaagcaaatgctgccacaatttcttcttttcctcttcatatatgtttataatatcctttctcacagtaatgcgactcttaattggaaaagtagggcgtaaatacttaataaaatccacaaagtaatcatgctcaacaatgttaaagggatactcatgcatgatgattgccatatagaactttttcaggctaaccgtctcatcatacctgtatgtctcaacagctccttcagtaccatcttcactctttttcatctgtagttgttgttgacctgacttgatgttgtgcttgttattcaagtgattccagaaaacagaagtgccacaattactctcacaccgacgtttatatgagcacttgttgcatttaacatactcctctacaatcacagtgtcatctgaccctttcttgcttaccttatatttagtgtagtgctgccaaacttcagaactacacttcttttgcttcttaccaggaggaggtaaaacctcaaaatcatcattggttgtcaaatcaattgcatcattgtgtgccaaggcaccagcagtaggagaagtgtcctgcgtagctgccgtagcatggcttggaggtgctgggagttgcaaaactggagattatgcagtggtacttgcagctgcacttgcactacttgcactaccagactccatcaccaatctagacacaaagtaaaaaaaagcacatccaagatctacatcagtttatcgatctcatgaaaggcacaaaacaaaggttacaggagaagaacaaatcaatggattacctaagagattagtgcatgcaagaggccttgccgccggcggtggtgacggctcctagcctcccactgtcccacgatttagggagataggaagcacaaacaagcactagggggattgaaggccaatgcccagcaactccagcaaggagccaaggagatctaagacagccgccgccactgtcgccggcttgccgctgccgtagtcaccaccgccgccgccgccgctgtcgcccatctggcagctagggtttagatagccgagagaaaactatgtgctgaaattgaagggatgggctggaggctggaaagacatcaagcgttacgcggatatccgcgcatcttaatctccggatattcggctccgtattcgtattcgccggaaactgcgttaccatattcgtatctatatccggagaaaaaatatccgtattcgtatccatattcgaactatccgaaaaaaatccgctccgaacactatccgtatccgtttttgaccggagcggacggaaactatccgctccgttttcacccctaatcaccaatgacaaacaacatggatacaaattaaaataacatccaccatcatccgatttagtgacaaacagcacggaaaaattaaaatcacactaaaatcaactttcacaaatgaatctttttccatggtgcttactgccgatttagtgccggggtttgagaggagagaaaggagcagaactggagaggttcagaccttgtctatgcatgaggtacggccgccaccgaagccctaccttatccttgtcgggatggggaagatcaaggcaccggtgtttctaatgaggaggcgcttgtgggaaggatagcaggtaccgcttcctatgggtcacggggaggagtaggaggaggtggcagcgacggcggggtgagcgggaagagtcggcagtgatgacatgggagaggagatgcctgtggtgaggaagaggaaggaggggaggctgcgacttgggagaaatggtggagcaggcggaggcactgaattcggcaacgacagctacactgagaaggagaagggggtgacactgagcagatgcggcgtgaagcagcaaacacacgagaatgcttttcttttctaagctagcgatgtggaagtacctttttgcgaaaagaagtttcttgaagaattgtgaaggtatatcttactagtaagagtatccggtggctcatatcatctatatgtgtaatcagacggtttatgtttatcggatgacgttgcgcaataaatttgtgaaaaatgactcctttcacttatttagataaggaacgattagaattgtaggatgattgaggtaagatggaaataattttaaataagaaacgattgatagaacaatagtacattagatgtgcacttattaggacaaaagtgctagaaatataattatacatatacagagggagtaagctgcaaacagcggtcgatttaacccaaatgttttttcctcacccaatcaataatcaaatttttttattgagaactaaaaaaatataataatcaattttttttgtgagttctgagatgcactcgatagtgcagtagcaagggtgtgtgatttaaatctcgaggtcttgtgtccaatcctcatcatgctcacaatttcttcttaaaaaatatttgaagatgcgtctctccctccaaatctcgtttagtgttcacgaaaaaaaattattgtgaggtctacaaattttatctctgggtttagtacattaggtatgtactccctctattttttttttttacataactttagtaaccaacaaaaaaaaatagagatagtattacaggagtgagctcgcacatgtgtacatctccatcgtgcacataataaaaggtggaaagatttgtgagaagtacatcttgtctgcatatcttggaggcgccaacgaagatgaccgtccgtgaggacaaacccttgtcctctgcccagtggtgtccccacgaccacgtacccttagccgacgaaacctccagctgccaaatgcgaatttctacgtaagatctctttgcttttgattgattcaatacagttcatatacggatcggtttattccatcaaaatcttgtggnctntaccagcagtccacgtgccat

SEQ ID NO: 60027 - DNA, 6611 bp, Oryza sativa
atttgaagagttccaaggccagcaaggcaagtcacacagatcccaaacaaccttttgagcatgttgatcccatttaaagctactgtttctattcaactattgcatttattttcgaatgtcattgggtggaattaacctattgtttgttatagcccttttgttcttgattactttattccttgataccttgggttattataacttgactagttgggctatatatattggttcagctagatattagatatgattgcttagccatgcttagaaacattagcacactattgggataacttttgactcactattgtttaatgatggcttaatgatagttcacgatggtcaatcgtgattggttaattaatcatatgccaactaaaacctgataatggtgggttgtgagcacatggttttgagagtcgtgctcatgacaattaaggaccggttcacgagtttcggttgtgaaacattaaccgtgccaaccacaagccagcgtgggcaacggctttaccttttgtatagcatggttcattgcggagcaccagactgagaagtggcggagataagcccacaggggtcgctggggagtccatgccttgtttataagggggtgattatgatccaggaaaggtgcgctgtagtggattgtgttgtacgagaggtaatgtctgtcacgcccggaaattcactagtaatttccgaacttatttgtgcatgaaatcctcgtccaggaatcagccgaggtacacaaattgacaatttaatatacagattcatcaaatacttacttaagaggcacttagtcctcaccaagaagaaaattgcagtggaaaataaaatctagcgaagctccggctccactcccacaggcagctcaactgcggtataagccaaacgtcttctccttctggatcctttttcttcaactgaggttgattgattattgcaaggtgagcatatgacatactcagcaagccacacagcaaatatgcaagtgcacaaggataccaaaggatggcataatataggctcatttgcaaaagcagcgtttagcaaaatatttaagagaaataaaacagtagagtagttaatcagaaattttaatcaacactgaacagcacacccatgctgcacaggcccgaccatcctaaacaaccatacccggctgtacagatctaatctccaaaccaggagctaagcaaattattaccagttataacatcaataattattgtgagaggtgtgagactaatcacgaaaaacattgctcaacccgcccataaccgcgggcacggctattcgaatagttttactctggccagaagtgtaccactgtacccacaagacacagccccacatcatgtcaccatgtgcctcagtaccaccacggtacctcggaaaggagctgtgacattacccctcgcataacacaacccaccacagtgcacctttcctggatcataatcaccccctcaaaaaccagaggcatggactccccagcgacccccgtgggcctatctccgccacttctcagtctggtgctctgcaatgaacaatgctatacgaaaggtaaagccgttgcccacgctggcttgtggttggcacgattaatgtttcccaatagtagctcgcgaaccggtccttaattgtcatgagcacgactctcaaaaccatgtgctcacaacccaccattatcaagttttagttggcaagtaattaattaaccaatcacgattgaccatcgtgaactatcattaagccatcattaaataataatgagtcataagttatcccaataatgtgctaatgtttctaagcatggctaagcaatcatatataatatctagctgaaccaatatataaagctcaactagtcaagttataataacccaaggtatcaaggaataaagtaatcaatgcaaattggccataacaaaggaataagttcacaccacccggtgacattcgaaaataaatgcacagttgaaataaatagagaatttaaatataggatcaacatgctcaaaggattgtgtttaggatctgtgtgacttgccttgcaataatcggtgttcaattaatcttcttgaatacttccggcgcactcgcgaaccttcgcaacgacggaaacgacaaactaacacgcaaaacgaagaaaaagactaataaaaaccaaataaacagtacatataaagtaaacaaacatgtagatcataattttagatgaattatgagacttgaacggcctcattctgacttcaaatgaatttattatgaattttacaagattaaatctaattaaagcccatttaaaaagaattaaataaatttaattcaatttatggacaattttaatatgtagatctttattttatacaacttttgcaacttgaaccacattaaactgagctaagatgaattagttatgaatttttaaagattaaatcggattaaaacacttatattgattttaattgaattaagacgcaataatgaattatttttgaaaaggaaaagaaggattattgcgtcagcggctagggtttgcggtggaccgggtgcacggcagcggttcacgggaacggacggccgagatcgaacggtccacgaccggctcacagagaacgacgacgatgacgtcagcgacgacgtcagcaccggcggcgactcgggcggctcggacggcgcaagctcgccggcgaacgacggcgcgaggacgcgaacagaggacaccaacggatagagggcgacgcggcgaactcaccggtgaccaaagaagcggcggaggaacaacggacagcgccggcgacgaggaagaagcggcggcggagatcgggtcgacggcggcgacggtgctccggcggtcttcggcggcggcgaaggggcggacgaggacggcgacgacttggcgatcccgatggtggcgacggcgaccgacgacggcggctgcaacggcggcgcggcgcggctgaaccgacggcaacgacggtggcgactagggctacgcggaggcggcgctagacacgacggcgggctaaggcaaaggtggcggcgggtagaggagatatcgggggtccttatataggtgcaaggaggcggcggcgaaggcccacggcggccggcgacgagaaggaaagattggggaaaaacgaatccgaatcaaactcgaatccgcctatttccaaaggaaattgaccggagtttctataagagaaaaggaagaggagatcgagaagatcatttcccctctattgatttcaccggatcgggaaagacgcggccgaatttggaaggagacggcggcggcttgcgctagggtttcgggcggcggcggcgcgaggaggacgacgaccccgacaagtgggacccacctgttagcggctgagagagagaggagagcggcggctcggcggactgggccgacttggctgactgggccgggaagggagagagaaagagaggttttgggccgactttcggcccaaagccaaaaggaggattttaaaacctttttctatttaaattattcatgaaatgcaattccatttattaaaaatacttccttagctcaaataaatcccagaaaaatctaggaattatagaattaagcaaagtatttaatgaaattttatctggccccattttatattgagatttaacaaattaaaattagatcttctcttctaggcttttaaaatcatttctaataattccttttaaacaacaatttataatttaaggattttaaacaagaaaagcacttaacaattataattagatcattattgatcaaataattactgaactgttctttgtatcatttaggaattgagctctgaaaaatccgagaaaatttcagagagtatacttaatcatggagaatttaataaaaattaaatccatccatgccttagatttaggaaattttatttcccacatttaacttcacttgtaaattaaagaacatttaatataaattctattaataatttattaaataatttataaatcctgaaacaaaaatcaggatgtgacaatgtcacagctcctttccgaggtaccgtggtggtattgaggcacatggtgacatgatgtggggctgtgtcttgtgggtacagtggtacacctctgatcagagtaaaactattcgaatagccgtgcccgcggttatgggcgggtctaacaatgtctttcgtgattagtctcacccttctcatcataataaaatgtgctttaattggtaataatttgattagctcctggtttggaatggtatattcctggtttggagatagaactgtgcagccgggatggttgttcagaatggttgggcctatacaacagggtatgttgtatagcgttggattaatattgcctatcccttaactgttttattaaattctgaaataattatttactcctctttaagccaatgaaaccctactatgccatcctttgttatcctgtgaccttgcatatttgctgcgtggcttgctgagtatgtcatatactcacgttgcaatcattcatcaaaggaagagttctccaatgatgttgatggtgtggaggattaggtgtagccctggtcaagctgcctgtggagtggagtcgtctgcgccgtttatcttatttttctgctgcttagatctctattgattgagaggaactatctacctctgtaatgacattttattcgcttatttaattagagtaataatggtactctattatcaatttgttattgtgtgcctcggctgattcctggacgagggttcacgcacatgtaagcgtttggaattttggatagaaattccgggcgtgacagttcgtccgaacactggtgatcgccgttgatcccaggttttggcatggacgctccagatcactccctgatgacggttgcggggtagttcggacatttccccttctcacaaccgtcataactgccctataaatggacctcactccctcactacacacacttccaagcttgagctgaattataagaggctctattatactatattgtgtaatagaataggaagagagtagagtagaagaagtcggaagaattccggagttgtcggtaatcttctctcagttcttttattctgtttatactctgatttcagtataatattcttcctgagtaattcagatttatcttgtgagaattatctcttggttagttcctaaatagtatacgggattattgttcactataatcaactaaaatatagtgattgctttggtgagttataaacagctaaaatatagtgattgaaagtttgaaacagctaaagttcaccctttttgttgcagatatgcaatattccttgggtgagcaccaaatcaatttgaaaatttctaagaaatttatgtatttctgttgactaagtagatgacgactacggtatttgcagagtatgaggattgttggtaccggggtatgcgcgagattgaggtagaaaagatgggagatagggatttttatataggttcgggccccttatttgtaaggtaatggctctactcctgttggccgaagccggtgttcctcttattcatcaggatcacacaagtacaatttaggataacctatctagtcatcgtcgacttggcggtatggaacaccacgcgtagtcgatgatggggtagtcttcctcctggaatatgaacttggcgagattagagataacgctagatccctcttgtcggcctctgtagtatcagattgggtatgtctaggcttatcttctgatgtcgatgtttggcagtgtgtattggtgtctattatgactgactgtgtcccctctcctcctagggggtcttgtatttatatccacagatatctctttgtctaagtagaacgagagagacaagtatggatatgatatgagtagtccttgtagttttcatatagaactctgcctctccttccttatccggaataccttctgtatatgagacatgactccgcataaaacttagtatatggtgccgcccccccacccccggagcctaaccaaagactattgggtatgccttatctataacactaacaatttcttaatttaatccgtctatgagtaaattattttcatgcactctacggtaagtgcaacaaaatttaagaaataggatagatgctaaaatataatgtaactgctgacctatttctattcccttcattttatattataaaacgctttgactttatttctatcaaacttctataaatttagacaagtttatagagaaatagtgtactatctccatttcaatataaagtattttgcctatgtatcaccctttttgtattttgagcggaggtataacatcaaattagttccattaaatataacattaaatataattaaatggtgtgtttgtttggtgttaacataacattaaatataatttgtaccagcggcatccggccgagggtcattgtttttttcgtgtttggttattgatgtgctattgggattggttatataacacttgctttcacaaaacttatgccaagctaaaacatattccctctgtttcacaatgtaagactttctagcattgcccatattcatttagatgttaatgaatctagatat

SEQ ID NO: 60028 - DNA, 2039 bp, Oryza sativa
  unsure (1)..(2039): unsure at all n locations
gtccacctccatggtgacgggccgcgccgcctcttcaggcttctcgatctccatcgccgcgccgggattgctgctgcttgtctcaggcttggcattgctcctgctcttggttttggttttggagagcacggcagagacaaaatccatgcgcagattggcatcctcttccactgttttgtttggtaggcaagcaagcaaattacaatccattcctggttcctctccttaaaaaccaaaccaagcgggcctatgtttactgaagattagtctttaacaggggcctatgtcaattccttgccgtcatcaaacagacagacaaacaaacaacacgatgatgatgagttctgtcttgacggctgcttccttccaatctcctcgcaatttcatcaaactacaagtacagctaaggcctcagcagcgacgcctgcaacaccaacaacagcttctgattgttggcagcaacggggcaataacaataggaaacatgagtttgtgccgggattgctgctgcttgtctcaggcttggccttgctcctgctcttggtcttgattctggagagcacggcagagacaaaatccaagagcagcggcttggccggcgccatggcgtcgatgatgctgccgccactgcgagagatggcgtggcctcggctgcgtttccggctaatccgtcgcagctaagaagctcgccgacggctgccacggggcgcttccacctctgcgcccatcgccgtagcgccggcctgcgcccaacccactgccgctgcgtcgccacgccaccccgccgcccgtcgccggccacccagctgctcccccgcccgcgccgctcttccgccaccgcaccggccggcccgcatgagaaaactgagaaagagagagagaggaagggagagaaaagaggaagagatgatgacgtggtcaccctgatgtgtggggcccacgtgggtcccacactgagtcagctgccacgtcggataaaaccggagtcaaaactattaatggaacttagtttgcactttttataagttggagtatgtgttgtatccggttttgctgtttaaggacgattttgtaacttgatgacaagttgagggaccttcgatgtactttttccttttcttcattgctggttttttctccctccaacctcaaatggggcggtgtggcccgattccagatgccttctcgtacaccgattccagatgaaacgaatcaatgggccggccggcgggcccgctatagctacaccaccccccagtccaccacacgacgcgcgctacattctccacctctccaccattccaaactgccaagtggcaacaaacctactactaaacctgagaaatccagattcccacccgancngacacanntcctntctcctcnngcngcngccgcgcnntcctcncaaaccctcccctcccccatggcagaagacgccgcggcggccgccatggccgcggcctccctctccgacgacctggagcccgccaccgaccgcacccgcatccgatccatcctggccgacggcgccgcgcgcgccggcgagcgcgtcgtcgtgggcgggtgggtcaagaccgggcgggagcaggggaaaggcaccttcgccttcctcgagctcaacgatggctcctgcgcctccaacctgcaggtcctcgtcgacgccgccgtccacccgctcgcgccgctcaccgccacgggcacgtccgtgctcgtcgagggcgagctcaagaagccgccggagggcgccaagcagcgcgtcgagctccgcgtcgaccgcgtcatcgaggtcggcgaggtcgaccccgccgcctacccgctgcccaagaccaagctcacgctcgagaatctcagggacgtcgtccatctccgctcccgcaccaacacggtccgtctgtttcgcctcacaccacgaaaactgaagccctttctgaagtagactacagaaatttctagattttgcaacttccgcactagttttgataaatcctgccgtgatgatttaggatgtctagttcctggtgtgaaaattatggttt

SEQ ID NO: 60029 - DNA, 24035 bp, Oryza sativa
cttatggaagatgtgagatttaatacctatcactatgggggatgttttattatctagactttatgcagatgttggcggtatagagtcggcatttaataaccgccaacacccttccaaggaagcacttagatagtcagatatattgcatcatatatttgttgtttaatatgtgtttattttaagaacttattcatggtaaggggtaaagaatattctcggtaggtacaaagttgtccaaattttatatttgtcattagttagaccatatcctactttggtaagtctgtcgactatcacccaaatagagtcatggcctgatgatgttctaggtaaaccagtgataaaatccataccgatttcttcccatttccattcaggaatcttcaaaggctgcagcaaaccggcgggtttctgatgttctgccttgactcgctgacaaacatcacatactgctacgtattctgcgatttcacgcttcatacttgcccaccaaaatctttccttgagatcctggtacatcttggtactaccagggtgaatggagtataatgtatcatgagcttctttcagaattgcttcttttaaatctttgttgtcggggacgcagattctctcacccaaccatacagttccttgctcatcttccaagaaaccgatagcttttcctcttctcatattcttcttgatttcttgaatatcaagatcattaatttgggcttctctaacttgatcaattagagtgggcttcgcttctaaggctgcaacgaaacctctactgacaattcccaaatttaatctttaaaattccttgcataattccaatggcaactgtcgtccttccgtagcattgcaatagctttcctgctaagagcatctgctacaacattagcctttcctgggtggtaatgaattcccatgtcataatccttaattaattccaaccatctccgttgtctcatgttcagatccggctgagtaaagatatactttaaactcttgtgatcggtgtacacctctgtacgagtaccgaaaagataatgacgccaaattttcaacgcatgaactactgcagctaactcaagatcatgagtagggtagttcttctcatgcggacgtaactgacaagatgcataggcaaccaccttcccatcttgcatcagaacacaacctaacccaagtttggatgcatcgcaatacacttggaaacccttctttggatcaggcaaaatcaaaataggagctgatatcaagcgattcttcaactcttgaaaactctgctcacattcttccgaccacttgtacttcacatctttctgaagcaatcgtgtcatgggcttagcaatcttggaaaaattctctataaacctccgataataacctgcgaggcctaagaaactgcgaatctctgaaactgtctttggttgtttccagttggttacggattccacattactaggatcaacggcaactcctcctgctgagatgacgtgaccaaggaacttcacttcagacaaccaaaattcacacttgctaaacttagcatacagttgatgttctcgtagcttctctagtgcaaagcgaaggtgttcttcatgctcttctttggttcgggagtagataagaatatcatcaataaagaccaccatgaactggtctaggtattccataaacaccttattcatcaagttcatgaagaaagcaggggcattggtgagtccaaaagacataacagtacattcgaacaacccatacctagtggtaaaagctgtcttaggtatatcttcctctttgattctcaactggtgatatcctgatcgaagatctatcttggagaaaacggtggcacctttaagctgatcaaacaaatcatcaattctgggcaggggatacttattcttgatagtcacatcatttagggcacgatagtccacacacatcctctgggtatgatctttcttttccacaaaaataaccggagctccccatggagatgaactcggtctgatgtatcccttctgaagcaaatcgtctacttgccttttgacttctgccaactcattggctgccattctataaggtctcttatggatcggagttgttcctggtaccaaatctattctgaactctatatcccttttaggcggcataccaggtaaatcatctgggaacacatcgggatactcccggactataggaatctcttccaaagttatttggttcagtcttgaccttaatgactcagaagacaatgcatgaacagtcacaactcgaccatcattgctggtgagaattacttttctgttagcacagtctatcacacctttatgtctggctaaccagtccatccctaggatgacatcaaggtctttggattctaacaagataagattggccagaaatggtactcctttaatttctattctgacagaggggctacgttgcaaagagagtgcttgattacttggggtactaaccatcaaaggacgtctaagatcttctacttccatcccatgatttcccgcaaaactcatagataagaatgaatgtgtagcaccagaatcgaaaagcactgttgcaggaactaagttaacaagaaatgtacccaaaatcacatctggagcatcttgagcttctgcagcagcgacatgattgacacgagcctttgatgctggtacggtagagttgctctgggcagggacaaccttcacgcgtcgaggcttcgggcacttgtccgcgtaatgtcctgggtctccacagttgaaacacaccacgggcttgctgccttgctccctcttggcaggttgttgctgtgtcgaagctgcaacaggacgtggagcttgattgcggatgttgttgccagcattgttgttgaagaactgacgctgcggacgaacaacagacgaagaacctccctgtggcatagactgcggtcctaaagtaagacgcggcttctgattatttccctgttgtgttttgaattgagcaatccggcgtttcttttgctccatgctgttgtacttgtcttcctgacgaatagccttaatcaccaacttctggaaatcaggataatccccagtcatgagtgggtaagaaagctcatcattaagtccttccaagaacttctcctggcgctcttcatcattgcgcacatcttccggagcataacgagccagacgattgaactcgtgcagatactcagtgacagagcgagacccctgagtgagcgacctgaattccttcttcttgagagacaccactcccgatggtatatgcgtcttccggaaagcagcggtgaattcaagccaagtgataggttcagcagtagtcctattcaggcggaagtgatcccaccattcagaggcagggccatgcaactgatgtgatgcaaatgagaccttctcctgatcagtgcactgaagcaaatccaacttcttctctatggcatgcaaccaatcaccagcttcaacaggattagtggtactagagaaaataggcggcctcacacgaagaaattctgctaacttattctggggaggtgcatggttatttccctggttctgctggttctggagttgctgcatcatcatgttcattaactgagtctgttgagcaagaacttgggcaagtgtgggattctctccattgttgttgtttccacttccactggcgcgagtgttcaccatctggtatgggcaaggcacaagaagagaaaccggggaaaactacttaggacaaagaattaatttaacttttattgatcttaaatgagttttgttattacaaaactgaagactctcacaccactaaactcaccaacttcctaacactcaaaagcaaacaaacgcatgcacttacatcccaccactgatgtaaataacatgcaagacccacacaaccaaacttaaacaaacaagctaacacaacgatctaagacaacggcttgacatggcactccagttcttccgggcatcggagttgattgaaggctcgttcggctcgtcttcatcatcttgagttgctccctactcaatcttggaatgagtgtgcttggattcttcttcttcatcatcacttatgttgatgaccggaggatccgctagggctggggtaacttctttctccaccacacggacctttggcgccaattggtaacgagggacaaatagagctctcttccttgcggtaagacgaatcctggccttctgcggtggtgcttctccctttaacgcggctagttccttctccaaacgatccactttgtcttttagcttgcaaatcttaccacgattccggtcttcatgatcttgagccgctaacacagtttccgcacgggtttcatccatagcccacagcatctcaaccaaatgctttgtggtaacatcattctcgattccttcagtctcaaggtagctgccgcggtcacttccctgtggttggcgaggatggtagcgatactcagtgtcggccaactgatcactgtagcgatcgcgaagctctcctatggcgatccttgccacctcctgacatgcatggatgtagtttcttcctccagcttcgaacatcactgaggggatatcttcactattactgttcaaggtgactttgactcggcacttctcttcatgacgatcatgaggaatctgggcataaaaaggggtagtcccaaatcctatcacaaaggacatcgtacgcaactcctggacaaatccctcaacaccaaacaagtactcaggcttgtagcgcggcatctaaagacaagtgaaaggagggagttaagacatttatccaattaatagcacaagtttttggattaatttgaataaagttagaaattcaaagtaaaaaggtaagtaaataaagtaaaccaagcttgcaagataagttgaaacagttggaaacaaggtcaccaattttgtacttttgaacatcaggttccaaaagaaataaaagaaagttataaaatcaacatgctaaatttattttattgaagcaagattaaataaaacaatattgtaaaacttttgttggtaaatgagccattagtacagtaatagatgtacagtactaataacactggaataaattttgattgagaaccattaaaagagattatgaagtgcatgtgccattagtttggtttaattaaaagagaaagggaggagaacagttctacttttccaatatttttagagggcttctatgggttaccatttggcataacctagggttaaggaggctctgataccaacttgtcacgcccggaatttctatccaaaattccaaacgcttacatgtgcgtgaaccctcgtccaggaatcagccgaggcacacaataacaaattgataatagagtaccattattactctaattaaataagcgaataaaatgtcattacagaggtagatagttcctctcaatcaatagagatctaagcagcggaaaaataagataaacggcgcagacgactccactccacaggcagcttgaccagggctacacctaatcctccacaccatcagcatcattgtagaactctttctctgatgaatgattgcaaggtgagtatatgacatactcagcaagccacgcagcaaatatgcaagtgcacaggataacaaaggatggcatagtagggtttcatttgcataaacagcatttaataaacatttcagaatttaataaaacagttaagtaatagacaatattaatccaacgctatacaacataccctgttgtataggcccaaccattctgaacaaccatcccggctgcacagttctatctccaaaccaggaatataccattccaaaccaggagctaatcaaattattaccaattaaagcaccttttattatgatgagaagggtgagactaatcacgaaagacattgttagacccgcccataaccgcgggcacggctattcgaatagttttactctgatcagaggtgtaccactgtacccacaagacacagccccacatcatgtcaccatgtgcctcaataccaccacggtacctcggaaaggagttgtgacattacctctcgtacaacacaatccactacagcgcacctttcctggatcataatcacccccttataaacaaggcatggactccccagcgacccctgtgggcttatctccgccacttctcagtctggtgctccgcaatgaaccatgctatacaaaaggtaaagccgttgcccacgctggttgtggttggcacggttaatgtttcacaaccgaaactcgtgaaccggtccttaattgtcatgagcacgactctcaaaaccatgtgctcacaacccaccattatcaggttttagttggcatgtaattaattaaccaatcacgattgaccatcgtgaactatcattaagccatcattaaacaatagtgagtcaaaagttatcccaatagtgtgctaatgtttctaagcatggctaagcaatcatatctaatatctagctgaaccaatatatatagcccaactagtagagttataataacccaaggtatcaaggaataaagtaatcaagaacaaaagggctataacaaacaataggttaattccacccaatgacattcaaaaataaatgcaatagttgaatagaaacagtagctttaaatgggatcaacatgctcaaagggttgtttgggatctgtgtgacttgccttgctggccttggaactcttcaaattcttctcctgcaaaaacggactctccggaaacgtcggaatctaaacagaaagaagcaaaatcaccaaaacagcacataaacaagcatgaacagtacatgtggatatttttagcatgtagatctcaattttagaaaaatttagagacttgaaccaactaaatccgagctaagatgaattagttatgaatttttgaagatttaatcggattaaaacacttatatcgattttaattgaattatgacgcaataatgaattatttttgaaaaggaaaaagggatttattgcgtcagcggctagggtttgcggtggaccgggtgcacggcggcggttcatggaaacggacagccgagatcgatccatccaaaacggacggccgagatcgaacggtccacgaccggctcacggcaaacggccacgatgacgtcagcggtgacgtcaccaccggcggcggctcgggcggcgcaagctcgccggcgaacgacggcgcgacgacgagaacggagggcaccaggacgtagagcgtgacgcggcgaactcaccggtgaccaaagaagcggcggaagatcaacggacggcaccggcggcgagatcgaagcggcggagaagatcgggtcgacggcggcgacggtgctccggcggtctacagcaacggcgaaggagcggacgaggacggcgacgtgacggcgaccacgatggcgaccttcccgagcgacgacgatgactggagcgacggcggcgcacggctgaagtggcggcgacgacggcggcgcgaagcggcacggcgctagagcgctcccggcgacgagaagcgaaggcgagagtggcgacgggtagcggcgacaccggggatccttttaaaggggttggagagcggcggcgaaggcccacgacgaccggcgacgcgaaggaaacctcggggttcggaggaaagagaccgatccgattcgacctcgaatccacgaacttccaaaacgattttgccgatgattccaaaagagaaaaggtagaggagatcccgaagattgttttccctcaattgatttcaccggaaacggaaagacgcggccgaatttggaaggagacggcggtgcggctcggctagggtttcgggcggcggcggcgcgacgaagacgacgactccgacaggcgggccccacctggcagcgagcgagggcacgcgtgcggctgcggcggactgggccgacttgggccgaggagagagagaagggttttgggccgactttcggcccaaagccaaaagagacttttaaaaacctttttcaatttaaattattcatgaaatgcaattccatttattaaaaatacttccttagctcaaataaatcccagaataatctaggaattatagaattaagcaaagtatttaatgaaattttatctggccccattttatattggaatttattaattaaaattagatcttctcttctaggcttttaaaattatttctaaaaattccaattaaacaacaatttatatatttaggattttcagggtgtgacacgaaccctgggctgggccctcctggcctggccttcggcggatctcctcccttggtcctactctatctatttctcggagttttgggctaagtctttgatatttcgatgaagtttacaacccatccttatatggatacatgtttctccttactttagtctagatttcctcccatcttcggggtttaacacctgcatacaaatatacaccaacacttgtggaagatgtgagatttaatacctatcactatgttggatgttttattatctagactttatgcagatgttggcggtatagagtcggcatttaataaccgccaacacccttccaaggaagcacttagatagtcagatatattgcatgatatatttgttgtttaatatgtgtttattttaagaacttattcatggtaaggggtaaagaatattctcggtaggtacaaagttgtccaaattttatatttgtcattagttagaccatatcctactcaccccttacatattaatttaacttcaattcataattataagttcacccaacttggctataaagaggacttccttgggccctaatgttcacacaagaaaatctaaatttagccaaatgcttttcttcaatgtaattatgttttccgctgccatgcctctaatggaaatcactgtccatccaatgaccaatgaagccatccatattctggtggtccacatataagaggtgctcttctaggttgctgaaaaaggtgcgagagctgtctatgctcttcaatgtcccagcccatgtcatcttgtacaacatagatgatgaggtggagaccaacttgttgtagcctacaattgacactccggagtgctacaaggacaaaagaatgttggactctgagagactcctccggctgaataccaaaactatcagctttagatcaatgtgataatgaatgatgcaccaaaagaacttggatgatcttgctcccaagataattgacaatctagaatgggtgttgtgtatgtgccatcgtggaattcacaaccgcgccaatgtgcttctctcaggggcttctccgtagaagaagttattgcatttaggaagcttatatattgtttgatcatttcctgtttctcctaaataataccattttaatgtttgtaagtgcagatgatatgcagccttgatggtaaggattgtggtgtttttaagtacagtacatgttgtcagtaaacactattcaaaagattgttgttgtcattatgatttgactcgaattttgtaccattagatcacttcttctacttttctagtgagccagcggtagtgctacataagggtcggagatcatgggcttagtaggaagcagagggtgtgagtgaccctatcatgggaggtggaggtggcagcatggctaggaaacaatagtgccataggaatcgtggggtcaaagctaggaggttagtaggagatgtaggtgactgcggtgaagagattcaacatgttatgacctaaagaaaggatagtggattctagtagcggttgcatatggtgacggagaagcacacatggggttcttctggccaagatgaagtgatggagaggaaaaagatgtgacaatcgaagatcaagatattggcatagggtggtgtgacagacttaaaaatggccaaaatttttatacatttttgctatgtggatatcaaaaattattctcgtatttgattcatgaaggaaaattaaaagaatcagcattgataatgctttcatggagccaaaaaggatagtcaacaaccaacctatctcctgctccctccaacctggagccgacttcctcgacagctccttgggcccccaaatgctcctcgaggtgctgaagcgccaaccactctcgccatcatgtcatgttttgttgtcatcgcccatgatcgttgatcctgcatatcgccattatctgtgccagttgttagagcgtcaaaatgtggtgacctaaagctcgcttggccagatccaacaaccttttgatcgagatagcctgtcatcgttcatcacagttgccattcttgggaagggagagggagtgacgtcatagtggatccggtagccccaacctctcattagtggatccagtagtcatggagacaccagcatcatcacagtcgaatgtccactctagttctcaggctcatctaccactctgggcacggccgtaccaccatcacttgtgccaatttaccatgctcggggaggcagaggaagtgattgtggatctagcagccttggtagttggtactaccaccaccatcagagttccgtgtattcctgctcctcagcaagctaccacaccactactgttttgccatagcatcactcctcgacagtcccccgctccatcagatcaattgagccattaagggagagtggtgggggaaggaggtaggcttcgcagagtgagagggagagggagggcgagataggaaattgtgaggttcaggtgacaacaagaaggggtaagagtttagtggagttcttacaccatgatttgcaaatattggctcaatctatttgtttagccggttccggtggcatatcactgtcagtttttattataaattgacaacgatatttcaacttcattgtccgttaacgatgaatcatagcattgttctaaatatcacttgcaattcataataaattcaatacgggtgctaacacggatggtttttgttgtgaacccgcagcagtaatgataccttacccaaggaaccacacaaattttcggggaagctaggggagcaaagtcactagagcaagccggacccacggcagccatcattagggatgcacaatggttgtaaataatggtctcttaatattgctaattaggaatatttgctgatcatatggaagagagaaagaggagagataaaacatcattgttatgggtaacaacggctcgacaatgattcttagcctccataatatggaaacatagttgcatgagaaagaaacatagaaagaatagtaacaaaaagaatatttttttagttactggttagaacttttatcgtctcaactgttataaagactcggtttatattgtctaagtgaccataattgtctttactattgaatgtgccctaaaccaaggagcagacactgcatggctggacatgagtaaccttcacaagattataacaggagagacagttttcattgtaagaattgttctcaaatttttggaagacgcaatcttatcaagtattgatccaatactttgagttcttatgatgacacagatacactaaacatggtcaaccgtcaagcaaattgcacagccaagcaattcagcgctaccttatctatctattatctatctatctatcttctatctattatatactaaaagtccattaaacttcctacaaacactcttaagctaccatgtggcatcctataatcactctcgagccgccatatgccactctaataaaatagaaaaaaatttgaccgtcaattttctttaaattggtgcacccactatcgttagatttatctttgcatgaaaacataatctccgtccgtccaacgtaccaacgtgcgtacgatccctctgcagcttacttactgaccccgtttcctttttttttctcttttttacatccccataaaaattgaaataaaaaaaattaagggcctaaaaagctcatcaatctactagatctagctagctcttcctctatcctctcctaataaatattccattaaacatcatatagaaattcctaaccatccataaagcactcttaaattagagaaaatctaaaaagaaataaaacattcgaccatcgatttactttattttaggttattagatatatctttttcttaagaaaagcatcccaaaagtccctccgtgctcccatgcatcgttaaagcctgttaaccatcctcataaatgtttctaaaccactctgtgacacttctaaattagaaaaagatcataaaagtttaagaacaaaccatccaatcattggtttcgccttaaatcgacgaacatatcatataggttgttattagacttatattttaagaaaaactaccaaacctcctttcctccctccacgcccatacaatgttaaagacataaagtatattaaacatcctataaatatttctaagccactacgggtctttcttaagttaaaaaaatcatacaaaattataagaaaaaaaaacatccgattgttggtttcgacttaaacatccaatacattattttagatcattaaataaataattgttttaaacaaaaaagcattccaccctccctgtcctcatgcggtgtgtgtcgttcgttttctcttatttttctatttatgacaagagaaaagataattgaaattaaaattatctttatgggaaaaaccacaaatggacctccacatatcaggtctagctagctgtcccactgccccttttcttctctttctcctcttgctagcacttataggaacaatataaataaaataataataactttttaagtcatacaacttatgatatgcttaaactattatattttttagtgaagtcaatacttcaatatctatattgactatatttaaatgctaacagaaaaaataatattccgaacccacatccattctgaggcctccactaaataaaaaaaaactaaaattcgttactaaaaatcaaaatatcccatcttaattttcaataaagccggtagacccattacttatatcccattagacaactaacaactttctatcaacttaattaatttctcgggctatttaccaatacaatttcattttgatgcttttatcaataaatgattgttttaggagaccaaattatatatatgatttatgaagtcactaataaattagagaaaaatcattgaatgatatcaatttttaggtcataatgcgtaccccatctagtgttaatttgttatagacaacattttaaaaattaaaacgtgctcagttgaacatcataatattcgtaccaagcttgtgggttgcaccaaggaatcttagcagtgaaacaataataaggtgtccttaccaatatagggagtcaattccatatggaaattaaagaccatgttcatttatttctttttggtaaaacttgctatgctacatcgtaaattcttaacttttagcgtagaatagtctagaaatgtgtatttattattgttaacagtggaatttgaattatatgacctctattttaatatttcttactcatttgaagagagataatttagaacatatgacttttaccaatgttaggttgtaggctgaacccacatatatttttaacccaaattgaagagatcaaatcatttcaaagatatttcatagagtggaattctccaaaattttaaaaaatggctggaaaaaagaattcaaaatttatgtagtttttaaaaaataattgttgggtttaaaacccattctaaatataaatattcaaatattttagtaggactaatagaatgaccatatctaaaatttcaaatagaatctaatacaaaaattggactttttggtagggataagatatccctgtggggagtcgaaatactcaaatttttctcatagaaactacatctattgtttcgacataatattttcttataaattgaaaactgttcaatttacagtttcaagtaattttactttagaatttatgtgctgcaagggtaattagaagaaaaccataaccaatgtttctagcacattaaataagttcaattataatttagatatggtaaaagaatattttaatataaagtcacccatacacggacattcgtaattatattaaataaggtgcccgtgcatgtgtgcacatcttcctaaacagtaagcaccccacagcaagatggatcatgctcgacaagaacaatcccatcgctgaacaattaattgaagttcctacttatgccttcaggggaagaaccatggcagcggtgaccttctttatggagggcctcgccgcgagcccatcccaccatgccttcacatgagggtacttgtcgagtagtgaagcgtatggcgtcgccatgaagtagaaggtgaaggggaagtggctgaggtccacaaagctgaggaaattgccagccaaatacgtattctgcgatagacgggcctcatacacctccagcactttcttcagcttctccaggctattatcgaccaccttttggttggtcgggacaccgtacatggccgggttgaagaggcattcatacacgatcgacgagatcaccggatagtactggtgtatctccacctcgatcccgatgtccaccatggccgcctcagtcaggttgccttcccgcagtaggttggcctcgctggtcttgtacttgcgaaggatgtaccttcctaccgcgcgggactctgaaaaggaaatgcatttagccagttttatttgcttaaatctgaatattttagatggtaaatctgtgaaaaaaatttatttgtaatgtaaacatatgaaaatctattgtgccgcaaatgagcgatgtgatgctatgtatttgtagtattatattatcggtggaaataatctgaattatttattattaaaggtaaattaataatttactcatacagtgactagggtaatttatgtttttctctatataggttggtcggtgatcatccatctcactatcgcggatatcgctcatattctatcaagaaaaacaaaaggaaaaagggctctggatccccagtcctccggctggcatttttttaaataatttcccttcacgtttctactactgatagctttgatgctagtaaaacttagatttaagcacttcgatcaaatgaaatcaacgattcagattactttatactaccgatagagagcatcgcagtggaactccctgcaaaaagctctgtttagttgtaaaatctcaattagctgccgaatatgcatgccagtcgattggtttagttctgtgttctcatgatgtctcccaaactattcacgactcctgtccaagagtacagaagaactacagaccgaagagaagcagatccccgtcctggaaagctggcatttgaccaaacggctgcgagaggaaagcacagagatcaagctgggagcacaggaaaacaaaagcagagtaagcacaagcgttagcgtgtgcttacgttgcgcttgaggtgttcggggctcttatgctccatggccttgaagtcgatgttgacgagctcgtactcgacaccgacctcctccaggcacaccagcacccgcgccacgttcgtcgacatggccggaccaaacaccttcaccggtgccatcttcgtggagcctagctgcccgcgagcaatcagaggaatcttgtggagtagacgagtgcggctgcgtgtggtgcaatgagcactacacgacttcgtttttatttataacgcggaaatcccttgcgaaatactagcagccgggttagcacgtgcttgacatcgtgctcggaaatttcctatcaggtgttgtactggtactactggtatccgttcttggcacggtagaggaggacgagttctcatcgaaatctaacgctagcttaacgctcaaggatcggagagcatagatacaagaaacgggagactgagctctatacgtctagttcctatgtttcatattataaatcgtttagattattttctatataaatttattttagtttgatcaggtttataggaattaggaagttagtccacgcgaatgcgcaggcatcttatttattatgtttatataaataatgttacgagaattaagtcatatctcaccatacgcgtataagaaattgtatattttacctcataataacaaaaatctatgttgtgaaatatattgtagactttaatactttaatataaacgaaaagaatgtttcttatattaaaaaaatcacttttgtccaaattatgtaaactcacctattgtcactattacttattatcattgtcgctagatgccattttaataaatgaaactgcatctgtaccaccaaaataagcctaatacattattaatacataaaacatttgtctccactacatacctaaatgtttatgtcaacacttatttctaaatctataaataatattcttaaaatgatgcttctattggttaatgggatatcaccgttaacaattagacatgaatgtcctctctaaaaggtggagctaccaactctttatttttttgttgcctttaaacatgggttccgaatcgacatactcgtgcctctcaaggccagcgtataatgtacttttaatgcttaattcactatcaacaccctcaaagacgattgcatcagtaagtagaaagttgagcactattgtcaatggtggtctccactggggctacctcaactgaaccaaatgtatgcccctactatacttcctcagtgccctttagagaaagcaagaaaagatagatgtaatgaaaataattcttcacataaaaaatagttgtttttacgttttgtgtagttataatttgtttatagtattaaatcagtactacccaaatttttatggtatatatacaatattctcttttgaaatgagtgaggttgatcattaaaaaatgtatcgctaaatagatatatgaccgtaacaatcttcagagtatcatatcattatatcattgttcatattttgacaaagatctctattttagcgtctagtttgttttcgtcacttgttcataattgcatcagacacctttactaattttaaaatctatttatttatcaaaattatctacaataactaatttgttggagtgcacttacggtcacgtcagtggggagtatatggcatacatctatcaactatcacttatgcccgacatattagagttacttgacaaaaaaatatcatgagtagtttaatgcatatgttatatgattgttctattttttaccaaaccaatttggcaaagggaaaaacgtatggattaaggggtcgtattatagcgaaatcattgcctagaaataccattgaaatagttttgaaaaatctgaaacaaaacatttgagaatcttagtctccataaattaaaattaaatcatatataactgacaaaacataatgttgtttcgctttcacagatttcagttagtgttatatatttgccaagtgatatttgacaccacaaaatatgatgtgaaattattcaaagattatgatgaaattaattattatatgtcacctaaattatttgaaaattattataatattaattattatatattatctccatttgttataatgtatttagcatcataatataactatgataagtcatcaacatttgaatacaatggattataatttaaaattaatttaaaaatgggtgtttaaatacctttgatttgatatttatatggatctagtttaacttgcatatttctagagtaataaatttggttttattgtatataaaatcttatcttgaggattgtctatattttttgtcgatggttgtacgaacatacatatgtatttttttttgggttttatagcttgtttaatggtatatacgtatgttactttggtttttttttaatcgaacatccggtaaacagtttctctcgtataaaaaaggaaaataaaaggaagcgagctcatgtaatggtataaaataatgggtccattaatttaaatgaccatgttgtagagtaataaattttatttttatagtatataagattctattttaaaaaggcctcaatggttatatattgttgtacatatattttcctttagagttttaatcgtgtgcacatgatacatatcctttgttttttcataggtgaacagtatattaatgtttttttatgtttttatagtttttttatcgtattactacgttctttgttattattgtttttatatttttttaatcatatgtactatgttctttattttttctcttcgaataaacagtacctaaatgcatatcttttttttgtcttaaaacatggtggtttaagagtgcttgtacaagcaccaaatgaccatgtttgtagagtaataaattttatttttatagtatataagattctattttaaaaaggcctcaatggttatatattgttgtacatatattttcctttagagttttcctttagagttctatagtatataagattctattttaaaaaggcctcaatggttatatattgttgtacatatctttttttcattcaatgtacgtacataaatatttttggtaaacggattatctcggatatagaaagcataattttttaaaatagatctaatcggacggtgtaaaataatgtgtccaccgatttaaataaaaatcgatggtgggattgaagaatgccacataacggcctaggagcacaaagatattggcgggtaaaaaaatagttgtatgatttagatatcgttgttacttaattttgttaatataaaattttactttaaaaaggaattggtggaatacaggagggaatcgaaggaagagaaggtacgtaacttatgcatatataatatcttagtacgtaactatacatatttaacgtacgtatgacctaatgctcggtggggctggatccatttaggaggtggattttttgttaaacataaatctaatgattgtaaataatggacccatcaaatttaatgaaaatcaacggctatttgttagatatatataaccagtaacctcactctcagatccggttgttactagtacaaccaatcagatccggttgttactagtacacccaacaacagtgtatgtctttttttgtcatcttatagaatttccttttaaaatacttagctgatttacgatctgattatattgttctattcattgcaataaagtctgtataacaagatgtcacacgattatatttttatgaaaaattacaaattaattacttttatataatatctaaattatttatagatttcttgttaggcatataaaagtaaattcaacaaagccttaaagtaatttacatatattatagaagtaacttagaaaataaagcaacttgtcatgacattaaaagtaaatctattgttggggtaaaaacataagtctatctagaaattaaatttaatcaacatattatagaactaacatttttaaagtaaatagttcattgaatgtctaaaaagtaatttaatcaaatataaaagtaatttatatatatgataaaagtaacttacatatataataaaagtaatttagaacataaatattttttcgtcgtaatataatcatgtaagatcttgttataaagatttaattgcaataagcacacagtggtgtaatcggattgtagatcggataaataatttaagaaaaaatttaataaggaaaaaaatacatgcactgttggatgtgctagtaattctctcacgtataacatataagtaacatttcaaaacaaaacaaatatattattaaaatacattcagttctagatttaatgaatctctaaatgttgctaaatttttatataaatttggttaaacttgaagttttgaaaataaaacagttaaaacgatttataatatgaaactgaggggtcaaagtttgatacttatgccatcctcaatgtttaatgtaactagagcaattagacgggactcacaatttgatgttcttttgtatatagcatatgctacatgtatatagtattttcttgatcttaagttaggacccattcatgaaaataaaactctattcaatatgaatgaaaaacaccatgcatgttgcaaaaggtatgaactatttttttatttcttctggtctagtcttgagcttaaggttaaggttggacatagcaatatatttcttactaaggttatggttggacatagcagtatatttcttaccttctcttctcccaacgcataaagttaaaaccaaatgactaatttatttctcaaggttacgttgcatgcaactttatttcttagccggagatttcgttagcttgtcagataccatccattcttcgatggtatattacctatttatattagccaaagattccaaaagagaaaaggaagaggagatcgaggagattatttcccctcaattgatttggccggagaaggaaagtggcggccggattttggaaggaggcggcggcttgcggcgcggctaggagcggccggaggttgaagacgaatgacaggtgggccccacctgtcagctgcactgagagagagaggagggagggacggcggactgggccaaacgggccggacgcaagcaggccgaggagagggagagagagacctgggccgactttcggcccaaagccaaaagggagattttaaaacctttttctatttaaattattcatgaaatgatattccattgattaaaaatacttccctggctcaaataaatcccagaaaaatctaggaactatagaaacaagagaagtatttaacaaaattttatctagcccacttttatattgagatttaacaaattaaaattagatcttctcttttaggcttttaagatcatttctaataattccttttaaacaacaatttataacttaaggatttttaaacaagaaaagcacttaacataattgtaattagatcattaattgattaactaattactgaactattctttgtatcacttaggaattgagctctaaaaaaccgagaaaatttcagagagtataattaatcatggagaatttaataaaaattaaatccagccatgctttatacttaggaaattttattgaccacatttaacttcacttgtaaattaatgaatatttaatataaattctattaataatttattaaataatttataaatcctgaaacggaaaatcaggctgtgacattatggcatcctcaatgtttaatgtaactagagcaattagacgggactcacaatttgatgttcttttgtatatagcatatgctacatgtatatggtattttcttgatcttaagttgggacccattcatgaaaataaaactctattcaatatgaatgaaaagcaccatgcatgttgcaaaaggtatgaactatttttttatttcttctggtctagtcttgagcttaaggttaaggttggacatagcaatatatttcttactaaggttatggttggacatagcagtatatttcttaccttctcttctcccaacgcataaagttaaaacaaaatgactactttatttcttaaggttacgttgcatgcaactttatttcttagccggagatttcgttagcttgtcagataccatccatttagcttgtcagataccatccattcttcgatggtatattacctatttacttgtgcccatgcttctgtgcttgatgactgtcctcatgttaagggattattgattagttcaaaaaagaaaatttttaggtgtcacattggatatatatttgaccggatgtcagaaggggttttcggacacgaatgaaaatactaatttcataactcacctagagaccacgagacgaatcttttgatgagcctaattaagccgtcattagtacatgtgggttaccgtagcacttatggctaatcatggactaattaggctcaaaagatttgtctcacgatttccatgcaaactgtgcaattaatttttatttttatctatatttaatgttccatgcatgtgtctaaaaattcaatgtgatgtttttaaaaaaaaaattgggaaccataccagacctaaagcttggatcactgccatcacgaacatatgatacgagttcgtgcactcaccacgtgaactcacgtgacaacggtgtatatatttctgccaatttattataaacatgtatatttttgtaaaaccggtgaaaaacaagtatattctcgaaaaaaacattgaggccaagcgtgaagaaagtgacagagcttatgaagatgccgtttgttgcttgattaaaccagaaactatacattggggcattcaaaaactcaaattcagcatgatgtgaaatcggtgtagtactaagttgcagcatctatattcatctctaaaagcttgttatccctccatctcaaaatataacaacttttagctctcaggatttgtcctaaaatataacaacttctccaccaacattttctttctaaccaatcacaacactccactgttcacttttcccacctatctctactactcatccgatcacaaccctccaccactcacttctacctacttacttaataatcatgttcaaccctaaaactttttatattctggaaggaagggcgtacattgtttactggagaggcggagtgctaatagtagaacaatgatttcatgtaggcccttggccaatcttgaatattatgtcatatttcttgatataaaatttcaaaaataattaattaatcgcatgttggatagccatagttatgacaaatcacaagctgtagtgtttcatgaaacctcaagttgtagtccacacgagttatgtattttaaattattaaaatcaatataatattcattaattgatgaaaaaaatattaaatgatcatagaattattaaatgatgaggtatattaaatttattcaaaactgagcacaatttggtattgttaattttaaatctcaaaatactaattcttcaaaaaattgattgagactacattccaatgcatttattaattagttattattttttgttattttcaactttaagatttatcacatcatcaaataaacaataatccaatatctaaactatgtaaattttatattaattaatttcgtattttaaattattgaataattccaacttttagaattatcacataatccgaaagctataattgagaatcgagcacaactctatatttcttaattctgaattatttaaattattaaacaacaaaaactgtaattgagagtccaaactgaatacaacgatgtatttattaattctgaatttgaaaacgtaacaatggatttgagagaggactttatatgagtttaccttttttatactagcaatttcatgctatttttatctcacctggttaacattgacgctcctatgagagccactaaatgggtgacctatggagtgacatcatcgaaatcttattatctaaagctggcggttatcgccgcaagctgattggttcgttttacccctatttagttttacgccacgtgtccatgaagcattcggcaaacgatcgagtgtctcgcgcatgtattgttgtcttcatgcggcagaaaacaaaaataacagcagcttctggatgtcgtctcacctcatgtccatgctatgtgggccaaacactcattaatctctcatcccagttctataaaaaaaaatcaatcatcccagctggcctcgccacattggcccgtgcgcctttgctggctgagtcagctatatggctaacctgtgagccgaacccatgcatgtgagtattgtagcataataccaggcttggaataaaaaataaataaataaatcaaaccatattggtctaatatacaattatatgtggcattcaattagtattagttttatagttaataattatataatttgcatgaatattgatgatcaaattttggtgtcaatgctattttaaaagctaacacatcatatatttctcaaaaagacaaagtatggtatagtctgcaacagaataaagaaaaaaatgcacacactttgattgggttataatattcatatattacttaaaaataaaacaacaaataataaaatttgtgtataaaaa

SEQ ID NO: 60030 - DNA, 11893 bp, Oryza sativa
aaatggccataacttggccatttgaactcggaattggaccgttcaagtctctaatttttccttaagaagtcaagaacccattttcgtgtagatgctgcagcttcggaggatccgctcttcgtggaagttgaagccggcgtttgggaaagcgagcaaggcaaggcacatcatccttgaacatattgaatcccagtttataaaattattctgatttgaattattgcattatcgctttatttaaattcccgcgttatcactgttttatttagccatgcctatttatcattgttaagacattattattgctattgttattattaccttgttcaccctaggaaaataaaaccccaactagtgggtactctatttatggttccactagtatgaacttaggtagatgcttcgctggttaattaggcaacattaggtggttttataactttagactttgggaaatctcatatcatttggacattatggaattgttggattatggtggaattggacatacccctctcttcctctttcaaagcccctaaaacctgtttttcggtggggttttggtgcatgccagttgtgggaagtagcaccccgaccaatataaggattaagctcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggtacagggctggtgtcctgctgctaggggctcaatcctgcctacctgtcccggaggttccggccgtaggtggggttgggtcggtactcttgtttatggctaggatgggttgggaactatgtcacgtcttccgtccgtataccgtggtggtatgtggcacgtggttacacgtgaggaagatgtgtcttgtgggtaaagatgtacacctctgatcagagtataatctattcgaatagccgcgcccctcggttatgggcaagccgagcaatgtacccaagttagtgttttaattcttaaaacctgcttaacaactaaaatgtggaatggttggcctgggttggcttgggacgagctgggacccagggtcgagttgccagttcggtctgaatcatcgtaggccttgggttaaggcaggttcgtgtgggtccacggccttgattaataatattgtatagctctaggatcgtgtttacaaaatagctttgggcaactaagtgacttttaaatgctgtttactgcaaaacttaacccctatattattatccccttgtacccccttgcattaattatgcatctccggtgtggcttgctgagtactgtggttgtactcattcttgctcaatcttttccccccccccttcagtaagagaagctttggagaagaagtcttaggtggagtcctagcttataccccagttgagcgcctgtgaagatggagccgtaggcccgctagtccgctgctgtttattttttatggtcaggccttaagtgcctttgtaataatgtaaatattatcgatataataaagatgtgccttttgtatcatgtttgttcggtgtaccccggcttttcctgggacggggattaatacactagcgttcgggaaaaggcaattttcccggtcgcgacaagtctttagtcctggtttgtaacaccaaccgggactaaagttatgatctttagtgatcccggggggcctgacaagccctgactgcatttgaaccgggactaaagatgttctttagtaaccgggactattatggaattcggccgaccgacgaaatatagtttcttcaccagtggtaggactactgcctccaccaaagttgctgatcggtacacaatgactaagggtcatgatcctcatgacagcatccccaagggtactgaaattactgatcctgacccagagaaagccatccccaaagaagaccgacgagattagtgagtctgatatctaagcacaccgcctcgcctttacttctccaagaatcacaagtggttaatttcttcatttttatttttaacgtgtgcagtggttaatttgttatttttttcgatcaacatgtgcaatacacgtatagttgattaattacttgatttgctggaatgcaaaatgtgatgtaacacgtgcattaatggttaatttgttcttatttttttatcaacatgagcaattcacccaccatcgtattttggtttttctaaatactaattttgtcatatttgtattttccatgtatccaaaacataaatgaagagtaaattaaatgtttgatcgaattcaaggatcatcttaatacttattggttcaatgaatgcgtacgtaggcaacactttacactcggccttctccgtatatactttcttgcataatttgcatatatgtctatcaggtgtagtgccacccttatccaaaaaaaaaaaaccaaatcggctagggtttcaactgcaagacaatgagaggcggcgaggtagtggttaacggcgagaggcggcacagtgcggcaaggttcgtgacaattggtggcacaatgcggcttacacgctcgggatccccatggcttctccaagtggatgcaagggggtatatcaaatatttgtgaaatgttgtgatgcggatgaagccaagtgcataaaaattgcctacatagcactccatgttgacggtcagccataatcaaaagacgattgaatcgagggtggtagttggtacaataaataaagtgtaccgagctaagtgatattatcacacaagtttaaggttcggccttatatttcactagtttttttttttgaaaaatgttgctatattcttatataaatttgatcaaactcaaaaaaagaaagttgtcttgaaaaatttaaaaatatcttatagtatgacggggagagacaatatcttagtttgatgggttataaccccagaaatgaagactttattcaacaaatatttttggaacgctagaggacggagtatgtcacaatctcggtgcccgcagggtctttgagactcttgcctcggactggtaatgcttcccaaatcaattcgctgtcagcccacataggagatacgacttagactccgtaccggctacagcccgtgcagccacggcctcatcgcagcgattccgcttcctcttcttgcttgccgtcttcctgacgtggcaaagtacccagtagtcgtcgtcgtcttcctcctcgtcggcgcgccggtacgtaccgggttccgtgatctcgtactccgccaagacccaccctcccccgaaggtgctcagccggccgccctcgtcgcgccggtagaagcagtagcacgtcttgctccacggcacgacgacgccgaggtcggtcaccgacttgccggacccggtccagctcttcttccacagcccgcccgcaccgccaccgcctccgcctccctcggcgacggtccgccgcacgttcggccggcggcagcgcctccgccgcacgaagtagaacgcctcgccgcggcgcctgtcggcggcgcccccgtgccgcgcgacgaggtccagcggcgccgcggcggcggggtcgtccctgacgccgatgacggggacgtcgccgtcggcgcagtggaagccgcggagacgcgggcggaggtggcgcaggacgagctcgcccaccgtcggcgtgtcctggaaacctgtcgcgcgcagattatcggacgcctcgctggcgtcgtccgggggatcgacaaccattccgtcttcttctacttcctccttgaccttgctgggtctccagcagatggttgttggttgcgttgccgcggagcttggggatgcgcgggagtggtcagctgcagcagcgcagatcgccatggcgcgaaggcgaaaagagcgcgcgcggcgtgtgcgtggcgtccgtgtccgtggcggcggcgatttttatgaagcgaatcatctggtttgttgtggcccacgatggatgcaggacaccgaactgaaattggtttcagttgtaaacctgatacgaaacggagtttgaagtggagtcctgttacagtgtgagtaatccggtttagagtttagaccatatgtatcaggtgctgcggcctgcgaaaccagaggtgggctcgggtcggaggcgacatgggccacggcccagtacatagagatggagaatgggagacgaaagggacgaaatggtccatttgcgaccctcaaccatgggctgattttgattcgcatttctcgaatttttttatttatacattttttattaaaatatttacgaaaataatttttttttaatctagtcacctctcgccctttccagagagcgataagggatctaaatgcaaattttccagcacagcttgttagctctataattttataatttaaaattacattatataaagtaaaataaaataaaactttatatcaaaattgtagagcttgaggagatctacaacaacaacttttacatttaagatcttttagatatccaaatatttgttacaaaatataaaacctatttaaaaaaatttcagatctacattttaaacgatatcggatggagataaactttatataaaagttgtagatctcgatgatatctgcaactttatagtttatcacttttccagttaaaatcaattgaagtgtcgaataagcattattagtatttaagcattaaaactggtggaaagggtttgaacacaaataaaaaaaatttgcatttaggtccctatcaccctttggaagggcgatttttaaaaaacgcctttccagagaggcgactagatttgtaaattttcaaaacaaaaaattattttgtaaatattttaataaaaaaatgtaaaaataaaaaaaatcggatttctctattgactatcacaactgttataaccggatcattagtcctccctcactggttagcaaggtgcttttgaccgatataggacctgcatagtattacagtcagcacagcacatgacaatgctttaagctgatatgacatctatgtggcattatcagagaaaaaaacatcaataagatccacatcagtcaacctcatcttcttcctccaactcttcatgtccttcatgctctctctcctacaccctctacggcaaccctacatagcaatactagcaaggaagaagacaagacatgcagcggcctcaaacggtacggtgatgacctaggcagtagcagcagccaataaggatgatgcatggttacagggaaaggagcgattgtgttgatttggtgggcgactgcatcaatgacttcaccagatcgacagtgagctctagcgcgttctccggtggccaccacctccgtgtgattctctagcaagatgacgagatggtgtgctcaagcctctacctctccattgctcgtggccaccacctcatcgcccttcccgttgcctcctcatgaccagtggtcgagctcgacgagagccctattcatgtgcctccttccttccttccttccctcgcacttgccatcttgtgttgtgaccaaggggcgtcctcacctcaccgtttgtgtccctcatcatggaccttcgccgctgccatgtcactgttattgacttgtgctacacctaggatggcatcgccacctcaccgctactaccaccgtcctcaccaacgagtggaggacggcaatacaggggaactgaaggagtagcatgggcgtgctgaggagtgagccgaaacggaagggtgccacggccttcggctacacaacatgctgctccacgccttcccggtctggctcctccatgatgtcgatctagccattcatggcacctgagctcaccggttggcggttgctcgaagaggtcaagctgttcggatttggatgggccacaccaggagccgcttctcatcctcctctcttccttcccaagcgtaagagccacatagccgctggccttatcgagagcatgggtgtcaatgttgaatcggcctccttggtccccaattgtcggctcaatctgctgccccggtggcagcaactgcagaagtctctgttgtccggttaggctccaccatacgctatactactgccactacaggttagagagggaagagaggactgatgattgtggtagagaaagtgggtcactttactttttattttagagaagactgatgattgtggtagagaaagtgggtcactttactttttatttttcttatttgactgatatatgggtcccacataattttttatttgtatgataaaaaatatcactgatatgtatgtcttattttgttttataattgtcatataaaacaaaaccatcgttaaatcgttcgggaagataaaataaaccgtttcactagttggaagtgcctttatattctaagggtgtgtttagttcacgaaaagaaaattttgaggtgtcacatcggacgtttgatcggatctcggaaaaaactaatttcataactcgcatggaaaccgcgagacgaatttattaagcctaattaatccgttattagcacatgtgggttactgtaacacttatagctaatcatggactaattaggctcaaaagattcgtctcgcgatttccatgcaaaatgtacaattagtttttttctttatctatatttaatactccatgcatgtgtcaaaaattcgatgtgatgttttttgggctaatttgtttagaaattaaacaagtcctaagttctatggttgaagttaagggttgcaaatcagatacgcgtggatgggcgacgagtgtggcgatgcggtgacagcccacgccccacagcctcagcagccggtggcctgacctcaccaccaaccggcggcctatgcgcggggagcgagcgtgacgatcgatcgagaggtgatccacaacaagtgtccacaacacatcgtacgcttgccgacactactactactaaataatcaatcatgtgtacatcagtgctccgtcctacgtacgcgatcgatcgagttagtagctagtgcgagtgcgacacgtacgtgcatggacgacgcgcccgaaactaaggcgaaagctcgaaaagcatatcaatcacactccagcatgcattcatctaattaaaccgtaccatgcattaagcgtacagctagcttcaaccacaagtcatgcctagcttagcctcgtggctgctgggccaacacacaagtacacacaaccaccgtccgagatcgaccatactgattcactgctttggcttaatttggtccacacgacacgaacaacatcatcattatatattggagtttattcttttggattcgtgtaccggtgcgtgcactgcactggtctagctcgcaggctatctaccaattaaactttggcccgatgacgtacagctggatggctagctgttaggtgttcgactccggtactgtactagtgtgttaggaacaaacggttcgatcgatcgctttgtcgaccagaccaccatctggcgcctgcagcacagtcagcagcaacaagccgattaatggcaccgcccttggctatgttgctggtttgatggattttttacacatgcgtagccacaggcccacatgggcgagacaagtacgttacacgtggacgcgaaagcgacgcaggtgcaaacatgagcaaattaaagcatgctaatgtatatttttgttcgatggtatcagtaaggtcaattcttgtcattgttcacggctttgagtttaggccgtatcgaaagtaaaagaaattagtggtaggctgcaaagataaataaaaaaacatggtaattaagccagaggccgcggcaacaacaacgaaagaggccagacaatcagccaccttacaggttataagttcaaatagagacaataaattgatcaaagatttacccaaaaatgtcttaataatctgcttgaacagagctccgtcgaggatgcgatccatagcttgtgatgtaattgctcgtttcaggtatcaatctatattttcccaaaatacttgtagctttgagtttttatttgtaacgtttgatcatttgtcttatttaaaacattatgaaaatattatttattttgtttgtaacttgctttattattaaaagtactctaagtataactcctattttctatatatgtattaatttttccaataaggcgaatggtcaaacgttgcaagcaaaaagtcaaagcggctactaatatagagcggaggtagtagttgatacctacttacttctaaatctcaatatgcaaatatgtcacatcatcacccattagtaattattatctaaagtattttaaatcacaatgcaagtgtaccacatcatcacctactagcaattattatctagattatttaaatctcatgcaaacgtgacataagattatcattttattgtatatttagaaatcaatatgtaagtaatgtttactcatcatttcatattatttaaacatatacctattttctataatgtaatatatattcattcacatattctgtagcaaagcgcggggtatgaactagttcttgccataccgagttgcgccactctctccaagcttttcagtttgcttttaatatatattaaatgccgggcctttcttgcaatttaagcataaagaaaagttaactttcttttttgacaaatggtccaaccatgcatattcgtgattcgtcccacctaattgatgaaattactatatgcttactatatgctttttaatatacgactagtgttgacttttaccattcgtcttatttagaattcttatgtaaacataaaaaatataaatcatgcttaaaaaacctttaatgctataaaccaataaagaataatcctcaaggttcaaaatctgcggaaatcataagctccgaccgaagccattattggagattaaggaaatttgtgatcgttcgctcctaaggtaaagccataaggacatgtacagacgcaaatcagattgggtgttggagatttttatgggtaaggagttaaaggacaaatggacatcaaaatatatagttgctacatgtcttatatttgttgttgtatcgtttgtgtctagggttagacgcatggacaagcctgcttagtcgctgtcctatacaagggctggatcttgtttgtttgattgctgccccgagagatctttccactcgcctggcctaagagaacttgcctgtggtttggttgcagtaaattaattgtcagctaatggaaccactaaaatatttttcccttaacccgaattgttttatgactactgatttttttctcaggcacgtttagccttagttcttcgagaaaacagaaaccaaatgggcaagcctcatcagattttagcaccactttttctcagtcacacacttcaaactcatcatacttaagtgtgccacatctcatatatgataagtttggtccccatcggttggctttttccctaataagccaaaacggcttattagggaataaaaataaatttgtaggtaaaatttttatatatgtgttcttatgacttaaaagccaatggtgaaaaagaaactatgttgaaaatatctcaaaattaagttagaaaatttaaattttggctttttctttggctgattattttttataagacggggagaatatataactagcgtactatagctatagatggccatatggcccgcagcccgacagcccggcccaaggcacgggcgtttggcccgacccaagcacagcccggcccgtcagtgttcgtacccatgccggcctggcccgacagccgggccatgcctgggctcccgcagcagcacgctgggccggcacggcacgaccgggctagcacggcccaggcctatataacggtaggcacggcccgacgaggcccatcgggagccgctgccgcgcactcgcacctcatatataaaggccgctgcgtcctcttgcctccgccagtcgtctccctcacaaccctaaccctaaccctagccgcctccgccgatccacgcacgcctccccctccgcctccgccaccatcttgaccgctccgcctccgcttctgcctccgtcgatccacgcctccacctccacgcgaccacgcctccatctcgtcgccgtctctgatgaacgcctcgccggatctaccatcgagggtcgccgcctcgccggatccgtgaccttgtctcatctcctcctctccagtcttcggatcgtcggccgtgctctcgatttcctctttctttctcatttttttgccactctcgcccgctcgctgtttctccatgagctctttgtcagatcactccccaaacccagtctctgctctcttcttctcgtagatccgtcgatctctatcatcaacggcaactccggtgctccggatgcgcaggtacaccgtacacacctatctctgctcctctcccctctcttggttttctacttctctctggtccctaactgctctcttctcccattttgtgtgtcttgcaggtcgctgagcggtagccgccgttgaggaaccggagtgccgacgatggacgatccatcctcttgcaaccacgagttgaggttgatggggatacggggtgatgacgaagatgacttggaggaggaacgcgtgcaggtgttcggaatcacttcatcacctcctcacttcgatgggtcacagccggagacggagccggacgtggacggtactggtggcagggacggtgatggtggcacaggcgcgccgtccggcaccgactccagtgctaccaacaagcggccaagatcatccaaggtgtcacaccccgaagttctcctcccaagcctaaatttaatttataaatgaccccaagaaaatacaggtgcaaagcaagagtaaacccttttaaatcaatgcaaataataatcggaattggcatgtggaatttttcttgagttctacatgtcgaaattcactaacaggatttttagtggaattttcagagccctagaaataattttaaccaattaaaattgagcaagcaatattttttaattccagggaaaatcctttttcctttttctttttctttttcctttctttttcctccttttttcgaatgggccgccggcccattctctctttcctcccctcctccttgctgggccggccgcaggccgaggcccagccaggccggccgcctccctcctctgtccggggtcgccgacaggtggggcccacctgtcgggtccttcccccacctccagccgacgccgcgcccgcgatcgccgcgcccgcaaccgccgccgcgtccacgccccgcctcctccggtccacgtcggccacgtccgcgcgtgcgccgcgtctcccgcgcccactcctctctctcccccgctcgcgcctgcgcccgagatggccgggattcgattttcgaatcccgcctctctctcctcccccactctccacgttggccggcgaaatctcgcctctcccggccacgtccgactccccctctccctatttaagctccgacgccaccccctctctctttttccccatttcgccgaactctcccgagcctcccatcgctcccgcgccgtgcaaccacctgccgccgccgtttccgctactccggccgccgctagccgccgctagggtcgccgccgcgccgcgccgtcgccgccgtcgggttcgcgaggctaaactctaccccggccgctccttccccgtcgagtttcgtcgccagaattcgcaccccctcgcgctccggtgagttcaaccgctaccgccgccttcggccatgaatgccggtcgccgtggttcatctccctctctctaatctctctctcttccttccttagggcaccccgaaacccgtccgccggttgccgtcgtcctcccgtggc

SEQ ID NO: 60031 - DNA, 24306 bp, Oryza sativa
ccgacgaacgccgacgacgccgacgccgacgtacgccgccgggccgctacgttacaccgccgccacggcacgccgccgccgcgcccccacgccgcgagacgccgccgccgccgcgagacgacgctgccgctgccacaccgctgctgcgccctcacgccaccgggcccccatgccgcggccgtacgtggcccgccgccgccccgcccctacgccgccaggcccccacgccgccggaccgcgcccccaccgccacgagacgccgccgccgctgccacgccgccgccgcgcccccacgccgctgcgcccccacgccgccgggccggcccacggcgccggaccgcgcccccaccgccgcgaacgaacgcttaacgaacgtgaccaaacgtgaacgaacgcgaacgaacgtgaacgaacgcgaacgaaacgttaaagaaacgtgaatgaacgcgaacgaaacgtgaacgaacgtgaacgaacgtgaacaaacgtgactgaaacgtgaacgaacgtgagtgttagtgaacgaacgcgaatgaaggtgaatgaacgcgaacgaacgcttaacgaacgcgaacgaacgtgaacgaacgcgaacgaaacgttaaagaaacgtgaacgaacgcgaacgaacgtgaacgaacgcgaacgaacgtgaacgaacgcgaacgaacgtgaacgaacgcgaacgaacgtgagtgttagtgaacgaacgcgaacgaacgtgaatgaaatgcgaacgaacgtgattgaaacgttaacgaacgtgaatgcacttgaactaaaagtgtgagaacgaacgcgagcgaaacgtgtacgaacgagataattaaactattgttgaacttagcatatatatatgattatatatacttgaaaacgtgaaatacattatatgttcctttgcatttagactaatacatttttttgcatgttgcagagaagacgtcgtcgtcgtcgtccctcaagccgaagtggtagctagccctcgaaggaattcgcgcaggcaagtgatgtaaagatgtgatagttagagatataatataagattgttagatttctaatataagattattagattattagagttagcatatgtgagtgttagaaattattagattattagacttagcatatttgagtgttagagatagttagagatttaatataagattattagaggtttaatatacgaaacttaattagacttagcatatgtgagtgttagagatttaatataagattattagagatgtaatatttgaaacatatttgattgttagagatttaatataagattattagagatgtaatattcgaaacttaattagacttagcatatatgattatctaccgtacaaatacacgacacttagacttagcatatttgagtgttagagatagttagagatttaatataaaattattagaggtttaatatacgaaacttaattagacttagcatatgtgagtgttagagatttaatataagattattagagatgtaatattcgaaacatatttgattgttagagatttaatataagattattagagatgtaatattcgaaacctaattagacttagcacatataagattatctaccgtacaaatacatgacacttagacttagcatatatgattatttgagttttaatacaagattagtagtgttaatatcacgcttagcaaatatttctgctatgaacagatggctgatcgcgatgaggaacagatactatacgatacaatcgcattgggaagcagccagtactggaacaaagaagaggggaacgaggatccaaaccagtacttgaacgaggaggggaacgcggagagggatgcagaggggaacgaggaggggaacgtggagagggatgcggaggggaacgaggaggaggctagtggaagtcatccctccgctggatagaagagggcacgcggacaatgaggtgccgcgaagaagatagagggtcggcacatcattactgaggtggacgcagacggccgacctagtgccccggcacaagcagccaagaattttgtacgccacagcggttgggttgtgagggataacgtgcctgtcagcaaggtgtactggcgcagaacaagggcacgcgggggtgatgacagctttgtcccggagtcagagaaagagatgctgtggaccacaatgctcgagacgttcacgctccctgcgggtacagagaacatagtgaaacagtggactcttaagaaaatggcagaacagttccagaccttcaagggagatctgtaccggaaatacatcctgaaggggcagacaccgaacttcgacatattcccgaagctaagggatcactgggacgagttcattgcttacaagacaggtcaacaagggcaggcgatgatggaaagaaataaagaaaatgccgccaagaagaagtaccatcaccacttggggtcaggtggctatagcgtcgcgatgccgaagtgggaggagatggaggcaagcttgcttgagaggggtatcgaaccggccaccgctaaatggcctgatcgatcgaagttctggtactatgctcacggtggaatgctcaacccagttgatggctccttggtcttcagcgatcagatacgcgaggctgcgaatcgactaacggacgcagtggaagcctcttctcagggcacgttccgacccgacagagagaaggacgagctgtcactcgccctacagactcccgagcatccaggacaaacacgagggaaaggcgtgattccctggaagatgggattcaaggaggacatccacacgtacaggagtcggatgaggagcaagagagataccgaggcgaagattgcagatcttgagtacagggtatcgagctacgagctcagcatacaagaggaggtggcccggaaggtggatgaacgcatggcagcacatcggtcacacgatccccagccgtacatacctcctccaatggtcagcccatcaggcaatcgtagcagctgcgcctcaacggggcaggtagtatcacatagcatggacgccatgcaaacccaggacgaaaccacctaccccgttgatgagatcacgcaacggacaccatgtgagctgcatattcccttcaagaacttatcaatcaaggtatgctcgatgtaatatatgatttttgactcgtacgttccgcaagttgctgcttaggttgattactaatagataacctctcatcacgtgaaggtggcgtagggaatggccatcccaacggacatttcagggacttaccactgcaggccgattccagcaggatactcgagggtcgaagttgagctggtggaagccgtgtacgaggacatcgagttggactacccaggaggagacggtgagacgcatctacgagacacaagccacgccattatattatggcgcaagcggtacatcatcgtccctgggcgacaagcggcgtctcgtgcaccatctcctccggctccgccgtctcctcctgcaccatctcctccggctcctccgccacctcctcctgcactatctcctccggctcctccgccacctcctcctgcaccatctcctccggctcctctgccacctcctcctgcaccatctcctccagctcctccgcctcctccgcctcctcctccaccgtgtccgcctgcacctcccaagacaaggtctcgccaagctccacctcctgctagcacaagggcaacgaagaaggccaaagttgacaccaccaaaaacaaggagccgccgtacggttgtagtcaagaggagcttgacgcttatgtggcaggagaagtgaagaggcaactcaagcctcagagtcctaaaaagaagatacctattaacccgagcgtgaagaatttcttcaagggaatgtccaccgcaaacaaggaggccttaaagctatcggactatgaccgaacacttaggaaagcctattacaagaagtccaaaccagttcctcagcttggagaacaaccacaccaagtggtcgagccgttggtgaccggcgaagactttggcataacggatttcatttcggacatcggtctaaccatggctcagttggttggaggcgcaccaatcccgaaggcggaagtggcatacaagtttgaactcggtaaaccgcttgtcaggcctgagcagctgcagtccctaccaacacaaatgtacaaattccatgaacggtacatggaaatgagcgccaatggtagagagatgttcggagcgaggatcagaaaccccgacttcttgcaaggagaagatgttctatggatccatttcaaggatgtttttgatctgtaccatcgggacgccctcgacgtctctcttctgagcgcatggattttgtaagtatctttgagttcgatttgtttcgttcaataattagctcctggcatatatgtaagcaataataatttccattcattgttgtagaatggagattcaaagggcccgacggcggggggtttacgatactgggttcatcgaccctcggaaaatcaacaccgaaatgctcgacaagtacgagaaagacacagaggacaatctcgtccatctcctaacgcagcagcatttcaagacgttcatactattgccgtacaacacagagtgagtttttattgtcgttcgaacaaatttcattcccatacatataacatgtacattctgatatttatctcatctcatgcatattccagattccactgggtcctgttctttttcgacttggacgcatgcagagtcactgtgtacgactcaatgaataaagaggagaaggtttttgacaaggtcttccaactgatagacaggtaatataatgccatctattccaaagtcgcgggactctgttgctattatgttgatctcgggtaatatttaattaatcatagcttgcaactgcacatgtagggcttgggatcggttccgtcaattggtccgcgggacttggaaagaaaaacttggacggaggtttcattttccagtgagtacatgcatgatccaaaattatattgaattgaatctctagttacagttaatataaagagtatattaaatctctcatcgtttctcatgtagtgtgcaaagcaggacaagggaactaacttatgcggctactacgtatgcgagtatgcccactgcctatcaaatcaaatatacaccaaacgagagctcgatgtacgtatacataaaccattcaaaatttcattgcgtatcgatttgttaagttgtttattaatttcatatattgatatgtcattatttttcgaatgatagcgtattcacatgagggaaaaactcccacacaaggattttatcacggctgttcaagaacaactgatggggttcatcaacgaagaagtccttaatcccgatggtgaattctactacgacggatcgacaattcgtaacgtcggtccttcctcttctgacgtaacgcaggcatcgaagtcgtagctatagctagcgagcaaatgaattgtactatacatgcatgtatatatatatatatatatatatatatatatatatatatttatatttatatatgtacgtacatttagtgttaatatatattttggtaacatatacgtacataaaatgttaagtgctttaaattataaatatgtgtgatatatatatatatatatatatatataaaatcaaccatgcagcaaacagggccatgcaaataaaaaaaaatggtacatagatctttagtcccggttggtaacaccaaccgggactaaagatggatcagccggccacgtggctgaccgatctttagtcccggttcgtgttaccaacccggttatttcacccgggattaaagatcgctatctttagtcccggattcgtagtcccggttggacaaccgggactaaagggggttacgaaccgggactacaaacgatttctccaccagtgttatcattaattaacatgataattaagcacgtaaaattatgaagtaaattgaacaacaataacaaaacaaagttctaatctaaactttggactaaatagatcgttgcaaatgagaagatgagaagatctcaagaccttatcctaaaccctagcgacaatgcggtaaggagtggccgcatgagagttggcaacggcggcaatggcataggtcctagccggtcgcacaaccggcataggccgttgagccagccttgctaattgtgcatcagaacgatttgcatgcagctactatagaacatgtgcgtggccgacctacatactacgatggaagtcgaaaggttcatctacaagccgacggtatgtcgggagcgatccatttgaagtttggcacattattctttcaattaggtaaactactagaaaaaaacacgcgacgttgccgcgtgcaacactcgatgggccacactatttggccgtattgagacagaatgatcagtttaacaacaatgcaagttgtagcaaaatactatattgcacaatcatgattactacagcagagtattaaattttaaaaattaatctatggcatataatgtgatatagactgtataatctgaacaaaacacaatagttatcctatatacttatatagttcatctccactaagtgtagttaatgctatttctctcttctcattaacccacatcaccctaattatttctagcctttggatgatagatctatggtctaaattgtttcttctttcttctctcttaaaaacatgcaatctcaattacttttaggctcaaaattgtatcaaattgtttttagttttgtacatattatgcaacttaattttccgcagcaacgccgcggggtatgagtatgtgacatattatagacatttgatctggaacttaaataatggaagattttaataaagctccctatcaattttgtattagagtaactggaaagtagatgagtgtaggttcttggtgagtgctaaatacatcaaaaataaattggctggtagatgagaggataacaaaagtatccagcttgggctataaatagcaaaagtcagtgttttcttcttcattattttcccaaaaaaaacaataattagaatccttgtcaaagtatgttactgaggaaccagcaattctttctcatgcaatacttaacacaatgcagtagctaggttgggcaagtatgaggtttctatgtagtgtcaggtatatatgtgaatactacatgtaaacagggtatctggtaggtaaccgtgaaattgaagcagccatataaggtaatacacttgcttgaaatggtgccaagcttatgcacagtacagtagtaggttaattatatgattgaaaaacaaatgattttaaatatgagcaattgtttacctgatcattactgttcggatcttcataagctcttttgcctgacaaactgcttgtctctaaattacatggctcagcttccatgctctgaatatcttggggtggttctcactaaattaagtgtgtcaatttttcactatagtggcagaacagagaaatttaaccaccagataatcacaggaataaatattcgaggaattaaattaagttaaccaactgaaagtctgaaacttcttatgcatgggtagtctcctagtcaatacaagccccaaagctggagctaagcaaagacttaacaaataaaattcaaatgttataattaatcattggcgaaattgtcaaacaaaaacagaaaacctcatgatattggaacttggtagagtaggagtagtaccagcatcactaaacaaaatatattctacaagggttctatcttcttaatgaagatggtcctcattatgcgtttacaataacaaagggacagtaaaacttctttccgaatgcttccattcccaataacttatactataacaaatagtctaatatatatcagtgaagtaacagatctagctggtttttttttaagaatgaaaaatctgcaatatttatatcactaatacatgtgattgccattcactgaactcgcgaacgtcgtcctcgcggtgcaggacgtgctcgccgtagagataccggccgaaggccaccgcctcctcctcgtggtgttgtctctgtgcaggacatgcttgccgcagaggtaccggccggaggtcgctacctctttctcccggtggatcagacaagatggagaatgaatgtgaaacaatgacaagagaaaagaggaacgattatagaagatgaagagtgaatcaagattatagaagaccaagagtcgtgacccttccggaaatatcaggtggctttgcactttttgattttactccaacgtaagattgttttttatattttagtccttctcaagtgtgggagcgcacgcacgaaccacgctgtgccacgtggcatcgctaattgctcgataatttgcacggatttcgatagtaagagattggttggtagcgatggggtatcggctggtatcaatgaatatcaactgggtatcgcctgttaccgatggatatcaacatggttccaacgaggcattgtctaatactaataaaaaatatcccttgatcctctgcccatgtaaaaaagtacttttcagaaaactacaactttggtaacaaaattatcagtgcaacaatagcatggaaaattatcacaaaactgtaatttttacgttatatcttgctacagttgtcacctatatatactgtagcagtatataacgtaaaaattacaattttgtggtaattttacacgctattgttgcagcaatctgaaacatgtcgctaatattacagcaaactgatagttttgttagtaaagttgtagttttctaaaatttactcttattaaaatatagtaatttctccatctaattctcatcttaacagctcaactaattacaatcatatttttttaatgaaattttttatccacgtcttttctcatacaaccccccatacacacacacaaacacacacacacacacacatatatatatatatatatatatattctatttaatttcacctaactccttaattactgtgcaaaactatttttaaaatccctctcacaaagacggagggggagtggggtagttgctactcacctgtcttgctgatccctctcaaaaacctcagttcgatcttctctgtcggtgcttgaatgacgcgtaaagatgggatttctaagtactccatccgtccttaagaaaaacttagtataacgaatttatacgaagggtagttcagaggaagtatgctgacttgattactgcgtgcattggcacttcaacgagacataattgatgagctgactatacgtggagctgcatgcatgaacatgtagcaggggagtcctctctccgtcccataaaaaatattaatctagtactagatgtaacatattttagtactataaatttgaatatatctatttaaattcgttgtgttagaatatatcacattcagtgtttaatttattttttatgagacgggaagagtatgttgctaagagcaggtacaatagtaggctataagccagctgcaaacataatttaagaagataaataaggagagagaagagcagcggactacagatttatagccagctgtagcacagactccaagatgcagtgtatgtatgacaggtggaaccaagtattaatagtgtagtatataactattgtatagataagctatcatattagttatagataaattagagctagtagttggctatactattaaacttgctctaacgctagctactcagctccacgagggaaacgtgcactagctagctgccatgatgtactaggtacgttgtactagtgtaccacagattcagtcataggtaaggagtagtaggagcactattgagcagaggcaattaaagaggtactagaggaacgtactagaacgaacgtgtggctgactagttgaactgatcctgatcgaggcacccactcggccactcggcccctcctcacgtggacatgcactactttgctatttttaagcactccctgcgggatatttaacactgttattaactttaaaaatatttaaccatacatcttatttttgaaaataatatgaatatataaaaaaatataaattataacaaaataaaattacgtaattttctgaataagacgaatggttgaatttcactctgtttgttacttcgggtgcgtccgaatcggcttccctaagataatttttagcgagacgtaaaatgagataagctattagcacgtagttaattgattattaattactataaacttgaaatttgagtttatttttttaaatctatataaaatgtattaaaaataccgtttagtaatttaggaaacgttctcatggtttaatgaaggagtagtttttttaacttacgaaggagtagtttagctgagttgtagaatcaaatgaaggtgagtccatttcatatttagaatattgtagatgtaacctaagttaatttcttaaagtttgactaaatctattaaaaaacagcaatattttacacacaaaataaatatactatacaaatagattcaatgatggatttaataaaactaatttggtattgctaatgctatttttttacaaacttatcaattttaaagaaattgtcagttttaattatctacagttaaatagagaacacgttcataataagtactaattaacaagcacaacggcacaagcatgaagaaattgcaaaccgctcggtattttttgagcatttaacaagatttaaacttgaacactgatacagatgtacgtactccactcccacgtttatcaccagctggctcgtatatagtattgggtttgttcatatgtggcggtgggatcgagattatctaacttgagttattaacatatcggttatcaacccagtgaatttatatgttagtgacttaaagttaacgagaagcaagtaatataaccgatatctcctatgacggtaagtacatggtatttcctccgtattttaatgtatgatatcgttgatttttttaccaacgttttactattcatcttattaaaaaaaattaataaaatgagtgatcgttaaaatatcaatagctgtcatacattaaaatacggggaagtacgtacaattagaaaaatgattaaccaattgggagcacgactacgcgctgtcgatctctatatataggagccactgcccacggagagtggccggaacatatacagacgtccctcgtctcttcacctccggcggccgccttacacccggccaccagcttgttcgtcgccggcgagctagcttcctcctctccgggctccggcgtctccgccggccggctggcctgttcgtcgtagtatatatatcgtcgtcgtctccgtcgacgacaaaactgtgtagtgccactgatcgcgacccggccggcattattgaggctgaggcaacgatcgacctgacacaagaagaaagaagatggtgaacacgacggcgggcgtgaagtgcggcggcggcggggcggcgctgccgctgtcgacgctgaaccacgtctccctggtgtgccggtcgctgtccacctcgctcaccttctaccgcgacttcctcggcttcgtctccgtccgccgcccgggctccttcgacttcgacggcgcatggtatatactccatccgtttcaggttataatacgtttaactaaattactttaaatttaactaaatttatagataaatataataatatttacatcactagattagttttattaaattaatagttagatatatttttataataaatttatcttggataaaaaatattatttgacttttagcaaggtcaaaacatcttgtaacctgaaacggagggagtatatatatacgcccggagggagtatatatatacgcccatccatgccaatgtgtacactaaattttgttcttggcgatggccggcatttcgacgatttgattgctgcatgaattgaaagtctgaaactgcaatgtttcatttgatgattcaggctgttcaactacggcatcggcatccacctgctgcaggcagaggacccggagagcatgccacccaataaggagatcaaccccaaggataaccacatctcattcacggtaacaaccgttgattatatatacaacttacatacagaatcaacctcaagagaatgagatgcaaagtgatagtaaagtaaaaagagagatgagaaaaaatgacaagagtgggatacctgatcgatgcatgcatgagggcaactacgacgttgacattataatataggagcgacttgtatgccatattaattgtcagatactcagatatatatattcaagatccactatatactgataaatagagataatgtgtaggagtagttgccctgccctagaatacatattcttggttctgatagaagtggattaagcatctattgaatgaagcaacatagcacatgcatgctccctcagatctggggattgatgatgatcatcctcacaagattaattgagaaccaagagaaactaatttcaaatagtgtcggctaaccactagcacattattattccaaactcagtaggtgcagttggctagttgttaattaatttctgcatcaagattatatatatttcagctcccagtcagtttagcagattatatatattccagctcccagtcagtttagcacaactaacaattgatgttcatataataccacaacattgcaattaccgctaccatgactcgtggatacattctttaatttggagatatgaattgaaatcggtcgaaatgatatataacgtgtaatcgtctatactcctttaaaagataccagtggtaaaacagtgaatatgttactaccacagtgccaccccaccactccttaagcagtttttataaatcatctcttggtattttctgatattatggaatagtccatttgattcaaatgagtgaataccatatattttaataaaaaaacaagtaaaaaaatatattttgtgtaaaacatatcataatatattttcttttacacctagcaaaacacgagcatttttactagtacgcataaaaatatgaatgtgtggcatggcagtgcgagagcatggaggcggtgcagcggcggctgaaggagatgggcgtccggtacgtgcagcggcgggtggaggaaggcggcgtgtacgtggaccagatcttcttccacgaccccgacggcttcatgatcgagatctgcacctgcgacaagctccccgtcgtccccctcgacgccgccgccgcccactccatcttcgccggccgctcgccgccgccgcccgtcgcctgcaagatcaggcccgtcaagcagccgtcggcgacgaagctgggcagcgtcgccgccggcggctgtgttggggaggtcatcgtcgtcgacgcgatcaacggcgccgccgccgccggcggcggcggcgcgatgagctgaggagacttgtggcattgctgatccaacgaggaatcattgatttgatgaattgttgttcaactttaattttggtcgtgatgatgattaaggtgtatgtaattcgatccggtgattaatttgtctctcgctgcccaataatatttgcgtaaattaattaattacctgtggtcgtcactagctaattcatcaacgtacgttgagtgaccagagattagcaggacaaactgaaactagcgcgcgtacgtaatatttgattccctccgttcaaaaatatatgacgtattttttaccagtctaaaaacacaaaactttgaccgtaaatttcttttgtactatttcgtctatggttacaaatcatgaatccaccaatatttttttaggtaaaaatctaaatattattaaattaatagcttgtcaaagcttaaaattgggcggtcgaaatacatgcatcttatataaggacggagagagtatacgagtacgcagcagctctgctagcaattactgtctttgaattcattcacgagatgtaatgtttcctttgctgctttgcacacgtagtaggccgcactgagtgagcaagataagataagataagaaaattcctcatttttgcgtgcgcttcgcgaggtgcaaagctatgtgttttctaagaaaaaattgtagaaaagttacataaaaaatatattaatctattttttaaatttaaagtaattaatatttaattaatcatgtgctagtggctcatcttactttgcatgcatatacatatcttcttcaatttcctatcctcaagtacagctgtagtatgtgttatatgcgtggtatttatacattgttcttgtaataatcagtgctgtcagcacattgtattacgttgttgaattcacagacaagtagcacctggagatcagttgcgttcaaaatgtgtaaatccagtaatatattgtgcaatgaagttagcagaaatgacatgcatgcacgcatcactaacatgccacagaactgataaaatttactattgggatggaggcatgtgacaagctaatataataggaacagtaccacgcatgatccacactgctcatgctccaccattcttaatttcaggttgacgatatattggtatgcatgtgatcggatgacagcttgtacgtagtattagtcatgttgcttcaggcagataacaaatgtattttaattcgattggtcaaagccgaatttaaaatttcccagcccaaccagcctgaccgaggtttttaattttgggcttcccaaaaaagaagtgaagattggagccgacgcgctgtacactttacacgagggaaaagtgcaatttgcatttcttaattattaatggtggagctataaatttacgtccctcaaccgtaaacgggatatatatagcctcctccaattcttttttttttcttttttttacgaacggccggtcagaattgactggcgttatattgatagaaggagaaaaagtacagatagccaaagggctaagaaagagaaaaactgtacatgacaacatgcaaacaagcttgcacgtagccttcctagctcctcatggcaacattctcccaatgtgtttagcgctggtcatacttcaccaacctaattcctcttggatgcgactaatcatctggtgtgctgtcgcctcctttgctctgaagattcttgcatttcgttccttccagatttcccgagcaatgagcaagaagagagttctgagtcctttctattttgttgcttccgggtcgcttgttccttgtgtccaccaatttaagaggtttctacttatgttccatttcgggatgatgtgcccttggtgtagccatgtgagaatcccaaaccagatttgctttgagaccggcattcaaacagaagatggtcgattgtttcgagatttcgaaagcatagctggcagaaataattatttggccatcccttatctgtaaccggtcagatgtccacacccggttttgaagaaccaaccaactgaagattttgcactttgccggagcccatgcctcccaagacaactttgttgatggcgagagtaccattccattgaattggaattggtacgtggattttgcactgtattccccattagttgtccattgccaaacaatcgagtcttgtaccccctctgttagttgtggggtgtcacgggctaaaatttcccaaacatggaaagaattcatcaagaaggggaatggtgaggctgtggcggatgtcgttaatccatcttccttgttgcagggcgtcctggacggtgcggggttcctctttgaatgcctataaagattcggtgcttgactttttaggctttggccaccgatccaatttgattcccaaaagctcgccttttgtccgtcaccaatttggactctcgttgatgccgcgaaaagatccttatccaattcatcacagggtgtttcagtccctatccaaggcttctctggcgtcctccattcgaaccataaccatctcagtcgaagagctctggcaaacttttctaagttcggaacccccaaaccaccgtaccggacatgtgagcaaactttaagccaattgaccttgcattttccgccatgcatattctcgttacctgcccacaggaaccgccttcttgctttgtcaatttcttgaagagattgtttcgacggtttcagcaccttgagggtgtaagttgggatggcacttagaactgagttcaccataattcggcgcccccccccaatgtacaacaatgatggtttccatcccgagagccgacctttgatcttatcctggagaggctggaaatgcaccttacgtaggcggccaggagtgagtggtagccctaggtaagtcagtgggaagctggctcttgcccccgaaaaactacgcaagatgtcgtccagatctacttcctggcatcgaattggtgccaccagactttttccaagattgacgtgcagccctgttgccttgccaaagtccctaagcatggtaattagaacatccacctcgctttgtacagggttgagaaaaacagctgcatcatctgcataaagcgaagtcctcaatctagcatggcgacttccgatgttggttagttgcctaccttcggtcgccagatgtagaagcctttgtagggggtcgatagccaagataaagagatagggggatagggggtccccttgcctcaagccacgtctgtgtgcaatgcattccccctggtctctatttaggactaccttggaagtggcggtggaaaagagcaaacagatccagtttctccactgggggccaaaacccatgttttgcatcaattcaagtaaatattcccaggagaccgaatcaaaagctctagcaatgtctagcttgaaaaaaagtgttggctttttgctggcatttaggttcctgagcacgttccgaacatacaggaagttgtcttgaatgcatcttttttttatgaaggcgctctgtgcaaccgagatcaggctatccatctgcctggcatgccttattgctagaactttggatgtcagcttggcgacggagtgaatgaggctgattggcctaaaatcggtcaccaaggtaggggcgttcctctttggaagcaaggtaattgctgctctgttgagtgctccaaagtttcctcctgacaggttatacaaacactagaaaacatccatgatatcctatttaattagatgccagcatttcttgtagaaggtaccattaaagccatctggacctggggccttttctgccggcatctgctttaaagcggcccaaacttccttctctgtaaaaggttcatctagttcatcggggttaacctgtggtagatccatcgcgttccaatttagggtgcaatttcgcgcctggttgttgcctaggattgagttgaaatggttgaaaagcgcctcacttttttcctcatgttctgtcaggatagcacttgttgtatggagttggtgaatgtggtttttccttctcctcgagtttgcgtgaatgtggaaaaactttgtgttggcatccccttctttcagccatgtcaatcgcgatctctgccttttctttgactttgccactgctgccagccccaaaattcttagcttgaggtctttcctgagctggtgttcatcgacagtaaggatcctatcctcctgggccaaatccaatcggagaatcacctcctgagccacgtgaaattgcattttgatctctccaaacagacttctactccacttcctgagagctttagtggtggcagtcaatttgtggctgagttttgtaaatggatgtccaccaaaagtgtgagatgaccaagcttgttgcactacctccatgaatcccggcacccggacccagaaattttcaaagcggaagactacccttttgggtgggcttacagtggaagcaagaagcaaagggcaatggtctgaacagaatgaggagagggcctgcagtgtgtggttggagaacaggatgtcaccatcaatattacaaaaaactttgtcaattctttccagagtaggcgcttcccgctcattgctccatgtgaatttcctattttggagcttgagcctcctccaattcttaattacgagtataaatggactctctcgatggtttatgattttacgatagagggcatgtgaattaaacctattgttgaagggatcatcctgaacattgctccacggtaatgtggcaccgacgcatgagttatacttgatactgcagtgtcaaagggtgtatgatttcagcctcgaggtcacatgttcaatcactagcaaactcttaattttcccttaaaaatatatttggagggatgtctctcactccaaatctcggtttttttatgtggcaccgacgcaccgtgcgggctattgattttgggctagaatgagtttgtgggatagtgtgggccatattgtttgggccgaaaagggaatgaagctcacgtgtggcccattctattttttttccgtgcggcccaccaaagaacgggccgttcctgcaaccggggattcggatatttaaaggaaaaagtacaccgaaggtccctcaacttgtcatcgagttacaaaatcgtcccccaatcgcaaaaccggatacaacgcatccccttagatcccttggtggttttgaccccggttttagctgacatgatggctgactcagtgtgggacccatgtgggccccacatgtcaggatgccacgtcggccagcctctcccttcctttcctctcccctcctttcgtctcgtctggttaggaattaggatgcaacgtcatcggcaggccggtcggcggtggggagggggttgcccgggtgagaggtccgtcggccggcgggcgatgcggcagcgacaacgtggctgctgagacacgagagaaggggaaggcgacgggccagcgtcgtggtggagaggcggcagcaggcgtgcgagcgtcgtggcagagagggcggaggcggcggtggcggtggagaggcgatggcggcggatgcgagcgtcgtggcggagaggaggcggcggcggcggctgccacgcgggaggggaggccaaaggcgacggcgtgggcgagcgtggaggcacgcgacggcgaggccgccgctccgcccgtcgcctcttctctctcaggtttctcctcgtctgggtgggcaggtcggccggcgggttgggaaggaagggaaggggttggggtgatggcttgctggagctgcttcggctacagctggtcgatgaagcaggaggcgaggtctggctgccggagccgttccagctgtcggcgcccttgcccagctagccgcatggtctggggacttgttcgctttcatcgttcttcgaattctctccccgtttcttcgtgtactgtttaattggttcttaatctgctcataaattaatcgtcgtcatctatggcctggattgccggatagtatctttgtgcttgtaaatttttagctgctatgcgagagctcgtgccaaatttgatatgcgagagttttgttgtttgttctgccggcgaccgagcaggactggtccgggcaccggagcgacaggcaccgcgcgccgtcgcccaccgccgcgcagaaacgaccggcgatgcagcagccgcaccggcctgccggaggaccgagcaaatggtgggcgaagcgggcgacggcgtaggccggagcggccggccggcggtgggcaggcacgctgcgggagaggaaggggctgcggcggcaggggcgcaggaggtcgggccgcaccggcaggcggctgtcgacgtcgaccatttagagggcagagagaggacaagagcggggagaggagagagcggaggcggatggcgccgatggggagcgggatggggatagcaaggctgccatcgccgtcgtcgtccatggcgtgggggaggctgcctccgctccgcctgtcgcctgcctgccaccgccgaacctcctcctctcccgcctcgccccgtcggcttcctccccaacccgtcggccggcctgcccacccagagtcctagacgaggtgaaagctgagagagaagaggggaaagagagagatgacgtggcatcctgacatatgggtcacatgctgagtcagctgctatgttggaaaaatcggggtcaaaaccgctgagggatctagtttgtcctggttttgtaagttaggggatgcgttatatccggttttatggttggaggatgattttgtaactcgttgacaagttgagggaccttgggtgtactttttccatatttaaacaacgaaccttatttgggtctctggcaaccgttagatgaggctgtgcggtccagatcgaattggtcagtgcacacgaaagatctaggagagcggccggagaacaatggccgtcggaatgtattgttttcccctggcaaaatggctgatttcttcctcgaaaattgctttgttgcctagcaacagtcttgacaagcatttctcttttaatctcgtatagctgatgatcgtctgtttctccattgtgattaagccaagtcgatttggtttacttgttgtctgactatgaccagttcaaaacagatcattgctcattagatgttttactgaagttctgcacattatcacctctgccgaattccatctgtctcgaaagagaaaagggaaatatctgttgtccacgtctgacaaacattttttttaatcttcaaaaatgaagtggcagattgaattgaaatgaaatgctacttcagcttgacgctgacagaaaattctcaaatcctttggcttgcatgcgttatctcaggtagcgcgcgggaatagcgatgcggctactaacaaaggggttcggggttaaaactccgaactcatttggccgttcgattgagtggatcagcttgtcagcgacctgcatcatactatcataaattggtactatctttatattttaatgtatgacgccgttgactttgtattcaatgtttgacattcgtcttattcaaaaaatttatacaattatcatttattttattgtgactcgattcattatcaaatgttctttaagcatgatataaatacttttatatttgcacgaaaaatttaaataaaacgaatgatcaaacgttggtcgaaaagtcaacagcctcatacttgcttagcgagcagctagtgcaatcatataatcattacactcacaaatcacgaacggcttaacgaagtcagtgtttattctaagtactccttcctctttttttctttcttttttctttgttaatctctctatgtgatcgtcagatcagatgcaatgtactgcagttcgtttcagtatttttcttattttcttttgtgtttggtttttgcctattaaccagctgaacgaaattctgaaacccagctagctatctgctatccctgtatgttcaagctgacctgtatcttgaacaagtttatctgaagtgggagtacgttacactgcctttattttcgaagctgcatgcataactgaatctaatatcctttttcaggcgaaactactgcatgattaggccgatcgattgcataactgaatctacatcctttattttcaggctgctgatggcttgcatgcaatcgatttttcgatcatgatcactaattgcgtgctttgattttactggaaaatctgtatatatatcatcactggaaagatgagcaaccagcatcaaggttgctgctgccgtcatcactggaaagatgaccccctctggtgggtcgctaccagccgttcgattagcctctgcggcccagattcgtactgtgtgcatcaaagacggccctgtttgatgtgggctgcctcgcgcggcctttgcaaagcccagcccatttagcctatggagtccgttctggcctggctcacgaactgtcatcagcccacatagataggcccagatggccagattccacggaaatggcaggcagttccatggcctggctgtaaagctcgcagaacaatgaacgaaatgccacattgaacttgattttcttttgagattagttttgaatactctgtatctatactactactattagctaaatgctcacgcgttgcaaaaaaataaaaaaaatatttcattacattttccaatgttaattaaaaattcatactttctttgaaattcatgggaatagatgatgttggttcatatggctcaccttttgatgtagagtaatactcctagatggtggattcactgatttgaatttcaagtagaggcgtggttaggggtgaaaacggtactgaaacggacgtaaaccacctttatcatttttgtttttatattttttttgggtatcggaatcggaaaccccggatacgaaaatggaatcaaatattatcgaaaccgaaaacagagcgaaaatgaaccggcgcgaatacagtaatgaaaatttatcggaatacgaaaacccctcaaattgataaatccaattatcaagtctcaacggttaacaattcatcataaaacacaaccatataagaccaattattaagtctcaacagtacatcacaaaacacaatctatgaaataaattatttatgtttaagagagtaatactgttgataaatcccaatgcaggaaaaaatattcttatgtaacttcagatttgcataacaaatattttttttaaaaaaataatagacaaacaccatggtattcactattcagtgcttacaaaaggaatccagggtatttcagtcacaaaatttccggaaattccgagaaaatttccggaaagtttctgatcgattccgagttccaacgaaaactgcccttatcattttcgattccgtttctgataaaatatttccgaattcgtttccgtttccgaaaaattccgaccgacaaattccgtttttgaaaatatgtccggaatctggaaagtttttgtaccgttttcacccctagccgtggtcacactgacagcatgaacccacataagtagatactatcattaaggtcttttaaaacagtatagataaagaccactaagtagtggtgtagttccgccaaaaccattatttttatacatctattttctataaattagtttatgacattacatgatagtgttaacattgaaatttagtaagcccaaagttaccatcggcttagagtcagtatcggcttcaaagttctagaatcggccgatgggagtgaagtcgccacgatgtcgtgttcttggtggagtcggatcaatcaaaggaagcttatctagaggagttcgagttcaagaaggatgcgacatgacagttatctattaattaggcatagtttgttagtttcattttatctttagtaaagtgtgtttagtgtccgataaggactttatcttttcatttttagtttctttcttgttcgacaaggactagtatctccctatgggtataaatattgtcacgcccagaaatttctgaatagaattccaagcagaatgtgcattaaaatccccgtccaggaccggtcggggtacacaaacgacaatgttgacattcagatccacgtcttacaaacatcataaaagtcttacctaaatgcagcggaaaaacgaaagacaacaggagctaagccttgactagaactgcagcgggaacaccactccacaggcatcctcgacggcacggacgaagcctactcctcagagaaacctccatctgacacatactcatactctggggttgggaaaaatagagcaagactaagtactacccactgtactcagcaagtcataccagaataggggtatgatgcagggaattatcaaagaagagctagagtggttcatttgcataaagcgagcatttataagcaaaagttgaaagatttaaatagttgtaataattaattaatattaatcatccactgtccaacgctataccacgttgcgacaggcccaaccatccacatatactatccaaattctaaggatttcactagggtgagactaatcacggtgaatctggttgaccgcccataaccgcgggcacggctattcgaatagttttactctgatcagaggtgtacaactgtacccacagacacagccccacgacacgtttccgtgcgccgacatgccaccacgacataccggaaagaggccgtgacaggacccttcgcataaccccctctaaccaagcacactacaccttaggtttcacccccactcctcgcaaggcagcgggcagtcccctctcgtgcctaggtgaatctggaagcggcagaggccgtcgtagggcccgccccgctccatcacgcccacccttgcctggatgcgttgactagaggaaagctacattacaagcccagccgttgcccacgctggcttgtggtaaatacgataagttcttc

SEQ ID NO: 60032 - DNA, 716 bp, Oryza sativa
gtgaaatacatgtacgaactcagtaaaccgcttgtcaagcttgagctgctgcagtccctacccacacaaatgtacaagttccatcagctgtacatggagatgagcaccaccggtagagagatgatcggagcgacgatcagggacacggacttcttgcaagaagatgacattctctggatcaatttcaggggaatctacgaactataccagctggacgccctgacgtctctattatgagttgctggattttgtaagtatatcgttcagttagatttcttactatacgtctcctttaattaattaggtccttctatataagtagactatagaaaataatatactcccttttatcgttgtagaatggagattcaaagggcccgacggcgaagggttttcgatactggattcatcgaccctcggaaagtaaacgtcgcaatgctcgaccaatatccacaagaaacagaggacaatctcgtccatctcctgaaggcgcagcattacaagacgttcatactgttgccatacaacacagagttagtttaattttactctcttcctacataccaaatttcattcccgtacgaacttgctaagtgtttcatatgtaatgcatcccacgcacattgcagattccactgggtgcttttactcttcgacctggaggcctgcaccgtcaacgtatatgactcaatggataaaaaagagtctacgtttga

SEQ ID NO: 60033 - DNA, 30015 bp, Oryza sativa
attcctgcagccctttcaggaatgtaattaaagaaaatgttttggtcatttgaattttcaaatatagggtgttatttgtgtttaacattgggcctataattatgtagtacggcccttaaagttgggaaggcccatataggtacttaggttaggtagaaggcagggtcaaccgcaggcgtggctaatgggcgggtgatcgctgacaacaatcacccccatcccccctatacgctcctcctctccacccttcctcctccccttcttctcttcctactacaccataaattttttttaaaaaaaacaaagttggaaaaatttatgtatagaaatgctatatataaaaaatatttgaattcaaattcaaatttgaaatgggtatgtaaacttttgacttacaaactttgggtttataaactaatatttgaattcaaattcaaatttaaacgggtatgtaaacttttgacttataaactttgagtctataaactaatatttgaattcaaattcaaatttgaaatgtgtgtgtaaacttttgacttataaactttgggtctttaaactttaggtgtataaactttagatgtatagaaatactatatataaaaaatatttggattcaaattcaaatttgaatcggatatataaacttttgacttataaactttgggtctctaaactttagatgtgtaaatttggggtgtataaactttaagtacataaatttactaaaataggaaagtaatacggtgccaaaaaaagaaaaccacgtagagggaggggggatcggctgatcgctaggggcgatcgatcgccccttttggtcaaccgcaccctaccctcctagtcaaggaactgcatttgttgtgtactatcaaatccccttgctttgaggcgtgtactatcaaatccccttgctttgaggccttgagacaagctgcccaatcaatcccaagtattatagcagatggcactatcagtgagctctctcataattaacccatccatgccaaccgccaagtccccaccaagcaaatacaggggaaatttcttcttgaatcatatttgtacagtactacaaaggaatgtgttgactactccggcaagcacgcaggtgacggccggctgcaaccaagagctaggtctccatcagctctaattggagattggggtgtcattgtccatatgagcatcaaacaagcctgaacatagggtcatgtgtcgtgctgaactctaatgaaaatcactgtggattttcatgattttattggaacagaaatatggaaaaaattttgaaactaatcgtgtttttgaccgtaattgcaagattaagctgactagtggcggatttgcggaaatatactagcgtcgcggattgaaaaagcgaaagcgcgatatcgcgctatcggcgcgcgaaagcggcggcgctatcgctaattgggagcgagggagcggtattgcatcggtatcacgttcttaaagcgcgagagcgaggcggtgtcgcgattttgtaaagcaagtgtgcgggccgccgggacacgaagcggtctcgcgcttacaaagcgcgatagctcgtgcggtgtcgcggccggaaagcgcgagatcgtggtggactgacgcctgcgggtccccgagcggtgtcgcgcttacaacgcgcgatagcgcgcgcggtgtcatggcctgaaagggcgagagcgttgcggactggcgcctgtgggtcccggagcggtctcgcgccactgctctgcgaaagcgcgtcggtctcgcggtacgcgcgtgcgagagcgccgtcggtatcgccctttcaagccgtgataccgatgccgcgtgattcgctgctgtgcgacagcgacggcttcggtctcgcgctttgaaagggcgagaccgctagcaatatcgctctccccgtgcgcgagagcgattagctaattacacccccaaatggtaatatttcatttgactcatgtcacagttctcatgtcatagttggtaagtatttcttccatcccataaaaaaccaaatcagtactagatttgtttttttgactgagagagtaaaaagtataattttttttttctattccctccgtccccaaaaataccaagataatatttttttcataattttttattatgtgtgcaacatatatatacataaatgaacatgacaaatatgtttatattgaaaataggcaaagattgtgtacgcggctacgagaagaaatataaatatcttggaatatgcaaaatagtgatatcagagaaagaaaacatatattacctatagaaaaacagaaattgaatatgtatgtattaaaaatatataaaggagtagagagatcattcgggagcaatttttacaaagttgacaaagaataggaatttagaatatgtcatattcacagagaaaaccacctttgcatattcacatgttcgatcttgtgagaagaaccgtgtagcgagttaacgaagtactcaagttcttgccacaatatcgggcctaagaatatgcaacaccgagtttatgaatttgcaggagtaggttatatttacaaacggatggtggaacttggaaaaaagagtgggcgtaaggatgtattaaaaaaatcacatttgtatattcatagactcgatcttgggacaggaaccgtgtcgcgagtgaacgaacaacatagagcgagttcaccaactactcagtttctgcctcaagatcaggcctaagaatatgcaacacaaagttggaaccagcaaaacgtttatgaagaagagatgtagttgtgtgctaggtttggttgttatttataggggatggcaagaagctgcgtagtttcaattattggaaagagacgacggtgcgtctgactgtttcagtaatcaattcaatagtgttagactgtttcacccgtgatgacaataattgcaaagcgacaccgtaactttcggcggcgcatgctgcataactgtttgctttattaatcacaaagcgacgaatttacattcggcgcagtgcagcataatcttgaaagtttaattgtgaatgatttgatgctctggcgcatgtcccgtgattggaaagagaggatgccatttcaggtgtgtcggtgacatggggccgggggtatcgtgactagaggcttgggtagccgcgatcactcacgtggcccgaccccctcgggggggtcgggcccaacggtgacatggccacccctccctctgtttccccgaggggtcgggccgctcccgtttcgtccccgagggctggggcgccccgaccccctgagggtttggcgccacgtgtgtgggttaggtgagcacagcggcgctcacctaaccgcgtttattgcgggttggacgagcgccccacgccgcatttaatgtagcgcagcacactcatccggtccgtgatcggtcacagtgtgtgaccggtcacagaccggtcagatcgcgggtagggggcaacaggcggcctgacacacgcctcgccccgtcccgtcggaatgatgagagcctccaggcactcgtccctagccggagccggcgtgggaactcctggagttggcacgtcagccccggccagatacattccaggcttcatcgcaaccattgcaaggaagtcattgtatgaagaagggcagacgtgtagcatgctaaactgacacgtggtagacaagaatgactggtttgtgactggtctgacgccggtcacgtcatcagcaaacaaccgtgctcccacgttgcacctgcttccggcggagtggaggttggtatgacccatcccatcggagggtcattcggacagcaaccattgcaaatctccacccattaatgaaggaaggacagggttatcccggtgtcaggcgaaggtacgagccaagttatggtcaaagtaggatgggtccccacccaaaagaagggtaggtagaaatggtgtatgtggtatccccttgagatataaaaggaggaccatgcctaccgagagaggggactgggggggggggaagaaagggagaagaaaagaaggagagctcgaaaaaggaagagcggagctcatagaggagagaaagagggagagggtctctagagtttgaactctcttgctctccagctctttgtaactccttcatacacagatccaccagaacacaggagtagggtattacgcttctcagcggcccgaacctgtctacatcgcccgtgtcttgcgcatttgctctctcgcgaaacattccacagatcgagggcttaaaacctcacctagcgtccccggccgaaccggcaaaggggggaccgcgcggtctcccggtgaggagccccacgctccgtcatctggcgcgccaggtaggggacgcgtgtgtttttctaagctctcgtcctctttcgtgtgcgccaagcttttcccgctcagcccaatggcagaacgggcagtggcgcacaacctctctccgagcgctagcggtgacgacggggagcagaacccgcgccgtcgagctcgtactccaccgcccccctctcgccgaagtcttaggcgggaggaggcgctcgagggggtcgaaagatccgcgacatcgccgcccacaagcgatggagaaggacggcgagacggggagcgtcgcctccttgtctacggcgatggcagcacgccccagggcgcgctccaagctgcgggcgcgctcttgcgttacccgcccgtcgtccccgatccagagactccagcctgacgttggctggatgacgtggccgacttggtcatgacggcgcagcagcgcctaggcgccggtgggcggtcctccgccaccaaggcctctggcgctgctaccgccggctccgtgtcgtcgaggcggagggcgcggcgagcggcggccggtacccgccgttcgtcagccattccctcgtcaacgcctccgacccaagaagatgtgcgtagggggtcggatgcccgcctcagtatcgagcgccggcgcaatggtcgtcgtgctgcccacgcaacggaaggcgcttcctcgtccggagcgccacttcggttcgggcgcgggggctagccccccgtgcccccagttggtggtgtcggctgtcgagcctttgtggcgagccttcggaacgtccgttggcccccaaggttccggcccaccatcaccgaaaaatatgacggaagtgtcaaccccgccgagtttctccaggtctacacgaccgggatcgaggccgccgggggtgacgacagggtcatggcgaacttcttccccatggccctgaagggacaggcgcggggttggctaatgaacttgccgcccgcgtcggtccactcttgggaggatttgtgccagcagttcaccatgaacttccaaggcacatatccgcgcccaggtaaagaagcggacttgcatgcggtacagcgaagggacaatgagtctcttcgctcgtacattcagcggtcctgtcaagtccgcaacaccataccatgcatccccgcacacgcggtgatctacgcgttcagggggggcgtacggcacaaccgcatgctcgaaaagatcgcctccaaggagccccagaccaccgcggagctttttcagctcgcggaccgtgtggctcgcaaggaggaggcctggacctggaactccaccggtttcggtgtggcaacttcggccgcccccggatccgccgctcggtcaggacggcgggacaggaggaggaagaagaggtcggcccattccgacgacgagggacacgtcctcgccgtcaagggcgcttcgcgggccacccgaaaggggaggcctgcgagcgacaaaaagaaggaggccggcgctcccagcagggagcgcccgaccggcaagtggtgcactgtgcacaacacctccctccacgacctcacgaactgccgcgcggtcaaaagtttggctgagcggacgaggaagtgggaggaggagaggaggcaggagcgccgtgagggcaaggccccggcggctccctccagcaaccggcgaagtgaggccaagcagaaggcccccgccgaggacatcgacgatggcgacgatgacctagggttccaggagcctggggccaccatcgccaccgtcgatggaggagcgtgcgctcacgcttctcgtcggagcctcaggcccatgaagcgagagcttctggccgcggcccatacccatgagaagacgcggcgggcgcggtggtcggaggttgccctcaccttcgaccagaccgaccacccgccgtgcgttgcccggggaggacagatcgcgatggtggtttcccccaccgtttgcaacgtgaagttggggcgtgtcctcatagacgggggtgcagccctcaacatcctttcccccacagcctttgacgccatcaaggtcctggggatggtgcttcggccgtcccagccgattatcggtgtgacgccggggcacacttggccgctaggtcatatcgacctcccggtcaccttcggtggatccgccaacttccgcacggagcgggtaaactttgatgtggcggacctcagtctgccctacaacgcagtcttggggaggcccgcgttggtgaagttcatggcggcggtccactatgcctacctccagatgaagatgccgggccccggtggccccatctctgtccatggcgacctcaaagtcgcgcttgcttgtatggagcagcgcgcggaccacctcgccgccgcgtccaagcccgagggtggcaacgagaggctcagcacctccgtcccagccgccccgaggcagcggatgatcacgtgcgacgaggtcccggtcaaggagattgccctgggcgacggcccgtccaagaccacacgaatcggtggtcttctggacggcaaataggaagacgcgctcgtctccttcctgcgggcaaacgccgacgtcttcgcctggagaccggcggacatgcccggggtccccagggaggtgattgagcaccatctcgccgtgcggccgggcgcaaggccggtccagcagaaagtgcggcggcaggccccggaacgtcaagccttcatccgcgaggaggtggcgcgacttctggaggccggattcatccgtgtggtcatccatccggagtggctggcgaacccggtcgtcgttcccaaggcgaacggcaagcttcggatgtgcatcgactacaccgaccttaacaaggcatgtcctaaggacccttaccccctgccacgcatagatcagattgtcgactccaccacggggtgcgaccttttgtgttttctagatgcatactctggttatcatcagattcgcatggctagggaggatgaggaaaaaactgcattcattacccctataggaacttattgttatacgacaatgcctttcgggttaaagaatgcaggtcctacttttcagcgtactactcgaatttctttgggtagccaaataggacgtaatgttgaggcctatgttgatgacttggttatgaagacgcgcaaccaagagaccttactctcggatctagcggaaactttcgaaagtctccgctccgcccgcataaagctgaaccccgataagtgcgtgttcggcgtgcctgcgggcaagcttctcgggttcttggtctctgcctgaggcatcgaggccaaccccgagaagatacgagctatagagcggatgcgcccccccagcaagcttagggatgtgcaatgcgtcaccggctgcatggccgccctaagtcggttcatatcgaggctgggagagaaggcgctacccctatttaagctcctcaaatgctccgggccgtttatctggacggaggaggctgagcgggccttcactcagttgaaggcgtacctcagttctcccccagtcctggtcgccccggagccagatgagccgttgctactctacctggcggcaaccccgcaggtggtcagcgcggcgttggttgtggagcgcgacgaggacaaccctcacctcgcacatccccaccctgtgtcgactcgacccgggagagagcagggaggagaggcccccgagccgaacggcggcccgaggcccccgacggccggagctggccctccgcctgcttgtccgacggtgccaggcgcccccgacccccaggatggccccggggccactgcgggaaggccgcgcctgtcgccctccgaccccgaggtcgtcggcatagaagccgagtgcgccccgcgcggcctctcggacgaagagcgccctggagatgcggcccctagcgaagaggatcggccccgccgaaaggtgcagcggcccgtctacttcgttagcgaggccctccgggacgctaagacccgataccctcaggcccagaagatgctttacgctgtcctgatggcttcgaggaagttgcgccattattttcaggtgcatcgggtcacggtggttacgtcttaccccctcggccaaatcttgcataaccgagaggatactggacgggtggtgaaatgggcaattgaactctttgagttcgatttgcactttgaaccacgccacgcgatcaagagccaggccctcgccgactttgtggcagagtggaccccggcccctgagcccatctccgtccccgagaccagctcgggcccctcgcagctgcctcacaccgcctactgggtgatgcagttcgacggctccctatctcttcagggcgccggtgcgggggtcacgttgacctcgccaaacggagacgtcctcagatacctggttcgcctcgactttcgggcgaccaataatatggcggagtacgagggactccttgcgggactcagggtggcagctggactggggatccgctgcctcctggtgttaggcgactcccagctggtcgttaaccaggtctgtaaggagtaccggtgctctgacccgcagatggacgcttacgtgcgccaggttcggcgtatggagcgccattttgatgggatagagctttggcatgtgcccaggcgggataacgcggtcgccgacgaactctcaaggctcgcttcctcgcgagcccagaccccaccgggcgcctttgaagaaaggcttgcccagccgtcggcgcgacccgaccccctaggggagacggacgcacctgaacggcccccaaggcccgtcggagtccaggcctcgggacccgaggggagcgttcccggctcccctagattgattgcttggatcactgagatccaggcatacctcacagataagactctacccgaggaccgcgaagggagtgaacgcgtccagcgcatctccaagcgctacgtgctggtggaagggaccctctatcggcgcgcggctaacggagtcctcctaaagtgcattcctcgggaacaaggcgtcgagcttcttgccgatatccatgaaggcgagtgcggagcccactccgcctcacgcaccttggttggcaaggcctttcgccagggtttctattggccgacggctctcaacgatgcggttgacctggtccggcggtgcagggcgtgccagttccacgccaagcaaacccatcagccggcccaggccctgcagaccatacctctttcatgaccgtttgctgtctgggggctcgatatcctgggtccatttaggcgggccccgggcggtttcgagtatctgtatgttgctgtcgacaagttcactaagtggcccgaggcttacccggtcatcaagatcgataagcactccgcgcttaaattcatcaggggcatcactgctcggtttggggtgcctaatcgtatcattacggataacggcacccagttcactagtgaactcttcggtgactactgcgaagatatgggcatcaagctctgcttcgcctctcccgcccactccagaagcaatggccaagtggagcgcgccaacgcagaaatcctcaagggccccaaaaccaaaaccttcaacatcctcaagaagcacggcgactcgtggatcgaggagttgccagcggtgctctgggcgaaccgaaccacgccaagccgagcaaccggggaaacgcctttcttcctcgtctacggcgcggaggcggttctcccatccgagctcaccctgaggtcccctcgggccaccatgtactgcgaggctgatcaagatcagcttcgcagagatgacctcgactacttggaagagcgaaggcggcgcgcggccctccgagccgcacgctaccagcagagcctgcggcgctaccatcagcgccacgtccgggcccgatcactctgcgtcgacgacctcgtcctacgccgcgtccaaacgcgtgctggactgagcaagctctcaccaatgtgggagggtccgtatcgagtgatcggtgtcccccggccgggctccgttcggctggccacgggcgacggcacagagctgcctaatcagtggaacatcgaacaccttcgtcgcttctacccctagtgggggtcgggtgttaggtctcgggctcgggccaaccccgcgcccccctaggcgtgcagggttggccgggggctaccacatgcatatccttatcttttttctcttccgtatttcaataaaagcattttagatttcctaaggactgtgtctgtgccattgtttcctttcgaagaatcttggcttgaattagcacgctcgtgctcgatcctgccctcggtggcccaggccggctaaaatcgccaaacggggcccagaaccgagccgtgcctcggggcgtggtgaactccgggggggaatcggcaaaggcccacaatcgggtcatccataaccctcggtcaccacattcccggcctggccagtctcgacacgcggatctccccaggcactagccccgacccgcgccatttgaggctgggacctgggcacgagccctcgttcaagccaagacacagaaggaccgtggcacagaccatcctcgtctcatacacacaacaaatgaaattgacacaaaaatttcatctttatttgattgcagattaaattagtttatacaagaagggagcccgaaggcctcagaagaagaaagaaaaagctatttaagattggtgggggcctgggggctcacgccgacgcgcccgggtcgccggcctcgtcgtcgctgtcgtccgcaccaccgtcaccgccctcctcgtcggagtcgagggcgaacgcgagtcgaggggccgtaccctcgaagctgtggacgatgtggtcggcggcgtcccggacctgtgcgcgcgcgccatcctcggttccaggagggaactcgtccagcgccaccgccccccgggcgaggtccctcgaggatgacttgatcgtctcctcgagctcctcggggagccgctggagggtcccggccatctctgagaggcgctgggcgaggcccccctggttggcggcatatttcgcggtccgcccgccccaaaggcccgcctgccgcccggcgcagtctagacgggagacggcgtcccgaagcatgccgggccctacctcgcctgccaagtggagggcctcgacctccccggcggacgagtccagcgcgccctgcagctcggtgatggtgtgttcggcggctgcgaggcgggcggctaggtcgccgtcgcctgcggccgccccgccgctgtgcgctctcgcgtccagctccttcgcccgcgcctcgaattcagcggcccgctggtccagtgcggccctctcggcgcgggcgccttccagattgaggcgcgcctgttcctcccgcagctgcgctgcggcctcggcctcctcgagagctcgctcccgctcagtgagctcgtcctcgcggaggcggagtgcggactcctcttcggcgcaggcagcctcgtgcgccaccagcgttgcctcccggatggcgacggcggcctcgcgacccaccagttccctctccttcgtgtccagggcgcgggcgcgctcctccagcaccgtggcgcgagcctcaagggcctcttcgcgctgccgggacgcgtcgagcttcttctctagctccgccgcccggctcccgtattggaggcagaggtcgtcccgcgccgtgttgaacacggcggtggcaatgagggcagtctcccgctcctcctccacctccctggcgatctccgccaggtccctacgacgggcctcgagctctgaggtgtgccggcggtgtgccttgcggcctgcctccaccatggcctccaccgagcgtcgcccctcttcgacacgcgcccacgccgcgtcgagctccgcccgctctgcctgcaggacctccatctgggcacttaacccgtccaacaccgtggtgttcgcggcggccaaggcctgcagaaggggctccgcgcttagtggggcagcggaaggcgtggggaagagccgcctcggtaaggatgccgcacggctcggcccgccgatcgacgtgccgaactcgggggcgtcccccgaagcgggctcgtcccgaacgtcgcccgaggggtcgggcccgggcggcgcgcccgcggcctcgtcgtgggcggcctcggaagtcgttgtcgcctcgggtggagtcgggtcgggggcttggcaggccgcccggcgtgagtgcgccgcctccgtctcccggacgggctcctcggcccggcggagtctggcctcttcccaagcggcttcctcagcctggcgagcccggacagcctcctgggcagcttcctcggcttcccggaggcggtttgcggcttctcgccgatcagcttcccgcctccgggcctccgcggtcgccgtctcctcggcctcagaccggccggacttggaatggcaggaagggcgcgacgggatctcgctgaggcagacaaaaaacaggtgagtaaaaacttgccttgggagatgggagaatgaatacggccgtagtgggcgcggggacgaacctgcgaggaggtcggctaaacgaccaccttgggggggagatgaggtttccccggcatggttcggtcccccccatcttgcggagccgcttcttttttcgctccccctcgggctgcgacgtcggcgcagcaccctccgggcgcctgctgctggcacgcaccgccccgccccctcggggaggagatggggagggggtatcctcctgtttcctcttcccccgggcgtcggcagggcggctgccccccgggcccccgtgacggggcccagaagcacgaccccctcccggggtagattgttcccccctgcggctcccgccagcgccatcgtggcctcgaggagcccgctcccctgacgccccgaccgcctgcatgatggtcaggatgttggcgcgctctggatcgctgcagagggggaggacaccttgggggatgagggatgcctccacggagctgagattcagcacccgttggatcaccaccttgaagtcttcagggacccagtcccatttgaccccctagtgggtcctcatgtagtcctcggacccggtgtactcccaggcgccccgggcgcgccgctggagcggcgcgatccggcgacgaaggtaatcgccgtacaccatggcccccgtgagcccctaggatcacagaccagccaggcggtcaagaacggcgtcgtagccgtctcccagatctaccggcgcccgccagctggaggcctgcgccgggggctggctcggaagtcggaggcgcgcttcgtcggcgagaggggtgtagaaccagtcgctcttccagtcgtcccacttcttgcgaaggacgcagggaatgtagcggttcagcaccggcccccacggctggaagtagcagccaccgactaccgacggtggcgacaccggctgtacggtgaagaaccaccggaacagccggagagatgggcgcaccccgatgaacatctcgcacaggtgcgcgaagatcgccaacgtcattaccgcgttgggggtaaggtgtgccatctggagatcataaaactccagaacatccatgaagaaagaagagaatggcaggaccagccctgccattgcgaagggaaggaagaatacggaccgccccgggtagtgtggcgccgggcgtccctcacctagcacaaccacctcccggccggtggcagattccggcatgaatcggcgcggcagcccggcctgcctctcgctcacgatgcgggaaggcggcagcacgctaccatcgagcggtgcggagccccgtgccatgacgccggcggaggaggagcttgagagcgagtgagtatggcaagggtagggcgcaggaaacggagagtcagagcacaagtggcgaaggcaataggaagagtggcgagaggaaggaaacaaatctcttcctcggcgtctttatacccttgccaacgctatgcccggctcctcgcttcccgcgcccactatctcgccccctcgtttctcgcgcccactcctccactaatcccgttcgcccgtttgcggcgcacgagacggatgtgcggccgtggcagtcgagatgggacatatcgtgcgcgcgttaactacgctcgccgaccgatgcaccatcatcacatcactaggcgaaacgaaccggttcgtcccgattcgcgcactactcaagtaatgtagcggtcttgaagaggccactcattattgtcgatcggtttctcccttgccgatgcgcgcgatttgcgaccgttaggtttctgcccgcctgtggggaccggccccacctgtcaccgggcctaaggagtggcatctcgcccgatcgcctccctcgaggggggcggtcgccctggcgtgacgccgggggctactgtcggtgacatggggccgggggtatcgtgactagaggcttgggtagccgcgatcactcacgtggcccgaccccctcgggggggtcgggcccgacggtgacatggccacccctccctctgtctccccgaggggtcgggccgctcccgtttcggccccgagggctgaggcgccccgaccccctgtagtgttggcgccacgtgtgtgggttaggtgagcatagcggccctcacttaaccacatttatagcgggttagacgagcgcgtcacgccgcattcaatgcggcgcagcgcatgcttatccggtttgtgaccagtcgcggcatgtgaccggtcacagaccggtcagatcgcgggttaggtggcaacaggcggcctgtcgcacgcctcgccccgtcccgtcggaatgatgagagcctctaggcactcgtccctagacggagctggcgtgggaactcctggagttagcacgtcggtcccggctagattcataccaggcttcatcgcaaccattacaaggaagtcattttatgaagaagggctgacgtgtggcatgctaaactgacgcgtggtagacaagaatgactggtttgtgactggtctgacgccggtcacgtcatcagcaaacaaccgtgctcccacgttgcacctgcttccggcggagtggaggttggtatgacccatcccatcggagggtcattcggacagcaaccattgcaaatctccacccattaatgaaggaaggacagggttatcccggtgtcaggcgaaggtacgagccaagttatggtcaaagtaggatgggtccccacccaaaagaagggtaggtagaaatggtgtatgtggtatccccttgagatataaaaggaggaccatgcctaccgagagaggggactgggggggggaagaaagggagaagaaaagaaggagagctcgaaaaaggaagagcggagctcatagaggagagaaagagggagagggtctctagagtttgaactctcttgctctccagctctttgtaactccttcatacacagatccaccagaacacaggagtagggtattacgtttctcagcggcccgaacctgtctacatcgcccgtgtcttgcgcatttgctctctcgcgaaacattccacagatcgagggcttagaacctcacctagcgtcccccgccgaaccggcaaaggggggcccgcgcggtctcccggtgaggagccccacgctccgtcaaggtgtgtatcattgcatctctgtgaaaagaaattagtgcgcaatttacgtcatagtagtaaaaagtacaagtaatatgcaattttaaccgcacgggtaacatagaaactgcactattaatttagtttgtgagactattattgttgttagctctcgtacgaaaaattaacagttaaccaaaaatcatatgtgttaactggctacaaaatagggcataaaaatatataatatttatgaaatacgatacatcgtacataacatgcagaataagcaatacaaataaataatgttcattgcagtacaaataacatgaagaataatccaaaatcacatgaaggttcagatagggttgccagtgaactgaaaaacataatgttcagttgtactcgtcatcatcgtcatggtcagtcgtagtcatagatgtgccacctcgtttttttgtagtttttttcctttgtcctacggcatgtcgcgggcctgagagtgacagacggttcggctcatggcgctcacggttagatctacgcgggtcattgtcgtttccttcgccaacctctggttgtatgggctgtgtcacttggggtgcatcatcagtttgtgaagtgcgaagctcattgggtaccgatgacgaccctccaccgaagcaggacatgtcgccgtacgatgtagtgtaaggcctaaaccctgacattagttcagggcgaaatgaccctacagaaaaaatgtagatatcaatgaaattatcaaagctggagcaaacaacaataacaaaaaaaaatccaaacctgttgacggtgcttgcatatatggaatttcattaggatgcgaggaatattgaccaaatagccaatcaccttattgcaacaagtccatataaccctgtactccaccaccaaacgacgtgccttgcacccatataaaatgtcacggagttatttcttaagttgaggtggggatcatgtatggcatgaaagtgccattaatatatgtgtatggagaatgatggctgtgcgtaccaccgtaatccatggattgtccttgccatgggttggtgccatatgtaggtgcatgcagtggaaccggctgagtaggccctgttaatatcaggaagtaaatagtcaataagattcatatagatgaaaaagtaataaattgaaataaaaaaaatatgaaattagatgtaaggggagattgaccgcctaacgacgtaaaccctccttgaccgataaaatctgcagacatttggggtatggtagggataccttggctagtccctgtatgtgcaattagttagcaaaaagtttaattacgagtggacatatgcatgccaatatagtactgaatgtacacgcacctgcaaatggtgcaaatcctccttgccagtgtgaggttggcacatcgggagccatttgacgaatcatttgtggcctagcaggaggcatatgaggcacgggacggaccattcgcgttccctctgtcatcaattggaaaacatcatttagttagtttacatacacaattgggaaaaaaattagcatattgatgagctatcccgtaccagcaaacgacgcactctcaccctgccattgagaggtgatgggcgtagagctatatgggggtacccattccggttgtgctgcgaacgtataaattagtctttaatataaatggcatttattttagcattatgcaataacgtattttaccttgagttgaaccaaagcctcctaggcgttcagaaatttcagtgatttttgggatagtcggaatagtgggtggctcacgaaaggaagttgaccttactcctacacgaccatcactggatcgtcgcgcggatgctgaagggcgggatgaggtggacggccgggaagaggtagagggacgctcacgcattggctcgaacgtccttcttgatgttgccggattatagatgtccgaggaatgacggcacgatgcgaggcgcatgattcgctttccttttcggcggagggagtcgaccgcagccattacttcctgattcgtacccgccattccatctctaagcttctcccataatgttttcgcctcctttactagctcccctgcaatgtcggtctgcatggagcgtaggaaaaattgttagaaagtggaaccccatgtatatggacacacagctgcaacgataaatttaaatgctagtagtaccgtcaagtgagcggggggtgctagctgcatatcatatatttgatcaattgttggtggacctcgctcgtcgggatcctccggtgcaagcagccggatgcgagtctgcgatgtgtaccaggccatgtattgtttgtaagtgttgtggtcgtatgccctggtctcatggacgacatcattcaaggcctgggaccacgcctctatccatggggtcatccttgagtgcatagatcgacaaaacctattgtcagcttgcctattttgcctgcaataaaaagacaacaattatgtgttaggtatatgtgacaatttgtagtgcacagaaattagacaggattgaaataacaacatacctgtgcacatctggtggaaggtaaagtccaacaggaactgggacttattggtacagtcccatctgacgcattaccctttgaacattatacccctcgacaaatatgtcgtacaccagcatttttcgtgtcatccagtacgcttcatcgcggtagcataagatgcttactccatgtggtgcacgcaaaatggcctcttcgttcgtgtacggagtccaccgaacttcgttttccctaaggctttcgaacgcctcggtgaagtactcgtacacattgtgcacctggattcttgcccactgtggctgcacgatcagagattgtagatttagttatgcagtaccattgaaatgacacaaatattcctttaatgcaagcatacgtaccggtccgtagcaccatcgagttccgaaggtaggacgatcatcaactgcgtcagtgtaatcatccttgtgggccacggccacgctcatgtatggacgtccgaacgagaagcgctcgtatgaccacaacatgaccaaaagtggacaccccgtgaaaatcgcctccctttgcccggtcttaatacaagcgtcgcagaaaccacggtatgtggctgcaaggatggctgatccccaggtaaactgtgtagaaggcgatatattaccttcagcaatttggcgagcaagggggattagcctggcgtccacagggttcccgtgcgagccggtgaacatgacccaaccaaacagccaaagtagataagcctcaaggtacaacgtcagttggtactcctggacatcgtcgggcatatatcgcacctaaaaaaaacaatgtgttgtcagatatgtgaatgtgaacagaatatgccttaattaaaaatattcaattacctcaaactgtgacaaccacttcaatgtggggccatgagtttctttttcagagaaaaatattttgtcctcatcatcgtctgtatcaccggtagcgtaccgtgacaaaatacaggcatatcgtgatacaatatcatctctccaatcttccggagggtccggaagtacaattgcctggccggctagtggcagccccgtgagcattgacacatcctgcaaagttatggtcatttcaccgcacggtagatggaatgtatgtgtctctggcctccacctatcaaccagtgccataagtagggacttgtcgatattttggcgtcgtttgctatgtgcccccattagtttttgtttaggttctcttgcgtcgtaatgcatccttgcctgcgtcatctgcacgaaggtaagaagacctgcagctgacaacctatgaggaaatttattagtcacattaggcaatgttatagtacgatatcatgatgttgcaaactttaaccatttatgcacctcgccttccatcgtcgatcaatcccctaccatccggctgtacgcggtatcaggacagctagactagagcaagaattcccatcatatatcttctttgcacgatgccgtgcatcgatctctttgctaagcaacgggtaaggccactcctcttccatatctgcatgtacatcatgaaggataaattagaaatttcatcaagtgcacatacggaagagtacataatgtatgaaattaaggaacaaaatttcctcatagtacaagtacaaactcgagcaatatcattaaaaccgccattacaaaaataggattacatacttggtaacaccttacaataaaatattacaacattatcataataaaataaatattacacgtaataaatgactaacatattaaaaccttattgaaataactgtcatgcaacgttacaaactaataggattacaaacgttacaattgtcatccaacgaacatttcatgaccgaacataaataactggacagtgtaggttataactactgcatgtttccttcctccctatcgtgagcaccttgagagccccttctattcctcctcgcacgttgttgcctaggttccacgggtgaagatgtaccctccttgttattcttgcaatctctagtgcggtgcccgtactgaagacattcctcacatcgcctcacaggccctcccgcttcggatgcatccatatcatttcttaagcgccgtgtttgtcttctacccttaccagccttcaacaaatccaagtctggcacatagatcctgttatcacccccagttttgactaggtgttggagggacctccacccgaggatctcagcactccatgcattcagaactctatcctttaggtagaacgtcgacacgtacgatgttgaatctagcttaattttagcgcatgcagccaggacatggctacatggcttatgaagaagcttcggcttattgcaagagcacgaacatgtgttatcagattcgtgccctagagtaacttcataagtgatgaccccagtagaagatccaaaaccccccttagtgcgacatgtgacttcccaccttcgtctaacgttcccagtggtaatgaccgtgtgaaatctggccttgttagccttctcttggaggtactctgccatctttttacagaaaggtgtttgtgtgttagacatttgttgcaacgccgcggcccgcctcgtcctcatccacatcgttgtcctgtgcataatgccttcaacaatagcagtcagaggcaaaggccttaatttgcgaagaaccgcattgtacgcctctgcaagattagtggtcattatgccatgcctagccccattagtgtcatgcaggagtgcccacttatcattcggcttgcactcaatccaatgggtaaaacattttatattctttgatgaccgacgcttctttccatttgatggaataagatcatccattggttccagggcctgggggacatgtacatccttcgggttgttgttcgtctgctttgaccgggtatgtgtccttgtcgcctcgtcaagttgtttccaaagctcatcgaactttgtggactgatttgtcttgcacaaccgcttgaacatgttcatcagccgccggctgttgaattgtttgaaaaaattggctcccatgtgccgcatgcaccaacggctgtgcatgtcaggccagtagtatgcaccatcaccatcctcctggagctctttgattgccttcaacagaccggcattccggtcatggatgatgcatatcgatgtgcgtttttgcaccactccccactttagatgttgcaagaaccaaaccagctttcgtagttctcgctttcaacaaaagcaagagctactggaattatctggttgttcgcatccgcaccaacggctgttaatatctggcctcggtacttcccagttaggaaagtaccgtcgacacacagcaccggcctcgagcactggaacgcatgaatgcatgctccgaatgcaaagaatgctcattgcatcacaagataatttggaggacgaattgactcccgatcctgcacagcaacataggtcccagggttcctgctctttagaatgttaagcatctacggcagagtgtcatatgcttcctcaaatgtcccatatcttttctccatggccttctgcttcgccctccaagccttgtcgtaactaattatgtattgttcacctttctccaccagttttattatgtgccgcacaggcaggtcatcaccttcaataatttccttgtagtacttgttcgcgacgtatgccgcggtcaggttgcggtgcgactccctagtgttccgaatcagacaggagtgttcgtgcagttttgacacaatccagtaagactcgtactttggcacgtgaccatgaagacggaaggtgcaaccttccgtctcacagacgaccgtgtactcagtcttgttagacttcacaaccctgaactgcctttgcgtcttgaatgaccatgacttcactgcatcttgcagccccgttttatcacagaacattgcacccagattgatttggccattcccgtagaaccatattgaatcatgacaagagttttctgcaatataaccagggtcttcttggttccacgaagcaggcataggtacttcctcaacttgttgttcatcttcgtcatcattctcttcagcagcgaggttttcctcatcttcgattgcatgtcagtccaccctctcaatttctttgactatagcaagtatgtcctcccctttatcggcttcaccagtaggatggtggttgaccacttcatctccttgtatggatagattttgaatgtcaggaccaacatccccaccacgatgggaagctacaacttcatcttcttcatgtgaactagaccccaactcctcacggttgctggattgccccgctgcgctctccgtggggactcttccttgacatgcttgcaccagcatgacatattcatatccccgtctcctacagccagcgagccaatcctgccaggccttactccgtgtcacattttttaactcccatcttatgttgttggccgatcggctccacataaccctcacgttaacactatatatacccgaatctaaagaaaatgtgcacgttagccagtacctaacttcgggcatggtaagggtgtcaggatttggatggtgtagtgtgcattgcctaaagttgctcagatcgacaccactttcattttccagaatttcaccttcaccgaaatacactataaatgccgacattcctgccattgcagacaacacggactagtccgtaaggaagtctaatagaataaacgtgtcctattcgcgaccaaaattagtttacacgcatactgtttttttgataaaaaattctttataaataactacttatttatatttccatattatttataaaaaaaatcatgtacttctaataaaaaatttataaaaaaataattacgtaaacataaattatttacttacgaatacatgacaatgcaattcattatttataattttaccacaactttgacataaaaaatatacacatgacaataaaaataatacatattaattaattaaaaaaacgtaattaaacataactatggcaattaatttatggcaattaatttaagtaacagagtatgtaatactcaaaacaacacaaccataccatatcgtacaaataaatatgatgacgaaataattaccttcggttatcagataacgcctactcccttttaaccagcttgctcgtataacaattgctgcctcaaagtttagttcactgcataatccatatgtttaactaacaaattaattatacatatcaattaattttaatacaacaaatgactacttgcaccgaagaaacattgacggaagctaagttaaaaatcatttttgttagctctttctgttctttatctaggacaatgacactcattgagccgcatcatgttctttgctacggacggtttgtacctacttggatatgacatccgaaacaatactactactgcaaatttggatgagtacatttattatattactactttaactataaattatctaacggacaactttacttaaatacaaaatatttgtaactatctgttagtacaaaactttttgcagcgacataaatttatttaactgcactttaattacaataccaaataaattacaaactgtctattaattacgaactgtcttccattatattaccataccttgttgtcttgccttcttcttttgaaccaatgtgctcttataaaaatcccaatttcgaagttcttcgtaattattgcatttatttgttcgttcgtaacaacctacaatgtaaagcacgtgtttaagcacaccatatatatgcacagctacttaacgaatatttataccttttccatttcttacaaaataaataaatgcatgaaatagtaagtaattgtaacttaaaattactacaaattaattacaactttaatttttgtaccacatttaataattatcaatactattaatatcaatatcaataactacgaatacaactattaatattttagtttttttcatttcttacatataatattgctcgtatatataaaattaaacatcacatgaactactaattaattataacttataattactactacgtacaaattaattctaacttatattatacatttaacctgaatagactctattaactttctacatttctattttcacatacgacctaacaaaatataatgtagttatacctaatacagacattagtttttctctgacataactacaaataaatattaactacgtgaactaacaatttagaaatcctcgtcgtacgaatttatgctaatagaaaactaatcaacttacgtgttttattttccttctctccactgcatgcactgcctcctctcctcttgctcttcctctcctcagttcactcccttctgtctttgctgtgtgaggaccatctcctctcctctcaatttaagcccgtgagggcattggattccaacgctagcggttacaaatggccggcatgatgtgactacaacagtaaatcgataagacaatgcacagagctcttccacctctccctaaagctaacccgtgcaaaaagcaaaaatcaaatagggatgggaaagaaaggcgttggtggagaaaagcggcgacgctctcgcgcatgcggagcgcgataccgaggcggtctcgcgcatgcgtaccgtgataccgcgcctgctgccgcgaccggcgcgcgcaaagcgcgacaccgctttcggtctcgcgccctaaaagcgcgacagcgctgccccacctcgctcctcgctctcgcgcacgcggaaggcgaagccgctttcggtctcgcgccctcaaagcgcgacagcgctgccccacctcgctcctcgctctcgcgctcgcgtatagcgataccgctttcggtctcgcgctcccaaagcgcgacgccgcgggcccactgcccttccccaggatttctctccctcgcgcatgccgcgtcagcactctcgcgcgcgcaaagcgcgataccgcgtgcccacgtcttccctgtcgcgtcataatcggtctcgcggttacatataacgaaaccggcctcggtctcgcgtaaccaaagtgcgagaacgatggctccgcccgaggtagtcgtggggatttctccacgtggcgctctcgcccctggaaaaggcgataccgctatggtctcgcggctcgcttgtgcgagagcgccagcttaacttcgctatcgctttttccgatcgcgatttcgcttcgctctcgcactttcaaagagcgaacatcggtatcgctattccaaaaagcgataccaatggtttatttccacaaatcgttcgctatagagtatatttttgcacaatcaatccataaacagtataatttcaaaaaattttccagaaatatgagttcctgtgttacagtatggctaaatataataggaatatatttattaaccataaggaactcctatggtggaagaagatcagttagtgtggtgaacatgttatatttgctttcactactagaaaaatatttttttcgcaacgttacgattttatttttccaggtggattacaaaatcaccgtttgtaaaaatagctcaagaaatgcaggacctcaagtccaccgcttgcaaaaatccggcacccacgcgctacccacttccttcactcacaggttgtgttcttaccacaggtttcccaactcatctccctcgtttttcgcgcgcatacttttcaaattgctaaacggtgcgttttatgcaaaaagtttctatacgaaagttgcttaaaaaactcatattgatccatttttgaaaaaaaaagctaatacttaattaatcacgcgctaatggactgtttcgttttccgtacgcactattcctaatgggaacaagctggagcgaacacaacctaagtcctcaccccctccacccatccccccacctctcccttcactccctcaccttcatccctcccccttccctccccctttacttcctcacccctcctcttagatccagccagcgacatggaaggtggaggcaatggccacaacaaccgacggcgcggaggcgcgtggcgaccaggaggagacctggcggcatggaagacaacacagtagccggcggcacggaggacagcacagcagccagcaacgctctcctcccctcccttcctccctcccagatccggccggaggaggagagacgacggcggacggaggaggagcaccctagatctagcggtcccgagcaccgccgctgtttgatctaaaggtcttgagtcctgccgccggtcgtcttcccgctccacctcttcttcgagccgcatgccatctctggccagtcagatcgaccagcggagagcccggggtcactagattcagccggtggctcggcctcgccgtcggccgatgcggcagtgttgccctcaacgatgacagcttggtcgtggagggaggcgatgacagtggcgccggagagagggccagagagaagggtagtgattaagggagaagaagagagagcgtgagagaaggcgggggagaagaagtgaggtggggactggagacttcgagagtcatcaatgggcggtggcttttaatatggtagattcttctttacactagcggtcgcttaagaggtccgccggcaaaaatagggttatttttgcaaagtgacttcctatgcaaccgtgagcaagaatggatttttcactgacggtcctaaacccttcaccaacccttcacccctcgttacagtttcgcacgcggagatctcatgtaaccgccatcagaaaaaatagggtacagccatgaaaaaatcatttttctagtagtgaagccagatacctgcaatctgaatctgatttggaccttgagccttgtaattgtgccgtgggctaagctcaatgggtggacgccctagggctaaccctattatgtccgcaatcatatttattcaatggccatcatatattagagtcaggttttgcttagattaatccatgtcatgcattttcgccgctagtcgatttgtgaaacaccaacttcgagtgcttaatcattcatctgtaattttagttgtaatctacgttgttcttgcttgtgtttttttgattcgtatgcagggattagccttctcggcgaggttaaccaggtttcgacacggttgataaccagataaaacggggtgatgcgattgtagggttcagatcgtgttgatcgaaaaccggaccgtgtgtataagttttcgtcaaatcgatagttatctacatctcacggaagatagagggcccgttgccatcagcggctgtggaatccaatgaaaagtgctatcaaacttagagtatgtgtttacaatttggatcttgtatcatctacttgcaatcactattgtgactgtcagtagtcggtagcagctctcaccatcagatgcaaatcgaatggtccaagttttttttgaaagaaccgaatggtccaagttaacatataacactattcattgtaccgtagcaaataaatgtagcgtgggatattgctcatgatgttattgttgtataggagtggatttgaaccgttgatcacaaaaaatggacatctcaaaatgcatgcagtatttaacttgttgtgactgcactttaatccttaccatttgagttctatgggcccttccatatggacggtcaaaaaataggatgctactggtataataggagtacatgcccaattattaccttgtttacttggggaaaaattttgggtttggttatcacatcggatatacggacacatatttgaagtattaaacatagtctaataacaaaactaataacaaaacaaattacagattccgtcagaaaactgtgagacagatttattaagcctaattaatccgttattagtaaatgtttactatagcaccacattatcaaatcatggcgtaattaggcttaaaagattcgtctcgtaatttacacgcaatctgtgtaattgtttttttttctgtctacacttaatactttatacatgtatccaagcattcaatgtgacgggcgtgaacatttttgttttgggactaaacagtgccatatatactactattttttttatcacgcatattggcatctggcaagcccacaggatgatcatttgacttggccgccagttgatcccaagccaaatgtgccttttcagtttcccatacggcaatgtacgagtgcgacgcgctgcctttgcatgccgcaggcagggcgcaccccccaccacgttatcctcatgtcctgttccttccgcttccactcctccgccctacccgcagccgctgcacggctccacctctcccgcggactccggccgccaccgtcacgccgtcgcctgcacaacacattctcacccaccctttccatctccccgccctcccgtcacgccgccatcgccgccgccgccgcttctcccctcggtacgtacgtgcccaatcttgacagagagcgggttagtttagtttagtaatatctggttgcggattgctcttttctgcttctacctcgatttttgccaatccggcaggtctcgatcggcgagggacgtataggatagggaatccatgagggagggggcaagactgcgatggttaattgcttagtttggtcctatccgattgaaactgactgctggttgttcgcttcctcttcgttccgggattgcaggcgcatctcaggaggcatcggcgatggcggtgtccgcgtcggagggcgttggccagtacgatctgctgattgttgggcctggcgtgcttggccggattgtggcggagagatggcagcaggttaattattgctttttgtacccttttttttaagcattggtaccctttaccctgcttttctgctgtttctgaatatcaagaatttcattgtacattgccgacttgatgattaacatggttgaaacacataaagataatcttcagtggtgtagtgaagcaccgactagtaggattatggttatcttttccttgcttaacgatggtttctgaatggaattcctatttttgtttctaatgtgagggatggtatatatgctgaattgctgataatattttctgctttccttttctactagtaaagatgtaaaaatatgtctgatagctttgcatattttacaggagcatccaggttgcaaaatttttggtcatactgcaaccacagatcatcacagtgaattgactcaacttgggatcattccctccttgaaaggaccagctgttcagaaagttccgtacgttattttctgcgctcctccttatcggacagatgattacccaggagatctgaggtaacaaaactgtagtactcaaacgatgattcctcgtacatagcattccgttgcttctgagaaaaaaaaccaaagttcttttagtaattatgcaaatacacagctatgaattatagggcatcacttctgggattttcagaaatttttctttcaaccatctagaatagactaagtgagatcaatgaatgctatgttaatatttactgatagcagtcatatatttgttgagaagtagctgagcggtttgaaagctgacacatacttgtaatttggtcttgtgctaatattggaaccggatgtctgcttctgtagttctgtttggggagtggacacatcagtttcttgat

SEQ ID NO: 60034 - DNA, 15822 bp, Oryza sativa
ggcggtaggcgactacttccgtcaattttcaaaatgaaaaattatttttgtaaaacttttaataaaaaaaattaaaaataaaaaaaattcgagtttacagagagttcagaagttaagtagcagacacaaagcccacattttgtcgggctgaaaacaggacaacactcagcatggtttctaagagaacctgcaaacatcctcccaaaacaacattcacccaggtgaaactaagctaactatcagactaaagaagagcctaaaggagctccaagccccagattcttttttcgttttcctgcatatccaagtgttgtcaacagtagccaattcttcttgccccaggcctccatccaaactttgagcagaagatatcatttgccacctgtcttaagagcttggcacccaagagcagccttcttcgatcggcctccgctttctgcaaaatagcccaggagtccatccaatgacagacaaaaaaaataacatcagtaggatcatttggcaattttttgtcaaaacaggctttgtttcttgttttccaaatggcccaaattatagctgccacaccaacaacaatcaggttcttcattttttttcccaaatgcagagatccaagagccaaagagatggttgctgtctgacacaggatttagatcaaaagcacagtagacagtgttccagattaatttggcaatgggacattcaaaaaagaggtgctggatagtctcacttttgtcacaaaactgacagtttaaactacccttcctccaccctctcttgaacatattgtctttagttaagattcttcccctgagcaagagccagagaaaaactttaattttcagggggattttgtaattccaaacctttttcagaggtgagctggcctgttgaacacacagagccctgtaaaaagatttcacagaaaaggtcccatgttttgtcagagtccaactaagtttatctttagccccttcctgaaagtccaactccccaaatttcgatttgatcttgttacagtcatgtagcttatccccatataaggatcttctgaatttgatcacctcccagcctttctcttttatcttggctaaggtaatgtgtttagaaaaagtgatattatacaaggcagggtactggatgttcaggggtctgccccctaaccaactgtcttcccaaaacaaaatagatttcccatctccaagtttcttagtacacaaagagtagaacttatcttttatttccatcagcccctgccaaaaatgtgagtcaccaggtttgttttttttaattgacattggtttctttcttaagtatttgttttttaaaatatcttgccaccaaccctcctcattttcgagtttccagatccatttcccaagtagggctttgttcataaggtctaaatctaggactttggagtccacatagaaatacaattagaaataataaaaaatcagaattaaaaaaaagaaatattaaaatacaattctagagtccatataggaatatatataatttacaaataactaaaattggatattaaaaaaattaataactaacacgtatataaaatacaatatgaatattacacattagtagtttcgtaatttaaaattatgttgttattgtaatatattttaataatataatgtgaaaacatatatgctattatatgagagaaaatataatgatgctagccgcgcaatctgcgcaggccaacatgctagttatattattaaaggaatagaaaaaggagcatccacgttcgctctcatggcttagaaattctcacattaatcgaagaaaaagaaaaaacagagtctatataaaaatacaatttaaaaatagctgaaattcggaattaaaaaataaggaatattagaagaagagactagaatccatatagaaatacaatttagaaatagttgaaattcggaattaaaaacataagaaatattagaagaggagactagagtccatatagaaatacaattaggaaataactgaaattcggaattaaaaataaggaatattagaagtagagtacagagtccatatagaaatacaattaggaaataactgaaattcggaattaaaaataaggaatattagaagtagagtacagagtccatatagaaatacaattaggaaataatagaaattgggaattaaaaataaggaatattagaagtagagtatagagtccatataggaatttaaaactaaacgttcgctctcattgtcaaggttacggataaggtataccctctacccttggatatacgatgtataccagtatggtataccagcgtgtatacggatgttccctgtacacgttaacgaattccatacctgcgtgtatacggatgttccctgtacacattaaggaattcatcgtgtaacagaaacggagtccacggatggaaggagtcctgctcggacagaaccgggtcgttactatatcgtgtggggtccgatgtctccgagtcctacttagagaccaactgacccgcggtataaaagggacctccccgggagaacttaagccatcgaatctcaccaccaacacatcgaccacagcctacgaagccgaagcctcaggagcaaagtcgccggttgatctagtcgaatcaactcgactatgatctcatcggtatcatcgagttccattattccctttgtaatctgtgacttccatcatataatcccacaccaactggattagggctattacctgtcaaggggcctgaactagtataatccttgtcttctatttgcttgatgtcgtattatgtagatcatcgtaccagcgtaccccaataccttctatatctggtctacgggtatcccccatcgacactcatggcctagaaattctcacattaatccgagaaaaagaaaaaccagagtccatatagaaaaacaatttagaaatagatgaaattcggaattaaaaactaaggaaaattagaagaggagactagagtacatatagaaatacaatttagaaatagttgaaattcggaattaaaaactaaggaatattagaagaggagactagagtccatatagaaatacaatttacaaatagttgaaaaattcggaattaaaaaataaggaatattagaagaggagactagagttcatatataaatacaattaggaaataactgaaattcggaattaaaaataaggaatattagaagtagagtatagagtccatatagaaatacaattaggaaatagctgaaattcgagattaagaataaggaatattagaagtagagtatagagtccatatagaaatacaattaggaaataatagaaattgggaattaaaaataaggaatattagaagtagagtatagagtccatctaggaatttaaaactaactaaaatttggaataaacataataaaattaaaagtagagtttagagtccgtataaaaatacaacttataaataactaaaatttgaaattaagaaaaacatgggaagaagagtttaaaatcaatataggaatacaatttagaagtaactaaaattcgaaattaaaaattaaagaatattgaaagatgagtttagagtccacatagaaatacaataagaaataataaaaattcagaaacaaaaataaatagtattggaagaagatcatagagtctatatagaaatacaatttatagaaaattcagaataaaaaaatattaaaagatgagtctagagtccatataggaatatatataatttacaaataactaaaatttgatattaaaaataattaataactaacacgtatataaaatacaatatgaatattacacatgagtagttttgtaaagttattgcaaaatttaaaattatgctgtcattttaatatatttaaataatataatgagaaaacatatatgctattatatgagagaaaatataatgatgctagccgcgtaatctgcgcgggccaccatgctagtttaaataatatttataacactggtaaatgaataactagcgttataagctggtagtaattcttttataatcatttaggaatggtgcacgtattatatgggggtattcgtgcaagtaaatttgttactttagaagagggtattcattcgagtaaatttgttactctaggaataaatggaaaactcaacacaataaattcgttatttttgaaacgtggggatacactagaaaaactgaaaatgaaaaactaaatggtaaatattttactaaaacgtgaaaacaaaaaacctagagagaaggaaaaaaaatctggatggttaatattttattgggtcctatgatgaagcatggataagagatgttaaagagaaaaaaaacacgaaaggcggggtggtaaaaaaatgaaaaaacgcgcgaactgagaaaaggtgggatgcggagtaaaggtggggtggtaaaaaagaggaaaatcggaaggagagtgcgttgtgcggcgctcgaactaatattccgcgcgcaacacgtgaattaacgctaccgcttaatgtatttttttcagagttcacgcgctgtttgaaatttgttgtacaacgagtactagttgcttgggttcaaatttagatttaaattgcaacacttatgaattgctcaaaaggcaaatatatgtacatcaggattgagatcctctgacttaagccacatgactttgagtcactggtatgtgggtcctctttgctatggacccacatgtcagtgacggtaaagtcacctgacttagggcagaggatctcaatcctatacgacattggtagaaaacacataatacatttatctttacatcatcatatatagatgcattgtgttctatgtatattttgcacaaggaaaaaatgttcttaataataacttaatatttgaatgcacagtaatgtacgtgcattctgtcgacgggtgatacccgtagaccgatatagagggtattggggtacgttggtacaaggatctacgtaatacgacatcaagcagacaaaagacgaggattatactggttcaagccccttggtaggtaatagccctaatccagttgatgtgggattatacggtggaaaacacaagttacaaagggaacaatggaacttgagggatccggcgagatcatggtcaagttggttcgactagatcctcgcgatttggctccttgcaggctccgacttcgtaggttgtgagggttgtgttggctccgagattcgatgccccaggtcctccccggggggtcccttttatatcgctggtcaggcggtttccaagtagaactcggagataatagaccctatacaatacattgacgacccagtcttgtccgagtaggactctttccattcgtagactccgtgaaggatttccttagtgtacgcaggaagtatccgtatgcgcgtgggtataccctaccaatatgtaacgtatatcgaagggtaaagggtatgcctaacccggaaccctgacacattcaaaatgtaatgcattatttctcaccataaaaaaatgctactaccaaaattcatttgaactgcaccatagtatacacctgcattaaaacttaatacattattttcttatagaagaaaaaaatactcccagaatacatttgaattgcacagcatttatagacagatgcattcgaattgtgttattaaaaaatggattttctcaatttttatagacatacggaggcaagggcggagccagccaagcggctgcgcatgctcaccgacaaaaactccattaaatttatatgttattgaatgaattgatgatgaaatttatataacaattactagaagtgaagcttgctcaggctcaaaaatctttctagctctgccactgtgaggagagataaaatgggaataagtagtttcatcactttggttcattggaatttggaatttgtgcgcatatattcgacttccaacttatgtcgatgaattcaatgtcttgctgctttaaattaatatatgaataacagggtaaaatttcataatttcaggtattaaatagataaagaaattaggtgtacttatgagactccctacattccatattcattattatataactttttcaccaagaccaacaaaaagtattaactttcctatatttcatttaatgtgagtatgtgtgtcacgccccgaactagtcccgaccggaactagcccgtgacgctccaaattaacctgttaatcgataccagtcccaggaaacagtgctggtatcacaggaagacagaatatcacagcaacagaggtctctttattatagagtaggagtacagtcatgttgggctgcggacagatcccgagctcacaactgcattacaaaagggaagcggaagccaagacttggaccaaacatcacagacacgacttgggaactaggccgaaaccctaaaactcatcgtagccggcttgctcctggaagaactcctcgtcagcaggatccgcttcatcttcttcagcaactgggggaggggattatttatatagagcaagggtgagtacaggagtactcagcaagccatgggaaataagtgtttaatgcaggcttcaaagaaaggctgttgtttttgcgattgattttatttaaactcttttctgaaacaactaagggagtgcttctcaaatgacatggatgagacagtgcgtctcgtccggtcggagtatgtgcaatgattcagtcttttgaattgatcaagattggcacccggccaacagctttcaaacggccacccgggcctggctgatcccatcagccgcagattttccaaacatcaaacccattccacaacagcaaatttcacaaggcagtagtcaaacaaaactacgctaggaatcacctcacatccgcccatgaccgtgggcacggctgttcgaacagttttaataacctctgttgagggggtacactttacccacacgacattactaacccggatcatccagcccgtgcagaacggccacgactagagaccttaaggctttcatgacaaggcatttcgaaagccgacatgggttcaccatatgccaacgagaggggtcctagaccaacaccaggttaggtcccagaccatactgtgccaggaagcccaggggtcctccccgacaccaccccggcgaatccacatgtctcttagcatcatggctcccccgataagctagttactcagccaggggtgtcccattccacccatgtggtcgtacttgtcttatgttcggatgaaattccaaggaaacggtccttaagtgcaagagcgggaaaccgtacaccaggtacgttccccggtccgcggttttgaaaattcatttagttcgcaagcaccgacccaggtgtagggttttccaagtcttttgtaaaacccaagttttacccaagatgtttctcagattttaagtttgaaggcgaccgtcgatacctatgcagagtgcacgattaccaaggcgcaactaggtgagtacaagggaacatggtataacaattacaatagaagggtcaaatgcaacaaattaggtaggtccgccaatctgccttgcaaacgggacaagcagattaagtgtgatcctatcaatgcataatatttttcaagcaacataattaagttcaaatataggcttaagatgttcaaaggtggcttgcctcgctcgatatcttgaacttgatcctcgaaatcctcacactgcgggtcttcgggctccgaaactacacgcgaaacgggacaactaataaagccctattattgacctctaagcgtgccattagatagatcttgagatttgaggaattttggaacttgaacggagtcaaacggacttacggttgggaagatattgaatttctaagattattggatttctggtctaaaggaaaaggatttatttaaatcctttttgaaaaagaaaagaaaagaaaagaaggagggagggaaattagacttccctcgggcggctagggcgcggcccgagagaatggggcggctcggccgagcttaatgggccggccggcccaagaaggcggccaaaaggcgcgcgcgcgggcggggaggggagagagagagctggtgggccaggtccataccgcgtggtccctggtgggacccgcttgtcggcgactcggctcaccgtgagcgaggtgcacgcagggtgtgctagggtttggggagggaggcgtggcgcatgcgcgcggttcgcggaggacacggtgcggcgggcccacgcgcagcctcacggctcgcggtggaccgcgcgcgcgagggggcggagggaagcggcggaccggggtctgcttgacccggtcgcggccgaggtggcaccgacgtggcgcctacgtggctgccacgtgggccggcgggaggtagacgacgacgccggccggaacggacggtggacgacagcggcgagcggcggagcgaaccatggcgatacaggcgaaggcgagcacaccgggatgttgcacaggacgaggggagacgagccaatggctcggattcgccggagggagtccgtcggcggcggattacggcggcggcaaccggcggagagaaaagggggaaacggcgacgaggtcacgaggggccgattcccggcggtgagagcatctacgcggctacgggaatccacctcttgcgccggattaggaggaaacgcatcgaggaaggtcggcgacgagagacgcttccgagctcgggcggcgacggcggcgagcacacggcgagcgacggcagcagtcggggcggcgccagctagctgtggggaggctactcgtgctactacccgagtctaaggggaggagatggaacgaggagggagaacggagggaggcactaccgagacgaggcggggcgttgtgacgagaggccgacggcatgggagtgtcggagtgatctctccggcctcgggccggggaagaggaaggagagggtgcgacaatgtcgggttgggaaccgacctagggcggtcaagggagagggctagcgctcggcggtcgcggcccaaacggcgacagggggggaggatgacgccggcgagagggaaaagggaaaaagggggagagaaagggggcttgcccccttgccacattggggaaaagaggagagagggcgatgcgccagaggcgggggggagctctgcctctgtcccttggaagcacgcgcgaggagaggcggggccaagtcgatgacgacggcgatgacggccgggcggtttggagcggagcgacgacacgggcggtaggcgcgggcaggcgctgacggcggcagtgaccaggcggtcggccaccacggcgcgcgtgcgcgcgggaagcaacaggcggcgcggtgatttcagcggcgtcggcgggaagcggcagcgagggcagagggcgctcggctcagcgcggctcatgcgcacgcgtgagcagcgcacgggcagagtgggggagagggagagagagagagagagagagagagagatggagggggagatgggccgataggagttcggcccatcgaacccgagggaggcaaaatagacttttgcggagggatttgatttgggaaggatttggattcgggattgaactcggcaatagatcggggatttgagatctgagatggcacggacactagacaacaagcaaagtaacagattttgcaattagggtttttaagagatagttttcccgctaggcgccacgacggaacgggcgctacaatgtggtagggaaaaatcaagaaacatgcacactttagctccttctgggccccatacataagaaacgatagctttattacctcaaattcgtacaacatgcatgcaaactcaattttcatgcttaaatgcaataatattacaagtaaacgaagggtctatgattacgtgatgatcaatttgaaaattttaatttgtgttaaacgatgatccatataaaacgaatggagtattttatactagttggtccattatgcggcaaagccgcgtctattttctagtgttgacctatcttcaggggagtcctagagaagcgtcagaattgtcggtgctctctcctcgcttgtactccgcggatgcttcttttaataaagtaagtgttcgggattttcttttttatttaatttactacttaagtgagatatatattcctatcgttgcgtgtttgtcgcttagtatttatgttgagtgctttagtactaggactttgtaggaaaaaggaagttcctatacgaggctagagtaatcaataacttaggtgtgttgtctaggttagcgattacctttgtttgttgtgtgctctctgaaaagtgaggtaggtagtaggtgatgatagcgttgttcatcctttgtatccctccatatttggacacatcatagagctacatgccggactcagcttggtagactggggggagtcggtgcccgaagtaatcgatagagttttacattcaacttaagcctacttaattaaaaaccacaggaatcctccctagcctaagcctgccttctataccctcatgttttgctcagtcccttatgtacgcccgaattttagtttgaatctcttccatacacttttcattagttgaccattaaattcatataaaaaagatccaggggtatataagggaatgagtaaaattcaggggcatagaaaagattgggcaaaatttcatgggtatacaagaaattttctgtcttgaatgtagatattgtgttattctgggtatagcattataattcacgggcatgtattttaaggtatatcaggcatacgaggatatattcatctactatgttcaatgtttccatagatactttttcatttccatttctattaatggaaatggagggctctcgccctttgcaaaaaaaaaaaagatcaatgtttttatcttatgtaatttatttagttgatagatgtagtacctcccatttgattagctatctgtcatgtccgttacctacatgaaggggttgtttagttggatgccacaattttaaaggaacttgtggctacgcactttgatcaaattagataactgtttagttcattatcacgcttttgtagctcgtgtacccgcaagtcatacgcacaaaattttgccataacattgctatccttatggtcaatgaatttggtgccataaaaattattacgtgtgataaaatgtttggtaaaatggagcatcctaccaaacagctccattatattttggcaaattttgttacagcacataggaaaatgtggttttgctcgacactccctcttttgttacgaggcacaagaatgattttattattttcatccgttttggagagaatctttctgcaagagcaaaaatgtccctgctaattctcatgtagccacatttcgcaaaaaaaaaaaaacaaatctaaaacttggtaggcatatttgcgctaatcttcttgatagatggcctcgacatcaggccctcccaccaagccttcacatgagggtacgcatcaaacagcgacgcgcacggggtcgccatgaagtagaacgtgaaggggaagtggttcaggtccgcgaagctgaggaaatccccggcgaggtacctgctccccgacagccgcgcctcgtacgtctcgagcaccttcttcagcttctccaggctctcgtgaaccacctgctggttggtcgggaccccgcgcatgatggggaagatgatgcactcgaacacgatgggcgacagtgcagggtagtactggtgcgcctcgacctccgtccatacgtccaccaacgcggcctccctgatgtcgctctcccggaggagatcgactttgctcgacttgtacttgcgaagaatgtactttgcgattgcgcgcgactctgaaaaaagaggactagtaagtttgtatttgctgcaggagaagctgataagattgccgcaagtatttaacaattaacatggtcgttaattatttgggttttggtagagagctgcaggttggccatggtggccactcaccgaacaagacgaggtccccgtcctgcagagcagggatcttcccaaatggctgcagaaaaggagaggtggcatccactgtgtatcacggtggaagctgatacatacatatgaaaaattactgaaaaaaacagctggagaaattcagttacgtttcgctcgacgtgctctgggctgttctgctcgccggcgaggaagtcgacggtcactagctcgtagtcggcgccgacctcctccaggcagaccagcacccgcgacacgttcgtcgagatggcccggccaaacaccttcaccggcgacatgccttctttcttttttttcctttgtcctcactgcagcttgaagatgacactgcaagtgcagtgaagacgatgacccactgtagcgcggatgcaaggccttggcagagtgcccttcacttatataaagcgtagcgtcagaagaagcccaactgcccaagtagtcatcttcaagtcttcgttgaaattgtaaaaatcactcgacaattttcgtgcaaagagggaaaaaatgtcagtggcgtgcatggaggagggaaaaaaagagggaaaattttggaacaaatttatatgcaatttatataagatcaatgtgtgttttgattcttattctgtgatgaacaattggcatttgtgattattggttttgatatttgaagattatcgtcgaagtggttttgtagataatcaattttcaggtgatgatcggattcactgttattttatgtgaccggtccgaccgggcggaggttgccggtcagaccggtgctatgtgtgcggtcagaccggccaggcccgcggtctgaccggccgacgctgtgtcggtttcggtttcgggttgtttctttggatatccgtgattatttcatggttatggcttctagatggatactatacgtatgtaatactgatgtttgctaacaatgagtcaagttggggatagcttggtctcggaatatggtttctctgtttgtttcatatgtaggtgactcgatgtctcgggagagtattgcggtgatggaccgggagtcagcttggtggtaagacgatgtccgtggtggtcagatatcatgcgggatactaaggctagagttgatgcacgtggttgatggagattccatatggcatacgatggaggtattgtgtgcgtatgggatgcagagtcgaatttggaaggacaccaaatttgatatgattggttatgtaaagtttgtgtcttgtactagagggtttcctaaggtattttggactcttagtatgagtttggttcgtgctttaggctgcctacctcatgtataaatagagggggagcatgaggcctcccggtatcgctttttgtatcggtttttgagagcaatagagttgctagtttagttagggtttcgagtttagtcgagatttttgtaaggagtgctgttggtgcactttgtaaacacagagagaagcaataaagttttcatctactttgagagttcttcgatttgtgtttcactgggtttcggcggtctaactggcaacactccggcggtcagaccggcggcaaggcagcggtcagaccggcgggtgacctgcggtcagaccggcggcggcaactggagctggcgattgatctcggtggttcgaccactgttacaaccttagtcagaccgacgatatccaggtggtcagatcgatgcatctacttcggtcagaccgcgatccgtcgatttcgagggtaacttttatttccgctaaaagttttcggtttttggttataccaaccattcaccccctctggttggctttgttcttgtgattcgatcctacaagtggtatcagagccacgtttgctcttttcgatctttactgatcttgagtttttgtcatggctacttctaataagtttacaactaagcctcatgttttcgatggaacggatttttctcattggtgtagtaggatgcaatcttacattatggctgagaattatgatatttggagaaaagtttctcatccttatgtgattcctgaagttattaatactgctactgcaaaaactgagtttgaactaaattgcaaagctcgcaatattcttttgagtgggatttctcgttcggattatgatcgtgttgctcatcttcaaactgcttatgagatttagactgctttgagtaatttttatcaaggaacaaataatattaaagaacttcgtcgtgatcttttcaaaaaggagtatattaaatttgagatgaaacctggagaagctttggatgactatctttcttggtttaataaaattttgagtgatcttagatctgttgattcttcttatgatgccaattatccacaatctgagatttctcgccactttttgaatggtcttgacatgtctatttgggagatgaaagttacatctattcaagagtcagttgatatgtctactttgactttggattcgctttacacaaaactgaaaactcatgagatgaatattcttgctcgtaaagttgattctaagtctagtgctttggtttcttcctcgacttctttggatgttggtgcttcttcatcgaagtcttctgatcttgctttatttaatgccgtgtccgatgatcaactcgaacagttcgaggaggaggacttggttttgttatctaccaaaatttctcgagctatgaaaaatgttaggaacaggaaaagaggtgaaccaaatcgttgttttgagtgtggtgcacttgatcatattcgctcgcattgtcctaagcttgggagaggcaagaaggaagatgattgtaaagtcaaagatgatgacgtgaagaagaagaagagcatgaaggagaaggagaagaagaagcattgcatgcagtggttaatccaagaactcataaaagttttttatgaattggaagatgaagatgagggcaaaggtaagcaagttgttgatctagcttttattgcttgtaatgcaagttctgatgttgatgaatctgatgatgataatgaagaaaatcttagttatgatcaattcttgctgcttacaaatttgctaagaaacttcaaacatgttctattgtgcttgatgagaaggatcgcactattgagattctaaatgctgaaatttctagattaaaatctttgattcctaatgatgataattgtcaatcttgtgatgttttattttctgaaattaatgctttgcgagatgtcaattcggttaattgcaaaaaattaaaatttgagattgaaaaatataaaaagttggagtcttcttttgctcttggatttgctttacatgctcgtgttgttgatgagttgattttgacaaagatcgttttgaaaaaataaaaagttgctttctgtgcaagttctttggtcaatgcttcatgtgcaaataaggcaaaacaaaacaatggtattttgatttctcaagattgttcaaagtgtgttttgaatgagatgaagttgaaaagatgctttagggcgtgttaaacacatataagatcaatgtgtgttttgattcttattatgtgatgaacaattggcatccgtgattattggttttgatatttggagattatcgtcgaagtggttttgtagataatcaattttcaggtgatgatcggattcactgttattttatgtgaccggtccaaccgggcggaggttgccggtcagaccggtgctatgtgtgcggtcagaccggccaggcccgcggtctgaccggccgacgccgtgtcggtttcggtttcgggttgtttctttggatatcccggattggttcatgggtatggcttctagatggatactatacgtatgtaatactggtgattgcgtaacaatga

SEQ ID NO: 60035 - DNA, 1771 bp, Oryza sativa
atcccctaagtaaaataatcgatgcgcacagttttgcctggtctcctgctgttctactggtgcgtcccacctagtcaaatatacaaatctttgacattaattgatatctaaatttttcatgtatggcattagctgctagcaacatactccctctgttacccctcctaggttgtatttttttaggacggaaggagtaggtagctagttgacgtgactgtactagagaaagagaaccaacatgtaggtgtgctttcatgcattagtccagcatgcatgcatgtagccacggccaaataactagccactgaaagtactaacctttacactaatatatctactaaaactactataaaacatcaaataggtgtcggcactgtaggtgccggttttactaaaaccggtacctataagccttttcccacctccgtggtccgaaaacataaaaaaggcatctttaagatgttataggtgttggttctatgaaaaaaacacctataataaattaaaggtgtcggtttttttaaaaaagctggcccctttctgatcgagccatgagccgagccgcctgaggagcggataaggaaaagcgcctcggtctcatcgagcagataagggagactgcgcctttctcacgcgtctctctctctctctctcggtctcttctcttcctttctcttctccaccacatacctcctcttctcttctcttcctcctctctttctcctctcccggtggcaggaagagcggcaggaggagcggcgacatcggtattggcattgtcagcagctgcagggaggagaggcgtgcggcggcgtcggcgtcgtcaacgtgcagcgggaggagcggcggccgcccggaagtatctaaaagtaccctatttctatcgagaaagtatctcacagttcatttacataaagactaacccattaccccaaacataaatcacttatccatctactccgtagctagacatcagaagttcgtactatccatagaactagccatatgctcgtaaaaaaccaaaggacaaggttctatgcatcaccgaaggcttctactagctctactgctctccatctcccatgccccttgtcacagcaagagtagaaagagttatactgatggtgtaagtatagtatagggtcaagtataggctttatatagggcagtttccttcagcctaaaggagaacatatgtcccagattcatgatgagctggataggtagataggtttccccctctctcgtcctcacctcaagagtggttgatcctatccatttcatcaatacacagatatatttgtctgtcttcctctccaaaataattcaagagttaaaacagattgtacatagttaaatgtcatgtatagtactattccttattattattattattattattattattattattattattattattattattattatattcttgttgtttattaatgggtggatttgggttggacatgatcctatgcttaatgcacaggctcgtaaagtccaattcaattgcacagtgtggaagacaacccatcaaataacttttcgagcagagtgtgagtaaagagtccacgcaatccagtgagaacacaatggctaaatataactatgtgtgcatcattgttatttatatgattttttatgattgcttctatgatttaaatactttttctaaaaaatcaacaattaaatattatgaattatatgtaaggatgatccactttttcaacggtttgtacactagaacaaattatgttcatct

SEQ ID NO: 60036 - DNA, 12481 bp, Oryza sativa
  unsure (1)..(12481): unsure at all n locations
ccgccgaatggtgtttccgcttgcacggctggcctttaatgccgccgttgttgggcgtatacgtcttcacagaccggccgcctcgtccgccgcagattggtgcttccgcctgcacggctggcctattatgccgccgttgttgggcgtctacgtcttcaccgaccggcttgcattcaccgccgccgactggtgtttccgcctgcacggctggcctttatgccgccgttgttgggcgtctacgtcttcaccgaccggcttgccttcgccgctgccgactggtgtttccgcctgcacggctggcctttatgccgcaattgttgggcgtctacgtcttcaccgaccggcttgccttcgccgccgccgactggtgtttccgcctgcacggctggcctttatgccgccgttgttgggcgtctacgtcttcaccgaccggccgcctcgtccgccgccgactggtgcttccgcctgcacgtctggcctattatgccgccgttgttgggcgtctacgtcgtcaccgaccggccacctcgaccgccgccgactggtgtttccgcctgcacggctggcctattattctgccgttgttgggcgtctacgtcttcaccgaccggcttgccttcgccgccgccgactggtgtttccgcctgcacggctggcctttatgccgccgttgttgggcgtctacgtcttcaccgaccggcttgccttcgccgccgccgactggtgtttccgcctgcacggctggcctttatgccgccgttgttgggcgtctacgtcttcaccgaccggccgcctcgtccgccgccgactggtgtttccgcctgcacggctggcctttatgccgccgttgttgggcgtctacgtcttcaccgaccggcttgccttcgccgccgccgactggtgtttccgcctgcacggctggcctttatgccgccgttgttgggcgtctacgtcttcaccgaccggccgcctcgtccgccgccgactggtgcttccgcctgcacggctggcctattatgccgccgttgttgggcgtctacgtcttcaccgaccggcttgccttcgccgccgccgactggtgtttccgcctgcacggctggcctttatgctgccgttgttgggcgtctacgtcttcaccgaccggcttgccttcgccgctgccgactggtgtttccgcctgcacggctggcctttatgccgcaattgttgggcgtctacgtcttcaccgaccggcttgccttcgccgccgccgactggtgtttccgcctgcacggctggcctttatgccgccgttgttgggcgtctacgtcttcaccgaccggccgcctcgtccgccgccgactggtgcttccgcctgcacgtctggcctattatgccgccgttgttgggcgtctacgtcgtcaccgaccggccacctcgaccgccgccgactggtgtttccgcctgcacggctggcctattattctgccgttgttgggcgtctacgtcttcaccgaccggcttgccttcgccgccgccgactggtgtttccgcctgcacggctggcctttatgccgccgttgttgggcgtctacgtcttcaccgaccggcttgccttcgccgccgccgactggtgtttccgcctgcatggctggcctttatgccgccgttgttgggcgtctacgtcttcaccgaccggccgcctcgaccgccgctgactggtgtcaccgcctgcacggctggcctgttataacgccaactgatgctatcttcttcacggctggctacatcgctgtcactactaataggcatcagtatcttcaacacaagctgcctacgtttgccatggctgccgactggtttcttcacttccatggctgcatgattctgccagtgttgattggcctattatgcagctgttgttgggcatctacatcttcatcgccggtcgtctcgtctgctgctgactagtgcccttacctctacgtctggtttatacagctaccactactgatggacatcatcatcttccgtcgccgactgattatgctgccgccgattggtgcttttatcttcacaactacgcgtcttcactaccggtttgcttctgttgccgccgacttgtgttcacttcattacggcaatacaactttgtcatcatggtggagcgacttcatctttattatcttcggcaccggcaaactctattgctgctacttcgcaagttttactacttcaccaaccacgacgtctttgtgaacctcgacatctcggcatgcaatgccatgatattttactacaacaagtgactctccaatattcaagatttctacttggacaccttcaacacatatcttcaatcaagcaatgactactcgacgacaagaagctataattctcgactctatgttcagttgtttctcaactaaccaaagagtcgggggctacacaaatataaggctcaaaatttgacaaattttatgtcaagctgaagaaatcaattaatcagccaatgagtcaactccaggagtcattatcttcatctttgcttcggaacagacattctacttcaacaacttcaaatatttcggtttagacgagttgggcaacaacatcaactctcctccaattatttgtcttcacggttggcctactacgcaactgccgatagaggatctcatcgttatcatcggctgctacatcgctattgactggatcaccgacatcgtcatcttcatcaacatcttgttaagcctcttcaacatagcctactctgctgccgttgatgggaaacttcgtcatcatagtcggctatctctgttgccgctaatcatcattaccgtcggatgcgtttgtcgccgccgattattttcttcatcttcatgattggtggatttcgccatcaccgttgatgcgcgtctacgtcttcatcgtcggtttgcttttgtcaccaccgactgttcttttgttgttgttgttgggcgcctacatcttcactgctagctgacctgactgttgccgactggtttctccgcctccatggttatgcaacttcattacctttgattggtgtcactgtttttactaccactgacatcttccgttacttctgatgagcaatttcgtcttcatgttggtcatttcatctccatgccgactgcgtcagctattgccaatagacaattttgactatgacagaaggacaagctatatgctcaggggctcatcaactcaagcgtgaggattatatctccaatttggacttgttccggatacattccacatggattcatagtcatgagtctattttctatgctcaaagactggaccaattattattccccgtaagggctatcaaccgaatacttgcgccagtcgggattcaattattatatatattttggagtatctcataagggataatcactcagatcagaagctattcatatgagctacacctggtctatatcacccggaagatttattactcgagagcatgttacatgcgtcatcctttaaagggtgtcgaaggcatattttttggtctaggcctaatatgtctgcagcccatattttcaggtgtggcctgtcacgttcttttagggacttaggcacttttcgcttaggccaaagtgcgcgtgatcaagtgcccaataccttaaaatccttttataccgcagttactcaactttttaggagttggtacaatgcatcttaaaaggtgtcaaacagtaaagctttatatagctggcccgctgacttttttatatataagtcaaggtgctgtttgggtttttaagcaattgattagatacaatatcattgcttttcgccacgtaagtgtgcatttttattgaccaatattatggcttaggctgattatatattgtggtcatttttcaggcggttggtaaatcctttatgagtttatttacttggattttataccacatatgccatatatttccgggtgtggtgaaaccatgtgtcttttagggacttaagcacatctgttaaagcagtgtgcgcatggcgtatgcccaatactttggaaatttctttattcacaatatataagcttctttatagctgttttgctatgtgaattttcaatgatgtaaccaactttaggttacactcatcatattttacaaagcagtcggtatatcactcggatcatgttattcagggattcacaccgcatatgctacatattaatatcaggtcgcttggttgactataattattaaaaccactcggttggttggattatttattccttgactatatgcttggtttgttcaattaaccacatagtcgggggctacacctattaggtgcatctagtcgatgcacctgactttatttttcagccctccacagtcttcgtatttggtaaaagtacttcggagaccatggcgaagatgattgaagcactcagctttggagtaatctagttcgagagaagattatcttttcgactgtgaaggtctcaggggctactgtggagattatgggtaccccatacctacatggcatagttatccgactggctataggggataacttatatctatggaatatgtaacagatcatgacttgggtattacgtttccctgtatattatgaaacggcctaaagtcctggtttgataagattgtaaagtagatttaggaaaccgataccccgtattggttaaggtttctatcttgtaaccctgccccccaacctatataaggagggcagggagcccctctaggggcatgatgagacaacctgatcgtcagatcaatacatactcggcggattcaaatccccaaacaggagtagggtattacctctcattgagagggcctgacctgtctaaatcctttgtctccacatccatccacttttaggttctcgtgcgctaccnccgttttattattgccgaattcatgtttcgacactatgtcatgacgatgatattagagtagtatctggtagtttaggcgtggtgtctagattacgggatatcattatttggagttatatattgcggatgagaggtgggccgctgatggtgacagctcagtacgggtattcctccacgccggtatataatcctaagttaatttcctagggagggtattcctccatatttagccccggttgtatggtcatgacgggctgtcgtaaggaactcggcagtcaggggtggcttctcgaagtaccaggaggacatcggatagagggtattagctagtatatcggttaactagaatgtatgtatactatgtatattagaagtataggaatagattttcttcctcttttctatctacttagcttagatgatatattatgagaatgagtagtgaatgattgtgtgtcactctacccttggattatcttaacccctgcttagaatatgatcatcacaagtaatgtataaattattagtcaatgttccctctacatgatcttctcacgagataaaataaatacgatacccttggaatactctcgggtgaaatgctacaatggtatatctatgcgcttgcggatgaactctgtaaccataatatatcagaagtatttctgcgccattgctgggtattatatttctagtaatgttattaagaaataccaataagcatttctggcgccattgccggggattatatttctagtaatgtcgttaagaaatatcaacaagcatttctggcgccgttgccggggaagattcataatagagattacttgaacttatactttatatttacctctgtataatcattttcctttgcaggctaaccttggttgttttcactttttgttgtgcaaacagggtagtgcatgactggtttcaacttgccggaaaacttcaaagaaaatccagaagctttcttccggagtgtcaggccacgagtcgctgctccgcagaaaactctaccgacagagaaatcagccgtaccagcgccaccgaccttcaagactatggcaaacaagactctccgcgaattcactgctccctctgctgacaatgtggccattgggccgcagatcaacatgggagacgtggatttcgacttgaagtccagcctcatcatgatggcgcaggctagcccgttctgtggcaagcctaatgaggatgccaatgctcatctgcaatagttcctggagatctgtagcaaacaagactctccgcgaattcgctgctccctctgctgacaatgtggccattgggccgcagatcaacatgggagacgtggatttcgacttgaagtccagcctcatcatgatggcgcaggctagcccattctgtggcaagcctaatgaggatgccaatgctcatctgcaatagttcctggagatctgtagcacgtacaccatcaagggcgtcagtccagacgccgttaggctaaggctgtttccgttctcccttctcgggagagcgaagcagtggttttatgccaaccgtgctgctgtcaacacctgggacaaatactctacggcattcctctcgaaattcttcccgatgggcaaaaccaatgcccttcgtagaaggattttaagtttccagcagacaagagatgagtctattcctgaagtatgggaacgactgcaggagtacatggccgcatgtcctcatcatgggatggacgactggctgatcctgcagaacttttacaatggactcaccccgatgtcccgcgatcaccttgacgcggcagctggaggagctttcttctctaaaacagttcaaggaaccattgatttaatagagaagatggtctccaatatgggttggagcgaggaacgactccagacccatcagcgaggcatgcacgccgtcaaggagacggagttacttgctgccaagctggacctcctcatgaaacgtttggacgaccacgagaaacggccacaaggcaccgtcaaggcgttggactcacacgttatgtgtgaggtctgcggcggcacgggtcattctgggaatgattgcctagaaacccgtgaggaggcgatgtagatgggcaacaacaacgggtaccgtccacaaggaggtcaggggtggaaccaaccacgcccatattatcaaggaggtaacaacaacagtaatttttctagccaggcctccttgaaggatctcgtttttgcgcaatctaaaaccactgatgcgttaagcaaaaagcttgcggccaatgataagatcctagataacattaatgtcaaattagatggctttgcttctgctttttaaaatcagctgagctttaacaaaatgatagaaacctagctagctcagttggcatccttagtccctgcaaatgaaactgggaggattccggggcaacccgactcctccattgaaaatgtcaaggcgatcacgatgaggggaggtaagtctactcgtgatccgccgtatcctaaccctgcaggaactagtgggatatcaaaagaagcgccatctaatgactcggctgacaaggaagttcaaccagaaaagtcagtgccgcaggagtattgtgacacacggttgctgccgttccctcaacggagtaggaaaccgtcggtggacgagcaattcgctcgttttgttaaagtaatctagaagatccacatcaacgtgccgttgttggacgctatgcaagtgccaacatacgcccgttatctcaaggatatactcaacaacaagagaccgctcctaacaacggaggtggtcaagctgatagaacaatgcagcaacttgatactccacaagctcctagaaaagaagaaagatccggggtgtcctacgatcatatgctcgatcggggcacaacaattcgaccaggccttgtgcgaccttggagctagtgtcagcgtcatgccgaaagacgtcttcgacaagctcaacttcacggtgttggcaccaacaccgatgcgccttcaactggctgactcgtcagtccgttacccagtagggatagcggaggatgtgccagtcaagatacgggatttcttcatcacggttgacttcgtggtactggacatggacacgggaaaagaaacgccggtcatcctggggcgtccgttccttagtaccgcagtagccaacattgacgtgggaacagggagtatccgttttcatattaacgggaaggaggaaaagtttgagtttcaaccgaggacagaacaatgctccgtggtcagaatcaagtacgggccaaacccgtagaatattcaagtggtcgaagtggagccacccaaaatggacagcctggtgaaattcatgcagaatttcctagagaaggaaataacgatgcccaagcaccgttattggaagacgccggtaaaaccacccataccggccaagaagttagagcagccggctcagaagaagccgtcttccgcaccaaagccgaagaaggtgtggaaggaaaagccaaagacgcccgctccatcacccccgaagatgggtggaactaaatcagaaggaggtatggtcttgcacgtcggactttaaatgacgcgagcttcgccaacaggtaaattggtatgtatccgcaaattttctttcaacaatttgaatttttgcatcaacatatgtttgaacttcaaaattgcatttatgaattttgaggaaattcttcaaatgaatctttcaaagcaaaccaaaataaaattttcaatgtaaatttgctgtgccacgaccacactgaccgttggaatccaacggccaaaagtggggccggttgggcccaccaggggttcggccgaaccagtgactggccaggccaacggtcggctgcctctctttttgaggcaatggttagtgggccccacaggtcagttttgatcgttgtgggtgcacttcttaagccaaccggccgggagagggaactccaccctgtttaaacacattttcattccctctccaaagtttgctctcaagttcaatcaagctttgatggtttccctcaaattcaaatacttagttgcatatatacaagttgcttgggtgaaactaaccggcgggtgaaattcttgtcattcctaattaacccccgccgagttagtccgttcttgttccattgtgcagaatgaggaggcgactgtctcgtctgttcaaggggtccggctcttcatcaagtcatcatgacgagtctagtactcgttcatcagcagatgtctcgatggaagatgccgaagctctgaggcgactcctaaacgacaccgacctcgaacttgtcagtgatcgggagagacaaacctactacatgctgagcgaccaggagtatgctcacacgcgagagtactcaccggagctgctaaaaaagataggtatggatgttgagtttcactctatttggaaagctgttgattggtagagatttgctgtggtagatgagcctggttctcgtctgcttactttgcaatttctgtacactttgaaagaaatagaagatggtatttcctctcgctttttccgtgaggagttcacacttacatggaaaggcttaagtacacttcttggttttcacgattcctgtaaaatcgatatccagaaaggaatttctgggttcgagaaaaataggttttaggaagatatttctggtggtccaatttgcaagaaacctaggacgaatgatatccataatcctacacttaggctcatgcacaaatggattgctatgactttgtttccttgaggtgatcttagacccattaggggagatgaattgattatcattgtcggtgacatggggccgggggtatcgtgactagaggcttgggtagccgcgatcactcacgtggcccgaccccctcgggggggtcgggcccgacggtgacgtggccacctctccctctgtctccccgaggggtcgggccgctcccatttcgcgcccagggctggggcaccccgaccccctgtggtgattggcgccacgtgtgtgggttaggtgagcacagcggcactcacctaaccgcatttatagcgggttagacgagcgcatcacgccgcattcaatgcggcgcagcgcatgcttatccggtctgtgaccagtcgcggtatgtgaccggtcacagaccggtcagatcgcgggttatgtggcaacaggcggcctgtcgcacgcctcaccccgtcccgtcggaatgatgagagcttcctggttctcgtctctagccggagctggcatgctgactcctggagttggtatgtcagtcccggtcagatccattccaggcttcagtgcaagcatggcaagaaaatcgctggccattgaatgaaggatgaaacgggcgtccaccgggagagctgacgaccggagcaggaggcgtgtgtactgcttgtcagaggtcatttccggctgtagattagccctcattgtaaaaagcatgtttcttttcttaggcagagagaggcccatgtggtgatccctaaccagataaaaaaaggaggctcaggcctaaggagagaaaaaagggggggaggtgagaggctggcgacttgatcggagagcctgaactctctctcgctctcgagctctctggctctggagctctcggttttccttcacacacagatccaccagaacacaggagtagggtattacgcttctcagcggcccgaacctgtctacgtggcccgtgtcttgtgcgctttttctcgctgacattcctcatatcgagggcgaagaacctcacttagcgcccccggccgaaccggcaaaggggggcctgcgcggtctcccggtgaggagccccacgctccgtcaatcatgtttgccacggttagaaaaattaaaattactcctgtgaaatgtatgataaggcaatggttagaaagtataaagttctctgctcctgttgagtgcacttctttgattacttggatagcaaaagggctaggggtcgttagcaaccaaattgcttttatctcagccgctcgtccgtgtattgatgaggcttatctagcgcaaggcaatattctgaaacatggagtagatggatctttgatttactttttacccagttgtacaaatgaaatcccgttgccaaccgtatagatgtatgaggcaggttgggcaccaaccgaggatgcacccggatggacctaagctccacgccatagcatcggagtctcaacttgggcaagtgccagtgaggaccggtggcatgcgcctcatgacatccaatggggggacaatcaacctcccagatcatgtggtgtgcctccatctctaagtgaatggtgctcaagttcctctcgttgggacttgggtgaaatcactaggagaatggacacccttgatgtgcagacaggggagatccagtacaacctcacggaacacatagctcaaacgtaagaatggcaacaatctgctgatgctcagttcaccacatcaacatgatgcagcaacagcacgatgacctacaagcgtactttcgctttcaggggttcaatccttatcaaggaccctgagcgaaagccaagcttggggggatatacctctccctccactaaggtaacttgtatcacattgtatatttccctttccaattgcatatttgctttccacttgcatcttataaaacttgaaaacaatataaaaatttgcaaaatagaaaataccaaaaagataggataggtttaagtcatgctaggtaagacaagctagttctcttcgttgaaatgatgaatagttgctctgttctatatctctgatatatgggttcttggtaaatgctctctcaaaggttaaatattagtagccaacaattatccgggaacctgaggtaaatgagctgcagttgctgatctaagtctaagttgttgcgagatatgagatagtaaatatgagttgctatgatcctgatactagtttgactttcattcaggatgttttgtttttcaaaatgataaattgagagttcctcatttgatataaattcctaccagagccaaaaatgtgctatcatgattaaaccatatacattttggttgcttgtcattccattgaactttgtcaaactcttgtgagttgtgtagataattctcatgctctatgatcaagatcatacacccacatatatgcacatgctaaactcctacactgggagctaagcaatattccattccatttccatattaccaccaaaataaattctccatactttcatatgttttcttctcctaaaaaaatccttttgaaaaagaaaaaaaaaagagagagggaaaggcatggttatgaaaaaaataaataataaaaataaagttatgctccattaagcatgagcatgacactgaaaaaaaaatgtagccatgccctctcctaatcaataaaagaatgattttttgggagaagaaagtaagcacaaaggagaagctttttctttattttcctttatataccatttccatcatataccacacacacatattgcatgatcttgatcttgagtatgtttagtcatttgctttagtctaagtttttatttagtaataaaggcgaatgcaagtatgccatgtttg

SEQ ID NO: 60037 - DNA, 900 bp, Oryza sativa
atcccgggggggcctgacaggcgctgacagcatttgaaccgggactaaagatgatctttagtcccgattggtaacacaaaccgggactaaagatcaaatatgcccgttacccttttgaaccgggactaaagatcatctttagccccggtttttattgcatccgggactattgtggaaatcggccgaccgacaaagatggtttctccaccggtgggagagctctacaagcggagggtgaggccgctcgacttcctgcacgccacgctcagggtgttcgtcttcctcgccctcgcgttcagcgacgccgggatccagacctgcctcttcccccaggagagcgcgacgtggagggaggctctggtcaacatgccgctcggcgtcggcttcgtcgccagcttcgtgttcatgatcttcccctccaccaggaagggcgttggctaccccagggaggctcaaactggcaccgagggcggcgccgacgccgacaaagatggcaaggccgagcctcccaagaccaccaccaacggcggctccggcggcgtcgacgcggaaggtagcaagcagaagaacaacgacgactgtcccaagaccaccaccaccaatgacggcagcggcggcggcgacggcgcgggcagcagcgtgcagaagaactctgccaaccaggttgttcccattcaaccctccactaaagagatatcgaacagggctgatgagaagatagctaatattgtgtgataattaagtgtgtgtctgcatgtgtgtacgtgccggcatgcatgcatgcatgatgtttgagcacgtgcatatatggtatatatgctcgtgtattttgtttgaataacgccaggccaggagggatgaaagagaaaatacgtagtgcaaataatatatgtaatggaa

SEQ ID NO: 60038 - DNA, 4497 bp, Oryza sativa
caaacacccccttaatcatctctaactaaatttgcttacttgcattatatattgagatggtgatgctaacaataaatattattaaagaataacagattgatgattttatctatgagaataataatgtcataatcatagaacatgattgtgatacttagcctgagatggccgatatctgaaacaacaatatagggtcagccgatatctggaatacctcacacaagtagggaattcagtgacgtgattctcagttaaaggtatcactggttgggaaaatagactaaaggaataagattataacaattattttaatacctctgaagagtgtatttgaaccactatatttagtatcttttattaatggatggctattaatatctacagtaataatgtttcatctaagaaaaagagtaaatatactaatcttgcttagtatgtgtaacatactcatattatttcttgctatttgatgtgcatagaaactagtcatgatgacatgtcaaagggggatggcgacagacaggcctaatggggagtgttgtcttctttagtcttcagtttaaattaagaggatatatagctgcttgccaggtgtagggaatagacctgatgacaacatggtggtcagtggaccagtggatgtatttaagccatgtagctggtgcaaaataaatgaagccattgctctagttttgcaaactctagttgggatagttagacattacatcttacctttgtatccttatggaacatatgtatatatataatccctttgtattcttatggaacatatgtatatatataatcagtatatatgcttataaggatacgacagactccaaaaaaaaatgagaaattttgggtcatgacaagctgcttatacaaaaggtgattggtttttattaaaaattacaaatggtgcaactctatgtcactatttaccatctcacagaagttgaacatgaaacaataattttatgtaggaaatgccaataagaagtaaaatgatcaattcgagaaaatcttataaaaatctcagttccttttcaccaaatttggaacacccgttatcgtagcattacataatttttaattgcttagatcctaatagccttctcacagtcctatacggtgttattagttcctccatatcttacatatataagggcactaaggtagcaatacataattgactatgttttttttccttaagatatactccctccgtttcacaatgtaatcattttaatattttccatatttatattggtgctaattaatctagacatattcattcaatatgaacgtgagaaatactagaatgacttacattgtaaaacggaggaagtactatggatctcacacatccgaaggaagcatggtctagatatgtctcttctctatctttatttgtatgatccaattagagggatgtcacgccccgaactagtcccgagcggaactagcccgtgacgctccaaattaacctgttaaccgataccagtcccaggaaacagtgctggtatcacaggaagacggaatatcacagcaacagatgtctctttattatagagtaggagtacagtcatgttgggctgcggacagatcccgagctcacaactgcattacaaaagggaagtggaagccaagacttggaccaaacatcacaggcgcgacttgggaactaggccgaaaccctaaaactcatcgtagccggcttgctcctggaagaactcctcgtcagcgggatccgcttcatcttcttcagcaactgggggggaattatttatatagagcaagggtgagtacaggagtactcagcaagccatgggaaataagtgtttaatgtaggcttcaaagaaaggctgttgtttttgcgattgattttatttaaactcttttctgaaacaactaagggagtgcttctcaaatgacacggatgagacagtgcgtctcgtccggtcggagtatgtgcaatgattcagtcttttgaattgatcaagattggcacccggccaaaagctttcaaacggccacccgggcctggctgatcccatcagccgcagattttccaaacatcaaacccattccacaacagcaaatttcacaaggcagtagtcaaacaaaaactacgctaggaatcacctcacatccgcccatgaccgtgggcacggctattcgaacagttttaataacctctgcagagggggtacactttacccacacgacattactaacccggatcatccagcccatgcagaacggccacgactagagaccttaaggctttcataacaaggcatttcgaaagccgacacagtttcaccatatgccaacgagaggggtcccagaccaacaccagattaggtcccagaccatactatgccaggaagcccaggggtcctccccgacaccaccccggcgaattcacatgtctcttggcatcatggctcccccgataagctagttactcagccaggggtgtcccattccacccatgtggtcgtacttgtcttatgttcggatgaaattccaaggaaacggtccttaagtgcaagagcgggaaaccgtacacccggtacgttcctcggtccgcgattttggaaattcatttagttcgcaagcaccgacccagctgtcgggttttccaagtcttttgtaaaacccaagttttacccaagaagtttctcagattttaagtttgaaggcgaccgtcgatacctgtgcagagtgcacgattaccgaggcgcaactaggtgtatacaagggaacatggtataacaattacaatggaagggtcaaatgcaacaaattaggtaggtccgccaatctgccttgcagacgggacaagcagattaagtgcgatcctatcaatgcataatatttttcaagcaatataattaagttcaaatataggctcaagatgttcaaaggtggcttgcctcgctcgagatcttgagcttgatcctcgaaatcctcgcactacgggtcttcgggctccgaaactacacgcgaaacgggacaactcagcaaacggcgaaaataaagccttattattgacctctaagcgtgccattagatagatctcgagatttgaggaattttggaagttgaacggagtcaaacggacttactgttgggaagatattgaatttctaagattattggatttttagtctaaaggaaaaggatttatttaaatcctttttgaaaaataaaagaaaagaaaagaaggagggacggaaattagacttccctcgggcggctagggcgcgacccgagagaatggggcggctcggccgaccttaatgggccggctggcccaagaaggcggcccaaggcgcgcgcgcgggcggggaggggagagagagagccggtgggccgggtccatcccgcgtggtcccgggtgggacccgcttgtcggcgactcggctcaccgtgagcgaggtgcacgcggggcgtgctagggtttggggagggaggcgcggcgcatgcgcgcggttcgcggaggacgcggtgcggcgggcccacgcgcagcctcacggctcgcggtggaccgcacgcgcgagggggcggagggaagcggcggaccggggtctacttgacccggtcgcggccgaggtggcgccgaggtggcgcctacgtggctgccacgcgggccggtgggaggtagacgacgacgccggccagaacggacggcggtcgacagcggcgagcggcggagcaaaccatggcgatacaggcgaaggcgagcacaccgggatgttgcgcaggacgaggggagacgagccaatggctcggattcgccgggggatgctcgacggcggcggattgcggcggcggcaaccggcggagagaaaagggggaaacggcgacgaggtcacgaggggccgattcctggcagtgagagcatctacgcggctacgggaatccaccccttgcgccggattaggaggaatcgcatcgagggaggccggcgacgagaggcgcttccgagctcgggcggcgacggcggcgagcacacggcgagcgacggcagcagtcggggcggcgccggctagctagggggggctacacatgctactaccgaaaactaaggggaagagatggattgaggagggagaacggggagatgcactaccgagatgaggcggggcgctgtgacaagaggccgacggcacgggagtgatctctccggcctcgggccgggaaagaggaagaaggcgagcgcccggagtccccttccgcgtccacgaacgcaccggctctcccggtgcttggcgatgaacggcggaggcgagacagaggggcgacaatggcgcggtggcggcgagcgaaacgggaggaggaatcgatgggagggcgccttggtttataggacgacgatgtcggtttggaaaccgaccttgggcggtcaaggcgcgagctggcgctcggcgctcgcggccaaaacggccacagaggcggatgacgtcggcggggaggggaaaaggaaaa

SEQ ID NO: 60039 - DNA, 13183 bp, Oryza sativa
gcatttaagaaggcgtgagtgggcgcaccacgccaccttaaatgcaacgtgtggtacgcctgaccggtcgaatgaccgatgggatcgggatagtgcgtctacgcactggttgcatgtcatgcggcctctgtcacgtcgtgatgatgagaggcttagccggagtcagtacatctcacctagtcaaagcagggtttccgtttccccgtgcaagtaaagacccagaagtcttcactcattaatgatgaatgacacggatgccccccgtgtcaggcagttggatttgacgggccccatgtcgtagcgcccgtgcgagtggcttccaagttaagcaacaagacatgcatttaatgtgaatgccctcgctctcccctaggcagttttctaggcccatgtggcagccccttgagatataaaaggaggtccaggcctggtgaggggagagatcgattcttgggcgaactcacactcgagtctgagcgacttaagtgatttgtaacttacactcaatcagccagacacataagtagggtattacgcttgcagcggcccgaacttgtataaaccacttttgtctcatcgttcctgaggggcccaaccccctctatgtcacaccttccatcgagtctttgattttcacccactgcccccggccgaactaacaagggggggcctcactgtccctcgcttgaggagtgcaccctccgacacacatgcaccttgtagattatatttgaaatatgagtataaatctataggagtatttatatgcttgtgtgtttgttgatgtaaaaacacgaggcctgggagatctgcttaactccagtgcaggtccaaaacttgcctttgggtgtgtgagcgtgccagttgatttgatcctgcaatcaacaagaaataaagacaaagaaaccacggttaaatccataaaagatagccgatcggctggatgctgatgacaaatcatttatctttgagccgatgtcatatatgcatcgatcggcagtcatgaataaataagaaagaactaaatctactcaatcggctgtagatattaacaatatataatccttatgtcgatatatacttaaatcaagtgattgggacatatcggtcaccatgccgagacagtataaatcacttagatcgaaatatataccaacaacaagactatctatgttcatagcatagccagtcagatagatctagcatgtatcggctaatactccgataccactctatattaagatattaatgcaagtagaatatatcaaacagaaagcctaatatacttttagcgcaacaggatcttaacataaagggcagatttaacatgtcaataaagcatataagataaatatagttaaataagataagatcggctgaaaccccaatacaaccctaattggcaaccaaagacaggctagagattgaaattctaatcacgacttataagatcaaactcaactgatgcagctataagtatgaaaagaaaggcagtatctagacaatcaaatcgttggatgttttatagagtggtagatatcctatataatctagatcaacatcagtatttaacctaatcggctgccttctattagcagatgttggccgattgtaggttatatgacgatattgctagagattacgtaagatatatgataactcgacgaattacataaacaagattagagtgtcataaagatagaagcactaatcccgagaacgcaagccgccataacaagttttacctcttgttgaagatcaaaactgatgcagctcaacccaaaagtaagaactcgtcgaaacaaaacgaaagtaaaatgggtggcgatgcgccgagattgtattgaacgtgtgttcgtttgattacatggggctcgggtctatttatacccgagaattacaaaatacgtccatatcggacacgactcttatctctaacaaactctaagataccataagtctttgcggtagacttttgcccaaacatatctctaaggaaattatataaaatatcctaattaatagatacaattgacttctcaggactctatccatgcgtggcaatcatcatgaagcacgtcaacctaaaccgacaacatatgctgtgtcatattgtcggattcggcttaatcggctaaccccgtccaactcgaactctgtcgatcctagtcgtagccgatttggactttagccgatcttcactctgtttccgggacaatctctatctcgatttccatctcgattcctccttcacatccgatatttggactaccaaatttggtcgttaacagtgttgcaacggtgtattcataataaactaaactttttatgggttcatgtgaccgagaaaagtaggcctcagcctcaaatgagggaaatatccaagtatggtcatcaactctcataactcaactaaaacattcgtgcatagttttttatgtattgttttgatcatttgtttctatagatttattacaataagattttttcgagaaaatattacagtaagacatagtgctaaatttataatattatgcatataatttttcatgcacaattttttatttcatattataagtcactttgaatttttcatgcacaatttttttaaaaatctataagttgctaaatcattctttaatcttaaaaaagtttgactacgaaaagctcaaagcaacttataatatgcacttttttgatgaacgtagtagagtactatgtatttactgtatacgtaagaaattaagatatatagacattgttatagatatgatgcattggagtgctctttttttcgagggaacgggtgggagtttatgcgattccactgtagaagaagagagttgatctaatttataaaaaaaatcggacccaaaagccttacaatggctcagttaatttgtgaaaaatcagcaaaaaccctggtattaacaaactgaacctaaacaaagcataaccatccaacaagggaaaagctcctaaaatgaagccttcaaggacacgccgacagaacggcaacatcgcccgaccctaacgaatttatggttttcatccggagaaatctcttgatgtggagttgaacaagggctccaataataacgccttcaagaaagtgaacggcgcccgagagcgtcgccgttgctagcatcggcaaacctgagtaaggctttcacctcgaagtcccatccaaacatagcgtccccaacggaagccaccaaataccaccaacacactggaggtgcctctcctatgcacacaaccacctgcacaccgttgacgacctactctacaaccggcctcgctagtacgtgcggaagccaccagagaggtgccggatctagacctacgtggtcagatcaggccgtccctcgcacagccttcgccgccggtctgggacgagaggccgccagcaccgggtagggaggagggctaggccgccggtcaccttagatctggagaaagggaggaagggaaaaaatagagagaaggaagaaggggaaaggaagaagcagggaggaaagggagggagcgtcgctgctaccggccatcgccgcaggtggcagcgttgccggtggcgtgaggccggcgaccgtgcgctggggaggttggggaggcgggctttgcctcccggatcactgagagaggtgacacaggagtccggcgtgacgcataggcattggagtgcttttaatgggcaacttttgttctttagtaaagcggctcgttgtataatgtttatctagatcatgatcatatttcattatctgcaaggcctacttgcgttggaaagttgcatgggaaaaaaaaaaaggcagaaatcgtgatcaatggaacttttgttgatgatggtccttcagtccttgcatgtggattttgtggtaccaatctgccagcagcacaacttttccttaggtttataaacggcttatatatagtaatatcgtcgattttaacttaggatcataagaatgtcgtgaaatgtacaggtgacgatcgaccatcctttaaagtgtggtggcatatatattaacaaatccaagtaaggtccattaaacaacacaacaattctcagtgattttgcaaaatatatacaataacctaccaattttataaaaagaaaggaaaaaaaagtgcaatgcgaacatagctttaattgtagatttgtaataatctggatgaaaagttaaaaattatacatctgaaaatgttgttttaaaagtataaacatatttaggattcacaaatagatgtcactaggtaattccccgcgctttactgcaggaattagcaattctcaatatattttttctcgacaaccagagtaaaaaagggaacacaaataatgaaatataagagtttattagtacttatcatgaaacaatcaaatgatacccgtgcttttatatgaaacatattgataattatatgttaaaaattataaaaataatagatagatttgttaaaatgttatgcaaatatttacaacatcatatataatttatttaattgtgggctataactttatagaaagtatagatttcagatgtataaacttaaaccttgaaatcttaaagcactttgattagtaaagatgataattgtagattggtcctgaaaaatacttctatataattatatttttaatgatctctatgaccaggcatgtgaataaaaatgtaatgataagacatcatacacattggagacaatgtcaatggaaacggcaaacaaaaaaaaagatctggtatatatgtgattagggggatcatcaatatcaatcaattttttaaactgcacgattgcatccaaaggtcacaggttaatttttttacgatcatcaaaagtaaagaatccccaccagtataaaaaaatattatcttcaaaagcattaaaataaatctaaaagagatcgtgaaaagaatatgaaacactgatgctatactagagttggaattaacttcacaacatatatatgaactcttttggatcctttcttttgtgaaagcaaaccctcatcggtacaactgagaaataattaagtgtgtagtaaaaaaagatgaaatgaagaacagaagagcaattaaatggagccttccattccttcgatcgatcaatcgatcgatgaggcatgttagctttgctagaagccgtgagcaatgcacgcctcccagaagagcctgtcactctcggcgtcgctgccgccggcggcggcgacatcatcctccgtcgccggcgcggcgcacttgccgtcgtccgcagccaccaccagctggtagcccgcgcagtactcccgcatccagcgctcccacgacaaagcctccacggagccagccgccgccgccccgccgcctccatcctgatcacccccgcagcacgactcggcgtcgccatcgtccgcagggcagctgccgcggtccaccgccgccgcgtccgactccgagtcgcccgtcgcctccatcaacgacgacgccatgctcggcggctgctcggagttcataccgacggggcgacacaggaggccgagagggagatcgttgtgtcgtggcgtggcgtggtgaggagaggcgttttgtagcgggcggggaggtaaaaacgtgaagaatgtgggcaaaggtcgcaaggaaatgagcgagcgacgggtcaaagattactgatgcgaagccgaagcagcagcggcagcaagaaaaaaatgggttttaaccgtgcggtggcgtggtaggctgctatctagttcatacttcatacacgtcgcgacttggttgcgcttgcgcgccctcctctctactttatgatatactccctctattttgtaatggatgaagccattgatttttgaacagatgtttatcatacaattcaaaaattttatgtaaatgtataagatataaatcattcttaaattactttaagttataaaacaattcacaacaaaataaattataattacataaatctttttactaagacgaatggttaaacctgtgaaaaaaaattaacggtattatctattaaaaacggagatagtaagattgctaaggctaggtcggctaataaaaggtcaagcagttaatttgttactaaagcctgtagccatggcagtgcatccattggccaaaaatgcgtggtagtattaattaatggatctgtgtcaaaagtctcatgccatatgcatttgaccaaagatagctctatcgatcgcttatacggtgtgtcgttgatgaagtcggattattctacatggtaccatttgttctagttcttccgtatatgtttgtcatccttgttagtcaacagttagttatgcacctagggtgagattgtgagtttgtttgtttcgttctccgcgtgacgtttcccgaactattaaatggtgtgttttttgcaaaactttttttataggaaagttactttaaaaaatcatattaatctatttttgaaatttaaaatagttaatactaaaaaaaagtctctttctttccccccacaaaagagtacttctatatttttttaccagcaatggcgctatattttcccaataaaaaacaatcaaatcgtttttatactgtgaattttaaatgttacaccgccgtaaatcactttacaaatttcaataattacaatctaaattttataatacaaattttataatgaaattaagactaaaagtaattgatcagaagaggagatagatgagatagaaacatgcttaattagatataacatacagagatactaatcactactacctccgtcccaaaataagtgcagccatgagttttcacgcctatctttgatcatctatcttatttgaaattttttcataattagcatttttgttgttatgaaatgataaaatatgaatagtactttactcatgacttatgttttaaaattttttcaaattttttttaaataagatgaacggttaaagttgggcgcgaaaaactatggctgcacttattttggaacggaggtagtaaaaaaaattgactgaatcaagtaaaatgtggcccgtgtttttgaaaacagaacatattgtcttaattaatgcctaaaataccgttatctgctttgtacaaccaaaattgtattccattttcctttttagttttgaaaaacaaacgagaatccatatatcacgatcagagaacactacaagaagacataattcatactatatattcatcttaccgatgtgcaggaaaaaaaaacaaatgagtaaatttccaaaactattgatgttttgaccaaactattacaacactaaagatttagggtgttgtactacaaaattatagaattagctcaaaatttatcaccaaactagaagtacagatctatagatttgggagtttaagtccagtgatagtttcattattattgaatatgttgttttgctatatatgcactctgcgttaaatatgtagttagtaataaattatcgctaaattcatagttatgatacaacatcttaattaagtatgcagttttgtagaattcagtctaaataaatctaaatttaaggatccaactatagggactaaattagcaaatagccaccgctagctacagcacaagttactatatatatatatatatatatatgctcttattaatctattatagttttattcaactacacaaaagttttcaaatctagaaatatattccacggttctagatgtcaagcacatggtactacacgactatagccaaagtcaataatgactactctaacaaacctgtatactaacataagtagtgtaggaacatatcacgtgcgtactctcactaattgcaagtataaggctgtgtttttctgaaattaggaagaagtttggggaaagttggtagtttaaaaaaaaaagttagaagtttatatgtgttggaaagttttgatgtgatgtgatgtgatggaaagttgggagttggagtgaagtttggtgtgaactaaacacaccctaagtcatcttatatttatgcatgataattgaggaaacaacacaactttgtaaccctttattcattctactgatttacttgtgagaacaagaacacattaacttattgaagttaatgtttttgaagaagagttgatgatcttaaagaaagacttacatttagaaaagagttagtgcaactaaaacaacttacactgggaaaaaaaaagatgaattgagctcatttcattactttgaaaagtggaatttcaaattaatttcagagaaattttgctacatgtcatccaaaatttgtgtaatatgctgatagatattaaaaaacatgctaaggctaaaaaacacctaaaaattggtaattacgagaggacatttcaagctcaattagagagaaaaattatttaaaaagataagaatgcttctgaaaccacaaatttctaacctgatcatgcagtgaaaattttgaaattatgcaactctcaatctaccatcacccaaagtacactagtagcgcacatcatacttcatctttactcttgcatcaagttagaatttctaaccccaagacattcttatctttctttttaaagaattcctctctctaattaggtcagaaatatcacaagttaccactttttggttgtcatatagccatgatacatttttttgatacccactagcatattacacatactttgaatgccctatatcataatttgtcttagtataatggtcacctaagaaactgccccgtttttttctattcttaattcattttttgctccttttctaggggtatacttctgctgatcgttttggagaaaaagggaatattaaataagattttctagtcaaacttttttcaaataaaattttctagtccaacttgctttgcgttgagatgcagactgactggacgtattgtccacatctagaacgtacaggacaatctagcacggattgtacatttctagaagctctaggacgtatgaactggtcttcctttgtctgcaaatataaaagacatatactccctccatccccataatacaggagattttgagtttttgtttatattatttgaccactcatcttattcaaaattttttaaattattatttattttttttggcttactttattatccaaagtactttaagcacaacttttcgttttttatatttgcacaaattttttgaataagacgtgtggtcaaacagtacaagcaaaaactcaaaactccttatattatgggacagagggagtagtatactgacgaacttaattatgcagggtctattctgcagattactgctaaaataaaccgttttaaattttgacaataccaaaattttagaaagttaacattattattaaggaaaaagtacgaattaccccccccgaactatcgtggtaggccgaattacccccctgaaccacaaaaccggacattttacaccttcaagtattcataccggataaattacccccttagcactattttgagtggttttgacttaagcttgcacacgtggcgccaacgtggcagtgcagtcagcaaataaaaaaaaatgttcgggcccacctgtcatcccttagactcaacaaattcctatcattcccctgggctctctctctctggcgaccggtggcggaggtgtacctcgttccggtggccgacggcggaggtggacctcgctcccggccgggacgggcggcggatggcggcgcgcgggaggctgtagcggggcgcgcgaggacgggcggtggacggcggcatgtggaggtgggtgcggcgaggatggccgacttgggcacgcgcttggacggccggctgtggcggtggaggtggaggcgcccgggcggctggtgtcagcggaccgggcggcgggtgacggcagcgcgcgggagcgggcggcgggcggcggacggcaacgcactggggcggtgtaacgccccgatttttgttcgggaattaaaaatcattaaataatgcattttctagaaactaaataaaagttaaagcaatttaatcaagtgaaatactgggagaaataaaattttactttaaaaatcattggccggaaatattttgtaatattctctgtgccctaaaatactctgtgaaattttccattaattttcggagctcgagtaataatttgaatagcacaaagtttatttaaccaatttaataaaaagaaaaacaattaaatctaccctccttcactttgggccacttccggcccaaagccctccttccctccccgcggcccgtcccctcccttcttccttccttcctccttgggccgtcgacccatcttccttcccctcgcgcaaaatctaaataacccccctgggttctcctccctctctccctccccgacaggtaggctcggcgaccccacctgtcaggccctcctcctaccttcggcttccaatgccgaagccgccatggccggcggttgctgcccacgtcccgccaaatccagcgccctcccgctcgcaccctcacacccaaaccgagtgaaaccagttcccctccaactcctccacattttcccccacttttccccaatttttggcgccaaatcgagtccccactccgcccacgttgagtcccacgtcaccggccggttgccgcccgatcccgcccctcttggccacgatttcaccctcccgagcctatataaaccctccccgtgctctcctcttccgtttccccctctttcccgagcccatcgcgccttctcccgctctctctgcacgagcccgagctctgccgctcaccgccgtgcttccagctgcatgccatcgcccctccagacgccgccgcgctgcgccgccaccaccgctagcctcgccgtcccgagctccaccccggcatccactttatttccctgaaccaccgccgtgatgccgtgtccacgcacagcccgagccgccggtgcttttgccgcctccggccgcctcttgctgccgctcccatcgccgctgcgccgcgcaaacaccgccgtcggcatcgccatgccttgccgcacactggcctttgcttggttttcccaaatcgccaccgcatctaccaccccaccgtgaacccgaggtcgccgccgtgactgtcgcctccggccacctcttgccgtcgtttccgacctcctcacggtgtgctgtcgcctccgtcggcttctccgtctggtgccgcacctcggccgccccatcgccctcgccttccaccgacggagtcctctccttcccgtcgaggtgagctactccccatgtcgccggctttcggccgagttttcccgccgcctcgcgcctcctcccttttccctaacccttccatcgtgctccccatgtcgtcccggtcgccgtccgcagcctcgtcgcccgttggccgccgttggagtgccgccgctatctcgcctccgtccggtgtcgtgccgcttggtgagcatccccttcctcctctcctttccgccacccttcgcgcgccctctcgcgccaccgctcgccgtcggtggccgttcaccgccgcgcatcgtgtctcggttgggccggctctaagccatgcccgtgctctgggccctcccctagtcccgctgacgtatggggcccgcctgtcggcgcgcccttcctctttgatgacgtcagccgtgccttttcccttgagaaaacaattaataattgtgcaataaatcgatattaattctagaaattcatttaaatggctcaaaacttctaaaattcatatctaattcattcgaactccgaattgagccattcaacttgcaaaattcatctaaaattaagctctacatgtttgtttacttttcatgtactgttttcttggtgtttattagagtttttcctcgttttgcgtgctagcatgtaggatccgtcgtttcggaagttcgcggtcgcgaggaaaagagttcggaagatcaaagtaaagaagcaaggcaagtcacacattccccttgagcatgttgatcccaatttacaaatgttttaccatttgcaaataaatatgcatgttttgctaattacatgggatcagagttttacctatctgctcgcttgtgccatgtttacttgatatccgtcctttgtcaacattgggtaataaattggctagctcatgttacttatgtgacctagctagaactatatgcttagccatgcttaattaccactagctcagttgatgggataattacaatattagacctttttagtatcagaatgagctgcgtgctcgagacatctggccatgcttcattgtcgtaattatccaactagaatgcgactgaatggtgggctgtgggtgcatggttatgctagtcgcacccatggcaattaaagaccggttcgtgggatgccctagaagaacttatcgtacttaccacaagccagcgtggtaacggctgggcttgtagtgtagctttcctctagccgacgtacccaggcgagggtgggcatgatggagttgggtcggccggggtgtccggttgatcggcttctggattcatcgcggcacgagaggagggctgcccattgtctgctgggggcgggggcgaaccctaaggtgtggtgcgatcggttagagggggttatgcgaagggtcctgtcacggcctctttccagtatgtcgtggtggcatgtcggcgcacggaaacgtgtcgtggggctgagtcttgtgggtacagttgtacacctctggccagagtaaaactattcgaatagccgtgcccgcagttacgggcggtcgaccagattcaccgtgattagtcccaccttaataaatcgactcaatgcactgtagttcaggtgggttggttgggcctgttcaacgtggtgtagcgttgatgagtggagatttaatgttactttaattactcaacagttttactgttttgctcaataaaatgttttacaaccgcctttatgcaaatagccacaaaccgtccttgtgttccccttgcacgtctgcatcattgatgtggcttgctgagtacggtggttgtactcagccttgctattattccccattttcagaagtattgtgcttctgagctgaagacgaagttagaagaccaaggctcagaccccagttgagttttgcctgtggagtggagctgaagccccgctaggatcgcctttttccgctgctgctgcttttgtttcggtgtgaggactaagtgcctcttctgtaagtattttacgct

SEQ ID NO: 60040 - DNA, 4473 bp, Oryza sativa
agggtttttctttttataaaataattttaactttgttaatttcataataatttttatttgtgctctgaaaattccactaaatttaatttacgcattttaggcttttaggatatttacaaaaatcctctaagccttatttgacttttaactttgcacattttaattgttggaggctttcacacggattttaattattctaggcataatctagaggatgtattttagagtcattttgggacgtgacaattgatttcatatttctcttgtggagcctatccttcagctagccttgcaaagagaggggaacgatgaagaacattaatatcattgtgagatcatggcaaaccgaagaatgcatgcggaatccaaagatcttttgaagcaacaacttccaaaactatagttcgtttgcttaattttcctttatacatgcctttccatgctgaagggcaatttttccactcccaatgcatgcaatctatggatccaagcattccaggaaaacttctctgctctccaagtgcaagtaatctagaagtgtcagcactagttggataacgcaagtactcgtctccgaaaatctcaacaatagctctcacaaaccttttcagactctctatagtggtactatttgcaatttgcagatattcatcttgagtgtcggctacgactccattggttatcattctaagtgtagcggtaatcttttgcaatggtgatagacccaaagcactagcatcatttccttttttgggctaccacatcattaactatatgcgcaagaaaagaggacgactcattccaaacctacgcaacaaaatgtgaattaatataagtggagaacaaaacaatatcaaccaaaatatgtaaattaattgcaagccttctccagaataagactaggtcatatgtaggatgctccaataagtagttgtggtgcaacctatcatggccggctcgacgattacgacgaataacttgacgatcaggaacaaaatcacctcgccatggagcattcgactgctcatattcatcttgcgcgactattgttgcagcaacgatgatttcatcactggatgaagatgattcatccaatagaacatgtctcaaaatgaagatcattgagtgatggaagaacaacgcacaataatgtggatggagcaaaaagatatgagtacctactttacattatgttcatgttatactgaatagacggctagcttatctgggaaaaactttggtgtgggtataatgtttgcttatgcaattactctatgtgtggagattatgggtaccccatacctacatggcatagttatccgactggctataggggataacttatatctatggaatatgtaacagatcatgacttgggtattacgtttccctgtatattatggaacggcctaaagtcctggtttgataagattgtaaagtagatttaggaaaccgataccgtattggttaaagtttctatcttgtaaccctgccccccaacctatataaggagggcagggagcccctctaggggcatgatgagacaacctgatcgtcagatcaatacatactcggcggattcaaatccccaaacaggagtagggtattacctctcattgagagggcctgaacctgtctaaatcctttgtctccacatccatccacttttaggtctcgtgcgctaccccgttttattattgccgaattcatgtttcgacagttggcgcgccaggtagggggtgcgtcgaattacctgtcgaaaagtgcgatggaatcaacttcagaagaaaccccgagatcaatctcatcaatttcgatggctcaaatcttcaatcgggtctaccgttgcaatttaatctctattagattaatttttaatcattgtttgatttcctgatattttgacgaatttcatatactggatgagatcgaaacacggccatcatcgtcgcctacttgggtgcccttgccgtgtccgagtgctcctctcttcctttccttgcagatggacgtgttgcaggagtggcacaggccgccaggattcgattcctgtttgcatgtatgatggttgatgggctccgccggctacctccgatgatggcatcatgccgaaagaacatcgagttagctgttagttgccggggcttatacatgttgcatggcacgtcgccggctatcactcatgatccagcctcactgctcgacttgagtttttcgtttcaatttgttatcaatatatattagattgatttctaatctcagattaatttcttactattttttgttgttgttcgcatataactacgcggcactattgaggcgattgatgctggtcatggactcgaggcgtctcagctttccggtcgatcggccgcgagtccactccgccggcttgtcctcgccaccgccattgctgattgcaacaacgacttcaccaccggcctgcctccgtcgccgccgactggtgttcccgtctgcatggctggcctattatgccgccgctgttgggcgtctacgacttcaccgccggcttgcctccgtcgccgctgagtggtgcctccgcctacacggctggcctattaagccgccgctgttgggcgtccacgacttcaccaccggcttgcatccgtcgccgccgagtggtgcctccgcctacacggctggcctattatgccgccgctgttgggcgtctacgacttcaccgccggtctgcctccgtcgccgccgattggtgcctccgcctacacggctggcctattatgccgccgctgttgggcgtctacgacttcaccgccggcctgcctccgtcgccgccgactggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgtcctcaccgccggctcaccttcgtcgccgtcgactggtgtttccgcttacacggctggcctattatgccgccattagtgggcatcttcgctttcaccgtcgaccgccttcgtcgccgccgactggtgtcttcattgttattgatggacgactttgttcccacattggccacttctgccatcaccaaggggaatattacaaagctaagtcatcatttattttattctttatatgatatttttccttttcctctgcctcactacaccaattggtcttccattgagtagtgagtcgggggctacagatgttatatcatatttttcataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagatgagataaatttattttctgctcttaataattgcaaaagtacccgagtagtaaattctgatccgtgaaactttgttccattaatgacgaactcatgtcactcatatgcatgtttgggaagtgcctaggccgactcccggtgcttgatggttatgactagtcggacagagtgtttaaacgtacagagtcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggctttaagcttatctcttacgctccaggaatggatcagtcagaacatcaccgaccggcttgccttcgccgccgccgactggtgtttccgcctgcacggctggcctttatgccgccgttgttgggcgtctacgtcttcaccgaccggcttgccttcgccgctgccgactggtgtttccgcctgcacggctggcctttatgccgccattgttgggcgtctacgtcttcaccgaccggcttgccttcgccgccgccgactggtgtttccgcctgcacggctggcctttatgccgccgttgttgggcgactacgtcttcaccgaccggcttgccttcgccgccgccgactggtgtttccgcctgcacggctggcctttatgccgccgttgttgggcgtctacgtcttcaccgaccggccacctcgtccgccgccgactggtgtttccgcctgcacggctggcctattatgccggccgtgttgggcgtctacgtcttcaccgaccggcttgccttcgccgccgtcgactgggtgtttccgcctgcacggctggcctttatgctgcccgttgttgggcgtctacgtcttcaccgaccggcttgccttcgtcgctgccgactggtgttttccgctgcacgg

SEQ ID NO: 60041 - DNA, 10613 bp, Oryza sativa
ctacccctccatatctcatatggtgttttgtccttatttctgttaggaactctgtttaacacatgatttgaggtcaacaatgcctccccccaccatgccttaggcagtcccgcggtgtccaacatggcattcaccaagtcagtcagcgtgcgattcttcctttcagcaatcccattagactcgggagaatagggaggcgtcctctcatgtatgatgccatgttcctcacagaataagtcaaattcgttcgagaaaaactctccaccacgatcagacctaagcctttttatctttctgtcaagttgattttcaacttctgccttataaattttaaaatagtctagagcctcgtctttcgttttcaacaagtacacatagcaaaatctagtagcatcatcaatcaatgtcatgaaatatcgttttccaccatttgtcaacaccccattcatttcacaaagatctgaatgtaggagttctagtggtgccaagtttctctccttggcagccttgtgaggcttgcgaggttgcttcgattgcacacaactatggcacttagaacctttgacaatggaaaacttaggaattaaacacatgctggaaagccgagacatcaagccaaaattaatatgacataaacgtgaatgccaaacattagcctcatcatccacactgccacaaatatggttcacagacttattgcagaaatcagaaagggaaaaacagaacaggcctccgcactcataacctttaccaataaaatatccatgtttagacacgactactttattagactcaaaaaccaacttaaatccgtctctagtcagacgggagccactaacaagattcctgtcgatagaagggacatgctgcacgttcttcagctgcacgatctttcccgaagtaaacttcagatctaccgtgccaacaccatgaacagaagcatgtgacccattccccattaggtcggtggaaccccgtgcgacctgataagaagaaaacaatgagatgtcagcacaaacatgtacattggccccagtatcaacccaccaattagtagattgattaactaaaaaaacagtaggtaaattaccatacccgcttccatctccagtgttgccaatggtcacattagcagacttagaagtctgccctgcaggtgccttcatccccttgcgctgtggacacttcctagccagatgaccaacttggccacacacaaagcaagtcctctcatcctgattaggattgttgttgttgttcttctgcttcttgaagttggtggtctgctgagctttgtatttccccttgctcttgttctgggccttgtgcacaacattggcactggactgcccaccatcgcccttagacgcggcatctttttcccgagctttctcctcaacatcaagagacgctatcaacccctcaacgaagtattcctgtctcttgtgtttgagtgcagtaccgaaacttctccaagatgaaggtagttttgcaataatgcacccggccacaaatttgtcgggtaagacacacttaaggagttcgagttccttagccatggtttgtatctcatgagcctgttcgactacagaacggttgtcagccattttgtagtcatgaaactgctccatgatatacagatcattgctagcatcagtagcaccgaatttagtattcagtgcatcccacaactccttagcgtcggtcatatgcatatacacctcgaccagacgatcgccaagaacgctaagaatgcatcccacaaagagagtagtggcttcctcgaattgcttctgctgttcagcagtaagaactccttcaggtttgccagtactcacctagaagcatttcatagctgtcagccacagagtgaccctgatctgccatctcttaaaatgcacaccggtgaatttatccggcctcagtgcatcggcaaaaccagccatagtaaaatcacagtgcctatgataaggtttttggattgttgagattatagacatataatgatttaatctattccataaataaatcatgacattacagatgaaaactagcatgaacgcatcattagatctacacatgtaaactacacagtataacatgaacagatcaaatatgcgcaacatattgaacacgtaccgaggtgacggaaagaccggctgcttggtcgaaacttttcgcaagtgtctacgaaggcacgaaacacgcgagcgaagaggaaggcaagccgtcgcgaacgaacagggagcagtcgcgcgaagcgcttcccaaaaaccttattgccgccttctcccggtgcagaacgtcgaaggcagaggttccggagacctgctctcccgatcgccggtgcacgccggcgagcgggatggagtagtctacgagcgacggcgcagtacagagtaggaggcaaaccctagattgattttgtgtatgttacgtgaagacggcaggtcggtttatatagagaagggtcgcttgatcagggcgcccgcacgatctctactgcgcgtaaccgaaccggataagtcgcgcgtaacttatccggactccacgccgtttgcacgcaccggatctttcggaacgtttccaaaacaaaaacgaatccgaatttgcaacaaaacaaaactgcaaaaggaggctgcatctgcgcaagggtgaggagccaatttttcggaccattcgacgtacgcgtacgtcgtgcacgccctgccctgccctgccctgcccggccaggccaggcgagcgagcgcgcgcgtgtgtttcccctcttctctccaccacacatgcttcaagcgactaggagggcatcctcccttttaaggaggtccccctctcctagaataagcaaggtggtactaaactccacatgcatgccatcccatgaggtgggcttttgtgattttccaaagaattaatcttcgagtgggctaaggcccattcattaattccaacactttcttcagacaacaagttaaagcttcagcacataacaagaagagataaggtgatatgggatcaccttgtctaataccgtgagagggttcgaaaaaaatccaaatgctccccgttaaaataattgaataggaaactgaagtaacacatttcattatagttcttacccactaatcatgaaagcccaacttcctcatcattgcttccaaaaaattccattcgacgcgatcataggcctttgtcatgtcaagcttcaaagcgcaaaaagaatttttctttgtcctattggttttcatgtaatgcaagcattcataagccaccaaaatattatcagagattagacgggccaggtacaaaagcagattgctctatagagatgatatccggcagcactacctttagttgatttgcaatagtcttggatatatgggcggcgcggctcggcattgggccaggaggcggcccaggtgggaggggagggaagaggtgggccgggaggaggaggagaggcccgggggaggagggaaagagagggatgagagggagactttgggctgggctcggcccaaaggaggaggggattatttttaggttttctttttaataaactttcttaatagttgttgttgcttaataattacttccggtgctctgaaaattcaagtgaaacttgagggctcctttaagaccaaggagaatttaacaaaaattctccgggccacatttgaatttttcttgtacgtattttagtgtttgccaatttctttttgaattttcattaattctattattccttttagagaatgatttttatttcgggatgaatttatcaggacgtgacattgggcttcatgtttggcgaaatcgccctgcgccgctaacggagggccttcgccgcgtcggagccagtctcgaaggggatggagtggtagaaccacttcgccatccaatggcgatcccacttcgacatggcggcgttcaccggccgtagatcggagcgctcagagcgaacattaaagttcacgcttccgaacgccgttttcttcgtcctggccggggtgacaaccgtcttcgagttcacggtggcatagaacacgacgtcgaaaagctcagtgctcggttcgaacccggcggtccggcacgcccagtcgaagatggcgactcggacaagtgccgacaggctcagctagggaagctccacctggaagaggcgaaggatctccagcaacaaaacgttgcatgaaaaccgaaggcccgccccaaaaaatacggcaaaaaccaccgtccagttgtcgccgggtttcggcaccacggcctttcccgggaggaaggcctgcccctccaccagagggccggcgctgacaagcttcgccagctcatcgtcgtccacaagtgaagcccctagaaaggcggtggagtcgtcgtcgatccggccgggatcagggcctgtcgcggaagcggggttcggcttgcgaggtgccatggtgaaaggtgtgcgcggtggcgaaaagggagaacaaccgaaagatctaggaaatcaaggggcgccgtgaaaggaaaaaatggagaaggagagagcgctcgcagtgaaaataatgagagtgcggcggtgaaaaagggaaggggggaatatatagcccacccaagcgacggttcgcctccccgcccaatcataagccgccacatgtcacaagggtaggcgaaacgggaaattcccatcgatcgagccgcacagtgataagcccacaaagggaaagcccatcactgttcatttcggcccaggaaaaaataataaaaacggtttcgccgctcacaagaggcgaaacctacaaaacgttactaaccataaaaatacacgtacacacaatgcacgttttctctgcaggaatccataataggtttcggcaggagcgtcggtcgaaaaggggtgcctcataccataccacatggtttgcacggtctcagccgaagctcctatctcaccctttcctgtgagaggcttgttggcggtatgtcatgagactcttcgaccggtcctgccgaaaccatgcaactaatggagggttcaagcccaagacgtcgagtctatcggggcgaagcccccatggcgaagactatgaagcaaagatggcgaagggcgaagaatcgcactggtatcccacaaggttgaaggcattttgggcgaagtctatatggcgaagaaggtatggcgaaggcggatgacttcgccatagcaagccaaacttcaaggaggcccaagaggccgtctcagccgatcaagcccgggggccactgggccagcgttcgccagtcggcccattagaggcccatgtacctcaattacactatatacccatgtaaatgtccctttcataagggcaaccatgtaaattcccctattaaacctaaaccctaataggggaacctgtaatagggctataaatagacccctagggccatgtaaaagggggatcccaagaaaaattctcaatttaatacactttactgctttccaaccactgttgagtaaccacgtctttcgacgtatgcggttgtcgtttcgacaacagtacattacctcggttgagtgcgatccctcctttggaaagaacatggccaaggaaagaaacttctttcaacgaaaattcacatttggagtattttgcatagagttgatgttcacggagtttgtctaacaccaaacgcagatgatgggcatgctcttactcatttttagagtaaataaggatgtcatcgatgaataccaacccaaatttgacaagatgctccatgaaaattgtattcatcatattcatgaaagtagcacgagtattggtcaatccaaaggaaattacggtatactcaaataaaccgtagcgagaggtaaacaaagtttttggaatgtcctccggttcgattttcagttgaaaatcctaatcacagatcaatttcggagaagatacgagcaccggtcaattggtcgaaaagatcatcgattcttggaagaggatttttttatagtgatttcatttagaggacaataatccacacacattcgcatggtaccgtctttctttggagcgaacaacaacgttcatccctacagagaggagctaggacgaataaatccttaagctaattgttcattaatttgccttttaagttccaccaaatctttagaggatatacagtatggtcttttagctataggtgctgtcccaggaattaaatcaatcacaaactcgatgtcacggtcaagtggcattcctggtagttcatcagggaacacacatggatactcttttactatgggtactgatttgagctcgatgttgatagagaatgaagtgatggctgctgagaagtagtagcacgatcagatgtgaatgtgatatgtcgaccatcagtttttactaatgacataatatttttagtacaatctatggttccttgtttggacaaccaattcatacccaagatgacatctaagctaggatagtttaactgaatgaggttggctttgaacttcacccctctattagaatttcaacatcattacatactagattggttttaatggttgcaacgggagattgtactaacatggcattctttaataggttgactttcagattttgttggttcactaatctggtagatatgaaagaatgtgatgacccagagttgaaaagaacaagagtaggagcagagtgcacatgaaaagtacgcagcacgatgtcagatgtgtccgtagtctcctcaacggccacatgattgagtcggccccatccaataggttgagatggcttggctgcaatatgtccaccttgctgcccaccatgaccctgtgcgggaccatgtggctgcggttttgttccctgaagacgtggcactaatcgttcggtcttcggaaatggatagttattggaataatgaccaagtttcccgcagtacgttgtagcatttatgttagctacacgattctgatttccttgcgatgaggcaccacaggaatataattgaactgttgtcggagctgaatgatgggaaacagcaaactgtggcgtcggtggctgcgaagccacatagcggaccatcgtgggctgagaaaggcgcatcgggtagagctgctgctacttgcatcttttctggctacccacttccatttgcgatcctcaagaacttccttttcactggcttccacacgaagagccttgtcagccagagtcttcatgctagaaattttatgagcaaagagagcatgcttgagttccagattaagtcggtcgcggcatagctcaaatttcctagctttagtgggcatctctaaagttgcatagtgccctagatagttcaagcaatctagaaattccataaaggacatattcccatgcttcaagttgagaaactctttcttctacatttccatgagactggcatgtatatgagcaaatctaaatccctcctttgaaaacaacccagccgataagctcatcgggaggaataagagtcttgtatgactcccaccaagctgaggctgcaccctgaaggtaataggaagcataggaggctttctccacatttttgcatcggcagaggtcaagcttggattcactgccacagagccagtggatcagtagcagagaagagatgtggagggtgagtgcattgaacgttggcgagcttggattgtccttgttttgcatgattgaccatagcagcacccacattctcggcatttgctttcatcctttcaaatagccggttctgggtggctaagatatgtggtaaagaaagcttatcatcacattgatcaccttctgcgattcgacaacttcctctagcatgacctgatggctgagtgccagctcaggttagattagaagggattgtttcggagcaccgacctccggtttcccggacatggatcgagtattagtcatcctgcactcaaagtacaaatgagtacatgagcaagctaagcaagatatgacaaaacttgagatagccgaatagagtactagatttatgtttctattgtgcaggttttaaaggagtaaaatttcaactttacagaataataagttctgcacaacaagcatatcaattcaaaatggaagagcaatcacaaaagtttacataacttcacattgatttatcataggtttgcatacataaagatggatggtagtcacatagaaccacgtacaggacatggtgttacaaaatttgactactagaaggttcagatttagataatattacatagcactataggagggttacatttattcaaggatccctattacaagatctaagtgccttcagaaaacccagctggaggattgggtaccacagtggtaggggtcgccatggttagacggtagtgtcgaccattcctttcataaaatatgacagtccatgtaatgctggattaccaacaaatgtcgggtcagccatagtgcggttgttatgatgatatcccactcccatgtgtgccctacgatttacccataggaggtgccagtgtttcggtgagtggttgcataatggtgctcccataaataaaggcattatcataatacccttaatgacataatggttctacccgcctatcgagtgtggcaactctagtttgaagtctatcaagttaacttaatgtcaaagcgaggtacctatctaatgactggacaaaccctgaaagatgaaggagtggtgtgttaaggtcccctgggcgtccctctaaacctagatagtaactaaatgtggcattatctgttcatgctagaaagagatgaaaaagcctggatattcccgacatatggtgccgaaaatacacgataacttgttatgcaacttcgagtcttcgagcatagctgagggtgcatcccaaccataaccatagaaacaaagagttatttcttgggtccatctctcttggatgtatgattctgacttgtaaactctaagtgaagaccttcgctcagccgaaaagaaatggtactcccatgctcagtcctgattcctgagtacttgagcgctgctgttgtggatagcatcgtttttcttgtgcgaaaaaaatgcgtattgcatttgtgtgctgtattatgcggacatttaaatgtgaagaaaatgggtattatatttgtcttgattgaatatttgtgcgatactatatatgtagttaaaatgtgttctccgctaacagtttttctggtgttaaaaactgtccattagagtgtgctccaaaaatcagttctaggcagctgttaggtgctttgtggcgaattcccgccatgtgttgcttggtgtcgcggagccaaacaccctcaccagcgccatggcgatcgaattgcttcaccgtccatagctgttggcttgatacaagaagttgtttttccatgatgttacttcatactccctccgtttcacaatgtaaggctttctagcattgcccacatacatatagatgttaataaatataaacacatacatatgtctagattcattaacatctaaatgaatgtgggcaatgctagaaagtcttaccttgtgaaaggaggaagtaggtcagctaattaagtgataaaacctggattgaacaattatcgactcatattaatcatgtatagtgttggagtggtccaagaggacttgcttgcatggcaaaaatgatctaatattttcaatgaaaggtttctttttactcgattactcttttgtataggtactataacttttcattacctgtagctccacaaaggaggcatagaaaaataatcctatcaatatagatgcatgtttatatttgtcagtttgacagatatttatctcatcataagctgtagtgaaaagttcaataccatataaatttattgaagataatgtgcatgcatctcataaatataggcgctacactgcttattaatgaacaaacaacacgttttttctagacgaatatagtcatacagatgatgcaaactgctgcatcatgtcacgcaacgctgaaattgagttcattactacaaactgtatagcttcagtttttattaagcagacggcatcttcagagcctctgtcaccttcttcacgctcggcctctgcatcacatcatcgatccaagccttcacacgcggataggcttcgagcacagaagcatgggcagatgccagcaggtaataaaccgtcgggaaatggctgatatctgccaagctaatgaaatccccggctaagtacttggatttggacagctgcgcctcgtagacttcaagggctttcttcagcttctctaagctctcattgaccactccaatgtcagttgctccacccatgaacatggggacgatgaagcactggaagatgatcggcgacatcgcgccgtcgaaatggctcgactcgacttccagccaaacatccaccattgcagactcagagaggttgctctcccttagtaggtcagatccatgtttgcgaagtatgtactttgaaattgcgcgggactctgtgttaaaatgcagcttgtcatattggtggaagaacaatggatataagatgaaaatgacaagtcaaataattgtggcgaccgttgacaccaatggcatatgaggtttacaccagattgaactatagtgattaagtttgagctcagttattatcatatt

SEQ ID NO: 60042 - DNA, 5209 bp, Oryza sativa
aagtcaccaagaagagtttttctgaagaggaatgtgggcacggggaaagtgcccatataattgctaggctcctaaggcatagcagttatctttgggacccggttcttatccccacccgggagtaaatatcttttcccgctatttcgaaattctttttaaacccggttagggttaagaaccgggactaaagattatagcactgcatatgattttcgcttacatatgtgtttataaaatagaagttaatgcattaacattatttaaagtacaaagattaatgacaattacttcgaaaaattatttttgtctgtaataaatgaagtggataaatcgtaataagcaaatataattaataaaaattccaataatcatatatacttagcatatatatgaatgatattattatattggtaaaaactctaattaagatatgtatgtacatactgcatgatttaaaattaataaaaattgtaatcatcatatgtacttagcgtaggaattatattaaattacatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatgttaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttcaaaattgtaagtatcacatataactagcatatacatgatttaaacttgttgaaacctctaataatcgtgcgtaattaacatatgccatacatcaattgatttatatggataatcaatacatccaaaatagtttacatcgtgtacacaataattacggcacgtactttctcctcactattgttccctccttgtgatcgctgcgtgagtaaggggtgtcttcatttgataggaagatgctagggtcaatcgtcaccgtgaaagggggttgcccatccaactgatcgtaatcctcgtcagtcttgtcctcaactctgacgatttttcttttgcctgggagaaccacttgacgcttaggctcatcaggccctctgcccttctttcctttgctagacatgtccttcacgaaaaagacttgcgttacatcattggcaaggacaaaaggttcgtccgagtatccaaccttgttaaggtcaacagttgtcatcccactgtcatcaatcattacgcctccaccagtcaacctaacccattggcaccggaacagaggaaccttgagaggaccatagtcaagttcccatatgtcctcgatggcaccgtaatatgtggcagttgttccatcgtgtcccatggcatcgacacgaacagcgctgttttggttcgtgctcttcatgtcttgggctctcgtgtagaatgtgtacccattgatctcatatccctggaatgtcgcgatcgacccagacggtcccctcgccaggaaggcaagttgttggttgatcgactcgttacccatgagatgttgtcgtagccacgcggggaaagtatcaatgtgatgccgtgtaatccatgcatcggacttaccgatgttcctggcgcgaactagagccaagtgctcctcgatgtaaggagctaccaatgaagagtgttgcagaacagtgaaatgggctttacggaataaattgttgtctaccgtcgttattgctttccttccgagagttccctttccccgtagtctcccttcatggcgtgattcaggtaccccgattgggcgaaggtcttcgataaattctacgcaaaattcgatgacctcctctgttccataacccttggcgatgcttgcctctggacgagcacggttacgaacatacttcttcagaacgcccatgtacctctcgaaaggaaacatgttgtgtaggtacataggcccgagaatacggatctctttcacaaggtgacaaagcagatgcgtcattatattgaaaaatgaaggtggaaatatcaactcaaaactgacgagacattgcaccacttcattctgaagggcttctaatctatctggatcgatgaccttctgcgaaattgcgttcatgaatgcacatagctttgttattgttgcccggacattgtctggaaggataccccttattacaactagtagcagttgtgtcatcaacacgtgacagtcatgagactttaggtttgtgaacttcttctccttcgtgcttattattcgcttgatattcgtggagtatccagacggtacctttatgctctccaagcattcaaacatactttccttctctgccttgctaagagtgtagctggctggactcaagtaatggcttcctttctcctttggttccgggtgaaggtcgccgcgttgttccatatgcttcagatcattacgtgcttccagtgtatctttcgactttccgtatacacctaggaagccaagaaggtttacgcaaaggttcttagtgaggtgcatcacgtcgattgcgtggcgtacgtccaagaattcccaatatggtaactcccaaaatatagagttctttttccacatcgccgcgtgaccatcttcgctctttatatgctggcttccaggcccctttccgaacactactttaagatctttaaccatagcaaacactgttttcccgctgcgatgtttaggtttcgtacggtggtcggccttatgttcgaagtgcttgcctttcttccgtaccgggtggtttgctgcaagaaatcgacgatgccccatgtatacaaccttcctacagtgcttaagatacgtactttctgtttcatccatacagtgagtgcaagccttgtaccccttgttggactgtccggataggttgctaagtgcaggccaatcgttgatggttacgaacagcagcgctcgtaggttaaactcctcctgtttgtcctcgtcccacacggggacaccttccttcttccacaactgtttaagatcttcgaccagtggtcttaggtacacgtcgatgtcgttaccaggttgcttggggccttgaataataatcggcatcattatgtacttcctcttcatgcatagccagggggggaggttgtagatacacatcgtaacgggccaagtgctatggccgctgctcatctctccaaaaggattcatgccatccgtactcaaaccaaaccgtatgtttcgtgcgtcctttccaaattctttaaattttctgtcgatgtttcgccactgcgaaccatcggcggggtgtctcagcatcccgtcctgttgacgctcttcagcgtgccatcgcaacattctagcattccccttgttcctgaacaaacgccttagccgtggtattatagggaaataccacatcaccttagcaggaattctcttctttgttagctgcccgtcaacttctcctggatcgtcccgtctaatcttgtatcgtagtgctttgcaaacagggcatgcttctaggttctcatactcctcaccacgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccatttttgcctttcattgcaacaactccagagtggtatccaactttttgtgcccctgctcgcaacctgggtacaatgaagttctgtggtcctccaacatcttgtccaatttatgcgcctccttttcactttcgcagtcctccctggcgtcctgcaacatctgaccaagatcatccgcaacgtcgttaccatcagcagctatttcctcctcgcccgtttgatttccttcaaatccaacatactgagcaaagtccggaatattgtcatcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggatcgcctgtcagcgtacatccattgccgatccatctacatgagtcaaaaaaaccgtacacaaataattattcttacaataatgacagtcatacaataattataagatatctttattcatacaaaaatcataaaatattacaccaaataattcttaaaaactatttgtaaagttttaaactaattttaatgtgttttacttcttttaattttcattttagtttgttttctattatttaagattaactttcactagagttttccttctcaactattttataaaaccttgtttagcaaatgaactaaatttctatatattctttcttccccacacacattttctctctcatcaacttacaactaaattttggagacaaaaaaagtgtgcaaaacataggtgcaaatgtagtatgacaaaaaaaaaacattggaggatgaagttgcaaaccttttaggcacctctgatttgtatgtaatcaccaaaataaattcaatagaaattttggcatgacctcccctcttttttgaagaaattttgaagcttgctcgggcagctggaggaggaagaagacatatatatatataggggtgggactttagtcccggttggtagcaccaaccggggctaaagatcaccgggatctttagccccggttggtgctaccaaccgggactaaagtcccacccctatatatatatatgtcttcttcctcctccagctgcccgagcaagcttcaaaatttcttcaaaaaagaggggaggtcatgccaaaatttctattgaatttattttggtgattacatacaaatcagaggtgcctaaaaggtttgcaacttcatcctccaatgttttttttttgtcatactacatttgcacctatgttttgcacacttt

SEQ ID NO: 60043 - DNA, 32765 bp, Oryza sativa
agagatccagagaaattgtttcagtacagagagccaggaggattaacctgtagcattatcacagcaacatggcacggaccactccaagctgatcagaaactattgactgaacaaaaaaaaatgtaaacgatcatttcatcaatcagttgggcagatatcaatgtacaagtcggtggaggagtcacacgataggcacaagcatcagaaaatgaaaaaaacactattttgtgaacaaagttcactggagcaatcggaataaaaagctggtgatcaatcagctaatgtcgtgataaagagggagggagagggagggaggagaggatcagtacctgcatcactggaagttggttgacttatcgccggtaagcaaaagggggttgattatagagcttgcctgtagggcttaggtcctcccgaccgtagctgccgccagggctcccttgagctgggatcccatcctatctctcctgtattggattgttgcctccctgtgcctggcaagacaatgaggacatggagttgacatccagttcaatcatcaatggattgaacaatacgggatagtattgttggcaggtcatctatgcacacaactttaattaagaatatatattgcacttaacaattaacattccattggagaaaaaaaatctggtaatgttttcactcaaaatctttaatgtataactttcatcattttcactttaatctggaattataatctaacctaaaactgctaaaatccaaacctgataatttatgagactaatggttcttgtcttcaagagaggctaacgacatttgagtttgtgagattgcaaacatcactaaacaattcaattatgaaccctatccccttagaatgcaattgaaggacctctgcactctttgatccagagaatagagggatacatatgtaatatgcgtctccctgcaccgcagaaaggggaaaacacactaataattgtgccatacttgacagttaatgggcaagacacaaaatgtgccattttcaaggtgacttccagctgatgttagctccatcacatcaactccaataagtaaaaaagtgcaaaatatcttcaagcctatcattggaattaaatctaaaaatatgttccataaaagaacttaatacttacgaggtaacgaaatagtgtagtaagatttgccaagctagatcaatggggatccacttgaatatgggaaaggcgagtgctttggttaatgacattgtggaacctataggctatgtataattttagtgtgggacccccggaccaaatcacattggacccctgatccaacccaatcaaataggcaaagcaagcaaccagaatgcaagacgcctgatggccgaatgctaattaatgccagatgcctgacggccaaacactaattgcaatctgcatcccacaacttaatttattaaactgatgaattgctttcagattaattaggggcattgggcattttgtttattcaattatgtgcactgccacaactgatgcttatcgtttacactataatcggtaatcggcagtcagccaagtccttaggtaattaactaataattgctttgtagaataaatttgtgtgatcagtagtccaccatgtttttagacatttcctgaggaagcatgactgatatgatacttgtgagatgcttagcaagcagaattcatagcaagtaaaattatctcctaaacaagagcaaataacatagcgagacgatagaaccaattgactaaacatttggggccccgtatcataagcaaccctgcccaaaccctaggtaaacaattttatgaccccaaaataataaaagcacaaaatctttattgtttgaggatttaggaagagaggatatcaccttaacctggagtctgtactgcgtagtgccgtaacccaccacagctccccggcgggcgcacgcgaggaggagccggccgacggcgagcccagaactccagaggccacgcgcgaggaggcggcggcggtggtggagaaggcgccagccgacggcgaacctggctcactggcggccgcgaggaggcggcaacggcggggtagggcgagcgtcgggcacgcgcgaggaggcggcggggtagggggcgcggctgcggcgggtgcgcgctcggagttggcggcggcgcctggcggtccggcgggcacgtgcgaggaggcggcgagcggctccgggaggcggcgacgggctagcgcacgggagagaagttttttttttcgatcgctgtatcgctataaccgctgctaatcgaacttggggatggctaattgcagaggttgatccaacttttgatataagccgttggatgaatagatctaaaagtcaggaaagataggtgtttgatgaacttgtgttttttatattagtatagataactactatatataactatgaacagagtctgaaatagagcagtggagtagccccccgctccatccattttcatttttctagaacacttgataggtaaaaccatttggttgagatgcattacagaacaatgtcaataataaaattcctcgcaaaaaaatgtcaataataaaataacaaatactggaaaatgaagcaacatttttgtaaaccagaatctagaacctaattttatgagatgtaaccttcatttagagttttagactaatctgatccacgtactgacgtacatccaatgaaccaaaccgaccataaaaattggatggtatcctcaattccccatcctcctgctttgattatccgacctgacgggctatagcgtggattgtatcaccatcctccagtttgagatcatccggagtttgcgagtcctgaacacgacggccctcgtaaattaaaacacacccatgcctgtacatacttgcaggctccctgcttaagcacaggtccatcaaaccctgcagcttgtcagtccttcgcagggtgtatgtgcgcttggccttcaccatggttaacaaatcgatggtcacgaacctgctcggtttgctcgccggaacgaggcggagctgatcgccgtcctccatctcgtaatccgcgggcgtctcctcgccgccgacctgcctgccaccgtacgtgaccgcccactcgccgttctgatcatcagttggcaccatggcgaagtagtaatcgatcaggcgctgcaactcgtcggtcctgcgcatggggcgggtgacgacgacgccgctgcggccgccatcgtcggtgctgcccttgatcgtgagggtgacgaaggtgctcggcttgctgaacagatggaaggtgatctcatcgccgtcgttcatgtcacatttctccggcgtctgatagaaactgatctccctgccgttgtacatgaaaacaccttccctgggcgctgtcgagggcaacatgtcaaagtagagacggaacagggtgcagatgacgtccaacctacgcatggtgtgtgtgacccggcggcctttgttgtccttcacggtgagggtgacgggcatggtcctagttccgtcggggaagaagctaacctcgtcgccgtcctccatgtcgtagtccgccggcgtccggttgccggtcacacaacggccgtagtgcatgaagacgccaccaccggcggcggcggcgacggcggcgcccttgcccttgtcggtcggcgtcaccatgtcgaggtagaaaccgatgaggacgcgcagcttgtccgtcctgcgcatcgtgcaggtgatcctgacaccttcgttgtccttgacccttagggtgatgagcgtgcttgcctcgacctcctctccggccgaagacatggctgatcgagatctcttcgacatggctgatctagaacacagaagccgatcgagatggagtatttgcctggattggttgagttttgagaaaaccttgaggattatgtagaatcaccatccggtacggtataatttgtggtataatttgtttctatagatttgtgcgcgcatgcatggcggaacgtgcacgcatatgcgggctaccgccaagcgcgcgtggagcagtttgctgcatgcgctgctctatcttctcctatattttctccagtgacgacgctagggtacgtacgtgcacaccagtgaaattggagttgtgcgttctgaatttcgtgtttttgaatttgagaatacgaagttagttcgagatatggttggactagagcgaactactggcaaaatgacatgtcagaactatcatctccgatgagcaacctgactgtatagtatagggagaggggaagatactacgaatattagacacgctgtattaagtcttaggagccggtatatataagagtacatgggaaggatataaggaaggattacagataagaaaagaatacatacaaatcaatcattcctaatacatctttaacaaccatatacttttatcactaacatgtacttgctactatgacatgcccctttcggttgccgcatgatatgcatgcatggcaattgatcaatcatgcttaaattaatgaggtccccccttcacaaacaaaagcaaataaatacttgcgttttcactgggctgggttgcccagcatgccaagaattataccgtccagtatttattgtgaccttcacatggtttcgggtgagtgcaatccatacgcgcataatagccactcaagtctcaatgcgccccatgatcataatcaaacaccgttcaatataatttacatggtatcgaatattaagcacaaaggatattgctgggactcacgcgtgccaatcaacttctgcatggcatgtgcccttcaaatcactcgaaggtggcgaccagatgtattatacattcagtaaacttgactcaaaaggcatgagctctacaacacctcaattcaataccatactcatgtctagcaagttctatagtcatagtgttgatgtaaaaacacgaggcctgggagatctgcttaactccaatgcaggtccaaaacttgcctttgggtgtatgagcgtgccagttgatttgatcctgcaatcaacaagaaacgaagacaaagaaaccgtggttaaatccataaacgatagccgatcagctaggtgccgatgacatatcatttatctttgagccgatatcatatttgcatcgatctgcaattattaacaagtaagaaagaactaaatctactcgatcggctgtagatattaacaatatataatccttacgttgatatatacttaaatcaagtgattgggatagatcggtcgccatgccgagacagtataaatcacttagatcgaaataaatattaacattgagagtatatatgttcatagcatagccgatcagatagatctagcttgtatcggctaatactccgataccactctatattaagatgttaaagcaaatagaatataccaaacagaagcctaatctacttaaatgcaacaagatcttaatataaagggcagatttaacatgtcaactaagcacataagacaaatatagtcaaatcaggtaagatcggctgaaaccccgatgctaccctaatcagcaaccaaaggcaggctagagattgagattctaatcacgactcataagatcaaactcaactgatacagctataagtatgaaaagaagaacaatatctagacaatcaagccgttggatgtgtcatagagtggtggatatcctatataatctaagtcaacatcggtatttaacctaatcggctgccttctactgacagatgttagctgattataggttagatagcgatattgccagagattatgtaagatatatgataactcgacgaattacataaacaagattagagtgtcatgaagatggaagcactaatcctgagaatgcaagccgtcataacaagttttacctcttgtcgaagatcgaaaccgatgcagctcaacccgaaagcaaaaactcgtcgaaacaaaacgaaagtaaaaagggtggcgatgcgccgagattgtattgaacgtgtgttagtttgattacatggggctcgaggcctatttatacccgagaattacaaaatatgtgtaacatacccaaagttctagactttaaaagtttcctgtcaaaatagttggaagctaacttttctatttttgagagccaaaaatttccattttaaacctaggtgaagttgatctaactcttgcatgaataaaatttgagaacaaattaaaactttttcatttataacctaggacaaaatgtaaacttctgtgtaagcatgcatactctcatatgcatactctcatagacatgtttgacttgagtccttcatatgcatttggattttcgatttgcatttcataataggtctcatgaatattaacgataaacaactaaaccattagggcttagtgctagctagaggaagttaaaataggaaccgtacaccttaaaatatatcaacatggttaatgtcaagcctcacaaaactaatttggtcatccatctgaagacatgtcatgaacatgaaagtgaacaaataaattaactcatatagggtatattctatcttaatcatctctataagcatcctcttaatttaatattaaagtaaacttatgcataaataggtaaggagcttacgacctatgtaaggtaaactgtaattctaccatatcaacatcacctcaggttaagaagagtccaaataaaacttttataagcatttacatgcatttaggaaaagggaaacacataaaagagataagcatcgctaattatctaaaataattcgtgcaagataaaatgatgggaaaatttatgtaagctctacttaatatatacaactcactgtaattttggtacaatttaataactaaatttgataccttaaataaacaagtcaaacttgtcaaataatagactaaatataattcttaatcagctaaaaccatacataactaaaatgtgcatttaactgcatggaagtgtataggggaaaatcatgaataaatataatttttccagaatttatcctctcagtttaggtcttctaaattcaaacaatgttctatcgagcccatcttctcctattttctgtgagcaatctatttataatttttaagtgcaaccaaagaaaatagaaactagctacattcatctaccttcagaaaaacccgcactaatttgtatgcttcacacgttaaaatattgagatataaagttggagggagagaattaatctgaaaatcgtccaaaaatcaatcaacacccagtttcttacccatccctcagactcccacctagcttacattgacctgggcccacatggcagcctctttggtttgaaccacaccctgtgcatctcctccatccaacacagtgacagctgagagagagagagagaccgagggcgccgaccggcactggacggcgtcgacgcgtggcctcgacgtggcagcgccgaaccgaggcttcacctccacccagctgcatcgcctcctccccattaccactcctgagccgagcaaaccgagggggagagctccagcttttctttttcatctcgaccttgtcgccggccgtgaagacgatggccgtcgccatcaccattgtgccgcggtcgtttcctcttctcttgcgttccattatcgcctctctacgccgattccatccctcttaagtttcatcccatttcatgcagtggtttggtgggaacgcaaacctcgccgacgatgctctggagcgcgcactgggcgccgccatcgggacatcgtcttcgttgccgtcgaaccggagcaagccgagccgagccaccgcaccatcaacatctcctcggtgtcctctcttaaatccctcatgaacccctgccagtggtgcagcgagcttggagatcggcatcgtcttccccaattccggccgtcaagctccaccttcgatttctccctctccggtgagtcacagttcaattcctcgggcataaagctttcctgagacctattcaacaccgtgtgtatgcatgcatggtagatcatcagccatatcaagccggcgtcgtcatcgagcgaggctccctgccgtcgccgagtcgttctgctcgtggtcatcgctatctggacctcgccaagtttcattggacgctcggtaagcatcctaggatcccatagaggcacatgcatcaatgctctagctccacatgcaccgtcacccgagaaccaccgccgctcgcgccgccgtcgccattaattccgatgaccaatgcttgcaaaaataccacctatagcctcgccttgaacccctttacattttatccttatgttgcacaccgagatctgccgccgtttgccaccggcgagctcgagaacgagctcggccatggctagctctgtgtctgctcaaaccaaggacctctgctgagaagagtcaaaactctaggtactagtttgtaaaacctacctcacacacagaacagtcacaggactgcgagttgatttcctaaaaccataggggcctttttgcatattggtctgagactgacctgtggatccaatctatttaaattctggaaaaatctaaatgaaatgcctaaagctttatattttcaacagaaaaacatgtaaacttgtaaaatctataacaaattgaaaacaactcattttagagcaaacttagtttctacagatccaccaacatgttctctaaaaacaaagtaaaataaaacatatacacactttacatcaaatgcctctaaaactattatctttaaaataactagttttacataagctgaagtttagaagtttatataaaattcatcttagatcctttttgagtatacccaagttctgtagaatcaccaaaacatatacttccaagttataaaataaaaatatatgcttattgtacaacaaaagcctctaatatttatgtaattaataaccaacatagagcagcctttaatttgtaaaatttgtagaaaattcatctttagtccaaatggagtgaaccaagtttttatagaaccagcaaatggtgagcttcaacatagtaaaataaaatatggcaccttctgtataggttattgctctaaactttaaatctataggataggtgctaatcacatagtaaggattaagcaatacgtatatataaatgtatataggaatacactaactataatgaaacccaactaaaacttgttgaaccagtgaaggcataagatccatccccttcctccaaaacttagtaccctttactcatataataatctctagattgatatattaagcttctagcatagaacatcccctagcttataaaatgtgaagtaaagtaatttgaactctaaaatttataaactaagattacattagttaaataaaatacttattttatacatcactagctagatgaggcaagttctgaacctaaacctctgaagccatgaacctatagaacactatacacctatgacacgctataacttgtaaaatacataaagaattcatattaactctaaaaattatgaaaccaaatgtgttaagtcttagaaaacacatatcttcacctcagcaaacataaacttaataagaatcatcttacaacagcatttcacaagcatttcacaatagtacctaagtaaatcctacactataccgacaaaacttctaaattcataactctcaaatgaaatgagataaaatagaaattctttcacctaaattcattttagacaagcacttatccactgtgcacaaataatgcattttagagcatttcggatttttcgcatatttcgatgtttaattgtataacgtgtactttgtatagatgattgcttaaatggtgaagaagtgatttaggtgctgacattttcctgattcaaggcaagttccacctccctctctttgatcactttgaacctatgttttggaggttattgaaaacgtttccaaatcttgcatgtcgattgtacactaacaaattaaaattgtgttaaaattgttagacaaactcctattatttgcattatcaccttaaccccacatatatccatatccatcattcctaaccttaggaacaatatgactataccactttatatataaattttggagtcactaggttactataatgcttagccatgcttagaatggtcttccttgtcattatgggctcattacaaatatgaaaattgattttgaaataatctggacagaactttaatacttgtgtttttgataaataaaatggtggaaaacatggattttaggtttgggcctcaagtggtgcacatatggtgattagttatgtaccgatagggggagagtgcgcccaaaccgacctaaggacttcactcaatgtcagttcatttcgttgagtcagttcatttcgtatacagtacaaccacatgtgctagtatgggatagcccaagcttagtaaattatttatggttcagccttacattctggtaggccggtgtgtatgagttcggataactcagaggaacttcctatttacctcgacgtggtagtttaggtgactaactctatctaatacaatggtattgtgccacgtgggtggggtcccgttgtgttcgccaccatggcgttaagtttaaggcgtgggcccaccacttaaacttaacggttctaggtcatataacgtgtatggcttaggatggagtaacacgtatcgtgctggtgtaaggctaaatcataaattttggaaaagctttgttgtgggtaataaattgggtacttatgtatcgcgtgccatgctcttgtatgattattattttgcatcatgtgggtaaagtgtacaaactctgcagagtaaaaactaatcaattagccgtgctcacggtcatgagcggcgtgtggatatgtattgagtataggcttgtgtttattcttctaaatgctaaaatttaccttcaaattatgatgagatttgagaatgatctcctggctgccatggaagccaatgaggtgcatatttatacatgattaatgcctactttgatgcccatatgctaagtacttaagtactagcttgctgaaatttattagtactagcttgctgaaatttatttgaaagcaaatctgatttggaaatgttttatacaaataaaacttgctttatgctaaaaagaaccatactatgcctttcttgattatatgtcttaattaatgtactgactcttgctgttgaattaacttttgcttgcaggttttagatttagtctttgagtgatgcaggtgattgactgcttcttctaggacttaaacttaatggggtaaacccctagtcggtgtgtttgaggattgggtagtcaagcttccgctgttctttatatttatttggccggtcggcctatgtaactatgaagtagttgtgatttagattattttcgtcttaagtgtatttttgctatgtattttcatgcttaagatgaaagtgtgaatctagtgcacatcttgggaactagatttacatgagtatgagttaagaatatttgagatgttgtagatctttaccatttttgtcaagtctgctgaatgtgtaacacatctggtcgccgcctttgagtggtttgatgggcatatctcagactgaagttgactggcaatgtctccaatattcttctctcgaggcgttggatgtttcattatgtttgtttgatgacttgaattattcacttcatctctcaaatataatgggaggtccggagagcctacgacaatatgtctatatcggacacgattcttatctctaacaaattttaagataccataagtctttgcggcacttttgcctaagcatatctttaaggaaattacataaaatatcctaattaatagatacaattaccttctcaggactctatccatacgtggcaatcatcatgaagcacatcaacctaacctgacaacgtatgccatgccatattgtcagattcggctcaatcggctaaccctgtccaactcggattctgccgaccctgatcacagccgattcatgctctgtctccgaaacaatcttggatttagattccgcttaaatcttaactctatctttgatactcagattacaaatttggtcgttaacacatagaacttgtcaagacactttcatctagcaattgatatctataaaagggagttctaacacatatataatataaagttcagatctattatacatatggccgaccggccaaatagttagtggtttagcggaagcattattctacccaaaataccttttatgcaaccgactagagtagaccctagttagaaccatcctaaaacttgaagttatcctcaacaaagcaatcctcatcgatgaagacctcgcctgcatccaagtctagaataacaagacaaaaatacaataacaatagcaagggtcaaaatgagattcaaaacatatgtacatgcatggctaaaataatggaaggtcaaaagtagttcaatttcagcattaagcaagttttgtttttcacaaatatttttaaaatcatgttttagaaaaaaaaagaaaatttcagcaagcatacatatatcattatggcatcttatacatagtaaaaatcatacatgtatataaacaacttggtgctctccaaagcaacaagtataatgaaccatttcgaatctcatttcatcatcaattcacaaaaggtttagttcataattaaagagagaacaagaggatttaaaacattattctatactcaatacatatccttatgccgctcataatcatgaggacgactaaatgattagtttttactctgcggagtttgtacactatacccacatgatgcgctatagtaatcatgtaaaaacatgctacaccgtactgaaatacccgatttactactcacaacatagccgttacattactcatgatttagctttacactagcatgataagtatgattccaccctaggcatatgacctagagtcattaggtggagtgcccacgccttaacctaacaccgtggcaacaaacacaagagttttccccacgaggcactatatcgttgtattggatagacttagatgcctaaattaccatatatgtaaataggtagttcatatgaactaccactaaaactaattcatactacttcggcctaccagaatgcaaggctaaataatgagaaattaacttagtgagctctggctaccccataataacacatgtggtcgtactgtaatcacaagtgactaacattgagttaagtccttagagtgtgtcgggcaaacactccccctatcggtacacaactaaacatcacatgtataccacttgctgcccaagactaaaatcattgattgattcattttggttcacaaataatcacatattaattttctgtccagaagtatttagaaatcaaactttcaaaattaaagagtgcctataatgataactacactagtctaggcatggctaagtatagtatgacaattgaacaggatcttaataactttttagcaaaaggacagtacactgtcatgtcaaaaaggtgacaatcagtaggttaatcaagtttcaaagaggggaatgcaagaatttggttttagctatcacatattaaattttcaaccatttatgtttgaaactaagtatgcaatttttcaatcaaaacatttaacctccagaacatgggagcaatatgatcaacgagggaggggaggtggcttgccttgctctggttctaccacctgttcagtctcgtggatttcttcaactatcgcctgattgtcgtctaaacatacaggtgaaaaccaaattacaaatatacacaaagattcagcatggtctacaatgactgctgtttttatggttaataagtactgtgatgacttgatttttagtgaaggaatttttattttatcatatcccatctgcaagatataaatattcaaagttgcaaactactaaattatggcctatatgcatttcgagttgttaagacataaaacttcaaagttctgtcaagctgaacatttttagattacagattataaaaatatgaacctaacaaaatttagtttgaaatttttagaactataatgaatttccaaagttatgtcaattttcagctcaaaagagagtgtttaattaatttttcctctaatttttcaaagcctaaatatcctcgtgttttagtttatttacaaataggtactaaccccacatgtgagtgacagattaaactgataaaacacccctggatgttttaaaagtttgcaaatccacgcccttgcgctaacagaacagggtagcagtgagatatgcggcgtcgcctccggcgaaagatgaggtttcagattgtgcaaccaaaatgtagagtgagaaggggttctaggcgaagctatcgacagctttcttgcaagctatggtggtctacatggatggcgttggcattggaagcggcttggctcagcatgcatgtgtgcatattgagttagaggcttgatctatgcggtaccaggctcgtatatggaacttggggcacctaggaagctaacccgaaggccagcaaagtctggcgaagtctcaatgaaaaagaaccgagctcatcggcggcggggctccacagtcgttgtcgatgatgcgtttctagtcttgatatggccaagggtagtgcacgcattggttaaaggtggcatggcatgtttctaagcaaaaggaatcgtgccgaagctcaccagagagcgagagggagatagatggcgttggcaatcggagatgaggaagaagaaaggaatcttccaacctagaccactttgttccgattccgtgcgggttcttggtcaccgtggggtagtgaagacaatggcgagacggtttggccggattcagactgtggtgaccgggcgacgtctgcaactccatggtagcgctcggagttcaccgttggaccgagttgacatggcgcgctttcctgaggattggctgcattgggttagagacagcatggagaggagattgcggaacacggcttaagcaagaacagaattctcacctgatgactatgagcggcggactcaaccttgctggtgccagagaagatggttttgtgcacgacgaaccctagatgatcttccctagtttcttcacgaaatgagcagagggtgagaagaggagagtggatgttggccagctaaatacagcggctgcgatggtttggtggacccagctgataggttgaaccaaatcgactgcggctttggaatgaataaatagaacgaaaccctaaatatgccgtatcggctgtaatactgtctcttttgtttttatcaatcactttaagacagtattatagaaatagctgatagaccaatatttagagcaaagatagataatgtattagctgttactccaatacaaatttatataaacaagtcaatctatataaatatatcaaataacaatcgatcacaaaatatgaggtttaatcgagaccaatctaacttgatgtatttatatagagtaatatatatgtatataagtggcaaatatacataaaacatatcacgaaacatgcactatcatgtatattaggtaagatcggctgaaactccgatactatccttagttatgattaattccaggttagtttttaaggttctagacaagactagggttgatgcaacttaaagtatgataaaaatcaatcaaggaattatccacttttcgggatggtagatatcttagctaatctaatctagtaagataatttagccgatagcagcataaaccctaaagcgagaatcggccgatacgactaaatcgagatactaaactagattaactaatatatatgatagcgatgatcacaataaaatactaatacatctaaagcgatgtaagagctccaatagtgcaagccattgagacaagttgcctcttgtcgagagatcgcagccgatgccccaacttgaagcaagaactcatcgaaagtaaaaagagaaaaggtggcaacgcactgaaagttgtatttattggattgtcatcccttattacaatgatctagggtttatacttataccccggaaacaaaacgtacctattatggacacgactcaaactttcctaaagataaaacaaacaaacaagtccacatggcagactcttactatatctctaattcaaattgacattaatatcttaattaatagatataattgtcttaaacgagctctatctctatatggaaaaatcagttatctcaatcgaggcccaaaccgagcccaagttgagtcgtatcggctgcttgccatatccgctcaatcggcgcagtctgttttggcaagattcaatctccttcaaacccaattcgatatccaactccaaatccgagactatcttgccaaattttgctgttaacaaatgctaaagcagcaacataaccttcatctacaatctccaaattgagtttctaaaaatcagagagtaacttcggttgatcaacttggacagaggtggtaatgtgatgtagctttcagctgagagcatctgctaccacattagctttttcgggatggtaatgaatgccaagattgtaatccttgatgagttctaactatcttctttgcctcagattcagatctaattgggtgaagaaatatttcaagctcttatgatcgatgaagatttcgcatcagttgcctattagataatgatgccaaatctttagagcatgaactacggccgctaattccaaatcatgggttggataattgacgtgaagcataagccaccactttgccctcttgcattaatataaaatcaagtccgtgtcgagatgcatcacagtaaatatgaaagctttcatgaatatctggcatcactagcactagggctgctttgagcctttttctcaattcatgaaggcttaattcgcatatctcagaccactcaaatttgtgttctcttttaaagagttgagtcaagggccttgtgattttagagaagtttttgatgaatcgatgataataatcagctaggccgagaaaacttgtgacttcgggaacgttctagtgttgtttccaattaaacacattttgtacatgttggcggtatgtcatgagacccttcgaccggtcctgctgaaaccgtgcaaccaatggagggttgaagctcaagacatcgagtctgtgggggcgaagcccacatggcgaagactatgaagcaaagatggcgaagggcgaagaatcacgctggtatcccacaaggtggaagacattttgggcgaagactatatggcgaagaaggtatggcgaaggcggatgacttcgccatagcaagccgaacttcaaggaggcccaagaggccgtctcagccaatcaagcccgggggccactgggccagcgttcgccagtcggcccattagaggcccatgtacctcaattacactatatacccatgtaaatgtccctttcataagggcaaccatgtaaattcccctgttaaacctaaaccctaataggggaacctgtaatagggctataaatagacccctaggccatgtaaaagggggatcccaagaaaaattctcaatttaatacactttactgctttccaaccactgttgagtactttcgacgtatgccgctgtcgtttcgacaacagctggcgccgaccgtggggacctccgagcgaaatcattgagagcgaatgccaccgaagagggtcgtgaagaagaaggtcgcaaagcgaaaggagaccgaagcaggagaggagatggccgccgaagaaggagcagagcctccgacgtccatgggcgaagctaggggagcaccatcggcttcggcaccggcgccgcaactgccaccttcggctcctgccgcttcgtccgggcagaggccaaacacggtcgacacggcgaaggcagccgcggcggcaagggcgctccagaccagggcggagatcctttcgacaagccagctgctggtgccccaagccgcttcatcacagccggcaacggcttcgaccgcgctcgccgctgcacaagtcaaccccaacctcgaagcacaaggcgaagccgacatggaggccatgcgacaaaacatgacgcaactccaagacatgctttgacaaatgcaagaacagcagtaggcatacgaggcagcgcggcaagccaaggtcgcttcggtcccaatcctctagtattcggcgggctacattccaccccaagtccacccacaagcatcaatccagccccttccgccacaagccatgcaagcgccagtgtacttcgccgggcagccttcggccgcaacaatacacccgaccccttatgtgcagccgcaggctcagccggtcactatccaagtacacccgccaccacctggccggccaaagtgcacccagttggttgccgtcgagccagcctggttcgagggtttcgccttggagtcaaggaccgcagttcgacttcatcaacactgctcaagcaccaaccattcgaccacaggaaccgacatcaggcttcggagcaaaccaagcgccaaaccaggtcgccatggcatggacccagccgtcgttcgacccatccatggcggcgcaccaagcgtccccgttcggagacgggccgccgaacactgtggcccaacctcacgcgcaagccatgacttcgcccttcgccacgccatagccgcagcaaggtgccgcgaacaaggcgggtggtgaaaagaggctaccattgagcgggagaatcaagatccgtccaatcccatcccagttcaagttcccacccgtcccacgctattcgggcgaaacagacccaaaagagttcctgtccatatacgagtccacgattgaagcctctcatggtgatgaaaataccaagacgaaggtaatacatctcgctctagacggcatcgcccgttcttggtacttcaatttaccagctaacagcatttactcatgggagcaattgcgcgatgtcttcgtccttaactttcgaggcacctacgaggagccgaagacgcagcaacatctactcggcattcactagaggccgggggagtcgataagggagtacatgcatcgcttctcgcaagcccgatgtcaagttcaggatataactaaggcgtccgtcatcaacgccgcttcggccgggctgctcgagggcgaactcacaagaaaaatcgccaacaaggagccgcagacgcttgagcacctacttcgcatcattaacgggtactcaaggggcgaagacgattccaagtgacagcaagcaatccaggccgagtatgataaagcctctgtcgccgctgcttaagcccaagtacaagcacaggtcgccgaaccggctcctttcgccattcgccagtctcagtcggcgacccaaggacaaccgccaaggccaagtcaagctcccatgacttggaggaaattcagaaccgaccgggcaggcaaggccatgatggctgtcgaacaagtttaagacctccgcaaggagttcgatgcccaacaggcaagcagccatcaacagcccgttcgcaagaaggtcagaaaagatctttactgcgccttccatggacgctctgtgcacaccaccgagcaatgccgaaacattcggcatcgtggcaacgcgcaagatccaaggccgcagcatggagcagctgccgaagcatctcgcgaagctattcaagaacaagcacccccggccgaacagcaccaaggtgtgcagtgcagagtaatccaagtgattacaaggactgacccgccgaatcaactgtcaaaagggcaaaagaagatgcagctgccaatggtgcacaacatcactttggcaagtgaaggggccccgcgatatttgaaccagcagatctcttttgggccagaagatgccgaaggagtgttgttcccacatcaagaccccctggtgatctcggccgaggtagctggcttcgaagttcggcgaatcatagtcgacggagaaaattcggccgacgtcatctttgccgaagcatatgccgagatggggttgcctaccctagccctcacccaagcaccggcctcgcttcatggttttggcggagaggcagttcaagtcctaggccaagcacaattggtggtagccttcggcacaggtgaaaacaggcgcgaagagcaaatactgttcgacgtcgtcgacatcccatacaactataatgccatctaaggccgcgcaaccttgaacaagttcgaagccatctcccaccataattacctcaagctcaagatgcctggccttgcaggagtgatcgtggcaaccttcagctacatcaaagggcgatttagccataatcaacagagcagtgcacaatgttgaggccgaactgcatgaccccctcatggcagggtgatcaaggtgcaggtcgacgatgccgatcccacaagacttgtatctctagggggcgacatgtgcgaaagagaagttgagaacatcctggaggtgctcaagaaaaacattgatatcttcgcctagggccccgacgaggtgggaggtgtttcgacagacatcatcatgcatcatctggcggtcaagccggatgccaagccaaggaaacagaagctgcgcaagatgtccgttgatcgccaagaagcagcgaaagccgaagtgcaaaagctgctcaaggctggggtgatccaggagatcgaccaccccgagtggctggcgaatccggtactggtgcggaaatcgaacagcaaatggcgcatgtgtgtcgacttcacagacctcaacaaggcatgcccaaaagacgatttccccttgccgcggatcgactagctcgtggattcgacagctggctgcgaactcatgagttttttggatgcgtactaaggctaccaccagatccacatgagtccggccgacatccccaagacagcattcgtcacaccattcggcaggggcaaccttcaccaagctagtgtacaaggtcctttacaagcagctggggtgaaatgtgcaggcttatgtcgacgatatcgtcataaaaagccgcaaggatttcgaccatgcgtctgacctgcaggaaaccttcgacaacttacgcgcggcgggtatgaaattatatcgtgagaagtgtgtttttggtgttcgcgcgggccagttgttgggttttcttgtttctgaatagggtatcgaggcgaaccacgagaaaatcgattccattcagcaaatgaagcccccgtcgagcgtacgcgaagtacaaaagctcgcaggccgaattgcggcactcagtcgattcctctcaaaagcagacgaaagaggcttgcccttcttcaagacccttcggggcgcgggaaagtttacctggacacccgaatgccaagcagcgttcgacgagctgaagcgatatctgcagagcccacccactttggtcagcccagcactaggaagcgaactgctactctacctagcggctttgccggtggcggtcagtgcagccctcgtccaagaaacagagtcaggccagaaaccagtgtattgaaatggaaaagcttgcttacgccctagtgatggcttcgcgcaagcttaaacactactttcaggcccacaaagtcacggtgccatcgcagtatcctttgggcgaagtgctccggggccaggaaattactggcaggctcaacaagtgggcggcggagttatcttccttcgacctgcatttcgtcgctcgcactgccatcaagtctcaagtcctagctaacttcgtggccgaatggacactggcattcgcccttgaacccgagcctgtcgaacaaccttgggtgatgtactccgacagctcgtggtcgcacaaaggggcgggtgctgcggcagtgctcacttcgccagggggcatgccgatccggtatgctgcaaggctgcagttcgacacaaccaacaacacggcagaatatgaagctatattgttgggcctaaaaaagacgaaagctttgggggttcggcgcttgctcatccgaactgactccaaattggtggcaagtcatgttgacaaatcctttgaggcaaaagaagaagggataaagaggtatctggaggctgttcgatctatggaaaagtgtttcgccggcataacggtcgaacacttacctagaggccagaacgaggaagcagacgccctagtgaaatctgctgcttgtggaggcccgcattcgccaggcatcttttttgaggtcctgtacgcaccaagtgtgcccatagagagcctggacatcatggcaatcgaccagacagagctgggtgaagacccagaagactggcgaacctcgttcgtaaagtacctcaagaacggctggctcccggaggatgaagcagaagcgaagcgcctacagctcagagccgcaaaatacaagctggtctcaggctagctatatcgctccagggtgctccaacccttgcttcgctgcatctcctttgccgaaggagaagaaatggcgaataaaatacaccaggggctctgcggcgcacaccaggccgcaaggacagttgcctccaaagtgtttcgacagggtgtgtatcggcccatcgtgctgaaagtttgtgttgagcaagctaagaagtgcaaaagctgtcagcggcatagccgaagccaaactgcaccccaatatgagctgcagcctatcgcaccaatctggcctttctccagatgggggctagacatcattggcccattccctatggcacgaaacgggtacaagttcgcgattgtagccatcgaatacttctcccaatggatcgaggccgaaccactcggcgcgatcacttcggtagcagtacaaaagttcgtatggaaaaacattatttgccgtttcggagtgccaaaggagatcatcactgacaacgacaagcaattcgattctgacaagttcagagagatgtgcgaggggctaaacctggaaatcaggttcgcttcggtcgcgcacccacagttaaatggggtggccgaacgcacaaatggtaaaatccttgaggcgcttaagaaaaggcttgagggggcagcgaagggtaagtggccgaacgaaatgctagttgttctataggcccttcggacgacccccacaaggccaaccaagttcagcccattcatgcttctctatggcgaccaagcaatgacctcaacagagttaggggctaattcaccaagggtgatgttctctagaggcgaagaggcgaagaggggcgcgaggtgtcgctcgaactcctagagggggtgagagtcgaagcactagaacacatgcgcaaatacgccacaaacacttcggcaaattacgacaaaaaagttcgaccgacagagctattgcctggccatctcgtcctaaggaaggagaacccggtggtggtcgggaagcttgaatcgaagcgggaagggccgtacctcatcaagcacatgtccaggacatgctcctttcgcctagcgatgctggaaggcgaagagttcgaccattcctggaacgcggcttcccttaagcgtttctatgtgtagcgcgggtggcacccaaatcgctaacttgtaaaaatgtacatactgttatgtaagcctttcggcactatgtaagcccttcggcacaaaaatgcaaaaaaagaggaaaatgaaaaaagaaaaaaaaactggatgtagggctattatccactctggaggcctgaaccagtataaaatatttgtgttttttgccttttttgtgtgaatgataatttgtggaaaaaccccaaggcaaacgcctgatcagcgaaaatgccagggggggcgaaacgaatcggccgaagcatcgctcgctgaacgttgaaactgtcacgaccggaaataacccaacgggcgttccttacgtgcgtgcattattccttgtcccaggaggcaaggtacaccaaaagttgatacagttcagagtttaacaagcggaagcgtaaatagttaatttattacatgggcggcgaaggcccagcacacacaaagacaaacgggaaacagcggaagactagggcgacgaccacaggcgcttgacggcaggcacgagctagacaccaaagccttcatcttccaggggctcctcttctgggtttgggaaaaattgtgcaagactgagtacaaccaccgtactcaacaagacacaaccacaagtgcaggataaatgcaagggagtacaagggggttataatataaagggttagggtttgcagtaaacagcattaaaagacacttagttgctcaaagctattttgtaaacacgattctagagctatacaatattattaatcaaggccgtgaacccacacgaacctgccttaacccaaggcctacgatgattcagaccgaactggcaacccgaccctgggtcccagctcgtcccaagccaacccaggccaaccattccacattttagttgttaagtaggttttaagaattaaaacactaacttgggtacattgctcggcttgcccataaccgagggcgcagctattcgaatagattatactctgatcagaggtgtacatctttacccacaagacacatcttcctcacgtgtaaccacgtgccacataccaccacggtatacggacggaagacgtgacatagtttccaacccatcctagccatagacaagagtaccgacccaaccccacctacggccggaacccccgggacaggtaggcaggactgagccccgagcagcaggacaccggccctgtgccatgacatctcgactaccgggccgcagctcgtgtagccttcatttgtcctagagatgtccatcgacccccgacttcgtccatctccattcgtgtacttttgtttataaccagactgagccacaaactaaaccttacccactagacatgtggaagtacggtagtgctttgcaacagaggcccgaagaccggcccttatatggccgaggtgctactatcaaaaccatgcaccccgagcccagcctaaaaccattttggggattttgaatagagggggaggtgtgaatccaattccacaataatccaacaattccatagtgtccaggtgataagagtattcccaaggtctagagttgtaaaaccacctaatgttgcctaattaaccagcgaagcagctacctaaaatcatactagtggtaccatgagtggagtgtccactagttggggttttgtttaatctagggtgaacaaggtaataataacaataacaataataaggtcataacaaaggtaactaggcatggctagataaaaacagtgataacgcgggaatttaagaaaagcgataatgcaataatttaaatcaaaataattttataaactgggattcaatatgctcaaggataatgtgacttgccttgctcgctttcccaaacgtcggcttcaacctccacgaagagcggatcttccgaagctgcagcgtctacacgaccaacggaaaggaaaaagcttttactctaataaactccatataacaagcaggaacaaagcacaaaaatgggttcttgacttcttaaggaaaaattagagacttgaacggtccaattccgagttcaaatggccaagttatggccatttgaagtttatatgctctttaaatgaatatttgcgaatttcttcatttaaattttaatttaaaaagggtttattgcgtcagccgaggggaaggggcgcgcggactgggtccacgggagtggggcccacgcagcagcctcacggtccacggtggaccgggtgcacccgggctcacactggccggcgccgtgggtcccacgcgtcagtcgcacctaaaggcgcgggcggctgacggccgggccccacgcggcagccactcggcgcgcccgagggcggccaagccggcgcagccggcgggaggcggcgcgcccgcgccccgatggtcgccgccggcgaccaccggcgtggcggagcggcggccgagagaggggaagggaagggggaaaagaagcggcggtccacggctcaccctaggtcgacggcgacgacgaaaaaggcggccggagcggaggaaggcggcggtgcggctcgggttgacggggtcgacggcgttccggcggtcggcgagcgaaacggaggggtggacgaggtcggcgaggatgcggcgaagccgaaggaggcggcgccgaggtgggaggtggtccggggcgacgacggcggcggaccggagctcggcaacgacggcggagagagagagcgacggcgcgagctcgattccggtgaggacgaagggcggcgaggggcggaaacggacggaggaggtgcggggagggtttaaatagagccggggcgagagagggtggccggggaagggaggaaaccggcgcgggaggtccggccgtcatcaatggcgccggcgagatttgcggggtcaaatccgcccgtttgaacgcgagagagagagggaaatttggggggaaagggagaggggatcacggggagtgatttccccctctctattgcacgcggagacggcgggaggcggcgggattcgcggcggcggcggcgctagggcgcgggccccacccgtcagcgagggtggcgggcaggcccgcccgtcagcggcgcgcgcgcggggagaagccgggtgggccgcggggagaggagagggagggggagggagatgggccgagccggcccaggagggagagggagggaaaggggactttttagagtttttctttttataaaatcattttaactttgtttattttttaataattattatttgtgctctgaaaattccactaaaatttatttacgcattttaggcttctaggaaatatacaaaaatcctctaagccttatttgacttttaactttgcacattttaattgttggaggctttcacacggattttaattattgtaggcataatttagaggatgtattttagagtcgttttgggacgtgacagaaaccgcaacagcttgtttcggaaaacaactaaccgaacaccgttacactcgatcaatatgaaaacacaagcgcacctttcagcgcagaatactacagatcgaaaacgaaagtcgaaagctaaaaagtcagcagacctatttcgctaatatacgcaaaggggccgacacattccgacctaacgaaagcacgaaaagtgacaatgcgaaaaatagcgaaaaggaaataaagcacatctatattaacttcgaataaataatcgaagaatacaagtcttacaacatggtacaagcaaagaaagcaatggctttacaacctagcttacagataaattacacctttgcccccacatcaatcctcactccctaaggaatggtttggcaaattgggttcgtcatcactactaatattatacatgaccctaagaggggaagggggcgaaacacagactagactataacgacgctaggagatcgcctcctgacgattggtcatctgatggtttcgccaaaagcgaaccatgttctccagaccttctgtatgaacatggtcgtagtcttccagggttcgcccggggtgcgcccgcatccagccgacaaccttcaaaaccttgtaactgttgctgtttattatcatctcatgataaacaagccgaaacggacatcgcaccttcggcaaacccttcactgccacgaacttcttgttcttgcttcgccaattcccaaaggggggccaaacgcacaattttcggtgaacaccctgctaaaacagtgcagaaagggcaaaaggcgaagtgcaaagttaaggctttgcaagaaacgtaaaagtcggcgaaaagagtaaacactctctagtatgcaaaaataatgcgaaaatgacgcaagcatatatgccaaaggcatcgaccataataactggctaaacttgggtcatccattccacatatccaaaaggccgttttcggctacaataagaaggggagagggccatcggccaaatttacattgttcgccctccgcggcaaacgccaaagaaaactacaaaatctaaagagaggacggagggcctcatacctctgggtgatcttgggcatcgcctccaccccctccgaccgctgcatcctccccttcgccctggtccgccgcctcagccttcgctagttgctcaagaagacgcgccttggcggtggatcggccgtccttctgccataactgttttcgccaggcgtgaagcgcgggcgaaatgtcctgtgcactgacctcccagtcccccttcgcatagttagggaactcggcgacgtgctcgtagccgaacggttgcagaaagcccatggtgaaggccgccgacacgcgtgcacagcaatcgccgtacgcagtggcgcagtccgagaccgcaccaccggcctgctaggttcactccgagaagtcgaaggtggaggcatcttcgccagggactcctcgcaccctcgcctccatgtcggaaagggcaaggcgaagtgtttggcacgccatcttcgcggactcggtggctttcgccatctcccgcacgaaccgctgcgactccttctcggcgctcgcctcagctttgctgacctctaggcaaagagcctccatcttcggcttggtgagattgtaataatcagtcagagcaggagaatgtgctcctttttaagttcagccttgaggcgctcaatctcagcattcgcctccctctccttctccagctcggcttggagtcgtttgttttcggccttcgtctctttgagggtgttagcgaggccctccatctccaagctcttgcatcccagttcgtcatccttggcccgaagacggttcttgaatccatcaagacgggcccgcatggttcgctctgtcgaacaatgagccacaagaatctgggtacaaaaatagagggggcgaagaggacgaacgtcagttatgagattgttttaaaaaaaaagaaaaacaagagaaaggaaagaaaaatgaacaacatacccgaactgccaaacttttgatggcagaacaaccttcgtcgaactcgttcagtttggtgaacaagctcgggttgccagccggcgagacaagattacttaccccctcgacgaaggggataagctctgcctgagtttcaaaatcaccaggggcgaagtggggcgccgcaagagaatacttcgaggcagatgtttcgacggcagcccccttcccctttggtatgacaagcggcgaagcaaccggctgacgcatagggcttccaaaaaccctagccgcggccttgacgacccggtcagcggaagccaaggtcccagcggcagcactacaccccgctccgccagtgtcaactatgacaacgggggcggtcgaaagacttaaacttcgaccagcgggcgaagtcagggttttgtccaaagactcgtcgtcgctgaaaacacgagcgatatcgacgagccctttctttttggcacacaaacacggtcaccacacgcacaagcgaacgactatcgacaccggtacacgggtaccggggtcgacaaccgcacaacgggcacgggtgacaccgaaaggacgaggagcgagaggacggatccttaccaccacgcaacgaggcgtgggaacgacgacggtgaacgggcgcggcggagacagctcggggacgacggaggcgaacggcgagggaacgactttggcggcgatccttggacaaaggcgagacgcggccggtgcaacgcttgacgacgcggaggcgaggacgaagacgacgacggggctgcggcacttgacggagtgaggacgacgaacgagaacggcttgatggagggacaaacgccacgacgaggaacgggcggccgaaggactctggcgaggcgggtggaggggttggcggcgacacggcggtgttccggcgaaacctaggagtggccggggaaggagacgatgctctgtcgcggcaaccggggcggctagaggtagtgggtggcggcaatgccaccggttgttggcggggacgcgcctccggtggtctgcacgcgaaacggaggcgacgccggtggaggggaagcagctgcgacgccgagggaggagacggcgcggccggccggcgcacgggcgaggtggtaggggcggctggagagtggccggcaccgaggaaagagaaggaggaggcggggagaggtggtgcggccacgggggagctcgggaaggggctaaaacgatagaacggagcgagggtgttccattttataggatgggggagcgagccgaccacgggagaaggtggaatggaggcggaaatggcggccggcggccatggaaggtggccgggaatggcgcggccgttccgggcgattgggggcacgaatcaagggggaaaacgggggaaatcaaagaggaatcaatggggattaaaaccccccaattaatttggaaagagccggcttgaatggggtggatttggaggagggaacgagctagggttcacgagagagagtgaggaggccgggcggctggaggaaggagacgacgaccggcacgtgggccccacgcgggcgcgcggtcagcgcgcgtgcaatgcgcgtgcgcacgcggctcgggtggctttttttttttgagaagaaagtcggtaatttcattcatgagaagtcagatttacatgcatcgcaataaaacctggagggtttagaagccacacatgacgcccctcactcaatgtacatgcaaacttagccaagttatgagcatctacatttagatcccgactttcatgatgaaattctactctaacaaagtgatggcttcttatgttgatgtcattaaggactgccaaatatctgcattttggtattgtcgcaatacccctgataacttcttgacagtctgaagcaatacagacctttaggatgttgcagtccatggcgatagcaagtccttcattacaagcaagagcttctagtgtagttggatcagacatcccttcccaaaccatagcactagctgccagaaatttaccagatgtgtcacgacaaatagctccaagagctcctttgttgcttgatcgagaaacagctccatcatcattaatcttcatgcaactttcaggaggtggtatccaactggttgttttagtacaaactagaggtctcaacctgtacatgcattggattattaatgatttccaaatcagccagatatgattcaataaagccccagattgttaaagggctttgataaaaatcatcatacaaagctttgcatcgagaatgccaaattgcccagcatataacaatcaattttaccataagctcaggtgttagattttcttgcatatgaaacaaccattctctggggtctttaatatttgtgattgcaataaggtctgttatatcattatccactagagcccacacccacttggccatggtgcattggagaattgcatgatcccaagtatcctgtgctgcaccacatattttacatatatctgctgtactcatgtttcgctgttttcgcaagttttctgttggaatggaattttgtgacagtctccaggcaaaaatcttcagtttggaaggaacgttgattccccataaagatttccaagacttagcaatggcactgaaatcggagacactagctttgttgtctaaccaattctctctttgcaattttgtttgaaccagcattcgataagcagatttcacagagaagattccagacctctcataatgccacgcccaagaatcaggttgtcttgttgagcctagtggaatatttaagataacttccttgtccatgtctagaaagaacttgtccagtaagtcatgtctccattttccggaggaagcatcaataagttcactgaccttcaccggtgggtgagattcttaggccctgattggtcgaagcatccaatctcttggaatccaattatcatcccagataaaagtatcttttccacttccaatccttcgaataattcctagtttaagaatttcacgaccttcaataatagcacgccaagtatgtgatggcctacttcccaaaccagcattcaggaagtcaccatttgaaaaatagacagctttcaaaactcttgctgctagtgaattaggatactgcaagattctccacccttgcttggcaagcaatactagattgaaaatatttatgtccctaaatcccattccaccaagaaacttaggcacagtcatcttgtcccatgctacccaattggttttccttgaaccttgtttacttgcccaccaaaatttccggattaaagaatttatatggttgcaaaggcccatgggtaaacggaaacaactcattgaataagttgggatggcttgaactattgatttaataaggacttctttacctccaactgaaagtgttttctccatccatccctgcactcttttccacactctgtccttcaagtatttaaattttccttccttggctctacccacatcgttggcaaacccaaatagcgatctgttatagattcattagtcattccaacctttcgtttgatgtcctcacggatggccatatcacacttcttgctgaagaaaatgcaggacttagaaaagttgaccagttgtccggaagctgcacaatagttagttaaaactctactcactgcatctgcacaaacactagtagctttgaatagtaacaagctatcatcagcaaacaaaaggtggcttataattggagctgtggtagttatttgaaccccttgcaatctcttgtttgcttcctctttctgttgagattatagacatataatgatttaatctattccataaataaatcatgacattacagatgaaaactagcatgaacgcatcattagatctacacatgtaaactacacagtataacatgaatagatcaaatatgcg

SEQ ID NO: 60044 - DNA, 6357 bp, Oryza sativa
aatcaacccccttatgcttaccggcgataagtcaaccaacttccagtgatgcaggaactgatcctctcctccctccctctccctccctctttatcacgacattagctgattgatcaccagctttttattccgattgctccagtgaactttgttcacaaaatagtgtttttttcattttctgatgcttgtgcctatcgtgtgactcctccaccgacttgaacattgatatctgcccaactgattgatgaaatgatcgtttacatttttttttgttcagtcaatagtttctgatcagcttggagtggtccgtgccatgttgctgtgataatgctacaggttaatcctcctggctctctgtactgaaacaatttctctggatctctttcccttttgttttggaccttatacaacctgctgttggctaataatgacattcatgaataatagatcatgttaaagctgtttgcatggtctgctgttgtcaaatagttttatgcagtcacaactcttattaaatgatcaagttgacttcaagcattgggctaaaaactaagattatgtaagttaaataacatataagccgtcatcttcaatttaagtgatattgtgtcaatcttctgatcaactgtttacatcttcggattatatagattcatgtcacctgtgtatgtcttcggaattatctatgtttatgttactgtgtatgtcttcagatttatatatatttaggtcacctgtgtatatcttgagatatttcgtaattgcatattattacagatggcaaagatgtttaattctatttttttattggatatccttcagcgatatgccctgcccggccttgtcagctaatatgcaatatcagttttatgcccttgacatggcatacattcctccaggctgcactcacttacacttttactgtagattgataggttaatgttccattgtcaaggtgaaccaatcagctaatgatggttcatatagttataatttgagtgcaactatgtatccactatgatgtagaattgtgggtatttgcaatttaaaaggtatgccacttaggaatcgacactcaggcacatgcacctaggcttgatgggtaagtctggccaatttacatatggggaacacaaattaatttaatcagttattccaatttattcttctttgtttctatgcactgcaatgccaatttgagtgcctatcttgtcatgctattcagcataatgtcttggcaggctatgcatatgttcatgcttatatatgcagcattcatataagtacggattaattggattgcttgctttgtctaatgcagcctcaccatttaatttgtggcgagcaccttaattccatcttgccattatcgagggagtatatcatatgcacctaattctgtatatagagtatttattgactagggtcttggaaatttttgaattgctgtcagatgtaagttcctcagattgatgatttgattactttcacagctaataccattgatcatagctaaacaccacttatagaagtttaatggatttttatctaaaaagggaaaaaaggaaattaataactgaaactgcatagtagtactatgatctctgaacaaagaaatttgctgagtttcctagcagctgctgggtgcattttcctcttgttatgtgtgcctaaccttgcatccattaaatttcaaaagtgcaaatagagaattattgcatgcattccttttatatcaaagattgggatgaaatttccagcttaatcctgacagccgcaatgtgtcttgagcaaaaggaagcaaggctgcaactgaaacacggtgaatagtaaataaaaatctcgcttttaggaaaaaaaaggtgagtcgtgcacaagtgctgtaatctggttttggcaaatttttatcgagatatactactccgtcgctttgtttacacaataaacctgaactctaggtgtagcagcttgaagcattaaaaaataagatggcagcaaacagatgtttgctttattggatttaatacttggatattccactgtgcttcccaaattgagctgaataaatagcttgacgaattgttctcttaacatgtctcagttgtcctttgtatcaaatgagcagcataatccattcatggattgttcttttccactggtgatacagatagttacttctaatgtttcatggaaaagttcgagctacagaaatttcttaagcaagcttacggattgtttctgatgagtttagcaactctatggaaacaagcataagtgcttctcatctgaccagttccaagagagaagtagccaagtaggtagaacaatcccaaaactgcaaacttattttactgtatatatatactttcctttttagcattttctgtaaagtcccagttctgtattgcagttggcatggttgtgttcatcggaatattgaatgtcaaatcgaaaggaggcgccaacctatagctatcaacaacatggacaccatggttcagattcataaatttggggatcatggatgtctaggttcagaaatttttggattttaggcaacaaattttgtagaatttccaatttagaaaaacacattttgcatttcgttataatgtaataaaataccaatttacgtttatttgatgaattatcaaagcaacgcttacaatacttttatttttatcggtgcatgtgagctacaatgtattaatatatatagttgtgcatcaacaatggatgtgttgttctccaatatacttcgcttagtatatatatcgacatgccttgtatgtgcacgctcactagtagccctaaaaaggccacatgtttgtgcttcatcatatatcatcacataattattcctgaacattgcgccactgtctccacaactttgagaggcacatcaaatttatctgcaactttcctagactactatgcaacaccggtggattggtcttcgccaacaactctaaattaattgtgatatttaagtcatctggttactttctcccgtttgaacctgaattagacaaatcataaattttacatgcaaagttcagtacatattcactataaagtcagtactagagtaaaatcaaaacttgagcaaaaacaggattttaggtccaggtactgaattggacttaaattccatgtctcaaaactaattaaatcagaaaaaaaaattcataacttgacaacttgaacttgagtattcctgaaaattactactactcatgaactagagttttagttttgctctatgaactgtagcaatcagacaaatagagggcttaccaccggtatcaatcccacctctatgtaccatagctccagccccatcctgatctgacgcttctatataacaaaaagaaagttaattcattcatgtacttgtaaaaatatccagttattttgggggaaacattttcagaacaaacaagtacaacttctgatttaatgattctgaacaagaactactgcattttcagatttcagaactgaagttaaaattcaggacaaatacaagtacaacttaagattttagatttcagaacaagcacaactatattttcagatttcagaacaagcactagtacaaattcagatttgatctcttcagttcattttcatgtttcagaactaacgctcgaaaattggttttgttaatatactaggactgatttcagaacttaaatcacaactcagtttcagtacttgaatttcagaaatcatttgcacttgaatttcaaaaataaattcagaacttcagtttttagaaggtatttaggatttcaggacattgctagaattgagatggacagcaacatcagatcttgggaagaggatcctctgatgttactgttcactatgattgacatgtgagctccaccactctcgggcccacatgtcaaccaccaaatcagtaggaagttatgtcaggggatctcaatcccaaatctttaactagaatactcctacagtcactacaacttcagtcgctgcagtttcagtactagagcaaaatttaaaacatgacaacttaaattcaggcacctaaatttcagtaggtttagcttaaattgaggagttgttcattaactagattatgtactgaatcagagcttagcttctgatttcaatgatttcgaaacaaaatttcgaacctgtgattcacaacttcaaattcagaacttcgaatttagaactagcattgtgcatttaccgtactcaacagcaatgaaaccagtatgattaacagctcctccctctccagtccttgttcgccacgacacgtcttacttgactgtaaagtctaccacccgaagacagtgtactagtctatgtacgtgttggactcgttcttctccaggcttccctcgctctctttaatctgccaccatcaacaaattaactctgcactgtgcacacatatgtaagaatcctactattatcctttccccgtttccgaccaggctttccacagaaagcagagtagcgaagcacatgtcgccggtgaaggtgttcggctcggcgccgttcacgaacgtggcgcgggtgctgctctgcctggaggaggtcggcgccgactacgagatcgtcgacgtcgacttcggtgacagggagcacaagggccccgaccacctcgccagaaacgtatgtgtgcgcagagacaaggattcatttctttcttgctttcgactaattcattaaaagagacaaattattgccgagttgcaacttgattttgtcgctggtgtttcatcagccgtttgggcaagttccggcgttccaggatggagacctgatgctcttcggtgagtaatatacacatttgaactatcgagcaaaaagcattctcagtttctcacgaattcgcctcaaaataaaattattcaatctttgtgttcaaagagtcccgtgcgatttgccggtacatactgcggaagcacagggcgacggacgaggccaacctgctgcgggaaggcgacccctccgagtcggcggtggtggacgcgtggctggacgtggaggcgctccggtacgagccctcggtgcacgccgtgttcgtccagcggcgcgtcgtcccggcgctgggcggggagcccgacgagcgggtcatcgccgagagcgtcgcgcggctgagggagacgctcgccgtgtacgaggcacggctggaggccacgcgcgggtacctcgccggcggcgaggtgagcctcgccgacctgagccacttcccgtacacgcgctacttcatggagatgccgtacgaggtgccggtgttcggcgcgtaccctcgcgtgacggcgtggtgggagcgcctgctgacgaggccgtcggtcaggaaggtggccgccatgatgagcggcggcgagggttgatacgtgtgctgatgcttgctactgttttctttttcttaaaaaaagagaatcatactctctcattcccataatataaggcatggtcaaaattgacacggtcttcaaaactaatctttatcctataatttctcatatattataaggtttgtagtaacaaaatataaccatatgaaagaaaattcaaatgtcaattcaatgataaattttttagcaagtaaattcatattgtactaaatattggtcaaaatgtttgaaagtgaaatcttgaaatacgtgggtgtcttatattttaaaatagagggagtaatggagagcgtttatatttctggcctctgcacaggatgcttggtacagtattgtctattgtttgtcataatgactactctcttcgttttttaaaatatagcaatttttagatggatgagatatattctaattaatactatgaatctagacaggggctagctaagatatatctcatccaatcaaaagttgttatattttgggatggagatggtgcttattactatgtatacatgaattatgtccttgtgattaagacagtgtgtatacctttgcgatactggatatgttttccatatccttgagttttcacttaattcttttcgtgtgactaagtttcatgtcaaatttttgttttgcccttctacatatgctcattatgttagttgacttcgagagttcgagtgggttattaacattttagaagtgatgagctgatgatattgtatctcgcttataatcataggtgcatgctagcctctgtgaaattagaggtatgtccgtgcaaatttagccgagacacatgtacaatacgaaaaacaaggatctatctcaaaatatggcgacatatttttaggtaaaatataacaaatataattatagtttaaatctagtgtaattacatattaaatttaagggcttacatatatatttatattgtaagtgtctaaat

SEQ ID NO: 60045 - DNA, 1187 bp, Oryza sativa
gactacaatattggtgccagttttttttgttgaaccggtgcctacagtgctaaaaggtgtcgatcttttatttttcattgtgcgaaggtgggaaaggcttataggtgtcgattttaattgaaccggcacatataagacgggtctctacacgggttttttatagtgtaggtgttggtttaaccaacacctatgggatgcgagaaaggtcaaaagagagaccaccgcttgtcgtagagaccacccgcggcctccccttgggcgccgctgcccaaccaactcccctctcaccggatccggcggaaggaagggcgccaccaccgcgcgccgcctcctctcgagcgccgccgcctgcctcctgccgcctcccctcccaccagatccggcggaagggagggcgctcccgctggcgggacctccgcctgccactgcccctcgggcgctaccaccgcccacggctcccggcacgtacagagagagggaggggatggaggacaaggaggacaaaatggagaaggagaggagctgaggagataaggtcgactcggtgaggataaggtcgatcaatttttattcgttgaggacgcgcacgaatcaatcggcttggctcggtcagtttcgatgggtgttggttttttataatatatgataggtgtcggtactttaaaaaccggtactatagtatattataggtgcaggttattttaaaaaaccgacacctacagactacaacattggtgccagtttttctgttgaaccggagactacaatattggtgccagttttttctgttgaaccggtgcctacagtgcttaaaggtgtcgatcttttatttttcattgtgcggaggtgggaaaggcttataggtgtcgattttaattgaaccggcacatataagactggtctctacacgggttttttatagtgtaggtgttggtttaaccaacacctatgggatgcgagaaaggtcaaaagagagaccaccgcttgtcgtagagaccacccgcggcctccccttgggcgccgctgcccaaccaactcccctctcaccggatccggcggaaggaagggcgccaccaccgcgcgccgcctcctctcgagcgccgccgcctgcctcctgccgcctcccctcccaccagatccggcggaagggagggcgctcccgctggcgggacctccgcctgccactg

SEQ ID NO: 60046 - DNA, 872 bp, Oryza sativa
caattttgggtccagttttgcatcttgtcggttgttgccgggaccttgaaaaattgaatcgtctcgtcatcgggtttccgtttttgtgatttggagaaatttttatcaaacggttttggagttgccgtactgtgcgcgtgcggggagtactgtacggttgaagagagactccagattagatcagatctatctgtgactatctgtattatcctctttatagaattgttaagcagcggatctgagatatttttataaaaacggaacctacatgatatgagcaattcatttttgagatgatccaattttagttttgcactttgcgtttgagtccctgtaatattcatatttacatttgagtccctgttggaggtcagtggtcagtttttgttgaaaaaaaagtaaaaaaaaggaataaagaaagaaagaaaacgcagaaaggtgcaaagaaaaaaaaaagaaaaaagccgcacctaaaaaaaataaaaaaaggggcagaaaggtgcttaaaaaaagccgcaccaagaaaaaaaatcattcatcctttgagtatgttatcagagtgcagagttgtgcattgattcatatctagtctttagaggtgtcgggtgcttgcttgagctagagttgagtctaggctaggccagcacattgactagtactttgaactattattcaactttgtattttcttattagcacaattgtgttcctttgctgctatatattgtgcctttcaagctccacatatatacttctggtcaacaccgctttgatccttgcaatcgccacatcacgtccttcaaggtgtcacgaaccagccaccggttgtaccatccttagcattgctggtaagacacttgtaagaacttggta

SEQ ID NO: 60047 - DNA, 9722 bp, Oryza sativa
atagtacatcataaatttacaacgtgcaatgggaatcagaggaaataaatcataagagtcaagtctgggttattattctctgcaatttgcagatggatacatcgtaaatttactacttgcaatggggactagaggaaataaatcataagaggtaagtccggttccatttttctctgcaatttgcagatggatgtattttgcacatcatgtattgcaatcactacctacttcatatttatttaatcctttctagcatgtgcatatatacatcagaattgaacagggatatatccagttttaatatttcccccaaaataggtatatatgcaattttcatacaagtacactgagtaaatggtattaagccaggtgtagctacttacacaaccccagatcaagtgaccccaaagcacccagccatgcaagaagcattagcccttgcaatgaagctcataccaagcatcatcttccttgcagtgacagcgcaggctgcagcttcttctgggtacagtatggcgttgccaggttgccctgacaagtgcggaaacatttccatcccctaccctttcggcatcggccccagctgtgctgcaaccagcatcagcagctacttcaatctcacctgcaacaacaccttcaacccaccacggcctatggttggggactctgaagcactcgtcgaggtcactgacatctcactggagcacggcgagatgcgggtactcagccctgtctactacatctgcttcacggcaaataccacgttcaccaggttcaccgaagggtatgagctgaagcacacacccttcctcccctccccgtcacgcaaccgcttcacggtcatcggttgcaacaccctggggctcatcggtggctacaagggaaccgtgagccactatgtgactggttgctactcctattgtgagagcatcaacagcacatctgatggggcgccatgtgcagggatgggctgctgcgaggccgccataccgactgacctcaccgcctggggggcgatgtttgagatgaaccagagcaaggtatggagcttcaacccgtgtttctatgccatggtcagtgaggttgggtggtacagcttccagcagaaggaccttgttggccaccttgggttcatagatgacagagctcagaggggagcacctgttgtggctgattgggccattaggaatggctcatgcccggaagaggggaaaggcatacctggtgattatgcgtgcatcagcgcaaacagctactgcatggacgcgaacaatggtccagggtacttatgccagtgctccaaagggtatgagggcaacccttatcttctgaacggctgccaaggttaggttcaaatttaccattggtttagattttgagaaacaaaactggtagaattctatggcgtgctcagtgtttgttcagctagagtgtgtaagatatagttcaaaatattatgaacattcatcaataggcagcagttctctttggtttccagcataattcagcatgggactggaaaaagaaacagtcagcttcatttgtggtgcggatttttaattaaatagtgaaaagttattttcagtcaataggcagcagttctctttggtttccagcataattcagcatgggactggaaaaagaaacagtcagcttcatttgtattgcggatttttaattaaatagtgaaaagttattttggaacaagtcatgaaaggcaagttatagcattcttataagtagattaggttgattttagtttacctatgataatgaaagtaatacagactagcttacacaagtttagtttgacttctgaatgcatgctttttgtctctgtcttcagacgtggatgagtgcgcattacgtaagcaggatcccaagtatgaagatatatatccttgcaggaaaggagtctgccacaacacaccaggaggatatttatgcaaatgcaagttaggaaaaagatctgatggtacaaattatggatgtcgacctctgcgtactacagcagagcaagtggttattggtaacgtcacatctgcagattttacttctgtttcacctacattataagatgcgtcttctactaaagtaacactcatattgtggcaagaaaaatactacttctgaaagtaattttgaacactacctagaattgtcgataaaaataaattttaacaaatttggagcagaaaattattagtatcaatattctgaaagagaattttacaggcaccagtgtttcggccattgcgctaatggctttgacatgcgtgttggccatgcaaatacaaaggaaaaggcataagaaggacaaagatgagtatttcaagcaaaatggaggtctaaagctatatgatgagatgagatcaaggaaggtagacacaatccgcatactcactgaaaaagatataaaaaaggccactgacaactacagtgaagatcgagttcttggaattggaggtcacggaatggtctacagaggaactttggatgacaacaaagaggtagccataaagaagtccaaagtaattaacgatgaatggagggaagaatttgtcaatgagataataatcttgtcacagatcaaccacagaaacattgtgaggttgataggatgttgcctggatgtacatgtccccatgttggtctacgagtttgtctccaatgggaccttgtctgagttcctccatggcactgatcatagatcaccaatccccttggacattcgcctgaaaatagccacacaatcagcagaagctctagcgtacctgcactcatcaacatctcgcacaatccttcatggggatttcaaatcggccaatattcttttggatggtcagcacaatgcaaaggttgcagattttggggcatcagcgctgaagtccatgaacgaaagtgagttcatcatgtttgtccaaggaactttgggctaccttgacccggagagcttcattagccattgtcttaccgacaagagtgatgtctacagttttggggtggttctgctggagctgatgacaagaaagagggcaatctttgccaatagcatcaatgaaaaggaatcattgtcctattcttttctcctgatgtttgatcagaacattcaccggaatatgctggacagagaaattatggataaagaaaccatggttgttcttgagaaactttccattcttgccgccaactgcctgcgaccaagaggagatgaccggccaacgatgaaggaagttgcagagtgcctacagatgataaggagacacccaatgcacgcagctagtgatcacaaaggagacagctctgcgcatcacaactatgaaggatcttcatcaccatcaatgtctgcccatttcgacgaaacgatatacaagagcatagaggcatccagattggtacaagatcttgtgagatgatggtatgcttgtgccagcacttaatgtgttaatatcttgtgtagatatcatagtaaatacggtataaaccaatttctgtaatccccttgtatgagaaaattagcaatttgttccccgtggtgatgactgatgatgaatgcttccattctgaataaatattcagttgtacagagtccaattgatcagatttcagaaacgaaattacctgggatttcttgcgccgccgatccaaagccgccaggctgcggctaaccgccgccaccagtcgcgacatccatggcaagtttggaggatcaccatcggtggtcatccatttggacgagatgacagttagcagcgtaatggacgagatgacagatagcattgagatgtctaaacttgtgctgagcgagtgacagacagagttcacaaaactgatggaatttcacgaaaaccggtcggctttcgtgaaaccaccaagtctcggattatgaaaaccggtaggaattagcctgttttcgtatggcgttgactaaaagtcaacagtttttacatttttttcagtcggattttggtaaaccgatgagaagcgatttttactttaaaataggtcttgctacatgatgcaacatcactcttaagtaggatgtactagttctttcttgagacatttcacttgatatgtcggacatatgttatataaaaaccttttttttttttggacacgtccccccagttgcattttattgaaactgaagtggcagcagctcagagcattcagtttcagccattcagtctgtgttgtagttgtagccatttgtttctgtcaatcaagctaattcttttggttagtaggtctctctactcgctaccatcttttgcctccccctcgtttgtttttctcgagtgttgttcctctccaatccactgatcgacgcaccctcaccaaccatgcatcgcggcgtctcgtttcgtcagaagcaaaattcttgcagctgtctcttttcgtcagaaacaaatttactgctactctctcactatcatttccagttttcctcatctttttactagtatcgaaacgtggaggtcattcttcttgccacaatataatctactgtataatagagttgatgcaatgattcttttcaaacctgcacgaagaacaaagatcaaataatcaaaagcaaagaacaatttagtcaacacatatggatattagcctagttaagtttcacgttagtgtgtctgctcaaagcccagattcgctcaagcatgcgttcatgatattccaatacaggagatttctacacaaagactacaagagaagcaaaaacacccaaccaaccaggtgttcacagcatttcagatccaaggaggaaacaagctgtgtgctacgctgcttggcagtgagatttctcacttaatgcaaataatggtgacaaggaatcagccccttcttcaattcagataaactactttaacccaaacatgtccagcggtaatattcctttcaaaagtctcaagggagatctcacctgcattcataatcaacaacagtcaccaaaatcttttgtagtttaacaatatcagatgcatcatcagcagttcagcacccatcatcatctgaaaagaaagtctgagatacacctacttataacccatgatataaccccagttcataaggcataatgacatcacatgataataacgaaaaatgagagtgctagctaagatagaaagaatggagtagcaagtgaccaccattactcccaacttcccaagtccccagccatggaagaagcattgtatggaaatacaacatgtgctactacgtgatgcctgttgaggtgtgcagttataaaggcaatccttatcttcccaaaagatgacaaggtagagtattactacaatgaattttacccagaatagacaagagggccaattatgaagttgcgcaactcttgcaagtgttaaagagaatccagatgcaactagtcacaaaacagatcatatgatgatgcattaccatagtggagggtaatcaatgcatatccctcgaatgagatgaactaccaaagcaaggacatggccaaactgatcttagatgtcaagatagcaagacgattttcacatactagtagtatttgagggtagtatcaaatatttgtgatgcactagcagtctagcacatccttcatggtcaatttgatttcttcaggttcgttatgtctaagccatcaatgtaactatgttattttatgttgaagcaattgcataaaaatgatcatgacttatgtattacacaaagtggagaatgtgtggacagttgggttcttagaataaatttcttcctatcagctctgattttgcccacttgttcaaataaaacatttgttttgatgcaggatttacttgtccacataaagagctataacttctatttagcatttacacatcaacatgggcaggatttctccctaaaactaatacttaatgcctgtttgttaagataattatgtgtaaattcataagatgacaatattgtagttttcaggcaatgcaaatccatctgtacaaattggtgaactcatataaagtattcttctcaagtaagccgtttgattaatgatattggcatatgcaaaagttatccaccaagattgggttggatgcgtcttttaatatttctcatagagaggtttgcaaggtcctgtttcatttaaaacagagtttcagaacaaagctaattaagcagcagaaaaaaggggcatatgcaaaacaaaagaaaaggcataatgggagatgatttaaagtcatgttcgaatttggtatgctattgtttccaagacattagtagtaatcagggccaattaaatgaaccaagaagcatagttgatccttctacctcttccaagaaatgaaggaatgcaaattctcgcataccttttactgtacatacatatcaagttacataccttattgctgtagataagcacatcatcaaaaggcttcaatgccaaataggacctagtacatccaaatacggttatcctaagactgcagaagttatgcataggtaagagcattactccacataaaaatatgttcttgttaaaagcatacattttgtttttgcaggaagccctaccttctgttccaggaattttagctgcccctccctgatccatcttggcgtctcatatgctgctccagtgaggaatgctcttttttgtggctgtggcagatcttattatcagcgtcagaagtgccatcggtgcaaatgttaccgcaatcatttgattgtccactagcaaaccaatctgaacaggccagtcctcccccaacacccaatagaaaagaagaaagtaagaactgcaccatggcagccttctgttcacatgctgagaggatgatcgcaatatattgatgaaaaaaatattatataagcaaacatggtcaacaaatccattgtccctatacactgtacagttaccaacaaatttcacctaagtttctgaagaaatcagctttacgtacacatgttaacatcaatagaaaataaaatagatgcagaacaataaatggggatcgaattcagatattatttgtttgtctaccattcagaatacttggaatgcagaaatgtcacatgtccattctaattatgctacacacgatccattccatgctcaggagttcggatgagcttaatcaaggtctcataatattatttccccacaaacaagaaccacagtaaaagaagtacataacaacagggacaacagaagtaaatacagaactgacagaaagtgcctaatatagagaagcctaattcagatattggctatcctctcttgcagctcagttcatctcccttagatcggcatgcctttgggcacaatctggtcctttatccacatgtagataggcaccagaacatagtatgcagcacatattgttcccatgaggaagcggaagaggaaggtgataggattcacaggtttgctgacatcctcaacctttggaccaagctgcaggggaacaattgaactcttcagtctaatcactacacaccaacatgataatgtatttccaaacgtaagctaaacaaagtcaggtgttcacatttaaaaattaatttcagctggagatggttttttgagctgtcccatttatttgtaataaccaggagaaataatgttaagagaagcaagaaaaaaagaaggaaataaagagaagaaaacatgaaatcaggaagattggtttcttcacaggaaagtttcatgtgcttacatgccatcaagcactatgatgggtaagatgctataacctataacagccttttcacatgaacaaaaatatttaaattgactcagattatacaagtcattatataatatgcaattatgtatgttagaaagtgatccaaacaaatgtattagcatcttatatccttcacatagcactacatttgagctgagactgagacatggcacaggctagctaggctacaagttttgtcgagagaacatttaggcggctgagaatggcatattgtcgacacttatctcttcatcccatcaataagagagaaaaatgaatacctacaatgttcattaatctcatgcaagtgagaaaaatattgacatgttcactcttcaacattcgtcatacccaggtgttgcgttgccaatccatgagtaataatcaacatataaatcagtaagaaataaaagtaacgacaaaaagagtcatccgaacaaaggaggcttatgtgaatttgcaacttgcaaggcaaattagcaaaaaaaaaaacctgcaaaggggagtctccatgttctcttttgacgcccgtcacagagcatcccataatcaggccatgccttcggacaccacggtaccattttggtccaatccttttgagcttgacatccttgaaccctgcctttttgaaccactcaatatactcctcttccttcgggaagagcatccacatgtcagcgaaaaagcgagacagccagaaggttgggtgcacggggccaatcatgcaagccactccaccaagcctcaaaaccctgtaagcttccttgattcctcgctgcggatcgggccaatactcgatgctgtacaacaatcacaccccctcatcaatcacaaccggaacaccggaacccgcaaagacttgactaaaaatcactagtgaagtaatgaaatgcataaccatagcaagttgttcattgttcattgttcatggttcatgtagaaattgaaattcacaatgtgcgtgcgatatcgacacggtttggaggtgaagagagcaaagtgagagggtgaacctgccggcggagacgtagcggtcgaaggtgtcggtggggaaggggaggtcctcggcgtcgccctccatgatggtgacgcccttgagggcctccttctcccgggccttctcgagctggtgcggggactggtcgagcagcgtgacgttctccgggtcgacgcgcttgacgatcccgagcgtggtgaaccccgtcccgccgccgacgtcgacgaccctgagcttgcggctgtagaggtcggcgggctcgagggcgtcgtcccgcatgtcctccgtccagtggcccgggttgatgacgtggtcgtagacgatggagaggaagcggtagaaccagaacgcctccttcttgtgctggatgaaccgcggctgcgacatcggcctcgccgccgccgacgacgacgacgccgcgcacctcagccgagccacggagatgttgccgccgcctcccccacgcctggtgagcacgaggggcctcgacttggtggtggtggtggagaagccgaggccgcgcggcggcctgatcctgcccggcgcggagtgggtgccaacgccgcccgctggggcgtaggcggaggaggccatcgccattgctcctcctcgtcacgccgccgccgccgccgccgccgccacgaaggggagaggagagagtggaagaggatgggaggggggagagtggcgaggagagagggagtcacgaggaggaggggattagtggtgggtggtgggatgggcttcgcctcgtgtcgtcttcctccggacacatggctccctccctcccgtccagtgtgcacgtgggacctgaccgagtggggcccactggtcagtaactgggcctttgcctttgtgttggggcttggagttggaggtggaggacgtggatcctctgtggcttcaagctttgtggtttttgtgttttttcaagttgctaccctacccaagagacgacgtgtgaatacttaacttcaggaaaatactactacctccgtttcgaaatg

SEQ ID NO: 60048 - DNA, 6425 bp, Oryza sativa
taccagcacgttaattcttgtgttggcgaatgccatagtaaatactacttggtttagccaactgctgtaattattgtttaagcaatttgttccttgtttgtggcaataatgatctcttctattctgaataaatattcaattgtatacagccaagttgatcagatttcagaagcaaagttacctgaaaaataaaatgcttcgatttgctccccttagcctgcagccacgatgctttgatcttgtaagataatgaagacgaataactaatcttggggatcatgaattgatgccattctgaatagaacgaataaataaataaaaatattcagttgtgcagtccgatttgattcagaactagagtagagttacctgataacctcgcctgaggtcgcaatgctttggagctggagcgccccgtgtcctctcccaccccatgacgcggcggcgtctcttcctcccgccgccgattcaaactgcgaccgccgccaccaatcccgactgccaagaaatgctagtcctccggcgatctccgccgccgccacctgaggcacgccaccggacccatgtccgtggcttcgtcttggaagggccggaccggggggccgctttccgccggcggcgactccgcctctccacgccgccgcggtgtgtggccggcgatgtgggcgagagactccattccgtcacccgagcggattacgagaatagcctgggcgtattctagttttcaaaacgtaatctaatttgacgctttcaacaggcccaacgaaaatgggcctcaatgacgagccatgggcaatttggggcctcatcggttactaacggtttatttattagcgataaaaataatttatacgaaaatttttatatacatgtattcttagcgaattaaagtcaataaaaaactatgttaaaatattttaaaatcatcttctaaattgaattttaaaatataaatttggcataatttgtcttaattctttttaggtgttgttcttttttcttgaagatgaagttttttatgcaaaacgaggtggtataaacgtatgattgattaagttttaattattacaaacttgaaaaatagattaatataatattttagagcaactttcatatagaaaattttcgcacaaaacgaaccgtttagcagtttaaaaagtgtgccacgaaaatcttaatattcatccagcccttgttagagaaaagaacgggaccttagtacaaccgatggggctcctgaagttatcaagacttctaaactccacggtaggacaatgtcaatgtggagtactggagtccaagagcctcatccgttccatcctgaaaagcaacttcaaatcggatcagtttaacaaaccccattgagtaatttttgattcagtaaaacattttaacttgctgcaaatagctttgagttcccacttccaatttgctgcagctgatgcaaatgcctctctcagaacttaccagtggtggttgcaacaattcacccaaattatcagtcagattatgcttgctgtagctgattcctatttaacaattcacacctcctacctaaaatatgtgattagagagcacgtagactactgctactgcttgattagttgcgactatgctaaatgttctagaaaggcatcacctgtcctctcccaggataagttactttttggtccgtttaaatttctagaatttttatggttttcttcctaattaacttcttcaaactgtgctagaactatgtatttgagatggcacttcacacatctcccatctgagtgagacatgtttaacgcggttggttatgagagtttctgattaagttcacattgaaaaccacatcgattctcaacgtgattctaatagaaaggttgcactaatactccacatattgtaagcttgtattctcgccgttacacaaaatgaaatctaaatttatgtataaatactaagaaaaaaattgagaagtaaaaatatattaaacatacatttttaataacttaactcaaaattcaggtattaatatgatatgataacttccactcctcctaaaattcaggtattaatatgaacatctagatctccttaacgggataaaggaacaacttccaccccttcagaattagagtacgtctgattcaggtattaatatgaccatctagatctaacaacttccacttccacttccactcctccttaacgggataaaggaacaacttccaccccttcagaattagagtaagtctgattagagtgataatgtcctcccaattgaaacatggtgctactttgcatttctccaatgtctccaaacaactaaataactatttacattgtctgaaaaacaactaaataattattgatctcattagttgattgatcctttatgtttacttatttacttcgatttactatttatatataagcataggctgaacagaaattaaacgctgcaatatagtttcagcgagaggtcatccagattttgttcttccatatcatcccgattgcatgtaagtggccgagatgacctttcagaaagagtagagagatggacacgactagaaatgattatattcttggtcatgcatatatgatgggcaacggtttttccaaacaaaaaatgctactgtgtccttcactttttcgcaatacttagcactaagctgttgagatgattcctgtcatgttataagtgttttactgaaccttacgatctcctggcagcatggattagcaggcttgcagcacctgattctaacttacaaatccaccttctcatattgaaaattagactgcattaatcatagaggagtagtttcccgcgtcgactttttatttcagtgtttaatcaactagtacaatacatgtcaaagttaggtactaaaactttacacatatatgcggagtggattttgatccctcgatgggatatcccctcgttgtttgcatgtcactcaaattgttatgaaaaaatttaagaagatgtattaacatgtgatatatcactccacaaacatgcaagtttaaattcaacttctacatcttgcaacgaaaaaaaaaacaaattaatggataaacaaattcaacttcataaatatagaaatttacgtaccatttcagaaaaaataaaaaaaatatatggcaaaatttatcccaaaacaacaaaatttgtgtaattggctaggagacatcgtaaaatcgtgtcgctgctgatggacaccacaaaattcgtatgatttgttataggacactcgagacatattttatcatttccaggcaaaaataggagagataaaattcaaaaaacacaattgtccagccctatctaacccccattggcacgaatggtggcggtagcggcggtggcttggacggcagctagctagcctggtggcgtttgcgatggtggtcagcaagttcggcagtggcaacagctttgacggcgacgataagccctgcgacagcttcaacggcaattggcaagctccacgacgacagctttgacggtgactagcaaacctggcggcgatggctggcaaacccagtgtcggtggcttcgacggtgactggtaagcccacaacggcttcaacgacagctggcaagcccggtggcggcggcttcgactgtggctggcagcggctttgacaacggcaggtgagccctgcggcggcggcttctatggcggttagcgagcggcactgtaaagcaggtgatgtcaccgaggatgaagtcacctgtcacctgtggggattagatagggtttagggcgattttgtcttttttaaatttctttcttctcttttttacccagaaatgataaaatattgccttgatgtcctataacaaattatatgattttgtggtgttcatcagtaataacgctgccactttaacaaattttgggtgttttgtggtaaattttgcaaaaaaaaaaatcgtttctaaccatttctgatccttttcatccctatttggatgagtctcatatgcaagctgcaatagggaaagaaacaaaactacaatttagtttcaccaagagctcatcgaatttgtgcagctttgtttcttccatgtcaatccatttcgtaggccgctctctgtttaggggagagagagagagaggggacaggaggcaagaacataagagattgttcatgtatatgttgtgatgtgcttgttatttatttatagatctcgcaccgtgatctaatttcattcgtttcttcatcagaagactcgtttgttttagtgtgctctactccaggtagttggtaccaggttgattaatgagcagtgagtaacttacggaagtaagaggaccaaattcgaatccatggctcgtaattcaaactaagaaattcacatcaagctcttgatcactaccagaagtataatatgcatatggagacagaaaaagaaattatcagaagtggatatatatcttagaatttgcgccatatatgaatgtttaggttgcaggttatatttttgcacattgcagcatcgtgcacgggtagaaaagagagatgtaaatcaaagaaaagaaccaccattgttttgttctcattctaaattcaaaagggaaaaatatttgaatatgagggaaagcaagtatagttgccttatgtctcagatgtatattggcataatcctgctaatatgtttgttatactcttattctcttcttaactagtgtaaaagggaaaaatatttgaatatgagggaaagcaagtatagttgccttatgtctcatatgtatattgccataatcccgctaatatgtttgttatactcttattctcttcttaactagtgtaaacaaattttaaaaaactagaacacaaccctaacataataactgtttttattatgccaacctaacataataactcttactatgcatggcaagaaatagatcagttcaaaaacagaaaataaactggttttattgcttctgattcgacttttttggattagacaagagagaatttgaagccacactagcccacaccaagttacactagaattgagtagaaaaacagttagaaaaataataatgttacatttggttttctccaatccctcgaaaaacttaacgtatatttatttgcttccatgtactatagtaccatgccatttatatgcctaggtcgaacaggctgcatatgtatctatctaaatattaaagtttcagtaaggtcatcaacgttgtgcagcttgatttcttccatgtcagcccatatgcatgtttaaaccacagagatcgagtcatgcacttgttatatatttccaaacgttctagtgtgatttaatttcatctatccgtagttcagacttcagaagcctcatttttagtgtgctgcactccagatagtcagatcaggtacctggtacaggttgatttctattattaattagtgactacttgttgtgccgcatatagtacgagcatcaaattcaaatccatggctagtaatccaaagtaagaaatttacagtgctcctgatcactgttagaagtataatctataaattacaagtggaggaaaaaattcagaggaagatatacacctcagaactcatacccaatttcagagttcatacactaattgtctgggatattcaggcatcggtgttaattggagtcggacaatgactatttgtggaaatgaaattttctttctgatccaatacaaataatgtggtatacattggaaaaacaacggaaccttaaaatttcgaaacttcggtaaccatagtgtgggttggctttatatgtgctcagaatttaggagctgattaattagctgaagctttcatcgttttccccttaactaagtcagccttacatagagcatcagtggttccaacttccaagacaacttcatgtgtagggagctgggaagaacctatatatcaaagtgaaattataagtactaaaaagatcatgcaaaagtaaaagagaattcacaattcattcagccatgataagaatgtaagattgtgctacagctaatgcaaagaatcatcagataagttcatagaataactcttgacacaacacacaacatagcggaaggaagagaactgattgattagtcaccacaccacagtgccacacacgtagtctaaagtctagcaaattcaggtcaaggatatcaaatttagtcaagagttgacttcaactacatacaagaaaagaaaaccttaacatcacctttgaaatcactcaaataaacatcaactttcttgccggctaaggaaccaaaatgtctgatttactaagcttttaaacacaaaatgatgtagtagtacttaccaaccgcaccagctgagcttttcaatccaggtgaatgaataaatttttcacattaagggaaatgtacggggtaattgttgcctgcatagcgggctgcaggaat

SEQ ID NO: 60049 - DNA, 6450 bp, Oryza sativa
ttaaatcactcaatatcctactggatgatgaatataatgcaaaagttgcagactttggagcatcaacactgaaatccatggatagaaatgattttatcatgttcatccaaggaactcttgggtaccttgaccctgagacttttgtcagtcaccatcttactgacaaaagcgatacctacagtttcggagttgttcttttagagatcatgaccagaaagaaggctctgtacaatgatactttgaatggaaatgaggcgttatctcatattttccccttgatgttccaccagaaaaggcactgtgatatgttggattttgacatgatagacgagaaagttatggtagtactgcagaaactagctgaactcgccatgcattgcctgaacccaagaggagatgatagaccaacgatgaaagaagttgcagagcgcctacaaatgttgaggagactccacatgcagcttgtctcaaaatcgagtcctaccagagtttcttgctcgtatgaaggatcatcaatgcgtattccatcagacccgatgaaataccagagcatggagacagccaagctggtactggatgcagatattgcaagatgagaacagtatattcctttcatcgagtagagtaataagtttcttctggtgttgcaaggtcactctttatgtatattaattctttcttatggctaacacagctgtagtatgtagaatgtataattgcacatcaattctcatcaactatgacgtactatgcgaagtgatgttttcagtcataatgatgaactattaaaaatagaacattttgattttttttcactatctgttaatcagatcaaactacaccatcaaagtatcaaaccatatccaagaatgcctgtttcaacagattccacatgtccaggtaacataacatgtatgaatgaccaattaaaaaccatttcgtctatggcaaaaggaaatgatgctaccagtgtaatctactaattcaaatatctagattatctcattctcttgcatatcgatcctattgattgattagcattaggccctgaaatgtaaaggtggtgacacatctgaagcaggtttttacctgatctgatctgaactccggagttcgcatccggtgcccgaaagaaacttgcttcgcttgcttgcttgatctgaaccaccgattcccccctcctcccctccgtcaatccatccaaccgtgggccgcgaccagccagccaccggagacccgaccccgatcgcgtcgccgtcgcgagccagtcgatttcccaaaggaagatcctgatacccgaagaaagatctccacgatttggatggggaggaggcagcaacggagcgagtcccagtaagggggagatctgagagcagctgcggcgagcgggaggagagtggccgccggcggcggcgcgccggcgccgggagagccacgcgccgccgagaagaaacaaaaggcccataaatcaaccggcccaacaacaatgagcctcacgcaaggtctcaatcccattagttgggccacacgaaagtcgaaatatcaaaaaagtccatttcgagtccctcaagtggagggagttaatgtggactttttttaaggccgcacgtgaggtgtaatcctgttcttgggccgcacgtgatcgagatctcgttctgggcctaactagtatgaggccgcacgtgcggaagccgcaatccccattgaagccggcaatcctcgccgccgtcgccgcccccgtcgacggcgatagcctcgccgccgccgccgcccccatcgccggcgaatcttccagtggtttggtttgcttctctctccctctctgcactgtctccgttcatcgtacaccacaaaaagaaattgggggattttctactcaactcgggcaatttccaccaagctactaatttgccatgtataggaaacttcaaggttgaaaatctctgcaactgagcgcgtattatcgtacaggctgatgtgtttgccaaaaagtagggaaacatcaaggttgaaatctctgaatctgagcgcgtattaacgtacggatgataacactagtcatagatacttgtagggtttgaatttctctagccaatcacaatttacaaatggggactagagcaaattattaagagtcaactcagcccatttttcaattccaagtttgcagctggatatatctgcttgcatcttgacttgcttggattgtgatggatgactaataacagattaaagagaaccacacctaattcatacatctatttaaactattctagtgtgcatacatcagttcatcccaagaagaagataacacgataggcaaagaagggatagccatagattcttgttgctaggtaagccagctatggcgcatgcacagctgcttgtgtttctgataccaatggccctcttcctgaagttggcaatgccggtggacggtgccatggcgatgccgggctgcccggacaagtgcggcaatgtggctatcccctacccttttggcattggagaaaactgctctgcgaccaacctaaacagctacttcaacctcatgtgcaatgacacctttcatccaccaaggccacaaatccgggaaccggaagcacacatcgaggtcaccggcatctcactggagcgaggcgagatgcgtgtgctcagccctgtcaaccacatctgcttcacgtcgaacaccacatccaccaagtccagtggtgtcgggtatgacctgagcagaactcccttcctcccatcgccgtcgcgcaaccgcttcacggtcatcggttgcaacaccctggggctcatcactggctacaggggtgcctcgggacaatacgtgactgggtgctactcctactgtgagggtatcaacagcacctctgatggggcaccgtgtgccgggatggggtgctgtgaggcttccatacctgccaacctcactgccttcgccgtgacatttgatctgaaccacagcaaggtgtggaccttcaacccttgcttctactctgtcgtcgccgaggtcgggtggtacaatttcaagaagcaggatcttgttggtcacctcggattcatcaaggaaagagcccagaatggtgttcctattgtcgctgactgggccattaggaatggctcatgcccaaagaagggggaaaaagaacctagcagctatgcctgcgttagtgcaaacagctattgcacggccgtgataaatagtccagggtatttgtgcaactgctcacaaggatatgggggaaatccttatctttcagatggctgccaaggttcagcaattactcaaatttacttgaattttgttacttattaaacattgatttagtaggctgaactgaactcgtattttgtttgattttattgagtggttatattgttcttggtatcttcagacatagatgagtgtgagatgcgtaagctggaccccaagtatgaagaattatatccatgcagaaaaggggtctgtcagaacacaccaggaagctacatatgcaaatgcaagaaaggaaaaaagtctgatggtacaggttatggatgccaacctgcggattctccagactatagaatggttgtaggtgagcgccgtgtatataacagttcaccgttgtttcatcttcataaataagtgtctgcagagtttcataagtgaacatctaaggatcagtttcttgtgatgacaaacaaattatataaattgacttcctactgaataggaaaactaataatgaatgctctagtgcagttttgtttgcagctctgtataatctaaacatttttaatatgcaatgcatgtcccatctatttaagatattcttaatattcaagtggcattctcaatttgtttaatttatgtcctatgcatgaacatggaataagaggaactcaaacttagtatatattttttttcaggtttaagtgtttctgccattgtggtaaccgctatggcatgcatgttgattatgcaattacaaaggagaaggcacaagaaagagaaaattgaatatttcaaacaaaatggaggactcaggttgtatgatgagatgatatcaaggcaggttgacacaatccgtatacttacagaaagagagataaagagagccactgaaaactacaacgaagatcgagttcttggatctggtggccatggaatggtctacagaggaactctggatgacaacaaagaggttgccataaagaagtccagagtaatcaatgatgattgcagggaagaatttgtcaacgagataataattttgtctcaaatcaatcacaggaacattgtgaggttactaggctgttgcttggatgtggatgtcccgatgttggtgtatgagtttgcgcacaatgggaccttatctgagttccttcatggtactgaccacagatcaccaatccccttggatctacgcctgaagattgccactcaagcagcagaagctttagcttacttacattcatcaacatctcgcacaatcctgcacggggatgtaaaatcagccaatatcctgatggacgatcagtacaatgcaaaggttgcagactttggagcttcaaccctcaagtccatggatgaaagcgagttcatcttgttcgtccaagggacgatgggctaccttgaccccgagagctttaccagccatcagctgaccgagaggagcgatgtctacagcttcggtgtggttcttctggagctcttgacaagaaagaaagccttatacaccaatgatttcaacaagaatgaatctctgtcgtacagatttctgtcgatgtttcggcagaacaaacaccaagccatgctagaccctgaaattgtggatggctccaatgtggtggcgatcgagaagcttaccaaagtcgttgtgcaatgcatgagcccgagaggagatgaccggccaacgatgaaggaagtcgcagagagactacagatgctgaggaagctccagatgcaggcaacctgtgatggcgaaaacgatcgtgatgtccatgacaattttggaggatcgccgtcagtgatccttcattttgatgagatgacagatagcagcatagaaacgtctaaccttattctgagcgaatgacagtacatcttgcaacatgctgcaacttcacttgaatttgtctgtgtaatgaggtagtaggatgtagttctgttgatgttatagtcattctttccattttattgaaattgaagtgttttagagcatacagtttcagccattcggcttgtgttgtactaaccatttgtttctgtcaatctaatttcttcgagaggcagtcgtgctaattcttttgctttcttcacatttttttgttttctttggagtgctgttcctcaccatttaccaaacaacctctcaccaaacgtcactagaacgggattggtcatctctaacgggcttaaagcatcatctctttcgggcagggcccccgtcactaagcaaaggtcagtgatgtgagaaaatatctcaatcgggcatccggccgtcacggatgacacatctcaatcgggccaacacaaaagcccgtcacggatgactctcatctctaacgggcctaggttatagcacgtcattgatgactctcatctctaacgggcctagattattgcccgtcacggatgactctcatctctaacgggcctaaattatagcccgtcacgaatgactctcatctctaacgggcctagattattgcccgtcacagatgagtataatccacaaaaaaaaaatttgtttgccttcctggtcggtcacccatccaaacctcacttgtgtgcctttccggtaggtcacccatcgggaattgctctagaccaagtacgtttaacctcatagttttttgaagattggcttccgagaaagaaattgaatttgttggtatgggtattctattaatcttattaagccctatgccaggatgtcacaccctagcatcccctattcatatacattcattcacataacacaaccacaatcacatatcacatatttcactagcaaatcgagttaattggatcaaatatatatttagcaagtattatcatgagtaggaggcaaatcagacttctaggaaaaaataaatttcgaattaaattttatgatactaaatgaactcatatgaaaaagctatcaaaaacaaagttgtagaactcattgagatctaccatttttattttggtcatttctccatctgggtttgattgaactatataaaatttgtattttaaaatataggaaattcaaatattttttgggtagtaaatgatttcaaatggaaaaatcatcaacaacaaagttgtataactcatcaagatctataacttttactttggtatttttttctatataacattttttgaacagtttgaatttgaatttaaaaatatgacaacttcaaacaacattttcaaatactaaatgatttcaactgaaaaagtcataa

SEQ ID NO: 60050 - DNA, 4509 bp, Oryza sativa
tcctgacctcgagtcaaaattttttcatcttgatctaatgcatccttctgtctacaaggtacttatcaaatactgcaattcagatatgcagtaagcagtaacgacacatgccgatgtttttccttggggatttgggttgcctaaactattgtataagatgaatatatttgtaggagaatgttgatttgttctgtcttgcattactgcttctctggtggttaaagttaacataaaaaaaaaacaggcgaaaaaagcttttcattttcttgttttctaataggactggttactgctaaattaggtgaatagcaattatcttatttgacctctgtaaatatcttatgtgactgttctacgtttcaggttggacttcaatttttgtctggtgttatatcaggtggcaatgcttgttgcgtagcaatgcttcttgctttcagagaggccataaaagattactctacaccttccaccaaaactctcaaccgagatcttactgctaaaatcagtagctacgtgtcatttctcatcgagtgcaagcctctttcaatcagcatgggcaatgctattaggtttttgaagaacagaattgccaagctattgcttacattgtctgagtcagaagctaaagctagcctacagtctgacattgatcggtttataaatgagaagataataattgcagaccatgtcattgttagccatgcaatagccaaagtcagagatgatgatgtattactgacatacgcatcatcctctgttgttgaaatgatttttgatcatgctaatgagcttggaaagaagtttcgtgttgttgtggtagattctcgtccgaacaacgagggacaagcactattgcacagattagttgcaaagggcatcagttgcacatatacgcacattaatgccatctcatacatcatgcatgaggtcacaagggtttttttgggtgcctcttcgatattgtcaaatggagcagtttactccagcgttgggacagcagctgtagcaatggttgctcatgcctttggagtgcctgttttagtgtgctgtgaggcgtataaattgcatgagagggttcaacttgattctatatgctctaatgaacttggtactatatcattcttgcttgtaaattaagttattgattaagctttcctcaagacttaactcatgacatgtttactcaggtgatccagatgttatttcaagagttcctgagagggaagatttgtgccaccttaaaaactgtacttataatgaaaatctacaacttctgaatcttaagtacgtgcctgaattccatagatgttatagctggtcattatgtttctcatgttggataatcaatcgaatttcgttcacctgataggtatgacactatgccttccgactatgtttctatgatcataacagaatatggaatggtaagatgtgttcctttctacttctaaatcaattcctcatgcttatattcaaatcatattatacccatgttaacttcgtttctttttgctgctgttttttgtgcttgtaatagttcaatataatgctatcatatgctgaccgagttttaaaattgttagtacagtaccacttggattcatcgaccttgagctgcaaatttgtctccctttcttgctaatgagtaaccacaaccccataactttaacttcagccaagtcaataatgaaaactttttttctgttaggttttgactaaatattgctctagaaaaaggcaatacttatatctagcagtataacggttgcacttatctatggcagggaacacttagctgaatatgttttgctattatttatttttatctttgttgcaagaaggaatctgctaggtatactgggtctcacagtcagtgagcaccagataatctctgatacagagatattctttcatttgattattgttagagtatatggttactggttaggattgataggatccggttgttatggtaggataggattagcttccatcttatctctcagggattgcttaaggtccaaaacctactcatcaaggttcaatatggcaattacaattgcgcagtacatctcttgtacacactttcaattatgtctatacccacaactttttttctaaaaatataactaagccacatatataagtagtcgctgtcatcttaaaaatagtaggaccagtattggcacaatattgttgtttttgtatatgtcctaacaaaattatctttcagaaagctgccttatttggtctaatagtcagatctgtctgcccccaactggccttggatttggacagccgtaccatatgcctcggcagatatgcgagctgtcttcaaactgatgcgttattttacacatgtgatgtaaactttatgagtcacatacctgattgcaataagaatggcatacagaaaagaaaaagagacaaaatataacatggtccttaatagttcaataattgttgactatgtctaatttgaactgtacttctctcatgagtgcaggtttaattgttcttaatctagtttggaatatctctatgccatctagtctttagttctttacactaattgctttctcattgatttatatatcttttgtttgatactagtctggtgtcttcaaaagtcatagttttattgattaatatgaggacgtgaccttcacctttcatagtttcatagtgaaaatactcgtgcattggctgcataacttgatcctacatcagtgctattaagagttctatgacacaaatagttatttctgaaatttcagttagtcttttttactagttggtgattctcgatgatagtcatggtctcatggatgaaaacaagcagttttgcttgcagttacttcccattatatttcttgtgcatactgtttgttttgtctgcataaccagtctgatattaatacacgctatactcaaatttctgcttttgttagtcttatatttctctaccactcccctactgttttgttcatcatttaagatggctgtctcatttggtccattgaattgatgttttgtcctgctgtcgcagctcccacctactagtgtgccagtcattgtgagagagtaccgcagggagcacatatggatatagaacgaatgatattttccttgatgatttaatgagttggatttttaatatgaggtatgataatttgaatatggtgtgctgccttggcatggtgttgcggtcttgtggacacctgattatgctttaaaaaaagaccaaaacatcttttttttattttctcaaccttgaaaggtgtgttatctcatgtagtttctttaattaagctgaagtaatccaaataaaaaacttcaatcaccattgctaagtatggataatgtgccgatgattccacccttcttcattaggtatatatcactgtttattccttgttatgtaaataaatcttctcacgtttgattaactcatggggtgttctttatagtagattggtacatgaggaccctacatgaagtaaaatatgctatgcaaacttacaaggtctaatgcagaggagttcacatgatcccaaatctagtcagactagaacatgataaatgtgatagaagagcatatttgtaatctttgttaatcatgatttgcctcatttcatctaaaagtgcttttaaatcttttaatttttgttgtagttttgtaggttcatctataacttgcactgacaattggaatacttaatcatttaggcgagagcaaacaaccagccaacaaggaatgcagttttggatgtagataggacgggtcatgcaggaaaagtctcacatgtgaacagatgctagatccaaggatttctagctcgcttgttatcttcagtatttgtattcatactaaatgtgactgttgattagtacacagacttgttatcctgtactgaggtgaccagacatgaatttcaatggcacatcagttaacaccgcttttctacttcatcaagcgccctgggtctttttgaacttaatattaactgcgtttttcttgttaattgttgatgtaccttgctggtaaaaatggtgttacttttgtccattttatttatatgtttctgttgttttgctaccccctataaaactcaatggcttcagagcccacatatgttttctgcaggtactgtctatcagcatcatcgtttgagttgtgtggtcacccttggtccaatgcgcacatgaacgctagtcctgccaccagcaagggatgttcatcagtagtcatttgaacagcttgttgtcagtctacaagaatggaccctacaaataaatcatgcatctgagttagatctatgtcactttggtcattgaaagctcatcaaatcaagggctcaagttttaagtggcaccaggtggtggatggcctggtgaattactgttgctccacactcggtggatcattactgcggacctaatgagttctcagtacacactaatgggcatcttttggtggggttcattgctttcctttaagcctgctaa

SEQ ID NO: 60051 - DNA, 6907 bp, Oryza sativa
cctgcacccccaactatcattgtcaattcaaggtcatattggtgtccatgtctgccaaagttcttgggtacaaggactgccacagttctgttcctggctgctacgacaggtatgagtaaacaaacattttgactccattcatttcctttaattcatactgcacattacccagtaaaaggggcttgatcgatcaatgtcaaataggttgctaccatagcaaaatagctacccagagttagttccatgtcaaatatgttgtttgcaccatttattagatccggtcaaaatccaggaattgagaggctacccagaattagttggcgccaatgaaaaaaaatgataggtgaggtggggatgcccaactagaaagagttcttgaaagctctcttttttctcttttgaaggaaatcaatcaccatcccttttttgtttgggtactgcttggggggcatagagatgacaaggcaagccacatgatctgtattacttttcttctctcctccaaagctgggttagccatgttgatagtacttacaggtcgtcctttttttaactggtagctccagggcatctaggcacatacacacactgcgtatcatgtggatgctcaaacaacagtatgacaaactccactagtagaagtagttgacacatgaacaactgcctaatggaataaagatagatagagatagacgccctggacaaaaggacgggcagacaaattagggataatccaaaacattgtactacctcatgcatatggtgtacgaaatatttcatcatctttatatcttcagcttgcatttatccatccacgtaccctctttctccatcactagaaatcctttttggagagtcctacctatcactccaaaatcctcaccagaactttgatatactatttagagaactccttgcctaactgcaggccttgtttagtggagaaattgtggatcaattcgtcgcctgatagctgtaaatcctaaaactcctgtagtgcggaaaaataagagaaatcctcagaaagtgacttgttgcagcaatctcggcttggaaggtaaaaatattaattactctgtcattgtctccatattcttgatcaggtatgtttttttaactagctcaaaaccgtagcatagcatatcatatcatgggtgatgttgagaggagcatatgcaaggggggccctgtcacaaatgcgagtggccaagagggtaccaaatgcaagaggaaccaatagtgagtggtactagcagactaatagtaaggttttcacaaggttttgttagtgaggcctcctctcctcttctgctcctgtttaggttccttattatgtaccaacatactcctgtcttgcacgcttgcacgtgttccttggtatttgccccctgaccaatcagagattcagagacaccctctttcctatcttggctccacatggacatggacataaacatgaacatggacatggacatgaaaggaggaagggaaaagattatacatgctactactggctactagcagctgggactgggaggagagctgctggtgttctactagcttccttcctttttcgcatacgacgatcacctttcaatttcccccatcaatctttctggttactggcactgcattcttctgtcgatccttttgtcttgttactgccactgttcactcttacttaacgcactggcattactagtgaggagtatgctagctttagcgtaatattttaaggcaagttgttcacatcacacaaacatgcatgggatccacaccatgcacgaactgcagttttaaatttgcccaaatatctactactgtataaactcttgtgagatgttcccatggcaccatgatctagaatgacgtggaccgtcctccttcaagtcttagtataatactataacactatgcctccttaaaaatcacagaattgggcaacattctaaattcctttagctgaaactctgcactatacttcggtttggtggaggccacacgctgtcaatgccggtgtggtggttgctgagctggtgggcgacaaactacttgaaaggttgtagcggatctaggcgtaagccttgctcagtggatctccgggccggcagccttcgggccggtagcggatccaggcgtaagccttcgggtgtcgtaaccctcttgggggcgctgtcgagggtatctaaaccctctctccctttcttagcaagttttctctgggtgaaaaccacatctttcttcgatgggcgatgtccttgatgttgtgatgtccttgatgtcttgaggtaggtccttgatgtcatgacctccctggggcatcgtttttgcagtcttgcctttgtggtgttgttgtaggccgggcagcgatcggccacgcttagcgggggtcgttttggtgctcggttccacttgcagtggtttgtgcttgtgtggttagcgtgtggttcttggaggtgcttggtgcacgcccgacctcgacaacttctatcgtgttctttcttgtaacttttctccttaatatattcggatggcctccttcggccttcccggcgaaaaaaagaaactccgcactatacttgctgttgttagcaatagcaggagtatttcttaaggtgaaatgtgattgtccatgtcatctagaaggctataattgggcaacatgagactatgagagagccccatatacatgctttcaatggtgtgtcccttaagtgtcttgtgtggccaaggcatgctattaattgccccctaattttctgcaaacacatggaacgcatcagatgcaaaacacatgcctagctaggtacatacaacatgacacatgacattgaatcaggtcaccaactataatctctgacttctctgtagcaatgatctagagaactactactagtagctagctcctttttggtgagagtgtagtaagcaccaaactctcctgtcgtcttcctccgtggctgtggctatggtccgggcccccagtgggtctggacgtcctagtacacatttgcaattatgcaactccagatttagacattgtggcttctcttttttttgccaaaagctcctcccccaactatccacctataaacagcctccttcctcacttgatcacccacccgctcatcatccatttctcatcactgagctgagctcagttcagttcagttcatggaagtatatctccttcttggcttcatttgacaacttccaacacaagcagaacaaggtgatcaaatcatcctcaaggcttgtcttttttttccttctctggttatctccaatggaggctcccccttctctttccatcgtcgacgaagacggcttcgtcatcgacctctcgctgacgctgggcctgacatcgcctccgccctctccaggcggcgcgtctccttccattcctccgggaagaggcggcggcggcggcacgagtggtggtgacaacaacagaggcagcagaggtggtggcaatggtggtggtggtggtggtgtgaggctcttcccttgcctcttctgcaacaagaagtttctcaagtcgcaggcgctagggggacaccagaatgcacacaagaaggagaggagcgtcgggtggaacacccacctctacctcccggccggcgtcgccgccgccacgacgacgacgacgacgacgacggcgatggccgtccctgacatggtcggcatgcccacccaccagatgtcctccatggcgttgcactcctgccggcctcaccagggctcccatgtcaccgccgccgacatcgccacgctggctgcgccgccacattacaccgtcgaccatggcgttgccggcatcgccagcggcggtggtgacagctcggtggggtggcgccaaaggcaaagggaggccggcggcgagaagcagaggcaggttgatctcaacctgaagctctagctagtagcttaagttgttgctcatcatgctgatctgtgctgagacgatgatcgaggtaggtgctgtgcttttggtttgtttcttcagagattcttctttcttttctttcctttctttccttggttatttcttcttcgtcgtcttcctttgagagctagtgtgcgtagtgccacgcaagtattttctactggggtgtacaattaagaataaatccgtggccattgtaaattaattaattatgctgttgccttgatcaaaagtgttgcactctttgcacacaaatgcatatgcctttgttgtgttcctaattaaccccctctgatttgatgttagctgtttcttgaattactcataattttttttctaagcttagatcatacagggatgatgcagtttctgttaagatgcactcttatatccaaatatatgcatctggagatgattagccagagtttcaagaagattcgtatatatatccctgaagaatgttttctggtgagaactgatgaacgacaaaaggtttaatttgctgatgacttaatgagactaataacaaggattatcatggatgaattagctctaactgcaaaagggatgaagaaatatatgcataaaacattctataagcctctgttgccatttgcctcacgagatccaaataatcccatatgtagggcccgatttattcgagttgtgcgctgagatcgatccatgcttgctactagtagttgtgaacccaacatcaattattttgacgtgacaaatcccttttaatgtttttcatgtctcaagtcatgtttactttcataaacagagtaacaataattcaagtgtgcctgtacatgaacacatgcgcttcatatcttttcagttgagtattggagacttaatttaattgagtttcaatatgaaactcaatagatatgtcataaagccccattttttcggtaacataaaggtcctacccatgatagattccattggtctttttgtctttcttctctgctgaagaaagggatagcctacaatgtttcttgcaaagttattatacatgttacagaactatgttagaagggtgctgaggctgtgttagggtgtgttcggaactacaagttcttaacttgtgctctcttgttttatgtgcgcacaattcctggattattaacaattcctggattattaaacgatgtatttttttcttaaaaaatactacctccgtccctaaataagtgcagccgtgtatatccgtgcctaacgtttgaccgtccgtcttatttgaaaaatttgtgaaaaaattaaaaatatttagtcacacataaagtactattcatgttttatcatctaatagcaataaaaatgttaatcataaaaattttttaaataagacgaacggtcaaacgttgaacgttaatagtacaaaactgtacttattttgggacggagggagtacataataaagttgatttaaaaatcatattaatttatttttaaagtttttatagctaatatttaattaatcatatactaatggccaccttgctttgtgagtttgtgtgtatgggagaaaagggttcttattatataatgtaggatatatgataagtgtgtcgattaagatgacaatactaaaaagaactcttctaatactcttcgatttatgtttttctaatgaccgtatcaatctttctggacataggcaagaattaatcgatttgtatcacgaggggaacagaagctgcatttgaattgaaaaaaaaaaggagacaaaagcagtactttggcagtagtcacttgtcacagcaccaattatatgtagttgcattatttaatttctgttcatgtgtactatgagatgtttgttagtaattaaaaaagaagtattccgatctcttcatgggtactcaatggggctcccaaatggcctagaagcatattactaaattaaggtcccgtccatttctccagtaagagttggataaaaataaagattttcgtgacatgtttttcaaattgctaaacggtgcgtttcgtgtgaaaactttctatatgaaagttgctctaaaatatcatatttatctattttttaagtttgtaataattaaaactcaatcaatcatacattaataccacctcattttgcgtaaaaaacttaagctttatctttatctttatcttaaggagaaaagaaccccacctaaggctcgttccaagcacaggaagtttatagaatttgcaagaataaattcattttcttaaaaaaatctcctttacaatttttttgttccagattaggcctaatcaaatttcaatttatcgttgataaatgctctagttacatatggtgcacatttcttcaaagttacaacctgcaatgatctgcatccagacatcaatttgatgcactgtccctcacaggcatagatgttagccaaccacccaagaaataactactataaatccaaacttgattaaatctcacaaagattaaagaattttctactctgatttcctccggcatgccaattaaggaatgtgagaggggttggacctggctaggaacagatatcttgtttttttctatgaaaaaaaaattatgttccaaataaagcattgtctcctcggccagttggcatgcacatatggaggcagcagcatctcccagtttcggccccagccactgtgtctgtggctcctgctgctgctgtcactgtgccacatatgatgtgctgcaagtcactgttgttggtatgttgctacaaccaagcagctgtaaaaagaagaaaaatgctatcatctaaaaagggaagaaaaaggttctcatggaataaaattatccaaatcacctgcaaaattcctctgatccaaaaaaaaggcacagaaatgtacttcctccgtttcatattgtaagattttctagcattgctcatattcatatgagtgttaatgaatctatacatatactccctctattttttaatagatgacgcc

SEQ ID NO: 60052 - DNA, 8934 bp, Oryza sativa
aaaagtcaacggcgtcatctattaaaaaatagaggtagtatatgactagatttattaacacacatatgaatatgggtaatgctataaattcttatattacgaaacggaggaagtagtgttctgtgataaaaatttgatgttacgaacaagattatatcaaactcttgaccagtgacaactttttaagtacttatagttttacatttgacatgtataaatttatcttgacaagtactaaattgtgataaaaaaaattcacatggctaataccatgaacataaatcatatattttcaacgtgtattataaactttgtagccgttaactttttatgactataattggctaacttacaatcattaagcaattatctatagtgcactttggctgatgatggagttctagagctccgtagtggcatggttgcatggcagaaactttatagatgtacttttcatgtattatttatctaataagtaactttttaacaaagaatacagtcatactcttcgggcccatttaaatcgcaagaatgaaaaaaaaaagaaggaatagaaaatacgaaggattcaaataagaatataaatgtaaaacagagaattgaatacagaaataacataagaatacttatttgattggagcataggaaaaacacagccggatgagagagatatactcgaaagaatatttaaggttagacctcactggtggagaagtgctttttagtcccggtttataaagatcgctatctttagtcccgattcaaatacccgggactaaagatcgatcaccaaccgggactaaaaagagggaagcggcagtgagatggtcctcttttctttttttttcttttttattttctcccgaattgagtgggatatatatcctaaatcaaaccccaaatcctcaaatcaaagtaacatcccaaatctacatcccaaatcttaaaattacttatacacataaatcaaatacatcacaaatcctacaaaaattacaaacatatcaaatacatcacagatccatacaaatgtgcaatgaatcacaaaattatctatacaaatgtgcaaatgggctgccgccggccgcctgctagccgccgccgggcgcggccccaccagccgccgccgcccgaccgcgcggccgcctcgttctgctgccgccgggcgcggccccaccggccgccaccaccacccttccgccacacggcggcctcgctccgctgccgccgcccgaccgcgcggccgcctcgctccgccgctgtcgcacggccgccgccaccgtccgccgcacaaccgccgcgcggccagctcgcttcgtcgccgccgcccggccgcagcagagaggggaaggaggaggaggaggcggggagggggatcggaggagaggggaaggccggaagggggagggaggggagaggaagaaggaagaagggatgaaggcggataccgagacttagtctcggtggtttttaacgaaggagataaaaaagggaggtgataccgaggagatatcggcagtttattttggtcccggttggtataaacaaccgggactaaaaatagatcttataccaaccgggactcaagataattggagcttaactgtacccaccaacttctttgaaccgggactaaaatgatctttcgtcccggttggtgtaatcaaaatttttttaaccaggactaaagataagatcatctttagtcccggtttttattgcaactaggactattgtggaatttggtcgaccgaccaaagatggtttctccaccagtgcctcttgttaactttcctccaaaatctctataagattacgtaatccgtaggaattttaaaggatataatatgattcaatcatttgtttcaaaggctttcataaaatttttttttttcataggattaaaatcctctaaatctactacatttttcttacgaatcaaagagccttcatgtattaatgaccggagaaaaccttttcttttttccaagaaaatgatgttacaggaatttttgttggcagtgccactctcattaactagagagggctccacatcacagtgacagtatctgttgccacttgttgtttgtcggcaatagtattaaattaggtgctatatggcgaataatctgtccacgcaggcatctatatgctacaacagtgcaacatacggaccgttcctattctggtaaagaccattttctgttgctccagttactttcgtacggcagctgagttggcattgtctgctttccacagctaacttgtttgttactaagaaggctgttcagattgatgctagttttaaccatacattttttatatagttatcaaaaatatgtctacgtttagtttgttactaaatttttagtaaatgcataagaaattctgctaaaattgttaacttgtcaaaattttggcattgccaaattactttagtaaggtttattttgattataatctgaacaggccctactataataatagtgtttttttttctgttctttcacttttcactatagtaaagcaattagggagaaattcatggatcattatcctacttctatttagatcattatcggcaaaatacgtatttacaaacaaacaaactgctgcatgatgtgatagaattaaaacggcaacataagagcatctccaatagcctctccaagtgactctctaagctaaattttaatcattccaaccaaaaaatgtgctccaacagcctctccaactagatggttaagccatccggttggccgaaaccctccctcttctagccaaatttggtcagccaaaaatcactggccaaccgtaggccccacctacatccctcctcccatctcctctcttgcatcggctagctcgctgctggcccagcatcgacgacgacacgaaggagagaggcgccggagctgcctccctccgtttgcataccccccattgccgccgtcctctgtccagccgcgaccaccgccgtctccagccgtgcgcgatcgccaccgtcgtccgcatcgtcgatagctgccggattcagccagccgcgcgacctccaccgcctccacgtgatctccgcccccactcggtgaggatggcctacccaccgacggcggcacagacgatgccgaccgccgctctgccctcccctccctttccctgcagcggctcctcctccttggtctgcccgcccagcgccgacggcttcttctcctagtgcggcgagggagggagggagcggcggcagggtggctcgatgccttcgccaccgcctccacaacatcgccgccgctgaccccactggcatgagcaatagcaacgtcgccgccggtttgaccctttgccgttgatgccgtccgcgtctccgccaccaacctcgcctcgccgcgtcactccgtccgccttcggcctcgtcgcccgtagcagcctccttcggcaagagagaggattggagagaaggggaggaagaagaaaaggaagagaatggcaggtggggtccattggaatgtggagagtctgttggaatagaagaaggtaggctggtcaaacaggtatttggagagtcaaaaatagccactttgtaagagatgctctaatgctccatgacaaaggggagaaaagcgatagcgtgcagtaagcatcagatccccacatgacattccagatgggaaaaattattgccgcaagaactgtttttcttttattttcttttcttttcccaacaagctaccaccaagctgatggatgattcagatgtctcatcgcgtaccttgacacagattttttttttttgggcaaggatcaaaaccgaaaaggaaactgcgtgtataaatgttcagaggatgatgccatggagatcactcaccaggttgatcgtcttcttcctttggccttcttcctcatgagtgaacccttcatgtccatttgacgccatggccattagcagcatcagcatcagcatcagctgggcaggcatatctctgcatctgcatgagatctttgccctgtcctccactgcctcctgtcgccaggaactactactgccccactgatgcccatcatctccaacagagggaagctgctccctacatcttcctgtaggcctgtgaattgtgatcatggcctcatggccatggatgggatatgcagcagcagcagcagcaacacatctggattctggacagatgtccatgatgaacaatgcaatcgcctcgatgacgaccgtcggatcggcgatccgatggcgggaacaaatgccacgtccaccatgcaagggagaacaggtcaggcatatcatgatgatttaacagaaggcagctacaggtgattaaacacaagaaaaatatcatccaagatgctggcaaatggcatcagctcagggggtaccagcaacagaagagaagctggagccatgtccatgtaaccagcttgtggtaacacttggcttcccaaacatatggtagtgcaaaagtttaacatggagcaccaaacatatagtacagaaattgaacatggagcaccaaatgtagcaggaagaacagagagaccaataatgcatgggtaagggtataactttagtgttggggaaatagaatacagtgtctacgccacaatggaggtcactacgtgacaagacgaacaaaggacagtggttctgaatccacaaatcatgatgttcaacaatgtcattaagaattgaattattggcagatctgctcgacagcggccacaatttgggcaggctgcacgacggttgcgtcctccagagttgcagcatatggcgtcggtacatcctgtgatgacaagcacatgatgggggcatcaaggtagtcccagaagttatcaatgatggccgacctcaggctggcgccgataccacccgttcgcatgcactcctccacaatcagaacgcggtgggtcttcttaatggagttccctatcgtgtgcagatcgaatggtttcagcgacctgatatcaatgacctccggatcgtaccctttgttcaccagtgtcttggctgcctgcatcacatggtacctcatgcgagagtacgtgaggatggtcacatgctcacctggacgtaccatctcggcctcctccaagcagcaaatgtattcctcatcagggatcttctccttcaggttgtacagaaggacatgctcgaacagcaccacagggttctcactccttatggcagccttcatcaggcccttagcattgtaaggagtagagcaagcaaccatttgaagtccaggaatggactggaagtacgattcgagacgttgtgaatgctcagcaccaagctggcgaccaacaccaccagggcctcgaatcacaatcgggatcttgaactggccacctgaggtataatgaagcataccacaattgtttgagatctgattgtaagcaaggagaaggaaacccatgttcatgccttcaacaattggccttagccccttcattgctgctccaactcccatgccagcgaaagaattctcagcaataggggtatcaagaacccgaaggtctccaaacatctcagccaagcccttggtcaccttatatgaacctccatagtgaccaacatcttcaccaaatacacaaactgtaggatcttctttcatctcttctatcaatgcttctcgaagggcctcaaacaacaggacctcatgactgcggaacaaaatgttaatgcagtcaggcgacttttcagatcaactacatgcaaatgatatttgtcgcaaatcattctgaagatttctttatactttgaaggtagcataatggcattcaagaagaatatacattattcactcaactcttcaagcagtatatcagctgtaattattgtaacaaaatttaaacaaactacagttggtcagtgttcgtcgttggcattactgattggattatcctggcaagattagattgtgttcagcatatctaaaagaaaccaatgatcatgtaatatttatatgatttcatctacaacagtgctttactcgtaaattaacaaataatgtatatggagaaaataaagggtactttggattgttttttgctagttacaagctcgaaacagtcatcttttttttagcagtacccaaacgttcctggacaagttctggctgtcactaatttgcacttccctggcctcatttggatgggctaaatccctagcccatccatgtgagtggtccaggattttagacagctgcaaatgaggccttactgtagtgtgaaaccaacaaatagtctcctgtctgtcaaaatggatcctgactggtaaatgaagaaggcaagaacaagtccagttgcatggaagtgactccttatagactacttcaacgagatatcttattattgccacattcacacctataactttatgcacataagttttaatttcaatgagtagctgttgttcttcacaatcacatatatccaatttgcacaagctaagcaaatgttgtaaaccaaaccaagtccaagcaaaaacaggaccccctaagtgcaagtgccagacctgctgatgcaggatacatattcaactaaagtactaaaatacgagaatgaacagaattgtccaaggaaccagctacccaagcattttatgtcctctgcaaactagttcaagatcaagtagtttatctaccatacacagggcagcgtaaatatgtcttgtgtgatgtgattcaagctaaatgtaacacaactggctattaacataaaatggcaaatgatgcaatgccattgccataattgttccattactgggatcccagggactagttctctatttcgaagaccatatcattcaggacatgtgctacacttggctacattgttcaaacattaaactggtcaccaagtttggagataattaaactgctactgttcttttcctccaagtctggagataattgaaaacatgtgtgtataaattaactaggggaaaaaaaactcaggctgctttgttcatgcctcccagttaacaccactaattagagaaactaaatcaataaatctcatttccaccaaagttaaaagcataggtgcacagcaaagcaataaagcttcggattacaactttacaagccacaaaaagccagtaattctgttcatatgagctatacaatccacacacaagacagtagtaatcgtcaaaaatggcaggaaagctactccacttatacgattgcatctagaacaaaccgaatcgtttccccagtctgaatcaatccagaattccaggcgttctcctgatctcttctcttcgtgaagagcaacacaaccattttgaaaataaaatggaaaaaaggagagaaacaacttacccgccggacttggattccgccgtcgcatccgcactcgcctgcaaacacacaaagaattcagaattcagttaaggaattctgagcagaggacgaagaacaaagaacaagaacaaagaacccggcacgtaactgtaaccgcggcgcgcgctaccaccgcccctccgcgcgcccgcaccgacctcctcgccgcgaccacgcgcacgctcctgcctggcgcggcggatctgggcttggcggaggcggaggcggcgccgtgcagcgcgtactgcagcgaggcggcggcagcggtggccatttctctctctctctttgctcgctcgcgcgcgcgcgtggcgggacggcgagaggtctcggattccggcggcggtggcggctgctgcggcggcggcggcgcggggagggggtgttttatagtgtgaacgcggcgagcgcggcggagatggaaacgaggcggcggagagcacgaggcgaggaggaggagggagttttttgtcgtggacccggtctatggaccgaggagaggtggggcccacatggagggtgccggttcacgggggatgggtgcatggaccgggtgcagggagagtgggagcctcggttgcatcgacgggctttgctggtttttgatggacctggtttgctttctttgggccgatccattaaggcccaattaacaaggccttcctttgcttctacgaccattatatatatgggctttattctgatttctttctttagagagaaatacttcttttgagatgatagtcatatgtgacataaatagagttatgaagaacacaaatgtgcaacaagaagagccatttaatggagaagaaatagtcatccaatgcaaattgtagtaaagaagatttaaatcaggtaattagaggtgtacatccagacctatcaccgattgattaatgctcattttatatctaccccagtttctttttcacttactagctaatatgcccatgctttacaaggataaacacacatctcattaatttttttagctcttatcaatttatcatggagcccttaaacaaaaatccgatcgaactacccgttgagaagtaggacgatttttccgccaatgtatggcttaattaggggcaggcaaaagtgtattattttagcaatatatagactcagtttcactgtcactactatgttatttttaagtagtaaattaagattctgagctaaattatacactgttcatatcttactcatacagttccaaacaaaccagcaggtgggtcctgacacttactagagttcatcaaaagttagcttacttctagtttcttctctcttgtttcatataatccctggccgtgtacatagtgatgagtatgaaaggagaatataagaagattctagaaagtagaaacctctaatggtgttaattaattgatcacataccgtacataaatggggctgttcagattatagtcaaaataaaaattaccaataccaaaattttggcaatttggtaatattgccaaaattttggcaagatttattatgtaattaccaaagtttggaagtttgctaagaaactaaacggatgcacatatttgacaactctaaaaaa

SEQ ID NO: 60053 - DNA, 5674 bp, Oryza sativa
caactccatagaaatcacaaaacccaattcaccaaagccaaagcaagaactagatcaagaagagagaagaagccaagataatccagcagaaataatttcagaaatctatagctagatagatcatagatgctgcctctgctgaacatgcaagctgaagctgctggtggcgatggtggtgatgcagagaagaagagtggcaacaacaagcagatgatggtggcggcgaaggtgtccatctccattctggtgatgtcgctgccggtgctctacgtctccttcctccgcatcccgccggcgacgctcttccgggacaccaccttctggttcctcatgtccaactccatcatcatcgtcatcgccgccgactccggcatgctcttcttcgccgctaggcccgcctcaagctccggcgagcttcaagccatggttgtcaccgatgtcagcctcagccatgcattggtggtggcgccgccgagaggtggccaagaagacgatgacggtgttgtcgtcgccggcgagccggcggaggaggagtcgacgatgatgttggtgccgtactacggcggcgaggtggtgcaggcagcagcaaggccgacaaggctgacggcgagcagtgaggcggagaggacgacgacgatggcgcgtcgccgtcgtcgaagcaggtcgcactcgtcgcaccacgcgctgatgatgacgccgccggtggtgcaggagaagagcatcgttgtcgtgagggaggagaagctccggcgaactgcaacggagcggccgccggagccggaggaggagatgacaacgacgagcagcagcgagtactcgcggctctccgacgaggagctgaaccggcgcgtggaggagttcatcgccaggttcaacatggagatcaggctgcagctcgagaaggaacaagaacaagctgcagctgcttgacatatgcaagaatccgccatggccatgtacaaaatcgatcaagttcaagctcaaagctcaaaggctctagctagctccatgtcatgtccatgtccatgtagatgttgatgcgagtttgttaattaggttgagcttttggacatggagctagctagctaggcataagctccatgtcacagaaaataggtcggttttttaaaaactcccacaaaattcctctaggcctattcagatcggaggaattttgcaggagtttttaagaaaccaagctattttctgtgaaaattttgtaaaattcctacgtttcaaagagccagcagtagctatagctaagtagttagctagtagcttcttcttgcttggttcctcttggtagtcttctgcatccatagatgcaggagagtgagatgagaggagctatattctcatgagggatcatataatttgtattttgtatttgtgtacatcatcaagagatcagatcagaacaatccaagagatggagtaatatattatagcactagtagtagttgttgtactactgatgaggattagattttgcatgcatggggatatagtaataactaataataacagagatctctatggcaagagagatgaagtgtatatatggcttgtttaattaattatggctgccatgatacaagtgtcctctctactgtacttctggcaccaagatttttcactgtagaaatgttttgggagtgggacccacctcataggaaaactgtaacaaatatagttaggttaaacatgtcgaaataaacatataagatgtctcgaaaaattcagagttgcaacatttttctccctgtatttctaaaacgcaagtctgatttttgacatgaaaaatgagggtgtatcatccatgtggagtcttgtaaaacaaaactaaattcacacgtacaactggtttcctctagagaaacataaattaaagctcaaatcaagaattcagagactgatctttttttgtattaacttattaactgaagatgcactgctcgaacgattttgccatcagaacagtgtacagcttcttattcgatcgatctgcagtacttatgagttatgacgacgacaagatcttgtcctcgtgatcttacgcacaagtacgaagaaatttcaatgcgctccttgaaggtatatatattatctcattaatctacctctgttaatttgcatcagtgaattgattaagctggcttagacatgaggatccagatgcaggggaggagcaaggttcatagcacgagcttcacttaggtaacagtaccactgtcctgtcatgtactgtgtagtaaagtttccagcctaattcttcctccggttccataattcctatcattttagataaaattaaaatcaaactattaggactttaatgattattaacttttagagcatttagtttaaagatactaacaacaatatgtatagattagcctaaaaatattttataaaattaaatacttatttattttttatatttattatgacagaaaattattgtcattttgtagatcatgttactgtgtaaaataataggtattatcaagctgaagggaagactactagctagtaattaagtaattaagttccatccggactggcaacctaactcatttacagtgcgtccatttgcaaatgacactgtgagcaacagtttttttttctcgaacgcgcaaaaaaattacacatcaatatattagaagaatagaatgtttgttacacgacgcaatcagtcagaccgacttatgccaataaagaggggggggaagactaaaataaagaagagacgaaagactcctgtgacggctacacacaactccaaatagctgggagggggcagagccattacctttctaggagaaccccaaaattagctgataccagctaaagactaaacactatgagcaacagttaactgatggggatcaaggctcctagatatttgtcggcaagaacgtggttaattaattaacttttgcactgttaattacaaggatgattaagtatagttccctttcttcaaaatataatttttgcactatgattttaaaaatataatattttttttgtgattcagaggcatgtgtcaatacaaggaaaatccttgttcttgcaaacaaaataaaagagcaggccaatatatatacacaataatttgctacttaattatctctgctaggctagctagctgacctacatcaaggttaatcaagctctattttatcatttgttggcttatgattgatcactgcaaagtctttgtacttatcccaacatctatgatcacccaactgtaataaactaaaagagaagcattgacagggggttactcaactcttagctgtcatgatacacgtgtgtattcgtgtggcatgaatgttactagaattacacatatgtatgcacttctctaatcgagcttaaagaaaatcatacaccaccattgcttacatatattgtaaatgtttgcaaaaccaacttattggagaggtatagcactggaaactattggagtatatatcatttttctcgattacataaaagacgcatatataagtacagcatacacacacccaaaaattcctgaaagggtccggtaagggtatttctatatccctcagcctccatatacactagtagggaaacgattaaacggtaggaaacatttggatctctaaggctgcattctttaagtttaagttcccaacttcccttaatttgattagagagtgtaagacaagttcatgcttggtggtgactgatgagtggtgacctacctacctcatcctgcatatgaattgttggcctggcttgaaaccagaggatgccaacatgaaaattcatgttgattcttgtaaaattgtagctagtgaaattagtatggatcttattgtccattctaggccttaccaaactagcttaggctatgttcggaacttccagttcccatcctctctctcgtttttcgtgtgcacgcttttcaaactgttaaacggtgtgcttcttgcaaaaagtttctatacgaaagttgctttaaaaaatcaacttaatccatttttttaaaaaaaaatagctaatacttaattaatcacacgctaatgtactgcttcgttttccgtgtggggagatgggttcccaacccacaagtaacggatagtgtttttattcttattcaccaaaaaggtatttatttgtgttaagcccaatttttacaagatatatattaccaaaaaaaagattacaagcatgtggccaaattggattttgagtagttacttctaccaatgcaacttgcataacaagatcaactaggaagctaggcaaaccaaatcaggatggccaacaagctggctggtcatatgtaaagctcagaatttaaataatgtttgcctcatcctgtgcaaacacatcctttagctgctaaggagataaggcacaaaggccatatatgaacccttttgttgaaacttttgctataatgcatacaagcaacaagacaacacatacttgtgtgaagcaaatctgctttgactttcttccacacgaaatatctctaccttgacctgattgcacactggattgtgatgtacatgattgaatccaagatgaaaggacaataaactttaactggaacatacttttactcaccaccaaacaccatactttttctttattctatcaaagaaagcacatactctatctagctagtttatcctcagaaagtaaattgtactttttagcatcaaaaaccaggttcattggttccttggctcctttctggatactcctatataaattattactcatattcagcttaaactttaatcaatctttgatcgagatatatgtcaatgagataacgaatggtaaataatggattgtgtgaattttttggcaaaaaataaggaattaattaccccttccttgttatatatgctagatttctaacttgggatcgaaacaatctagaacatgacacgttgataaacttgtggatcctatatgttagacttgcataccaattacagctcacctcactgaaataaaagtgaccccctttgacaatcaaccatggcatagctagctgtcatgaaatttggttgcttacatagataaaacagaaaatctagataacggcatctcgtaggaacgggatgacttaaaaggtctacgttatttccatcaaaacagttgtacacgcatgcggcacgatttcctactaagtggcaggtctatactccacaacacatccacgcgtatgtgtccttcctgcagcacaaggactctaaatacactggttgggcacttgggccatgtgaatcaatttgggcatgcacctctatagacttgacttacatcttctatataccacggtcatttttaattttttcgttttctccttttcttgctttgtttcttttcttgagtgagacacattgagatttagtatgtcatgtaaattaattgacacaatgatattatgtaacatagattttatttttctttctctttttgactggtgttcacttttccgtcgctatgctgataccagctgataccagtatggtaccagttgcatggtacctggtacctgtgacagctggtatccgatacctgtgatacctagtacctgatacatgtgacacctggtacctggtacctgtgacacctgatacctgatacctggcacctggtacctgtgataccttgc

SEQ ID NO: 60054 - DNA, 1405 bp, Oryza sativa
attcctgcagcccagctctaactagctactacatcccaaaattaaagcctaaaagggcacgacatattacacactgcagcaagatcataatatatacctcttccattccaaaatataagacacaaccacccttaatccaaagaccaagaaataattattatcacctctttatttgaatcaatctaactaatacaatacatgcacccaataaaattaaacatattatgagtgtatgatttaaaaaatagtaatttaggagagaagatatgttaattaattgccatgcatgcatgctttatattatgaaatacttttaaaaagtagttgtgccctgtattttggaatggatggagtatcaattctttatttccatctcaaaacattcttcatggattactgctcacagcaacaggctggtgttggtttagtattttacttctttttttttgggtgtaccatgtacacaaagtgaaatggtgaaatattggaaatcatcagcaattgttaatctttcgcatagttacggtggtcattgttagttgtgcatacatggtttttcaggcaatgattttccatgttaaactcttgactcttgttatcttgatcatctttgttatctgaccccgtcatttgtaatgatttgaagttctgatgacctgaagacagggactgatgctttatattagactctgatagatggactgatgatttcagatttcctttaccctcggttacttcatgtcttcatatcaacactttgatatatacatactccctcggtccataaatatacaagattttagccctgtatttatccacaattataaaggatcttgagatattactagtcccataaatcacctccaattcaaatttcttcgcatattattcctgaccattcctcaaccttaatttctagtaaataacctataattccttatattcgtggatggaggaagtactctatatcctctttaatgaaaaaagaattggttactgattaaaagcactgatctttgcaagcaaagactgttgtaatagtgtaatcaggctcatctgataattcctttccttgaagccagcattcagcagcaaatgcttcatggatattggatcagttcagcaacagaggaattaccagagcatgtccaaaaatatgttagtttcttccttactggtttatactgaactccggctccggcttcgttttaatttgttctctaaagtttctagtacgatcaccattaagcagatgttcttttgaatgcactgatccgagtagcagcagaagtatatatatttcagagcaatcaacatggcagagggagacctgcatttactagcggataatgtactacagaagaatcaaaacctattgctcacagatgttccatacacaatgagg

SEQ ID NO: 60055 - DNA, 2495 bp, Oryza sativa
tcctgcagccctgtttgctacgttcaacataaagagcagtatcatatcatggccatctagtacagaagatcacacgagctggcaatccacaacagccattttcttgtgtgtagtacatccggtttccttaaattgagtgaaaagaacaaagaactgaaacagataagtgttttttttccttttatttcttttttattttgggagaaaggggtattacccaacttctgttccaagctaataattgtttggacaggtacagaaaatgctggggataacagcggtttgaattagatagttttacatcgcataacctgacctgcatagggtatcagtatcaccaaataacaatgcgacaccgaaccaactattcaattctaatgaaatatctcagcaaggccacaacttgtatttctagagaaaatctagcttcccagcaaatcaaggcagaatggagaaaagatctttgaccataggtattgactacatggtaacaagactttgcctgctgcttgggcaatattatgataaggagaattaatttttgatcctgacagtctgttaactattcctttcatcatacaggaacgaggacttatgaaaaggattcaacaaggcatgatgctgcatggtctctgttagctctacagttacttctgttattcttggtttctcccaacaaaggattctcaatgactagaatctttgtactgaatgcacagcaaaatgtggcacgcataaaaacagaaagtatcggtccattttatactcttcgtgacagattaaagcaggcaaatgaaaatcatgtgagctgtacatcttttgatatttaggcagtgctgatcttaatataggagcattacctttacgtgtgaatgtagctgtatttactccaattacatgaccatatgagtcaattagtgggccacctgagttacctgtcatttgtcaatgttagaaaattatgtgaaataaggggaaattgtgctttttgacataatacaaatacccagcttatatgaccaatgaactctggatattaagcgacgaagctaaggaacatgaaaaaacaaatactacctccgtttcaagttataagactttctagcattgcccacatttatatagatgttaatgaatctaggcacacatatatgtctagattcattaacatatatatgactatgggtaatgctagaaagtcttataatatgaaatggaggaagtagatgtgaaatgaagaattgtggaataagaatcaaaagctgccctgcaaatctttaaaattcctggaattgaatggtgtgtgcagaacaattattttccacttcagaaaagaaaagaaaagaacaattatattcctggaatggaattgaatttataaacactttacacttattttccattcatttcttctcagctttttcttatcaaattgttcatggcataccaacaacaccaaagttttgtgaatgagatgatcatcacgaattttgtagatagtggatatttcattgagcaatgaaatcacatccagatcattacgaatatatagcaccactttcagctcctcggtagctaaatccgtggctgtcaactaacctataggttagtttatacactaataaattgatcagaaaatttctgtgcagttaaaatcatatttagaattatctatagatcttattttcaaaggaattatatttgttgggcggttgggccaccagtccacctcccattctcttttctcaaggcccattgagaagctataccatgattgcatccaactctaattcataggctttgacacctggactcttgggcatttaggccagcccatatcaagttcacccaatcataccctttaaggtctggccacaaaacaacgcaccaacaaggcaacaagttatgcccttttatacatatatttttttagaacagtgaacgtatcttccaacatcacttacaacacaaacagtttttcaccatgctcgccatatggcgtacatatttagctgatgcttgtgttagtccctatttcaaccttacagtcagataattcacaccaccacactgaaatatgctctgttcatgcatctaatccaaacagaacaagttccatagatctaacgttcttctaggaaagcacagcactagtaatataacacgaaagcacatctcagatgagctttctatttggaggaccatgcccctggtttctactcacatagagaacagacaacccagtccatacgtcaagtaccaaaaaagaagtaaccactaaggcacaagataagcccaaaaagaagtgaatctgaaagactacatcagtacatttaaaattaaattaaatgtatctcaactgagatagagcaaaagcaaaatatgaaatgttgccatcggccatatttcaaattaaataatcagtacactacaccatttcagaactagttggtacttggagtatgtcacaaggaaagatgatttactctatataa

SEQ ID NO: 60056 - DNA, 4340 bp, Oryza sativa
agctctgcccaactcgcaagccctttgatgttccaatcagagcaggcctcaacttatcaccatcaacatcaacctgcagcaccaatagacttcaaatattgaatttggaaccagattcacataactgaaacttcatcaacaaaaggtgcattaccttcagaacagcaagatcatacgatggatcacaccctactagccttccttccttcaaataactattcccactagaatcctccaataacacctaaaggaaacactaaacaattagccaatggttaaaacttaaaaggcaagaacaaggaaggtcactatctttagttaataacacttcagtgtataacagcaacaggaaaccttgcagcgatgaaatgcagatccatccccagctaattttgcaaccacatggtaatttgtcacctgaacgaccaatgtgaccaatcagtttttgaaacattaaagaacaatactctagcattatgatcacatatttgcgcatatgaatgcatcaggattccatattttgaacaaagttagcaagaaataatccataaggtgatactccttccgtttctaaatatttaacgccgttgacttttttaaatatgtttaaccgtttgtcttattcaaaaaaatttaagtaattattaattcttttttatcatttgttaaatatacttatatgtatacatatagttttacatgttccataaaagtttttgaataagacgaacggttaaacatgtgctaaaaagtcaacggtgtcaaatatttagaaacggagggagtaattgttttctttttaaaacaagatgatgatatctttttgggggtgaaatggagatggtcggtgcttgctcacaatgtggcccgcggtgtcccagacgaacccagagccggtcccctccaccgtggcgcccccctcctcgccgtcctccgcctccaccgcttgcccgcctccccgtcccggcgtccgcccgacgacgaggtccttgatgaacaccaccgacggcgacgcctcctgcatatataggaggaaaaaaaggtgatggtcggatcagcgcgttagggtttaggacgcggcgtgctggaatctactaccacctggaagaggcgcacaacgcgggcctcgtcgatgtcctcgccgcctccgccgccggggtcggcgcgggcggggcgcggccgaggggaggccgcgaggaggaggagcgccgctgcggcggcggcggaggcggaggaagcgcggcgtgtggtggcgaagggtggtgagttgggaggcggcggcggcggcggtggcggtggccggaggaggagaaggcggagcagcgggtggaccgccatggctggagtggcgctcgttggacgcgcgctatctgatgcgtggctgggagcgaaggcggtattgttgaaatacgccttcatctttgcaaagcgaattttgggagcacgccttgtacgtttcaatttcgagagagagtggaaaaaaaaaaggtttatgccatttcgaccagattctaacaatcagtagttatgtaaccacgaaaataaactaaaaatacctactagcttctcagaatctcttggctcaaccaagagtctgtttggggagcttctagcaacggtagattatcacagaatcttcagttcccccaatagtcgagattgtcaccaagattttgacaacatttagttatagaacccaaaaaataaattagaacctaggagctggaaaacacagcttctctagatttttcaaaagttggctaacagccagcagattctcataatcttgagctcctccaaccagggcgtaagattgacatgaacaccagcaatgtaagtaaacaatgaaaatgtttcatctcggagtagaaatttactgaatacgattgaattaatatggtggattcatttgttcttccaaatggacccaggtatgctcctagaaatgcagttagtttgatcattggcctaagaaagcttttaggttgtgtttagttcaacgcaaagtttggatttttgttgaaattgaagatgatgtgactgaaaagtagtgtgtgtatgacaggttgatgtgatggaaaaggactgaagtttggatccaaactttagatctaaacacagccttagaattgcagttatttcgggaagtatggaatatttttcatttgacaaaagccgcaatacaacgcaggtaatttcagtcgtattagcaatcaaatttataaaagtttgacagcaatactttgaaaaacaagtcaaaaaggaacagggataacgcaaaaagcagctagcagcatgattaattcgacgaaggctgcacactgcgtacaagaaaaacgactgatgttattatatacacttcatcagtataacactccacacacacaacaaacatatatcgctaccattttctgtgaatcatcaaacatgaactactactggtagtataataatactggtagtataataattctggccggcgacgagcaaattaaagtcatacaatgtcgtggttcatcggtgaatgcgccaccgggacaacggcggcgccggtgagctcgtcgagggcgtcctcctccgtcgcggcgggtggcctcgccttggggtcgtacctcttgctcgccgggttcgccgccgggtcgtacctcttgacgaccagcaccgacgccgacgtcctgaactccggcgacgccaggtagctccccacggggcccagctcgtcgggcttctccaccagcggcgccgtcggcggcatcctccccaccacgaacacgctgaacatggacagcgagttgatcgcctccatcacctccgccttgctctgcgccggccgctcgtcgaaccgcaccgacccgtccttcaccatgcccaccttcgacttgaacgcctccaccgccgcctcgtcggcggcgtcctcctcgtcgggctgcgcgcgactcggcctgaaccgctccagcgtcacggcgacaccagggtgctccgccatccgcgtcgcgtacgccagggcctcgcggtcgtcgggcccgccgaagaagagcgccgccacggagaaggccacgttcttggcggacacctgggcgtggccgccgaggccgcggtcgacgaggacggcgacggagcagggcgcctcgcggaggacgcgcttgttgatggcgtggtacgcggagccgagggactggaacgtgccgtcgtgctggagcatcttgtggtacggcatgacgacgatggcggcgcgcttggcggtggcgctgtcgatgacgtcgcggtggatggtgtccaggtcggagatggccgtcatggggcgcacccgcaccgagctcagctgctggaacgcctcgaacgccaccaccatctgctcggccttgtcgccggagttgaagaacggcatgccgttgcggcgggcgcgctgcaccagggtgatcgccgacgaccgctccgagagctccacgaggtgcatggcgtacatcacgaggcggccgcgcccggtgccccgcgacgactcgacgaggttgagcagcgtcgggatgttgcggttggtgtggaagcaggccagcacgcgcagctcgccgtcggcctcgccgccgtccacggtgcggcgcttgtacggcgccgtcggccgcgccggcttgtagatggccatgacgatcggcgtcgtgatgaacgtggtgaacagcgccatgagcaccatgatggcgaacgcctcgtcgttgagcaccttgcgatccttgccgatgttgaggacgatgagctcgacgagccccttggtgttcatcaggaaccccagcgtgacggcctcccggacagggatcttgacgagcaacgacgtgatcaccgtgccgccgatcttgccaaggcaggcattgacgatgacgagcacaagcaacccccatgacttggctccacgtatggtggccacattggtcttgaggccactggagacgaagtagagtggcaggaagaggccggagatgaggtcctccaccttctcgatgagcacgccggcgaacggcccgtccttggggacggcgatgccgacgaggaacgcaccaaacagcgcatggatgccgatggtgtcggtgacgaagccggcggcgaggacgatggcgagggtggcacaaatgtacagctccttgacgggctccccctccggtgaccgccgcgccatccacgccagcgcggggcggaggaacaggaagatggcggcgacgaagccggcggcggtgaggagcacccagagcgagatgatcggcgagccggagccggagagcgcgacggcgagcgccagcaggatccacgcggcgacgtcgttgaccgccgcggctgacatggccgggctgcag

SEQ ID NO: 60057 - DNA, 6494 bp, Oryza sativa
tgaaatgagtaaatttcacaaatctacatatacttggatcaaattatgacaaaactatagaatttagtgataaagttatcaaagaactacatatttttagtttagatccacaacactatatttatttaaagttacaaaatctttagttttgtgataaaattattgttaaatttatagttttatgataaaatagttgttaaatctgtagttttgtgatataataccttaaattgtagttttgtgataaatttagcactaaatctgtagttttattaaacacgttcataaatctgtagttttgtgaaacacattgttaaatctgtagtttgtgatagtttaattaaagtatgtgtagttttgtgaaatttactcaattggagaaaacacttgaatgcttgtaatatcactccatttgtgaacaagtttagcgtttttcattagagcagcagtggttatatgtaagaacgtaacactggaagaacatgaacatgtagtgtgctgtagaattcgtgcttatcaaggttctatagttgctccccggtaaaagaaagaaagaaaacaaaacaaaacaaaccgtgtaagtttagtggtcatggatgaccttgttgtttaatttgtggttcataacaatttaaagttgagctaccggccaatagttgtgtaattttctgtaggaaaaactgaatgatgctgtaagaaatgatctaagcaacaaagaataagttggtcagagggcatggcaaggaatgccaatagataattacgcatccacgaatggttacaagttacttgctttgcttgatgaacgaaaagcattgtttaatagcagttggcactgttacctacttacctgtactctttttcttgcttaagcaatttctgcaagtcaaagacagctagctaatcaggaagcatatctttctttcaataatgcattcaactattcaccttaatttttccccgggtctattatatcctaaatatagtgttgacttcgactaataaaacaacacaagaaatacaaccaaaccttgcactgaacctattggcaagaaacaggtccacattcattttcttcatcacttcttaagaatcagtggttttttttagaaaatttaagaatcagtggtggcttactgtaagaagctaggggctatgcatgcgaaatgaacgtgcagtaaactgcagattggctagctagttaatcagtgcagttgaaagtcagcagactgtacagttcctaaaactattttcttctcctagttctctataaaatgcagattattacagctcctcagagttaattctttctaacaagatgaaagtgacatgcatgtatggcaaaagtcaccgatgcagttcacacttttcagtaaacacatggcaacattgtccaaactccaggacacagatcacagatgtggtggatatcacgaatgcaagttgcaaccagaaatcacatctttctgggagaaattaagatgtgatatctctatggcaaatagtgtcccctctaaacgtggtgcaagcaaagagagtagttgccctgaagtttaggagtataaatatatactattgtttgaagatgctaggaatcttcttgcttctaggtgagcgaatatctctgatctcttggaaaacaaagcatataaacctgaagtatctgaggcaggtatcccctaggagagtcagtatccagcctgcctgatgcggttgtctaccacgtgagaagcacggctcagccaaagtcttcccttattataggatctaaggaacctaatgtggtattgattaatcaaccaatagctaatttggggaaatatatattgcactaattacatattgcattggttctttagatgcatgcctctttccttcgtctgatcctataatgatgaaactatatagtatcaaggtaaggcagttactgattgtatgttatgaaaaaggaaaactaagttactaccatatgttttagcttccacatccagttaatatgggctttaatcatgttcatgtatcattcctcctcctgccatactgtcaatgtaatagtatcacaataatttcttcctccaattgccattttcaatccatttttataggccacgtgagtgtttcttttgaaaattaaaaacgcaggcatccagttaaacctcttcttttttatatttttctggaaaagaaaatctcgaactctcacaccaatcattttttcaccggacaactctcaccaacctaatccatacccactgctcatattcacaccctaataactattccatccgtccctaaatatttgacgccgttaacttttttaaacatgtttggccgttcgttttattcaaaaaatttaagtaattattaattcttctcctatcgtttgattcattgttaaatataattttatgtatacatatagttttacatatttcacaattttttttgaataaggagaacgatcaaatatgtttaaaaaagtcaaatgtgtcaaatatttaggaacaggtggagtacttaaatgaatcccaaggtcccaaggcaagcaccaactcctagatgtgattgatctacttaagaacacgaacactaaacaatatatttgtacaaactctactagaggggtttttaaaatatttctcaagtaataatcactgcaaaattcaagtcaacatatattatcaaaccagtaccccgtcaaatttggtgttaatcagtccatgcccactctgttcatattcatatatcccaataagtaataaatgaatcccaaatcaggcaagcaccaactcctagatgtgattgatcatctactttaagaacacgaacaaacagtactaaacaagatttgtatacaaagtatttttattaaaaatatttgtcgagtaacaaataagtgcgaaattcaagtctacatattatcaaactagtggtaccccacgaaatttagtcagctgaatgtgtatgcgtctctatcacgcacgatcgcaacggaaacgggggaagaaaaaggccacgaaaaggattcgattgtcccatcggctccgattttcaaaaattccaacccccgcaacaacaatttcctcccccaatttcgcagttattgttccacttgcgcgagattttcagcgccttcacatccaaggacaacaaaattcagaagctgggaattaacagagccttcacctcgaaggacatggagattttcagaggggaacagagaaacggataaggacaaagcaagcaagcaacaagagagagagagagagagagagagagagagaggcggaggggaacacggcacgccgcaaccgaccgagcgaaaccctaggcgccccgggccgaaccgggttggtccacagtactacactagcagagcaggtagccatggcggaaggaggacttacgatgatctcggcgatgacgcggggctggcggagggggcggaggaggtaggcgaggacgcgggtgacgacgacgacgaggcagatctggaggatgatgagcggcagcgcgaagtccagcgggttctccttctggaacgccccctgcgacgtcgccttcatcgccgccgggcagctgcctccgctcgccgccatcctctactcctccttactggtgacttctcactccccccgccgccggagtggaccaccaatgcgcttcgccgccgccgccgccgcaccacggcgaggagggaggagtcgatcgagtcgagtcggagaagcgaacacgaatcagacacgcacagccacactcggcagccgcgtgggggtggggcgctatatataggggaggccgcgtcggccggggtgccacgtcagcacccgaggaggagtctctcagaagaggattaggagaaggagacgatgaagaaggcggttacaaatactactactgctacaagtcggtcgagacaagacacaagaggggatttttttttattattattatgtcccataatataagacagggttaagattgatacggttatcttataattttttattatatattaacaaaattatgaacatatgaaagtaaattcaaatggcaattcaatgatataatttttagcaagtaaaattcaattcatattcaaaatgttttaaagatggaatcttgaaatgtgtgtgtgtcgagtataagcgattgtaaaacggtgttcttttttaattagaatataagtttatcttgattttttgttatcaatgcattttaaactgttaaatagtgttttttaacgaaaacaagttactttaaaatgtaaagaaataaagttggtaagggagaatataaatattgtctctggatttcaaaatctattatattttaggataaatttaaagagcaaaatcccttatttattatgagacgaagggagcagtacgtagaagcaaaactctaataatcccacatgcatacaagaaaatttttttaaaaaatgcagcctctactgcttgcttataggttagattgtttgagattagtttagggcaataatgcataccaagcgttgacattgcccatgccttgtctacacgatggaaaatctaaaaaacatgcgtacacacaatgcaagcagagagaatctgagattttagacacggtatataatagtactagtagctagctactccctccgtttcaagttataaaacgttttgacttttgtcaaaagttaaactacttcaaatttaattaagcttatagaaaaatatagtaatatttataatattaaattagtttcattaaatcaataattaaatatattttcataataaatttgtcttgggttgaaaatgctactccctccatctacttttgatagtcatatttttaaatctgaaaaatttatttttgataggcatatttcaatccaacaacttatcatcttaatggatttcttggatttaatgcgtgactcttcattcttccacacaagattggctacatgagtatcgagaaatgtaaatattaatgatcgcttgtttacgaggaatgactagtagcatgtttagatggatgataagtagaatcagttatcgttggtctgtgtgccaagatgaaatatgactatcaaaaatagatggagggagtattattttttctacaaacttagtcaaatttgaagcagattgactttgacgaaagttaaaacatgttatgatacctgaaacggagggagtagttcagtttgttcatagccatctagaaactaacacgtgcacaaaagttggattcattgccgcactattatatcatatatgcatgcatatatacctagaggctagagaacagcgttttttttttccctttctctgccagcaatctaactcaggaaattaaatttcgataaaatttgttacatgacactctaaatttatggcatttgttctcttacactctagtttcatggttttatctaagtcactctagttttgtggttgcttgaaaaaaaataaatacttccaccattattttagtgtatatatatatactctttcaatggagagataaaactctgtaccaacatgtcgcaatttgggtaagttttaaattttgtataatatgtgtctaaattcatctaaaatgtattcaaattcaaatcttgcaaggtgactcaagggtaaagttgtttcttttaaattttatctctatatcagaagaggatatatattaaatagttggagtacatttttgcaaacaaacacataactaaactataattgaatgtcctgaagcaaatgccaccactctagtgtcctcaagtaaattttgccaagtttttggattagtaacaaatgtaacagtcttcaactatttagtaagagttaactttttcacgatcctaaaaaagtatttgcaagtctttgcgatttcgatcgatctatagtgttaatcaggagacatatctcgatctcgacataattataattaacccccactcaatcggttaacactaaaatatacatctagtcttaatactcaccaaatatacaaagggtaaaaatatacatctacctcaccgaatgtaatggataaaactaaacctcgaagtagcaatcatagactcattagtcatggtcacaatatgtaataaggccctgtatagatgggactaaaacttttaagtccctatcacatcggatgtttgaaaattaattataaatattaaacgttgactattaataaaacccatccataatcttggactaatttgcgagacgaatctaatgagcctaattaatccatgattagcctatgtgatgctacagtaaacattctctaattatagattaattaggcttaaaaaatttgtctcatgaattagcttttatttatgtaattagttttgtaagtagtctatatttaatactctaaattagtgtctaaagacagggactaaagttaagtccctggatctaaacaccacctaagcatacacatacatcaacatcgagtatcttttgttaagtattctcctaggtctg

SEQ ID NO: 60058 - DNA, 13493 bp, Oryza sativa
cgctctctaacacatgttctaagagatggaaacctaaaggcatatctctgatcttaccacatttctgttaaaagctaagtgagatactagctattacaagcgatgagttaacatgcatgcatgcaagtagcttatgatgtatatataggtacttacagccagttgcgtaaaagaatattttctacatgataataatataattatagttaaactttaactcatagactatacaaattctaaaaattaatcttatccgtttgagccagagtagggaaatatatatataggtagacagatagatatataaatattattaaaacaatatagatagatagatatatcatccatccacaaatataagaatatttagttatttatagtagatattaaggttaggaagaaaagattccggtgttcctcattaaatgaggtaaatgaggtatggtttatgccctgatagttgaggataggatagaaaaatcaatatgattaatatgaggtaattaatatgggaattactagtactctaaaatttcttatatttacaaataaattttaaatggttgaaatgtttacatcggtgaacaaatgagtaatctctccgtgctaaaatatatcaaactagaattggatatgatacatattatagtaatacgaatttggatatgtatgtccttatctaatattcgtagtaatggaacatgtttcatccagttttgtgttgctaggtggtgtttgaatctcctgaagatgaagatgaagattaagtgtttcacgcaaaatgatgtggtaataacgtgtgattaattgagtttaaattattataaactcgaaaaatggataaatctgatattttagagcaactttcacatagaaagttttcgcacgaaatgtaccgtttagcagtttaaaaaacgtgccattttaatccaaaagtttatcctctaattttgatacggtggaagtagattagtattcgcgtcgtgacagttgcgaatagtacattttccattgtgtatgtgcatgtgttgagggggctgaccagcggcaaaagctagctatagcggcgaggcgacgtgttctgagactctgcttttcttctgcactttttagcgtacattactcttggggacaaaaaaaaccttttctgtactagcgaagaaattaatctggcgtacacactctctgaaagataacctctctgactttttgatactccgtactcgagccgactacgtaccttgagctatcaacaaaactgtattgctgctacttgcagagaataatgaattaataattattacttcctccgtccctaaatatttgacgctgttgatatttttaaacatgtttgaccgtattcaaaaacttttgttaatattattaaaaacttaagtagtagtagtatatttaaaaatgaatcaaatgatagaaaaagaattaacaattacttaaattttttaaataagacgaacgatcaaacatgcttaaaaaaaccaacggcatcaagtatttagggatggagggagttattaacatcttaatttctcttttcgtgtgtaattaaacaaaggattttgtcaaaggccactagcgtcgattggctggctccagtagctagataacatgtgggtccaaccctgtctcttaattattggtgtgctttgaggacaaaagtttatatttgtcgtatctcaatcgtttttattaaattaaggaatatatatgtgccaattgccatcatgttgctgtggtaatatagatggaagaaaaaaggaactcggggacaatctaccaataattggagaagaaaaggttatcctacaaagagtaaggtaaatattgaaaagcaagcgggatatatatagataaaaacttggaagtaatgacgttttacgagattgtgtcattgtatgtgtttgtgttgcgtgcaccattttgcaccaccatgattttggtgtagacttgattaattgcatttttttttggtaattggaaatttttaggtgaatggaatagtctagcaaaaccaacaccatgtacgtactgcctcgagcaatatggtgtatacgatgaagctggtgaagataatgtacacctcgacggcctccccatcacgtcctcacgtgtaggggtaaaaacgatcgcataaattctttatcaacgagcgtggtttttgtatgagcgtacgtttccgaccgtacgatatgcaaccgaagttgagtacttcgttcatctcaaaatgtagctttttcttcacaaccaatcagagacttctcctcctatttaatttaattacttgtaagcgtaatgaacttcggtacttttttgtcctggaagtatgttattcgtcctacgcagttctgcaaatgcatagtacaaattaaagtatagtgcctggccggtcatatatggctgtgtttagatccaaaatttggatccaaacttcagtccttttccatcacatcaacctgtcatacacacacaacttttcagtcacatcatctccaattttaatcaaaatccaaactttgcgctgaactaaacacaggctatatcatgctgtttaacttagggatgtgtcgtcaagtgtcaatgtacatcgacaaaagcctcgaaaataatatgcatatgtgcatgagacttgactaattcagccaaataatgcatatgaaaagttgatgacaatattatgtcctttatttaatttcaatttatattatcttattctggaactagcggtgtgtaattaatgctccgtccggttacgaagctacatcattaacatactccaatgatgcactgtacaagatgtgctgttagtttgaccttgtaaattactcatcccatgaatctaataagcttaatctgaacatctaaattttggcggccagatcaggatcgatctttttttagaacaaaaataatgacgatcatacgagtcttccttagcttttggcatattttcagttactttttatggtaaattttcctacagaccactctaaatttatgtaattttgttgatgaacgtcgtaaaaatatgtaatggttgaaagacacataaaaatggtaatttgctggaggacatttctgatccaattgaagagataaatttttagaaaggcgagaatacccttgggactatctacaagattataacctaacgctggagtgaatattgaatatgatgtatgctaacaatatacttaggcaatggcctggtaaaaattgatagttgcataattttaaaatttgcactctaacccgtattagaggcatatggccctagagacgttattatcttgttgaataatttttgtcttcaatcggaccgaaaatgccattcagcaaattatcagttttctaaggtgtcctctgcccgtgacacctttttacgatgtccactaaaaaaacataaactttagatatcatgcagtaaattttatccatttatatatatacacaagctaactagctcagtgacatctcaagaaatcgagaaaattaactcttatttgaaataaagtatttgctatggagttctttatatatatatatatatatatatatatatatatatatatatataagcatttaattaatgttgctatggagatggatccccccttacaatcaacccatcacttatctagaaatcttatcacacgaagaacgtccaggtcaacacgtacacgcaggctcgcgtattacacgtaaccttgcttattagtgagcttttataatttaatcagctcccttagcttatcaaattcagagggatccggcaggacacatgtacggacacaatttgggtttgcatcatacgtgacgcaactagctcatcatctggcacgcaccatgatatacggctctctgacttttttctatttttttttcgcctgacgtgttgctctgacttttctccgagggtctgatgacgtcctacctgtgtcctttgacttttcaaatgctggtccagctccgtctctctcacggtttaattacgtcgtattataaatcgttttgactttggttaaaattaatttgttttaaattttattaagtttgtaaaaaaattataacattttcaacccaacacaaatatattatgaaaatatattcagttatagatttttaatgaaactaatttgatgttgtaaatattactgtatttatctataaatttggttaaattggagtagtttggttttgatcgaagtccaaagggcttatagtctgatacagatggagtatttactatgagtaccttcatattaaaatatagtaaattttagcatcgaatcttaataggttgtctagattaatttttaaccaaaagttatgatatagtaaccttttcgattacatgaaaaaaatacatgcacatgcataccacaatatatacacactagactcgtccatacgtgaatatgctttctaatacacgttcacatgcacgcacaagtggtcagaccataacctcactaaaattatattaaaaacgcatctgcaaattataatttcatatagtcaacaggatttaaatcttggtggatgaaattatccatatccatgattttcatcaacatgtcgagatgaggcttaacttacgtgtcctgactcgatcggttgcatacaagcaattgacttggtttcattggctgatcccaaataatttgcttgatcagtggttggagacgagtagttttatagtcggcgtgtctaagtcgatcggatcagtcatgcaataatgagtttttaatataaataaattgtatagttcgtttcaattttaaattctgtgcctgttgcttgttaattgaattattgcctctgtggagctaggtaaaccaaatcaaattgaaacactagtgactacttatcgatgagcgtgcaatgtcaacgtctcaatggataaacatagcgatagtatatgcactcatattatatagaccggctatgggtagcttgaaattcttttcatttttgctgctgtcctattttactacacaaacgactggaggcatatgataaaataaggtgtaaagaatgaatggctaaatacgtacttacacttcgttgggtggaaaaatttatggtgaaaaccaggggcggagcttggtgtggggcagcttgggcttgactggaaattttggtcacctgtgataagtttggccatccattatttacgcattattttatcctaaacgttcactcatttttctatccaaatcccatatcttgtaatccattttctagcccttagaagtcccattattttctagctagtgatctatttgtcctgttttccttccaagaatctctgctaatgatcgatttgtcctgtttttcagtactacatcagtactatattcttgatctgcttacgtttcattttgagttgtaccttttttctgaataaagagtttcagttgtacttggacagttggatggcaggtaggagtagtgttgtaatgacaagtgcggaggtatgcacattatcctattcatatgttcattgataaatgtactcctaaatagcagcatttctgaactttctatctctgactttctcaggccatcctaatctgattagaccttgttagagccgaatggacatggactctaccatgcatgatgcatgtatgtacttgcagagaagctatgaactcttgatcccattgacaatattaattaatcccttcgtctcaaaatataaagattttttggttatttagcaaatactaaggttaggtcaaaagattcttttttagttatttcagttgttaatttttgaattttgaattgcttgaattccctttccaagcatttgattaactttggaatcattgaaatgataggaatcataaaaatcagttagcaatgcttatattgtggtacataatttgaatcttagaaatgcttatattttggaacatatggagtatatctatccaccctggattacttgcttgtggaaatcagcaactaactaaaaaaattagtatgatacttttccatgttctacacaatttggcaaccacaggaatttttacaaaatattactgattagcacatgcctttctcgtttgtgagtggtcatacttcatacagaacgtatggaaatcatgcgaatttctgtcagattcctggatgttttaggactccaggaagtccagatcaatcgtcatagttttttgccctgagaggtcaaagtattctctggcctgatcttagccagattatgtgatagtaatttactccactgttagttccgtttgttcttcttctctgtgctttgatttttttttcctcttttggttagcaagtgtaggagacgggtaaatttcgtctttgttttttttccctgaaattagcggtgccttaccaaccggacaggcttagcttaagtcttcattaacttccatgatccttaatattcagtttcatcaacaatgacaactgaaacaccattagacaattagtgaccaactgataacgacctgtgctttcagttgattcttaatctatctacgtcctactttcctatggacttctggagatgctgatgagctatgaacagagacatgtctcaacggacgtaggcatcaaggtctgaacataacaatcatatcttacttggatttcaactctgttaatcctgcttgttcttcttcttcttcttcttcttcttttttgcagcagttcttgcatcaaggtctgctagctttcattttactagttcttcctttggttgctttctgaactcctgttgtgcatggatgcatcgccagtttgactgttgctggataaagtttgaacagtgccaagaaatgtcattctttcagaaaatgacaccgttgtgtagtactgtagctattatgacagataaattcacttctgacctgtcctttttttcaattactctatccttagtctttaccttttttaagacgcatgcaagttcataaaaaaagaaaagatgtcaaactcttttgttctttctttgagatggatgatgctatactacacagataattgattacttgacaactcttgcagctgaatatcttgttccttggacaagtgtcgcagtgacaactctgacaaatgcatacttgcaaggtgcagagttgacttctggtaatataaaatagacaaagggaaaaaaaacctttgttggatacttgtatgagatgataatcctgagtcctgactcttgggtttcagttaatcatctttgtttctcaattatttacctattgttgtttaaaaaaatatttacttattagtacagtttcagagtttctcttcacaagcacaaagataatacagctcaattcggaaggtgataatatgcaagatctctaggaaatgtcaggcacctaatcagtttaatttgattcaaattatcagagtacaacagcagatcatatccatggtttctgatcacagcagtctgagccttttaggtcacagacaaatcgtacaccgtccattttcgatattcagttcctgaaaacttctgtcgttcagttgttcaggttttcttcatgctgatcagccatgacttttggcacaaccaggcaacttttattgagagcccgttcaaattggtgtcattttgaatcatattattctttaggtaaaattgacaaatattttttttatttttttagagaaggatattttttacccggcctttacattcaaccggatattattctttaggtaaaattgacaaacattttttattcttttagacaagcctttttagattagaaacttagcctatcaaacagggaaattcgttcctatgaagatttgaacttagaatcttggggtgctactcagttcactacaccactaggctacatgccttttcacagaattgacaaacatgtggatgcatttagtttgttaccaaacattggtaatacctagaaaattttaacaacacatttaacctatcctactaaaatttgataatgttgtcagtttgttaaaattttggtgttgcaaaattgtggaaaagtttattgccctgagattggagttcaaaacaaagaatgttagtgcatgatatacttgatgtataatgtcaaacagagcataaaaaaacagtcgaaagaatgtactatctgataaatcataagagtgatgcatgcctgtctgctagtactttactttgtgattaaagtaggtgatcttcaataggtgcagaaagttcaggatattgtgattaaagtatacagcttagaattctgatgtatatctagcatgctgggtcagtaggtccccaggtacattgtatgtaacaatttttttagagggactaaacaaatatctgaaagcaactagctgcttttgaaatttatttagcaaaaactacttaaccagtttttttaatcacttgaaaaaaaaggtagattattcagaataagatataggagaagagacaggtgttcaaccacagtttacaataagcataaatgaaattaaaatctgaattatggcctagacaaattaagcagtaagtctgaactgaaagaaagaagactacaacactatggattctggacccatttggcaacggggaagatatcaaagcccaaagacaacaatgaactgaacccaattgaagcccatgtagacaattatgtaaagcgttcgtgaaaaaagtagacaattatgtaataagtgattgtagttttaacttggttgaagcaaaggccaggtttacacccattatgggtatttataaatttgccactggtttttctaattttgcaaggatgccacttgatgacagttctagtgatattattgcaatttattagtgacagtcttgcaataatgatttaaactagtggcaaatttgtaattgccccaaaggaaaaatgtatgtttgacctcccttgaagtccataattgaagcccattctgacttcttcctggaaaaaaaaataggtctgaaattgtgagcgctcaagtttcttaggttaatctaagagtagtagttaattttctccgagcatcttttcctataaacaacgcttacttcagatcacagaaggaaaatttctcattatgttgtggcgttttaacatcgaaaatgttgggacctacgtgtgcagggaatctctcttttgttagcgtcgtctcgtctgccatggctgttccaagtagagttatcctctttagtgtaaggcagacaaatgaaaagaatgtttttttttggatgtttgtatgagatgctaaatcctggaacttgaaaattgagggggctgttcagattgtaaccaaaataaaccttattagaatttgacaatttagcaatattgccaagttttggcatgattttcttaagtatttactaaagtttggtaaaaaaaactaaatggatgcacgtctttagcaactttaccaaaaaatgatatggtttgaaatgacatcaatctgaacaacccctgagatacgcatatttgcttctcaaggtatcaaccattcactgagttgagaaatcatgtaaaaaaaaagttcagaaatatcttcagataggcgggttctgaagaaaaatcaagccgaaaaaaaaaacctccagccctgggcttcggagattgaaattccgaacccccttgccctctcttgcttaaaaaaacaaaagttcattgcttgcttgctttattggttctgcagatcactgtatgtattgctgtattggatttctaatgttgaatccaaaacagaaaagttcatctactcttgtactgtcctgcaatcacagtttgcaatactctggcacatctgcacgagtagaaattcagttgctgtagtagttggcacagccttgctgggagatcgtctgaatttctgcattgccgaaaattcgatgcatgctgtacttctcaaaggactggaatgcagggcctcggccgaagattcgatatacagtatttctgaacgcaaaggtgaagtgttcttatatgtggctttgattacaaaacaggatggaattcgaattcagaacatgttcaagcaaaaaattatgaaagaggacgcattagtaatgttcagaattcagaagatgctttgcaggttgttgaatttgcaccaccaaagctttgaaatagtgtaggctttgatccatggaccgaacatatacatctgtaatttatctgattatccctttgataattggcagaaactttctctctgctccatgccgtaggatgttcagctgagcaatccagctctcacgcaaaacgggaaagaaaaaccagttctaggcacgatccaaactgatcaagtcgcaatcagtagtgtgcgtaaaggtgattaatctctgatcccgttgctttcggtaggaaaattagaagaagaaaaaaaaatcctctcttgggttcggagattaaaactccgagtcggccttggccgtaagtattgctgctgcaaagcctctgtgcttgcttgcttgctttattggttctgcagattgtcgtatgtatcgttgtcttggattattagcgatgaatcccaattcccaaacaacaacaaaaataatgcataaatctagtcgtttctgtatctggtctgcataatgtataagcccatgtcgttcaagtgacatagcaaatcctgaaatataagggttaattggatccatgcctctacaaatatgcaaaattagaaaaatggcactactattcacgatatcggctatatgccactggaatttggagaaattgattccataccactccctcgcgttttccgtccacttttctatcatccctgttaatttctatccttgtcgtcttgctgttatctctgggacctcgccactgcaacgacaagcacaccgccaccactggattcactcgcgccgcacgcaggcacagccgcccaactctggccgcgagttgcggtgcaagaagcggaggaaggaagcagagaggcggggagcgaggaaaccggtgagtttaatttgagtttcggccggatagataagtatgtggttcttggcccaaaaagatcagccaagatggggttgggccggtcgagagagcccattaaaatattaatatgcctcaatttatccccggcccaccaaaatggcccgcacgcaagtcctaatccagttccgggcttccggcccagcaaaaagccggatatagtgtcattcgataattaagcagaaggttagatcactgagatgtattagtagggtctctaggaaaatgtcaggcatctctgattaagcagtatgtgacaaaattatcgaagtacaggcaacagaatgacatggtttctgaatcacaacacagtcaaggttacaattaaatcgtacattgttagagaatagagaaatggaaatcatgagccggaagaatcatagatctggaattacatccatttttctggtgtttaagtttttttcctggcgctgacatcatcttcagttcctgaatactttttcttgttctgaatttttcttcatgctgatcggctttgacttgtggcacaacaccagacataacaccaggcaattctgaattgatgaaattaggacgataagagaatattagtaaatgagattgcatacataatgtaaaacaaggttttcaaaaagtagttgaggcatgaaagaatgtgctccaatcagattaagtgagattcatgttaccctactacttgatagtataatggtagcagtagataatcttaaatagtgcagaaagccttggaatgtgatcaaagtatagtgcaaattagaactttgatgtatgtctagcacactaggtcattagctaggtctccattgaatatttttcatacagttttttttagatggtccctacaaattgctgaaagcaattaggtagtttaaacattaacttggcaaggaactggttatgagttataaccagtccatttgaaccacttgcagaagacagagttcttcatgatagattcaatagaaataggagaacagactagtgttcaatttacaatcaatggcaaatgggactgaaatataaatcatggtcaagatgaagcacacatggtccaaagaagacattgacactttggaatctggactcatattgcaacagtgaagactaaaccccatgactgaaatgaattgagaccaaaccatgtttcatgtacactacagtctctatggggcatagtttagtattttgtagtccaggacactctgttgcataaagttatctggattcagtgatgtgctcgtccatagtttgagaaatacagctctctttttttttcaagcctggtacataataatgctaaataattttaactggcacaacagttcactattctcaattcgacgagttaacttcatgataacttctgctataattatggtgctactgctcctcatcagggaaaaactagctaactgcatttacttgttctagatgacaactccaaattaaccaatagcagcttggcactgaaatatctcagtatctctagctagcatgttcaccacaatggtcttgcaaagtgcttaagcaaattagtgctacacatggatgctgaataagaacaacactacattttggccatcaagaacaaaacaatctaatggtttcatctgcacatatagatgtttaccaacaagcgaagctattgtaatctaccacctatccttgacgaccaatacatcaaatgctacctgagtaggagtagcaccctaaaatcttaagttcaaatctccatatgagcaaatttcatatcaggttttttgagagactaagtttctaattttaataagttgcatatatccggttggatgtaaaaaccaggtaaaaaattgccttctttaaaaaatttaaaataaaatacgcaagattttattatctgaatgttgtcaatggaacaggttcatctagcaaatcgaaagattaaaaacatgcgaaaattttaacaaaaatgttacttacttagtcatgtcttcctctcctccttgaagtcccagagctgcagcctccgctccccaccattggtcgtcgccgccggagcagcagcagcagcgccgccgacgccgcctgcaaggaagaacgggaggccggcgacctcagccggagcggcggcgaacctctgcagcaggaacgggtgctgcgacggcggcggctgcggcggcggcggccacagcgacgcattggactgaagtgtgccccgatcgaaggcggccaccgtggcgtgctgctgctgctcctgcgagaacgcgaggtggggcggcatcgccatcacctcgaacgacatgggcgccgccatgtgcgcgctctgcgccgccgcgtagtacgcaagcgtcgcctgctgctgttgctgcaatggcttgctgccgttggtgttcgagcagtggaggagctcggcgaacgcgccgccgccgttgtcgcagggggcgttggcgagggagagcacggagctcttgctggtctcggatgtgctgacct

SEQ ID NO: 60059 - DNA, 3709 bp, Oryza sativa
cccgcgacgtcaccaccttgctgtgcctgtccttccgggccgccgccgcccgcgccacccggctcgtccgccacgccgccgccgtcgccgccgacgcgcccccgccgccgacgccgacgagcgcgccgcgcgggcgcttgcgctccttgccgccgacgacgacctcctccatggctgacgcttgcgctacctcatgcgaaatccgcctccgcttcgtctgctcaaatttgggggggaaaaggggataaaatttgtaaaaaaaattctttacgaaatgatagctttagaggtggcaaagattgcaaaaaaaaaaaaagatttgtgggagttcaaattgtccacaaaatcttctcagaggttgcaatttgcaaatatagtaaaatttggtagcccatttgctctcccttgatttgtaaatggattgtacattgcaatttatgaaaaagtaggagctttgtggaagaatctactaaaagcaaacataaatctgaaccttttgcggctgttcttgcagaattatttatggtgccaactttgctgtgacaactttttttgtcaaaacgaacttcaattagggctaacaacaagaagaataatcaaaacgtcgagttgattaaagaatttgtaatttgaggtcatgtatcagaagctcccatcttcccagagtcaaatctggcaagcaaatcaagaaatctctggacaaaataattccaagaaaaaatggggggaaaatagctttaactgaaactctcaaaccactatctttcatcagttcatcaccattttcctgcattacttaaaggaaacaaatctctgaagaaacaccacccaaattttcctccaaggggggaaatttttcaaaactgcatccatccaacagacgaaaatcgaattcaaccgaacagaatgcatcaaatcttgctcccaaaacacatcaacaccagaccaaaacacacacacacctgaagatcaatccaaatcgagatatttcacctcctatccttccaagaaaaaccccaaatcaatccccggctcaaattcagccgccccagagaggaatcaaagccgctcacctgaaggggatcgatcgaaaccgaggacccgggcgaactagctccagaattcgagggaccaacgagcaaaagctcactctgagctactctgaatctctctgatgctgtgagctgggcgccctgcaagctgtagctgcagctgctgctgctgctagctggtcttatcgcctctgagcaagctgagctcagcaactctctgcaagctcagcacatatatagaggagcacatttttcagaaaagacctcggattttccatacttcgtggatgtgccccgcgcacagtaccatgcaggggcttgactgcaaaaaaaaagtcaggttcacgtttcggatttattacggtcgtgctttgtaccatgtactgctctacaaccatttagccggactatttggagatgaaatgaatggattatatcgaagagatcttatgtttttaacaagtgtgaccacatgagttaggcggaaatgggtggttaaccattgtggttgatttgggtgaccatgagtcgattcgattgcaatgtaattttgtaataaatactgacatgaggtagggaaataagtagttaatcattgattttgtgttattgtttaaaacgtttttcaggttaaggaaaaataagccactatgcaagaagatgcggatgttatcgtcggagcatgaatcttgacgtgatcctacgataagtaaatttgattgaatttttttgaggatatcaggtggttgaaatcttgtgattcgcattaacaaaaaaaagaaaactattctttcttgacttgtacattactcccctggtttcatatttttttaatgttttgaataacgttttgattttaaaaatatatatttaactatctattattctaatatatttataaaataaataaatatttaattgtattaaagtgctagtttgtttttaaaagactttttagtgtctttaatctcggtattgtccaaaacgtaaaaagatttatggtgcaaccttatcttttcacttatgcttatatttatcagccaaaatttgaattttcaactttaaatttgaagttgattttgaggtttttttcatcgaagtttattttttagtctttgctttttgattgctaagaacacatatataaaagttttattcataaattatttttcgttaatgtttggcttatttctagaataagccaaaggatggagccctacggagtagattatttctttcatgagtgtttttcataccattgtggtgggggtgccaattaagcgctaattaacagcagcccgatggtgatgaatggagctagctaggctaagctagtgaaatgaagaggaagatgatgagatctggcaggtgacgtggacggtcaaccggaaacagttgacagtaggggtacggctttccactttagagacggtgtaaagaggagtagcctttcctttacaggctgtgcgtgctgtacactactgcatttgttaaatgtacctacatactactactagtccactttctacgtactagtcgtcgtagactgctacagttctactagtattactaaggggatgtttatcaaatgatgtaaaattttgacgtgtcacatcgagtattatataaggtgtcgtattgggtgttttggcactaataaaaaactaattatagaatccgtcagtaaaccgcgagacaaatttattaagcttaattaatccgtaattagcaaatgtttactgtagcaccacattgtcaaatcatggagcaattaggcttaaaagattcgtctcgcaaattagtcgcaatatgtgcaattagttattttttagcttatatttaatatttatgcaggtatttaaacgttcgatatgacaaggtgaaaaatttttgggtggaaactaaacagggcctaagctacaagccacttgcatttgggtcagcaactctgcatacagggccggtcctgggtttttggggccacggcaaaacttatatatatatatatatatatatatatatatatatatatatatatatatatatatatatatatatatatatatatatatatatatatagtcatataaacacacaacatttaatattcgatgtgataaaattatctatatataaaattttaaaacttcaaatagaaataaatagcagtagcgagcagagaaggcgatcggcggacgatcgacacgagcgtggctactagcgagccacgatttgccaacttgctgtttccgtttgcgagatgccaagaagtcaagaagttgccgagagcgcaggagcagcgagcgacgtgacgtgattgaggctgcacgatgtgagtggtgtgatgtgatcgaggcgaagcgacgggagtcagatgaagatcgcttcggcttcgctaaaacaggcctgacgatggactaaaatttattttctatattaggctatttagctgtctaacttaatatagagccatagctcatgaactaaaattatacggtacgtagtatatatactatatgtgtatatagggggcccctagattttgggggcctcgggcggccacacggcctggccggccttgtctgcatatagccaagctgcgagtatatacttgacagatgctaccaaaaaggcctccttgcaatggacaaaatttt

SEQ ID NO: 60060 - DNA, 1801 bp, Oryza sativa
tagttttaggatcgtgttacaacatagcttgagcgactaaatgtctttaatgctggtttactggaaccctaaccgtttatgtcataattcccttgtactccatggcatttattatgcatttgtgggtgtgtcttgttgagaacggtggttgtactcagtcttgcttaattttcccaagcccagatgaggagttccttgaagatgaaggctttggtgtctagctcgtgcctgccgtcaagcgcctgtggtcgtcgccctagtcttccgctgtttttcgttgtctttgtgtgctgggccgttgttgctcgtgtaataattatatttacgcttccgcttgttaaactctgaattgtatcaacttttggtgtaccttgcctcctgggacaaggaataatacacgcacgtcaggaacgcctgttgggtgatttccggtcgtgacaagttggtatcagagcctcccttgaccctaggacgagccgtagatcccaagccttagcaatattttcaaaaataaaaatcctttgttatttgtgaaaacccgctattctctctctgtcttgctgcttcatttatcgtcaaaatctgatcttttaaaatgttgcttttcttttgtttttgtttgtagatggccggcagcgttacccgtcgtggtttggacatgactggcttcgtcttggagttgcggggcatgtgcgtggttttgggatatccacatggagtggattaccaggccaggccgctcccggagcaggagggtgaggatgcagagcctcacgctggatgggaggtcactgcagtgatcctctccggctctcccgagcggacttcgctggcagtcaccgcgggtggagactccttccccgccgcttgccagaacgccgctctcctcgccatcggcactcttcaccagcgctacccggacgagttgcagcactcgccctaccgctaccaccctcgtcgcggaggagcccgcgacctcgccaccttccgagacgccagctcggaggatgacgctaccgtcgtgcatctggcacgcatggtggaggcgtacgacgcggctcgtatcgacttccatcagatggtgcgtcgtggcatggtggagaacaacatgaagatcctggagctgcgtcaggagaatctgcagctcaagaaggacctcgatgcgttggaggcgcagctgcatcagctcaagatcgcccagggagagggcagccgccccaagcgtcgccgcgtctgccgcagccagaagatcaccgcccgcaagagcacctccaggcctgagcttgtccgtcagtccttggcgtggacttgcttcgtcgagacccctcgtgccgagcctgcgcccgtggttccccaggagggggaagcctccggcgttggtagctcggagggtgcgctgttgctcaccttccgtcctggcccgtcgcagcggtagacgagcagttagtaggcttgcgcgtgtgtttttcctcgtttgtctttttgagttgtgtggggcatggttacaccggtgtgtggtgcaactatgtcggagcctgtcttattttgtttgcctaagcaacttgaactttaatgaaccaatttaatagcagtgataaatttaagaataatagtagtcgtgggtggttagttttaatcgtcagctctccttctctgtttgctggttctgtgtggggttttcagatggtgacgaccaggagaaatgttaacaccggtgaaggcaaccaacccgagggcagcaaccccaacccccaaggcaacccacctccaccaccaccaccagacaccaacgccattctca

SEQ ID NO: 60061 - DNA, 3999 bp, Oryza sativa
aaaacttaagcccgtcacggatgacccctatcagtgacgggccacaactttaggcccgtttgagatatggaatgttatctcaatcgggcctaaagttgtggcccgtcactgataggggtcatccgtgacgggcttaagttttatacccatctaacatgtatgtgcgaccatatctcaatcggacacttttcagcccgattgagatgacttccttgtgacggcccgctatttctaagcatattagagcccgtcacagatagaagtatctgtactaatgaaacttgtgctctaggggttcatgattggtcacaaataatgtctctaatcaagcaagtcatgatagagagggcactatgttcaaagtagagatgatcataggatcaaagcatgcatataatatatatatatatatatatatatatatatatatatattagcaacagagatgatttttttaaaaaaaaacaattaacatcagaagcagaaaagttcaacggatcttgttgatgaaattggtgtgaagccccttacaatgtcctccgttatagaggtggtgtatcaaaggtggacagacaaattaaacaaaggtttggaacgttgcaacagataaatggccagtgtagcgcattaggccaatttggggaaaaaaaattggacactgctgtgcaggtaacactggcaatggccatggaagcatgacggtcactgaatgtggccatgttgcaaggcgaagcaaagatcaatggaagcaactcagatggttcaaatggatacaagtatatttgtgtcaagacagagcaacattcttaagtttaatgttaagttcggaggtgagcaaattgtagaactgcttcaagcctgtaatgatgtttttttattcccttctaactttggtccacaaaccctaaccttatgattatagtactaaattcatccttaggaccaccaccactaacttccatttctacgcaacaaattaaattcaccaaaacaagaaatacatacagttgacatgctgcagcctgcagctcgctaatgccattccttggactggtggtggccattacatagaccagagcaatatgaaaattctcaaacaaaagaaatggtggccattctgcaatatgaaaggggattatgaatatactgaatcacaatttcaaccaacttatcagtgtataaaacgctgatgatttttacagcactcccatacagatttcaaccaaatttgtgctgaatttgtatattatttcatatagatttgcactgagccacctagtctttcacaggctttgctcagagctgactcgagctgcagctgtagctggctaagctcatccattgtgaccaccaatggcaggtcttctctagttgcctcttcaagcttaacatatgctagtttaacagttcagatacctgaccatcatgaagagttgtttgctcactcacacaaaatcacaccgtttcaattcagtttttgaaattgctctgaaatctgtaaatgaaagaaggctttgttaattgtaacctgtaagcaggagccaggagcaaaaaaacagacatggacataacatcaagattgaaaactaaacatggtaaaaacgtgaaaggcatgtgtaaaccatttctttttcagatgctttgagaaagtactaatatagcaagaccatgactcattgattcagtatctacttgactacttactacctctgtttcagaatgtaagactttctagcattgcccacatatatagatgtctatatgtatgtgggcaatgctacaaagtcttacattgtgaaacggaggaagtaattagtattgactcaccttggctcttcctctgctagctactgctgctcgcctcctgatgccctgatgccccaatggcggaaggcctgatctgctagttgcttggcaatcggcaccactgcaccagcgatcttgtcgcccagtgcccttgcttaggtgctcgctgatgtgccgccaccgtctgcctctgccggctcacactcggcatccgatgcgcggctccacgcccacggcccacctccgcttactactcgttgtcgccgcaggtctattgccgctgttcgttgcagaagcctgcaacatggctgggtcgttgttgccacttgccaagacgcccccaatgcctcaatcccccaaggctccaaccctaatctatggagtgattgagagagaagtggactggatgagagagaagtgatctgagaagcgggtgggagcgcgacggcatgcagcggggcggtggtgatgcagagggcgtgtgtcggaacccggaattaacaacttggatccgactaagataatgtatcaatccctgaatcagtaaatattgatacatacaatataactggttattcattgcatacgttaaagttttacaatactaagggttttacaataataggtactcacctaactaattaattaataattaatacacagcggaagtttctatacattctgactagggaggtataacctttagggattctctaagttatcgggatcatcgtagtaatagtcataagggtcctcctcttgacccagatctgaaaaagaggttataagagcaaggatgagtattcacaatactcagcaaattatcatagaaatatgttatgcattgacatatagtagggttctttgcaaaaagcagtaataaacaatctgagagagttatagcaagaatttataaacatatagactttagatttctaaccagggtaccatatgagtcccggtactcaactccatgagtacggctattcgaatagtttcaaggatattctactgcagcagatgtacgctttacccgcagtccacgacttgctgataatcatcggctttagtcatggcctagtattaagtcattaacaattgtggcacctgttccatgaacttatatcctcatatgctctgaacgtattgttaacagcagcaagaggagttacggcgttcccgaggtatttaaggggaactgatcgtatgacaccacgtcatctcgatcagggtttagaaatataccatatagtttatactcgagtatcacaaacaatttacctgtacatggtaatggttaaagttgcccttcgcggctatagttgcctcctgtgcgaggacttaaaaataagaaccactatacagaggtgccatattgctaattaacataataactaggtctgtccccattctagaaactgcggtcgtacccgttcgttcgacataagtacctggtaataactatatcgatcgagacagtactagccacccggaaatcaaccaaatcttacgtactgtcccaatctaagtataaggtattttaaccagattgtaagcaaagtaagcaatactaaattatctgggtttctatggttgatttatgcatataaaatagaatattgaatagaaggctataaataaataatttgtagaatataggcttaaatgatcaaaggtatatggtaacttgccttgctcgatgtcctgagattgattgatattatctattgagtcagaagaaccctcaagacctagggttatacatataaaattcaaattcaaaaaggaattcaaatgaaatccaaaataagaaaaatagggaaaataaaataaaatagaaaaaataacaaaagggggcacaaaagatagagaatgattttagaagaatattggtccaagtttcactggaattggatctatattttaaaagatatgggcttctaaagtttgaaaatcaattaaatgtgaaatgttactgtgtgcgggtcccacctgtcagtctctctctctctctcttctcttcttctacctccagccgttccccaaaggcggccggcggcgctagggttggtgattgcagtggtgatggagggggaaaggggttgcggccgaggaggggagggagctagagttctccggcgacggtgagcggcggcgtacgggttaatttgttgtgtggatggcctatcggct

SEQ ID NO: 60062 - DNA, 748 bp, Oryza sativa
atgttgctgttcctatctgcttgctcaaggatgctaaagttgatatatcggagaaatgtttagtagcaggcttaagccatgccaaattcaatcgttattcgttagtactacacaagtaaataacgacgtcaaagagggaggtacatgaaattctttatctacctacaaagtaaaaaaccacatgagagagacaagtgtgtgaattcatatctatcatacaaagagatctaggttgcatttcttcatatagatcctgtctcatcctgggtagttgtaacgcaaactttccaacgaatcaaaccagagcacggctcgatctggctgatgcatgtgtgacatcgaatccccggaaacaaagacgatcgtttttactactgttctatctcttcatctagtttaattaatgccctgtatattcgatcgtgcatccatgtatcagtgggctcagttaaacaaagcagacgcaggcatgcaggagatgaaaacgagcaacgcaccctcgtgctgcccgaaagacagtgtactctccacactggcatgactcatttctacgggtgaaaacagagcggattcagacgaataatggtcataccatatcctaaaccaggattcaaagtgggtgcggataggatacggatgcgcatgcggagcggattatttcggatgtcggaaatagtgcggaatcagttcgaaaaaaattaaattatcggatattacatgtgtatacaatcaatacaatattaagtta

SEQ ID NO: 60063 - DNA, 3103 bp, Oryza sativa
gcgcccctcccctccaccggatttagcgggaggggagctggtggcgacctgtgacggcagcggcggttcggcggcggcggcggctgttcgacagcgacctccccttcgatctattttttttgatatatttgtgtgaatatgcttcctccgattttatttttgtgattgaattccgattgggaatttttttggatggggggtgattgaattccgattgggattctagggggaggtgatggacgaaaaattggtgtacagatgaagtgacgaccggaaaaatacgaatatttatattagttatagatataagaaatcctactaaaattttgacaaattaccattatggtaactatgctaaaattttggcattggttgaaaaatgacatcaaagtgaacaggcgctggatgcactgtcacccagtgggaaatttaccaaatacttccccgtggcggcgtaaaagaaggaaaatctcccatctctgtctcctccgctccgctccgctccttgcgccgccaagacgagtcgcggctgaacataacaggggaggggcggcgatctccctctccatctccatctccatctccatctccatctggcgagcagagcaggggaggggaggggatcctcacctggtcagcctctttctgattcatctctctctctctctctctctctctcccatcgggactggaatttgcttgcgttcgttcgttagccctagcttctcttctagatctggaagaagctcttcttttaatttcatagccttaaccttaatacaagtaacagtttgtttgttccccgaaatatttgggggttcaattgaacccccatgtcccaagttggatccgcccctgcttgcagaggtttattgctgtgactttgagggcttatgaaccatattctccttgcaggaaagtgtgggtaaagcgcagggcaacaagaaatggcagcattcctgaggtcaaaatgttcgtcaggtattgagatttgagaatgcctcaacgtttatatgattgtacggataggtttgcaaatgcctactagacacatttggcttgtgcaaagttaggatatatgttctactccataaacaaaccatggacaaagttatggcttctaacgatagctgttggttggacctaaaccagtttagattggcttttagcctaaattaaccaattgttgattacttttgggatttgatctagtgcgaaatgatgattaattcatagcattcaaacacgtgcacaattaaaattgttgattctgtgcgactgatggcctttaaccataataaaacagtatcttataccttacaagtgctcttacctctagttagatttttttgcctctgcctgatggcttaatatttttagcttatggtgctgtggtatgatgctgatctaatttgcatattgctcatggttgttcttcatctttttagttggacgtaccttgatgggaggccttgggaacaatctatttggagccgttaactcatctgttgaaacggtgtcaagaccatctcattgtgatcctatctttcaggtatgacttcttctatctagcagaaacatcttgacatcacttcttatagcaacttgaaaagtctaaaattaattaatggacaaacgtcttgttcttttcactagagaacccatggcacagtagacaagcatatatttattccactatgatgtggttttgttgatatgattgaataccttttattattttttttacgatcgacatcagggatttgctcagttgtcaaactagattgtttggcagattggactccatcttagtatcttatacgtttcttttttgtcgtactcttttagccattctttaggaggaatttttattgttcttatctcaaaacagcagggactccatgtcttggtattttaaaataaattttatgtgccctgctattcgtgcgacgataataggattgttgctgggtgccggcatatgtagttctttgaagttagttatctcatcatggatgttttccatgtggaataaaactttaactcgtgttctcattctggtttcagcaaatcagaacattcatccagatgagaacaaacctaaaggtggtagacaactctggtgccaagcgcgttatgtgcatccagtccttgagggggaagaaaggagcgaggctcggggacactataattggatctgtcaaggaagcacagcctcgtggtaaggtgaagaaaggagatgtggtctatggagtggttgtccgtgctgctatgaagcgaggacgcaacgatggcagcgagatccagtttgatgacaacgcgattgtccttgtgaacaacaaaggcgagctgattggcactcgtgtatttggtcctgttccccacgaactcaggaaaaagaagcatctcaagatcctagcgttagcggaacacatagtttgagatgcttacatacctggcaacctacctgttagttctgcagaatgaaatgagcatggtgctgtctcaagagtattccaccgttgttttgatcagttctgtttgcaataatgtaccctcaaaagattaaatgagctgatgccctgcagtcagtcctagacaaatcagattctgtactactatttaacctctgtagtattgcattccattcagatggaaacgcatacattgcttatgttctcttgttaaacctgaaactgcaactgaactcttgtgctttctgatctcaaagtgtttcggttcatgtgttacattgtgtgatcatgccatcctattcctagtttcctaccattgtcctgctgggacatgcagaagttataaagcttcatctacccacatatttctctttgcttctgatttcaccttaatctcccaatcaaatatgagtattttactctgtacatcaagtcatcaactgcagatgatcagatatctgtttgtccttgatcttggacttggaagaagcatgcagagtttgaaggaatgtgttgagtttgtaatttgttgttgccaaatttgtcatggtcagagtcattacctctcctataattaagctgaacctatggagataaacaaggcacactggtaactaatgctcaccttg

SEQ ID NO: 60064 - DNA, 9308 bp, Oryza sativa
aggtggaggaggagggagctggcgcgagtactcgagccacgatatccacgagttcgacgcgtccaacatcgggatcaggaaccacctgctgaagcacgccgcgtcggcgtacctgcagtccgccgtcgtcgtgccgccgcgggagcaggggtgcctcgcccgcctgtggcgccacgtcgtccggctgcgcgccgcccgcggcggcggcggcggcggcggcgacgggggagcgcgggggcgcggccgcggccgcgtgctcctgcgggcgtgctcgtggcagggctgcgtcgacgaccccgccgagctctgcgcctcgttcctcgcgcgctcggcgcggcgcatcgccgccttcctcgccggcatctgggcctagactagcctcgccgcggcgcaccgcggcgcgccgccgctcgccgtgcgcgcgcccacggattcttctcgtgatctcgtcttttgctgctactattactgcagcagaatagcacgtaactacactacattattaggagaggcagacacaaaaaattatatatattaaatttcttccaagaaaaaggctgattaccgatttactaaaccttgatttttttggggtttttttctttgttagagaaagctggcaagtaattaagatcaatggatgtaattttgctattgatctataattctgtaatctctacgtaaagctgctacttttgtagtaaagtaagcaatgattttttttttttgcacatctcaatataaggatggtgagataaatgagttggtttagtttgctataatgccaaaatatactaggtaatgtcaaaattagttaagttccagactttggcaatatatatgtgtattgttgtgaagtgtcaataatttggtagtgcataatttgccttcaaatcaaaatgatcccatatacataaatgtatacgagaaacaacaaggaccattttggattggtgtcgaaatgtccttaccaataatttagtagtttaaataatagtgtatgtggtttgaaagctaaattattaacattgccaatgtccaatttgatgctttctatattatattcgaagcttagccctaaattggactcaaaccatatactactaaaatattttgtattgatattactcaaagctttgatacaacaaaggtttttgatattactcaaagctttttcgtggtatcaaaaattatctagattttgacgctaccaacattttgatagtgtattgaaccaaataagccctaagtccataacttgtcttacgagtatagtttgtgaaatatctttgtgagaattattggcaaggctttttttccctttagaaatactcttttacgaggattttagaaatatatttagtctcatatcaatgagtaatgaacaattgaacatagctttgacaagatttgttgcagatgatgtactcccgctgtctcagtatgtagcaatttaggatgggattagacatactccctctgtactcgtaaaggaagtcgttttggacagggacacgatctccaatatacaactttgacttcttgtttctataaaaatatttattgaaaaatgatatatgtatatttttatgaaagtatttttcaagacaaatctatttatataatttttacattttcaaactcaacaacttgagagttattcataatttatattcccaagatttgacctaaacattgttctaaacgacttcttttacgagtacggagggaatattctagaactatgaatatactccatttttgcagtcctagaatgagacgaaggaagtaagacattgatattgttaaccttttttaaaaccatttttttccaccattgagatattgcaagtgcaaccttgatgtcaggggagtagtacagtttacaaagccccttggccctaccctacccatctttaagaaggttcagctaagactagtataccaacctagctctacatagacgatcgaaggaaccgccatagtgatttgatttcaaacagaaaagaccattggcgatcaatgaaatcatgacatccatcccctactacagtgatacgagacgagactaaacgataggagacaaatttccgctttattttcctctttaattatcctcagggcgacgcatctggaccgtccatccaaccccccccccccacccccaaaaaaaaaaactaatctaaccctaatttaatcatcatcaacaacaacacaaaacgcacgcacgcatttcgaattcgaaaagagaaaaataaaatccccccgcagttgcaacggtcggctcccccctccattttccccatcgccctcctccgattcctcgccatcctcgccgcctccacgcatctctccatccctctcgacgcgggatcgatcgataggcgatagccttctggggcttggcgcggctcggattcgaagtgggggtttggcgcggcggaggagattgggcgtggatttgatttcatttcggggcgcggtggttgatggagatggaggaggaagggagcgggaggggaggggatggccccgccgctcatggccggataggtgacacggcttcgcttggtgcttcgtgcgtgcgtgcgggtgtgggtgtgttttgggttgggtttggtttggtttctgacatggtctcgattcgatttgcttgcaggcggcgactcgccggtgatggtgtcgtcggcgtcggtcaggaagacggtgaagatgtccgagacctgcgacttcatcccctacgtcgacgacgacgacgacggcaacagcgaaggttcgcgcgcgcgccgcgccatttctagatctcgaattctcgatacatcgcgctggattttttttgaatttgtctgaatttttttctcgttggactgcgcggtgacgaccagaggagaattccgcctcgtcggggatcctcccgtgcgacgggatgcagcacgacacgcccgattacatcaggaggggcgccgcggccgccaggcacaggatcgcgccgctcgagctcttctcgggcccctcgccgccgcagggcccgccttctccttctccggccatcggcggtgccgccctggaagccacctccaacgatggcgtggccgagccgcaggttcatcctcccgaaggcatttctagcatcataagcacaggtggtggagagcaggagaccgccaccatgggttcacaaagcgtgcatgaaacacttcacattgaggaaaatgaggtgatgcttcgaaaaatttgttctccctttgtcccaaaatataagaatttttagaatagtgctaagtcaaacatttttaattttgactattaatagaaaaaatgatcaatcatgtaaaattgatgttaccagattttatattttgggacggagggagtactaagaaacaaggaggtactagttactgctgttcttggtgcttaatggaaggtgatgtatttgttgcagggaaaatgcagctgctgtggacagctcaagcaggagtactctctgcttttgagggagaaggaagagtgcaggagagttttggaggacttgatgagggagaacgagctcaagagcagggaatgccacgaggctcaggcgtccctgcacgagctgaggatggagctgatgcgaaagtcaatgcatgttggctctttgggtaagaactcaaaatttgtgtggctaatctactccagctttccaatggtagtaggcgtaatggaagattaagttcggctgtgattggagaaatgaataagttggatgtaaatatgtcagctcaaagtacttgtaggaattcgctatttatgtaaccagtagttacagtggttgtttaagtatctcatcaaaaaaatgtcagcatgcttgctgagtggctgaatgcaagctttctttttcatcatgcagcatttgcagtggaggggcaagtgaaagagaagagtcgttggtgtcagttgctgaacgatttgagtgagaaatttaaggtaactggtttcatattcaaagtttgtttactactcatgtacaaatagcacaattgtctgggaagtcaaagcagcatattttattttattttcaaaaaaaaccacaggcattgaaggcagagcaccagattttactacaagaatcgcttgaatgcaaaaaatttgtggcagatgctacacaaatgactacgacaatccaacaacatggtataagtgtggcatttcaactagttgtacaccctttagtttgttgcgtgtatatatttctccacttcctagagttggcaacactaatatcttaaatggaacagtgaaccaatatgcaagtttggaatgtgagtttaaggatctcaaagagaagttcactgaggagacaaaagaaagaaaagatctttacaacaagcttatagaggtcaaaggttggtttgatttgttgctatttgttggtttgatttattgctactgcaacagatggtgataataatagacttactaattactatgtcttgcgtattgatcaggtaacataagagttttttgccggtgtcggccattaaatggtgaagaaattgaagaaggggcttcgatggcagttgattttgaatctgcaaaagacggcgaactaattgtcagagggcatgtatcttcaaaaaaggttttcaaatttgattctgttttcagccctgaagaagatcaaggtaaatcccttcataactagtacagtttatcaacctgtatccttgctcaagtttttaacgatgtaatgttctccgatttctctacagaaaaggtgtttgagaaaactgtgccttttgcaacttcagtgctggatgggtacaatgtttgcatatttgcttatggacagacgggcactggtaaaacatttacaatggaaggaattgaagatgctcgaggggttaactacagaactctagaggaactctttcgaattaccaaagaaagacaaggcctttttcagtatgagattactgtcagcgttttggaagtgtacaatgaacaaattcatgatttgctgctgacagggactcagcctggtgcaacagccaaaaggtatgtttcttgtgaattctaacagcaacatgcgagaaccaatatatcatggcacttccttcacaggctagaagtaaggcaagttgcagaaggagttcatcatgtgccaggacttgttgaagcacgtgttactaatatgaatgaggcctgggaggtcctgcaaactggaagcaaagctagggttgtcggttcaacgaatgctaatgagcatagcagccgatcacactggtcagtcccttaaattcatacttttctttgacacatttttcatccatttatgctaaagttgtaattattaaatcctaacctcgttaattctgtatcagtatgcattgtgtaatggtcaaaggagaaaacttgatgaatggggaacaaacaaaaagtaaattgtggttaattgaccttgccgggagtgagcgagtggcaaagacagatgctcaaggagaacggctgaaagaagctcaaaatattaacaagtccctttctgcacttggagatgtcatatctgctcttgcaactaagagccagcatataccgttcaggttgtgaattactgtcctttaagtctaatttttcattagtactgtcttatgagcccagtgcccactgacatatttattgtcccaaattgacaggaactcaaagctaacgcacttgctgcaggactcgctaagtatgtagaactttttccttgagtggtaggatttacatctattctttatttttttggtaataatgtttgcaaacaaaacaggtggagactccaagactttgatgtttgttcagatcagcccaaatgagaacgatgtgggtgaaactctttgctcgctaaactttgcgagcagagtgcggggaatagagcttggacaagcaagaaaacaagttgatgttggtgaactgtcaagatataagctgatggtacagtagtactatgtcaatatatatacttttagtaagatcttagattccatctttttttaatctgaattcatactgctcgttttgctaggctgggagagccaaacaggacagtaagaataaagatgctcagattaagagcatggaagaaacaatccaatcgcttgaagcaaagaacaaggccaaagacctactcactatgaatctccaagagaaggtacttcaagcatcttttatcttcggctgcttaattggttcctccagcgcctttgcaatataaacaccttaatcagttaatcaccaattcaccattactttctaataaagatgttgtcctcatactttcatgaatgaagaattcacatgcttacagttatttacttgctctctcattatatatccagatcaaagagctggaagcacagctgctggttgaaaggaagatagcgaggcagcacgtcgacaacaagatcgcccaagatcacctgcatcagcagcagcaaagcaagaagccagaaaactcaccgtgcccgacgagaagccccatggcagagaggaacctcaactccacagcagagaagccagtgacgttgctcaaagacctcggaatcgcgaggcagatgttctccgacagcaacacggacacctacagcatcaaccacctgatgtccatgtcgtcggagaaggagaacaaccctgccggcggcgcgcagcctacaaaagccagaagagtctcactctgcggcggagctcaccagcagccggctgctcctcctcgccggggctcgctgatcccgctgccgcggcggaactcactgatgctgcctctaccattgcccaagcccgcaacacccgcggcggcggcgtcgccgctggacatgatcaccgagcagtgctcctcgccgctggtgatcgcccccaacgacatcaggggtggcggcggcggcggcggacggaacaagaggatcatcaacagcatcctgcgtcgcagcctgcagaagaaggtgatcatcaggccgccactaatggcagctcatcagtcagggaggagggccggcgccggcgtggctggtacaaccacccatggcggcggcggcggcggggtgatgagagcgcggcgtgtgccggtgagcggcggccggggaggaggaggggtgcagcacaacagggagaaggagagagggtggaacaacgggaccagcctcaggcagctcaactagagtgatactccctctatcccatagtataatggattttgaaaagaagtgatatatctaggactatgaatgatagtcatagatacgtcgcgtccctctagaatcccttatattatgggatgaagggagtattatgcatcgtcactcagctcagacgggtgagtgaaggagagacttatagaattgggagtagttttaggagggtttcaggtgttgatacctcattagattgtgtggtgtcgtgggtgtgcttgagttctcgagtattgtgagagaactctttgctgatgtttcattgtgttcatagattgatgattggattggttgatctggctgccagatcttagattgctggagtgtttgatctggctgtcagattctattttacgaaactgtttcttgctcggatcaggtttacaagtgttttccagttcaagtttgatcaaattctgtaatgatctcaagtgttttccagttcaagtttgatcaaattctgtaatgatctcattttctttccttcgcgacagagaggaattaagttcgagtttgatcaagttctgtaatgatctcattttctttcattcatgacaaaaaggaattagaacatgacgggagaaaaaaaaagtgaaaattcatgcttaccccctccgtcccaaaataagtccaatcctagctacgaacctgaacacatgtgtgtccaggttcatagccagagtttggctttttttgggacagactagtaggttaaagaaaaaattgttgcaatctgcacattttggtatagaaaactggtgatacaatagaaccatgcgcttgcataaacattaagcagtttaggccctcaagccagactatggtgatgcataacttatggctatcatacatgtcccatacatcgagctcctcggtttgtttctccaacacaaatatgttatagagactagactaaaaactaaagagtacaaaattggtaccacggcctcaattcaacaatttagctccacgtccgcttcatttctgctttccttagctcctgaaattttcgagagagagatcaaatgtcagatcatagctaaaattttgttggtaaattaaatacatcaaggttatggaagaatttcgttcaggcaacatagaacacaaggttgggttagtggaaaaggaatgtattatcttaagcaggattaatgaaagagtgcatgtaccagcaaacaattgtttctaaaaaagtaaacaataaacaaaaatctagtaactaaagtaaaaaaaaatatatctcagaacttcagaagacggttgcccatccatctcatagaaaaagaagacatttgacgtatggatgcactccgaatagattgatttaaataaataaaatgtcaattttaatcaaaccatcgactgtggaaaaagcaggtataaccatcatggttagttcttttcagtcaatagcaataagcaacgttagcctccattggacattgatagacgacacaacaacaggatgaatattccgtggacttacaattcaatgatgatcccgcaagacaagtcagccttgcttttgtgttagcctctgctaatggagtagtcttctcttttgcaatcatccgagcatcccagatccttattataccatctgatgaggccgaagcaattaggttgcacagttcagatccatcgttcttgtcgtcgaagacaacaatccctttcacacgagttgaatgagcatcctcaatgcgtgatgtaaccttgccactggaaagatcccaagcagtaataccgcgttcctctcctccagtgtaaagtattcccttctaacaaattaaatcataaacaagtgagcggtatacaaaaggcaacaccatatagtcactcaatgtttctataatatctatagcatccaaagattaacctcaatcctcatgcataaagcgaaatgatcagctccagatagctaaaagaatagcatggactggagctccaaatgatagctaattcaccacaatatcggtaacaatataatcaatcaaaagccgacacattgaacaatatgacaaatttcatcaaatactcagcacctacactgtaactactagcatttatgcctaaccatttagcaaccacaactcataagca

SEQ ID NO: 60065 - DNA, 10982 bp, Oryza sativa
tttgcaggcgcaaaggcgagcacccttttgccgcagtcgatctcatggatgatcctagcatcctcggagtcgtgcacggtcaccttctcctcggcggccatcacgaagcggtccccaccggcgccatcctcggcgtaggcgatcgccgtggccgggtgctcgaggcggcaggagaagctgcggcggccgcggaggaggttgagcatggcgaggccccccgagcggccgacggcgagcgcgacacgccccgtggggtgcacggcgagggcgtcggcgggctcgcggtggcgcgggaagacgcggagcgaggcgaggagcgggaacccctcgccggcgtcgtagaggtggaggaggccgtcgtcggaggcggcgaggaggttgcgcgggacggggccgagggagtggatggcgagggcggagaccggcgcggcggggtcgaggagcgggccgaggtcggcggcggcggggaggtcgtagaggcggacggtgtcgtcggagccgcccgacgccgcgagccccgcgcgcgccgccgcggcggcgcagcggatgggccccgcgtgggccgggtaggagaagagcggcgcgagggctagggtttccgacgacgacgcggaggcggaggaggaggttagggttttgagggagaagccccagatgaagcgctcgtaggagccggcgatgagagccatccgggagagcgcgccgccgccgccggcggtgagaggaggagggtttgggaagagagaggagagaggagaggagacgaagggtttggggggttttgtttggtcagggacgctgtcatgtggggccaggctcaggctcggtctttcagtgcagcacgaatcttgacgatcatcagatggctagtagtagtactaacatggaagctggtttccgagaccgacatgtgggcccactaggggctgtgttgctttcttcaccttccccgctcttttcacgcacacatttctcaaactgatggatagtttacaaacggtgtatttagttcatgtcaaaatttgaagtttggttgaaattggaacgatgtgacggaaaagttggaaatttgtgtgtgtagaaaagttttgatgtgatggaaaagttggaagtttgaagaaaaagtttggaactaaactcggccaaaacttttctatataaaaattgcttaaaaattttcaggctagtattttaagcaactccattttacgtgtggaagagagaagttgcaaacctcagggaacaaacacagtgcaaacatgcaatctgtctttctttataaaacaaaaaataattaagaattcaacctctacgtcaataaggatgtgcaacgtcttaatctgcatcgatgaaatacgatttgggataattgatttgcttggcatgggcctcatcgcagaaggttagaggcaacatatgttagttgtgcacaatgaacttgtaagcaaaacaactctgaatttgcaatggaggattcatttgtgttgtctaaatctttcttgtttgctgtaggaattggattgcttctaagaaaatctagcaaaatagagggcctaaatcttgtatacatcaatgaaggactcgtataaacatcaagattttatttagctggtgataatcaaaatcaggtgtaatacacaaacaaaccatttgcacaatatatctacctaacaaaactacaaagacaaaaaaaaagagatcatctttgcttcttccagtatctgtttcaatcgacaactaatgttttcattttatttctaacccgaaaacctcttttccttcaatatagctttacataaatttttcatcaggggctctcttataccaaagagctaccagctattataagtatagagtgtggtgagttgatgtgcgattatgaaagagattttaggctaaagttgagttccaaataaattgttgcagtgattatctaattaattatagtgataatttgctccattttgtttagagaacaactactcactccaattcataatttttgatgttttggacaagattgagatcaaacttttatagctctaattattaatgtccaaaacgtcaaaaattatggaactggagaggatactatgtcgtaaaatcaagaatgatggtttcttcgtgcaaccaaaaaaatagataattgttatctgaaaatatctaattgttcaaggaaaaaatatggtgctagtgaaaataagtaagataatgaaatattttttatcactaattcatggttgtcaacgatcttacttactgataattatttttgacggttaaagtcaacaaactagcttaaccaacaatccgaacatgtgttctaaccagaatacaaaggggaggggaaccatcgccacaatccaaccgttgctccccacatcaacggccgagatgtaaccttcctgatctcatcaccgacttaacaggaaatttttcttatttccaaaaaaaaaaaaaaaaaatctctcctctcgtcgcactcttccccccgaatccaacactaaccctaaatcgcagcggcgggcggcggcggcggcggcgcgatggaggaggacgcggaggggatggaccggttcgacatggacggcgacttcgagggcggccggttcggcagggacggcgagttctactacgagcgccgccgcgagcgcgcgccgcagacgcgcgacgacgcgctctacggcgtcttcgccgagggcgactccgactacgactccgacgacggccgccgccgcagccgccgcaagcgccgcagggacgaggccgagcccgacctctcgcgccccgtccacttccagtccgccggcaagttcatgcccagcaaggagcccgagcccgagctcgaggagaggcccggccttggcgccgctgcctccgcctccgcctccgcctccgcggcgggtgaggatgatgcggcggaggaggaggaggatctcgacctgcccacggcgttcgggcagcggatcgcggagggcgcgagggcgaggcgggaggagagggcgcgggagcgggagacggccgcgcggcgcaggcaggcgtcgggggtggcctccgggaagccggcgccggctctggggagcctggggtccaacacgaaggtggccaagatgatggccatgatggggtacaaggatgggatggggctcggcaagaacgagcaaggtatagtcgcgccggtggagaccactctgcgccccaagaacgccggtctcggaagcgtcgaggggttcaaggagcccaagccattctttactaaggagaatttgccgcctccgcctccaccggcgcccgccaagaaggagcagcagaggtggtcgaagaaggccggtgcgaagaaaggccccgtgctgacgaagaacgagttgctggcgatgcgcagcgagcaggagcaggacgagcagcctacggttgtgcagaaggtgatcgacatgcgagggcctcaggcacgcgtgctaacggacttgaaggggctcaacgtggagcaggagatggaggcgaacgatgtgccgatgccagagttgcaatacaatgtgaggctgcttgtcgatgaggccaaggctgatattgtgaggctggatgggcagctgcgacgggagcaggagaaggtggcaagcttagtgcgggagaaggagaaagtggcaaaacaggaggctttgcagaaacgccaactacaagttatggagaagattgcaggagtgctggagcaggtccgagtggatgatactgcaggtattctctctctggaagggttgcttaagacctttcaggaattgaaggcatgctacgtggaggaattcaagatgtgcagtgttgcatggattgcctgccggtttgctcatccgctactaatccgagtcttccaggggtggcaaccactgcaaaatccgttgtttggcttggagatcatgtcatcatggaaagatttgctgcagggggatcaagcatatgacttctcaggtgatgttgaatcgatggctccatatgcacaattggtttgcgaggtcatcctacccgctgtgaggatatcaggaaccaattcatgggaggctagggatccagaaccaatgcttcggtttcttgaatcatgggaacggttgctgccccctatcgtgctccagtcaatattggagcatgtcataatgccaaagctttcagctgcagtagattcttgggacccacgcagggagaaggtaccaatccatgtatgggtgcatccatggttgccaatgctaggacagaggatagataccttgtgccattctattcgatacaaactgagtagtgttctccatgtttggcaagctcacgatgcatcagcctatgctgtgttgtctccatggaaggatgtatttgatgccgcaagctgggaagacttgattgtgcgttatatcgtaccaaaattgaaaatggcacttcaagaatttcagatcaaccctgcaaaccagaaactcgaccagttcaactgggtaatgatttgggcttctgcaattccagtacaccatatggtccatatgttggaagtagatttcttcagcaagtggcagcaggtcctgtaccattggctgtgttcaccaaatcctgatttcaatgaaatcatgaactggtacaagggctggaagggccttttcccaccagaattgcttgccaatgagcgcatacggatgcttttaacggctggccttgacatgatgaaccgagctgctgaaggccttgaggtggtgcaacctggcgctagggaaaatgtgggctacttgagagcaacagagaagaggcaatttgatgcagcacagcaagcatcacaatacatgactcaccatgcggtgccaggagcagccatggcggatatgagctttaaggagtctatccaggcatatgcaatggaccaaggcttattgtttatgcccagagttggtaaattctacaatggtatgccagtgtatgagtttggcaccgtaagtatttgcatcgactctgtgaagcgcctactctacgcacaacttcaagaaggaattgagagatggagtgctgtctctcttacacaattgatagaaatgaaccggaaggcgaggcaacgctagttgatcatcctattgtgtactattactaaaaggtgtcagttttgatcatcattgtagaatatttctaaagagcagatggtttaatgatgtatctgaacaggttgttgtttggcctagtaactttgtagtatttatattcatgctttaatatgcaccgtggtgcctttttcttgccatagaatgaacaaatgatttattaactattagttatcaccatgacaattctatttggttgtgtcatcaatatttttatttcttggatgcttctcttgggctgtacaatttgttgatatgtgcttgctttgaatcattcagttagatttgaaaaattagaaaatgaggttgggctctgggtggctagttgaattgtatcttctttatttgcataaagctcaggacaatactgtaaagagttatactatgctccgcaattcagatgaattagccgtggcagatttagtgagcattgcactcagttcttccttgttcttcaggacatttcagcattcttgcctagtgttgctataaagaaatgcttggtcaagcaagaacggtaatatagaaaaggtgtgatatttggtatccttacctactataccaagatactcacatagtatgtatatcttgagatatatcattctttttgcttaccttcgatatgcaggtaaaatcatttgatggacatgggattctttattttctctaagaagatagctgctgccattgttcattgtcaaggaaactcaaaagcttgatgaatattgcttctttattagatcatacttagataacctgtatgactgctataggaatgagtgaaaatgtatgtcaatttgttgtggatgtgggaggtgtgatctcatttcatgttatgacattatacatgtaaatgtaactgaggttatggtggttttataaattgttcattctgtgaatttatggaatcttctcagttcccatgatttttggggcggtttttgtttttcaggcattagaggcttgtcctggtgtaatttgtcaacaccagttgccattgttgggtgagtttgggttgtggtcgaattctatttgttttgttggcctgatgggtgtgtgggcttatttattgctaaagagctgcagctttttgtaatctttcggaccaaattctgttattatcagaaaaaggtgtcaagtaaagtttttttcctttcatattttgtaaaatatgaataactttgcaataggtactgaattaaactgaaaaatctcgagatgtggctgagcagtgtgttactgactactgattgctggaattttgctatcttgcttcttcactaatatatgtggaatttgatttgctttcaggaataggaaaatattcatgaataccaattcggagcaagaacacactacaaaagcatcttagttgtacgaaactaaaccaaattttctcgtccactaatcaaattggaactgagttactgagatgctacataaactgaagccgaaagggtaaacaacccaagaaaatctttgccatgtccaacttggagcttctaggatggccaagctgagctctagatcagtcctgtaatcctgttcagttccattcaggcagatcactcgatgtcgtcgacgatgggaaccgtgccatcatccacggcggtttgccgcagtcgctgaatcgccttcatcacctgtcaaagaagcatcaccatgagcaccaccaccgttgatcaaagcttccatggagagatcacaaggatgaactaaagagcacacctcattgtcccagttggtcctggcagtgatgatgatcagagctaccgtttgcacagatactcctatgatcaagccccaccagatcccctgattaacataaacaagatgttatgagttgcaactgatgaaatctgtgtgaaaaactgtaacatagaaaagtaaactggaaagaaattaggagagagcagtagtatttacagctgcccccaggcttgttttgtatccaaggacgcatccaattggcagcccaatcaggtagtaggcaccaacattgacataggcaaccaccacctgccatccactaccaacggccactcctgcagatttctcaaaggtaaccaagcaattcttcagttacaatcatgctactacttggcagccgagaaatgcgaaatgcgaagcgtttgtgctatgtgaaatgcacctgagaggattggctgaattccattcaagaagatgctgatggacagcaacggtgtcagtttgatgacagcctcgatcacggtggtgctgcttgtgtagagcgtgctcaggggatacctgagaactaggactagaattgtagccaggatgctgaaggcaacgcttgctgtgataaccacgaagaccgagaaccttgccacatttggatggccagctccaagctcattaccgacacgaatactgcataataagttcatgcaaaagtttgaataatgaagtgggattgagaagtgtgtatctttcatttgcactcacctggccgcatagcttaaaccaagcatgatctggaagtcccaattccagtaattgatgctgacatgcgtaaaatacatagcgatgtgagttacatatatatgaatactgcagtagtgtataagcagacatttgaaactgcaagaccaatgagtatcatgaggtaaacagggtgtgggcggcataccagatagagagcgaatcaagtgcaatctctgggtcggggaggaagccagtaagaagcacaaatccttgcacataccaaatctccaacctgaccaagaacacatgaaaacaagacataaacacgcaagaactatggctcatagctcaagataagtagatcactcacgctagcatgacggctgacgcgaaggcaagcttggcatatccccagaggcctctgaacgcgagcacggacaatccagtccacgtctccttacaagccggagtccagaccatgagcccccatgtcaatgccacgagcacccaccaagagaagctcagcgtcagtgccgcgccgaggaggccaaagccgagcacgaacacggtcagccacgatatgaggatgtggaagatcagcacggccatggtgatgtaggcaacggggttgacgatgttctgggcctgcaggaacctctgcatcgggcagaagagcgcgaacgcgagcagctgaggcaccaggccgcgcgcgtacagctgccccgctgccgccacatccgcggcctgcccaatgagccgcaggaacgggccggcgtaccagtaaaggaatgcgatgacgatggctgtcgcgaactggagcaccagcgccctctggcacacaatgcccatggccctgaacttcctggcgccgtacgcctggccgcacaccgtctgcaccgcgctcgccatgccaatctgcagcattgcatgcaagcaacacacacatcataatgctttacattcccaaacaaccagagtgcatgcaagaaatcaaagttaccatgatgccataggctaggccctgaatgccaatgttggtgatggaggcgccggcgagctcgagctcaccgaggtggccgacgaacatctgggtgacgaggctgagagtgaagctgaggagcgtgatgaggatggacgcccacgagatgcgccacaggttgccggcctcccatgccgccagccgcgacagaacgctccgcggcacgggctcccggcgcagcagctcctccgacgcacccgaagactcatcgacgtccagcaatggcgaccgtgcactgcttgtttccgccattgtctcctccccttaagtgctttgctcaacataattcataatggaccaaggcatttatagacctgccaaagattcatagctcttttgaattttcagtagcagctaactaaccttcaagtgccagacctaccagtccgtttgctgctgtgaataagttggttgctgtgaagaagtaggtgcagtagtaaggcatgaccaattaaccatggagtttgcaatccagctgaacatagacaactaggaagctgccagtttaggaattaggatagatgaattgcagattgcattgcatccagaaagcaaaagaacaagctttacagcatgtagtatcgtattgcctctgactctaaccatcacaattgcttgtttttcgaatcttaaatattggatgaataaatacaaatagatcgatacgctgtaaatcaattgctatcttgttttacttgtttcagaagacctctttcagcaaacttaaccatgagttttccaggaactggtttgtttttctctgaggccagttgattatcaactttttggcataatttaacatcaggaattaaatttctccggaacatacgacaggccacgttgtaggcctgaagtccgaggcctctattcagaaaactctccatcagaatgtggcatgtttgagcatctctcactgaagcagttctcagtatcttgtagaggagactgtaagcctcattaagtttaccgaaagcacatagcttctcaacgacctgattgtatgcgctcttcatctcttgtcttgctagcattttttccagtagattgagcaagtcttccaaattgcccttctcacagtatctatgtatcactgtcctgtatgtaacaggtgtagggagcacgcctctgttgagcattttctccacaagccctgtcgcttcttttaatctacctttctttcccaaagcatcaacaacaacagtataagttacaacatcaggatgcctgttgctcagatacatgtcgtccatcaaagagagtgctgattccaaatcaccctgccgagaaaatccatgaatcacagtagtgaaattaacaacattaattgtacagcctttgctctggcactgttccatgaagtctttggcctctgctggttttctgtccttacatagagcatggatcagtaagttaatctccacagttgtggggaagaaacccttctgcaacatctgcactaccacatcacatgattcttttagtttcccttctcttctaaatccatgcattacaacgctgtaagtgatatcacttggagtccaccactcctcttcgctcttgtttagcaattcccaggcctccgacgttttcccaactttgcagagcccatttaacagagcagtatgtgtgactgtatttggcttgcaatcattcttatacatatgcttcatcatctttcttgcttgatcaagttccccaatgcggcaaaacccatcaactactgtgctatatgtcacaacatcaggttgacacccctttgagatcatctcacctacaatctcttttgcctccgccatcctcccattcaaacaaaatgagtgcacaattgcactatatccaacctcatccactctaaatcttttcccctccgattccctcaagaactccaatgcctcatctgcatggccatgctttgcaagcccatggatgagcacattataagtgacctgatctggaaatagacctgcatcattcctcatcctttgaagcaaacctcggacctcttccaccctcttctccttacacaagaagctcatcactgtatagtagctaatcttatcaggagggcacccattttgcagcattacaccaatcatctccatggcatcaacaacccgccgagccccgcacaaccccttgataaggcaattgtatgtgtacacatctggctcaaccccaacgcggcgcatccgttcggcgaactcaagcgccttgtcgacacgcccggccaccacgaggacattcaccgccatgttgcaaatcgatatgtcaggcgcgcacccgtccttctgcatgaggtggagcacgcgcatggcggagcggagcttccccgcacggctgtacgagagcatgagctgcgcgaactgctcggtcccacgccg

SEQ ID NO: 60066 - DNA, 35993 bp, Oryza sativa
gcgattaaattgatataaaacctgtagttttgtgataactttgttactaaatctgtagttttgcgatagtccaccttatatttgtacttctgtgataaatttagtgttaaatctgtagttttgtgatacatcataattaggtcatctatcaaatggtgttcagtacaggattatattaagatcttttcactaggaccatgcaattggtcacaggaaaatggaacacatgaatcagagaagatccaagtaatcaagtttccaacaagccagaaagctagaaggcataacataaattggcacatattacacagttcagaataggttctgatgtacctaaaatgtaggggggaaagagaataggtcgagtagatggcaacaattgtctaacaaagatagaatatcttacttgtaacctgaaggtgcatgtgcaagaacaatgcgctgtttgttctcaattattaatcttaagtctcgccgtgcagcttcaagatgcatataatcgcggaactgatcctgttaagatatgaagagaaagtacaagaagagaattgcataagttgatatttttgtttgtcatacaagcatggttctgaaagtaccaacagcaacaaatggactaacaggataccaggctttactgtagtttttttctcactaacatgcacatgtttagaatcagaaacatgtgcaaacgataaacaaaaactaaattcataaaattgtatcatcatgtgcttgacacatggataccaaaccaacttataaaaccaaaactgtaagtacgtgaggattaccttagtaaaacctgggcttgcaattacagcacattggactacttcaaaatcaatatgcttcaggaaagcctgtaggcaaattaagtaatgcatcagtccaaattggtttcattaatattatcatttccttgaggaaacatttttcatttacttgcaaaacatgttcaaagaacttcttgagggcctacaaaagagcaaaacaaagtcagttgggaatagatagaacaattagattacacaatatcagaaccagtttccataccgactcataaccagcaatcgcagggccatgcttccgaggaatagatgtttcaatacgtgctctggttactgttatgctgtttagataaccatagctaataagtcaaatacaatcaccgcaagaggtaactcaagcctttaaaagaatagggaatcaaacagggctactattaagataatactctttcatcatcacaattagcatgctatcatgggaagtacaataaaaattatcttggtcgtgccatggcacaatgagtcaatgactcaacttaccttctaccaatgaggaacaaatgtgcaagtccttcttgcatgagaataactgctagatcagcacttgcagttgggtctaatagaggtttagatgcactcagttagaacattgcatttctcaagaaagaataataacagaaaatatgataagttgataaaacaaaagtagaagtttatgtctcaatagaaatcacaagatagatatcactaggggtctcaatgcatattcaagatgatggatgataaattgattaattatcaatagttctcattaataggtcaaagtaacaagtttgcaaaggttgtcaagcactcctggtatccgcggtacaaccataccaataattttgcagagcagaagatggaacgcaaacaatatataaacactggacataatggcacatcaggtttgaaagaaaagagatactctatttatgagtgagtttctctgcattaaaatctattcataagaaggggagcaatatgttcaaaatctctgataatcaaaatatctcagaggtgatggcagaaaaaatggagatatgtgcaatcagtttatactgattattatggttggaagacagcttgaaattagggttaatacttcgagatatttaggccctcctaacaggcaggacccggatgggctttcctgctaaacttaaggtcctatttgtaagcttaggcctcttcccacaaattctccagaaaaaaaaaacagattatgagtttcagtgagtaactaagtatcattgtacaatcaacatagtgccaactttgttggataattcatcaggactgaaaaaaaacaaccacatgtttttttcccagtggcttaagtaatctagatgaatgggcatatcaagcattagcaggctaaaatttgaggtacaggtagcattcctaatgtgataaccatgtaaccattcagatcaatccatcatagaatataagagcaataagacaggaaaagacagatggaatgtacagaattagaagatagtaacatttcagttctcacataccacatgcttgttggatggtatcaagagctaaccaatcccaaagttcctgcaaaagtagaaatagcaatctctcctcaggtaagctacaacagaccaaaagaaggtacattctaaatggactaccacaatttacaaaaataaacaatggtgataaaattttcaacaacgatatgtatctgagaatagttggggaacattatcatcagccactgaaagaaggaaactatattatgtcaataatcgttatgctttccaactcctaagtagtcatcgtagacactatgaattaccagaggctggaaaagatacaagttccatgggcagggacaaaaaaaactcatatgcaagtgcaagattcattaagaaaattagggaaagaaaaggatagcagtctgatgaaagtgccaagtttttttatataactgagtccatagtaatgtttaattgcaaagggatatttgtataatataaatattgcaaagctaaggaaaggtcccattgtcaagtgctattaaaagaaatgaaccaaatttggccaacctagttgttcaagatatatgacagtaaataaaaaagcatgtgcacagatgcctgcatatcctatttcacttataggttcagttaaaaaaagggcaagctgcaaatgggatagaaagtttatctattaaaaatctactagctcaaagcaccctgtttgtagcactctcaggtaggcctgttcacaggttgggctcaaaccgatgaacataccaaaccaaaccaactgaaaccagttaatctcttgtatatataggtaggttgggtttcctccacaatccatcaaacactatgactccttcatcttcttcaggacctcgtcctcgcacgcaggcagagccatctttgcaatctcaagcggtggccgtgtccacccaccggcaaagaccttcacagaggccatgtcccccaccgatgtccccgatggcaatgtcccccacaagcgacgagttctccagagccacggccacatccccacacaattgacaagtcccaatagtggccatgaccccaacccctcgatgggccttcaccgtggccgcgtcatctcacactcgaaggcgacttcccctcacatgcgacgatacatcgcgcgctcgatggctgcacctctgtagtcggggcgtcccttgcatgttcaacagcaactcgtggacgtggctgcgtccagtggcctgtcacaatctttgtgtgctctgctgtgcttcacaggaaaggaatgccatggccatttctagctcctctgcccgaaggactcttgatctgcttctttctcttgttgaggaaacagtttaacccgtgaaaccagaccatctaaaccgtacttctttgggctgggctgggttaacatgctaaatcaccttaaaccatcgatgaataaccacacttttcaggtaaggcttaacaaatcccacatcagcttggaatgtgccggatattggtgccatattttaaccatttagaatcatatccaaattttgaaccattagtgtagtgtttaagacaatcctatccatcattagctgaagactataatgtggtcccctagtaaacaggtaaaggcagtttgatcaaattttagggcataccttcgtcaaagtaaattgtctcttcagctcaagctccacagtatgaaactgtccaatcttcacatgatcgttctcagttatattttttccacgtacacgcaagacagatccctccttatcataatctacagactatgtgcaaaacaaaggagcatgtcagttatcatcaagaaaataggtaagttttgatttggaaacaataaggaacaaaactaataagagcatcactggctaaaaaactaaagacagcattattttttagtatgcaaggagaaatagatttctcgacctcttcggctgtggtgccacttagctctaagtaattcaaatgcttaagtgacgatgcttgttgcttgacttggggggtcccattactccattatgcaactctaaattattatttttctaaggcagaggcagaaattttgcatttaaaaagtacagaatttcactccaataatattatgtttaggtcacccattgtacagcctttgcggtttgttagattgtcaatctctttccagttcacgcattgtgtaggtaaactaggctctcttcccaaataatcaaacaatgacagtgccactcaagtctcaaattcacaggttgcaatccacataggttacatctgactgtaatcactagtataagcactcagtgcagatagaaggaagacagatgatatatcacctcgactacaatttccaactttaacctcacacgctcagcatcacgtcctccagatgccatctctctcagaactttcctgggaatcaacaggataaaaatatgtttaaggggattatgagttctcactgtgcactgaaggatctagatatattttgatggagaaacatagaagttcacaagaataaaggggacagaatcttcaagtaacacaaactacattaccaccaaggttgaagtatgagtatgatcaaagcctttcaagtaattttacatatctaatttttctataatcacataaaagcataatggcattgagaaattgttaggtttagtttttttaataaaatggatgtttaaagtaaacgaaacagtaacactaattccagcacttccttttcttcccgcaatcccaattcttaagtcccagtccaagagccaaaaactatttatcacgtagtgaaccatgccttccctaagtttacgccaaaattggaagtttggttgaaattggaacgatgtgacggaaaagttggaagtttgaagaaaaagtttggaactaaactcggcctaaatctaagtgccctaattcctctaccagggtaggactaggacatcgaggatagttcgaaattaacagctcaaaattgctaaaccgaaataaattactctggttactaactgaaccaacactacacaatcactacataaaacggaggaactcacctcacagtgacggactggagggtatcccccggaacaataaggttgtaggcatgccacaggtcgtcctcctcctccggcaccagctgcgctttcacaataaatcgatctaagtcatccaatcagcacacgaaccacacaacccccacaaaaggggatcaccaccgtacccccaaacccaaacaacactagacctagtgcaagcgatcaaacggagagcgagatggggaggggaggggagggttcacaccttgacggagccggggccgttgcgggcgaggttgcggtagacgagcttcatcgccggtggcccggagctgtagaacgcagagatgcttggctcctcgtgcgggtctcgctctcggcggcggcggcgcgagcggcgggggggattttgcgacggcgaggggagggatgcggcggaagctgtgtcgacagcgtgggatgggatgtgaaaccggacacggaatctgtctccctttctgttacgacgttatatacatggggccccaaagaccggattagctgccggcccagccgcgtcgacgtctataatcggagtccaactccacattggactcgagttcggcccatgattagtaccacctcaggtctggcaagtgttactctctagttttaatgcttgaacgccgttaacctctagttctttttattttaaaaagttcatgtttttttgttttactataattttttattgttaaatatactcctaccatgacttatatttttgtatttttaaaataaaattaataagacatatatcgaagacaccaaaaatcaagcgcgtcaaacgttaaaaaccagagagagtaggcgttcacaactataattgtgtgtgttttccacgtgcgtgcatgagtacatcgatcgaatttagcccctacatattttcaaagcggtagataatactttgactttggtcaaacttaaaaaaataacttaaaaaattaagcgacttacaatatgaaatatgaaatgggtataaacggaagggacagtaacaaacagctatcattatttgtcagaatttctgagtagctgatactttggcaccccatctgtttctaaatgtttgacatagcacatatttgatcgttcgtcttattaaaaaaattgcgaaatatgtaaaactatatgtatacatgaaagtttgtttaacaataaatcaaataatatgaaaagaattaataattacttaatttttttaataagacgaatggtcaaacatgtttaaaaaatcaatggcgtcaaatatttagaaaccgaggaagtaataaccaacatcttatgtttatcattttttctgcatatgtattgtacagttcaccgcgcctttttacttcagatgaaatggcacactgagctagctttacatttcgttctcgatgaccaggctaaattactcgctactagctagctagctagccaagcctctttctgatgacgccttccaccgagccgacgaacgcgaacgtgccgacgacgaagcagacgacgctgaacgcctgcagcgcggcccaccgcggcgtccacggcgagatccgccgctgcacgcagtacatctcgacggggaggtagatggcgagcggccagaacacgagcgcgccgagcacgcccagcacctcgttgaagtaggggaacaccagcgccagccccgtcgtgctcgccacgtacaccgtcctgaagcacacccgctgcaggttcacctcgtacctccccgggccgccgccgccgccgccgcgccgccacgggaggatcttgacggagtacgacctgttcacgaacgcgctgttcggaaagctcgccgcgaagcaccggtcggcgaacgtgaatatctgctggctaaacatctgatgcatcgagttcatgcaggattcgatcaggatagttttttcagagaaaagcaatgcgattttggagaagtttgagtcgcagcttcacctggtagccgccgaggaggtggagcacgatgcaggcattggcgaagtctatgagccagtagggctcgtagaagccgaagccggtgaggaggttgcccggcgcggcgttgccgaaggcggagtagccgaagcagccgacgcagaggtagaagaaggtggtggcgaggaccgcgatcacgttgcccttctgcatcgtctcgctctccggcggtggcgatctcagcgtgtcctgttcggtccatcagtctcagttcagatgaatcttgactaatttcagctaaaaagtgtccaaaaaaatgtctgcttttcgtgttctgaaattggccgtgcgcacctgtatctccaggagaacgatggtgtacgggtaggcgaatgcgatgtcgccaattgcttgagccactcgccaaactttctgcattggggtggccatcgcaacaccggcaatgttccctttgacagttccatcacctgacacgaagcaaatgcaccaagatttacacagtttccggctaattaattaagcactgctgaattgtgacatcggcatcaatcaaatggaacaatcaagctactataccaatggtcttggcgaggccgaggccgaggccgatggtggagtaggcgaaggacatgatcgccgcgacgacggacagccacgccatcttgtggaaattgggtatgaaggacagcagcagctgggctgctccgaagagcagcatgtagaagtgttcaccgttcgagtcgcagggagcgtcacggccttcgctgtggtagcagttcgccctcttaattgccctgtcaacgggaacaagttaattaagcacaggttgaacaaacaacagtttaatcttctacttgaagatctgtatgaaaaaaaaactgtaaaattcacctcatacaagttgccgtagtgattgtgtaagcaattcctatcccgtacaagttcaggtactgcagcaacccacataaccaagtgtgcttcctccctaaacatattgccaagttgccacaaaaaccataccattaatttactgctacccaatatacaatccaaaagtggtatctatatttgaccaattggacttcctgaggaaaagattggctaactaacttagctgaagtaggattaatcaaggtacttaattacctaagtgaactctgacggcgtccatgtaggagtagttcctctgcatcttctccgagccaggagacctgtagcagtgcgacagcaggaaggccgagatgtaggtgacgaaggcgaagcacaccatggcgatggggccggccacccagccgagctgcgcgacgctccacgacagcgccagcacgccgcacccgatcaccgcggtgataatgtgcgctacgcacgtccatagattccctgaaagttcatcgaagaagaagaagacaaggaaaattagaagagaagagctcaagagcaccttactacttgccggcatgcctgaattctcgtcgatgaaccaaacagatcgaacaaatctcggcgacagagagcgtaccggtgcgttgtgggtggccgtcgtcgtcgagcttgggagcagaggccacctcgagcggcagctgcggcgccattgtcaaaggctcagtgaagccttcaaatttgactcgttggactacagggaggactgaggagtgaacacgcgagagctatacagtactactatatactagtccactaaccaattaagctagcgttgtcactggattggtgagtgatttggataaagaaacttgggggataactctgccgtatcgacagccggaatcgcgccttgttttaagtacaaaatggcacgagcagacgaggctgctgctcatgttcgttgaatcattgtatagtagcctcctgacaaatccaactgcagcacagcctgtatgtactacaagaacacacgtcaaaattgtcggtttctaggagcgcctgtagtttgccaaggcctctaaactgcatattagtactacctccgttttttaataggtgatgttgttgactttttcttacatgtttgaccattcgtcttattcaaaaaattttatacaaatatataagatataaaccacacttaaaagactatgagtgataaaacaactcataacaaaataaattataattatgtaaattttttgaataagatgaatggtcaaacatgtgagaaaaaattaacggtgtcatctattaaaaaatgaagggagtagtactgtagtagtattatgttataatcgagtcacaggtttaataccaaacctagccaaccaaaaatttatgttgattagaaaggatgcacaatataccacaaacattttgacagtgactgactgggaattagcggcacggttatggatcattttcaatgcgcatgttgcttttttcgtggatgaattgaacattgcttgcttacaagtcactgggctcgttttcatggattacgggtggggtcaacggcacctcttcttgtcagctgctttgacaacttttttctgtatacgggttacgagggctgaataaagccacggtgtagaagatcagggtttctttttttgtgttcatatatgatgtcttcacatctctgggcataaaaacaggctgggagcaaatctcctttccgatgacgatgaggtggttggtacttctacgtggtagtgatttgcggcctttttctttgtttatttcctcgagattattattatttgcctatatagattggttctttgatatatgtgaaaatatagtatggtacaatgatacatgtggtgcctacatgagaattatgtgatactagtctgttaaaaaaaggtaaactctagctatgagcttaggcacgagattcgtaactaggattggacttttttttttgacagaggggtagacggtttttgataattcgggatatgctcctctctggacatccgctatttatgttgtgacatgctcattattgcaaagaaactagagaaaaaatgctcactatatactatacagagaaacctgacatacatattggacagataaattaacaatttttaagaaaatatttcctccatctaaaacacatttttttaagtactacgaatctaaaggcattgctaattttggagggtttcttggaagtgtagtgtggctccgctaccgccctctcttttttttttggtagtttccctttctttcaccagttgcagctctgatttttccttttctttccccatgacataggcatgtctggccgtttgtgtgtgtaacaaaaactcttttgtttttaatatattgacgtgcaatccttttgcacgttcgtagtactaggaagtgtcccatctgtccaaaattcattatattctgggatggatggagtacctaaaggtacgatattttctactgtaagaaattctgatataaatgttgatacctcttgatattttgacatataaaaccgtatcttctaatgtaaaaatttatggtgtaacttttaatacctcttagtaatttgaggtaccaatagtggctcggtggacattccctcgttgtttgcatgtcatccaaatggctataaaaaatttaacaagatagattaataggtatgggataaatcacttaacaaacatgcaagttaaaatttaacttttacaggttgcaacgaaaaaacaaattaaactatggcttaacatatattcgcactcaaatttataatctgttgtaacatatgtaaattaaatttgagcttgcatgtttgtggagtgatttatcacatattaacatgcaactagcgaaaggataaccccttaagagttaatagtttcccatatcagggtactaaattttacattaaaaagtgatacctcccggtatttctcgttgactgcaataccatttttgttcattctggattcaaaatcatataattttagattcccctatttagcttactagtcatataaactggtaacagaacatatataatcactctgtcaatggtggaaaaataaagaaagacaggtatatacagaacaatgcttaaacagagtcaatttttcttcttgataatcagttcgtggcaccagaccagaacctgcctgcaaaactttccccaaggcaatgggagctatctagtgggtgcttagttcagctatcagggttgaatggaatccttctgcgtttcatgtaattttcgcacgctttcttgagcggatcgcacgagtgcgcttttgccaactccatgatgccgctcgcggtgtcgtcgccgatgaagcggcacaggttgctcgcgcacatcagcttcagcctctccatggcgtacatgtcggcggcctcgaacacctcccgcgccatggcagccgcgttccggcccttgttcgcctccggcggcaggctgtcgtggtagacgtagtggagcacggcgccgaacgcctccgggctcatctcccggaggcggatcgccggcgagctcgcctcgttcccgacctggccgtagaggagcttccggaagtagagcgactggccggcgagcgcgaggcggtgcgccccgaacgtcgcgtcgccgacgtggatctccaggtcgaacggggcgtcgccgctgaggaggaactccatggcgttcctggcgtggcacgacggcggcacgggcacgcggacggggccgccggcgccggtgacgacgggccggccggcgccgcggcggcgctggatgacgtgcatggtgcagcgcaccgtcagcgcgtcgtcgtggatggcgcccagggcggcgccctccagctgctcccgggcgatgtacttgcggatgccccacgagttgttgcggttgtcgaacctgcacgggcgatcgatccgcacgtcgtggagtacggcgccgccgccgccgccgccgccgagcagcgcgaaggagaactcgacgtggtacacggagccgcacgatggccggtagagggactggaggaagaaggcgacgtggtcggacgtgtcgctgttgtagccgtcggggtagaagcggacgaaccactcgcggccggcgacggtgaagttccgggagaggacggaattgccgacgcccttgcccttgacgccgctgtactgccggatcgtgaactggtgcacgccggtcaccctcggcacctcgttcaccgagcccgacacggcgtcgtcgtgctcgtagccgtcgtcgtcgatcaccgagaagcagcaacccatctcgccgctggtatagtcgcgttaattagggttttagccgcccctggccggtcgtcgatcgtttcgatatcggtaagggaaaaatagcctgatggagatcgtaaaggtgcattacatgcatgcagaaacggaaaagcggaaacgtcgccaagacatagtagtaagatatatatattcctagtataaatacggatcagatttcatatagagaaattaattaacgggctccttttctttctctgcataggctctgtcacgttcattgcccacgtcgcgcacaacctttgtcacgttgacgtaatacgtagtatatatattttttttgttattactccatccatttcaaattgatctacatatagtatttttgaggttatttttaaatgatttacatatttgaatttatttattaagtctattcgttatttgtgcattgaaataaatggacattgatgcatctatccatgcacacaagtatttataacccacatgcaatatcttgatttgcaattggctagaaaatagtggggatggtgtatacattgagtttgttgctagagtaaatatggtatgagagagttattagtttttttggtcttggtgtatctatgaaatatgtagatcaatttgaaatggagggagtactgcgcacaacgtacatgaggtgaggcatgaaaacgagtcggctcggcaccgtgaaccgctttgtatcgcatcatcagattaattggtgtacgtcttgacatcgacaaggtttctatcagcctaccaggaaaacgaacttagctttgtgaacagtgcgaaggctgatgtgagaagctagttcagtgttcgtgcgcgaagccgcgaaccccgtgtgaccgtgtccggtgtccccctgcacgcggctgtccacacgtacgattgatggcgccgacagcgagagctccaccagattaccggccagagagacaccggctgatgatatgagcaacacggcagcctcatcgtccggtgcgtgtcacctcggcgtacgtgatcggagccgacggtgtacgtaataacgacgtccgccatcggcgacccacgcgttggtgcatgcgtcgccacagcgaaatcggcggcgttgattttcggccggagttggaggatcatcacgacccaagctaggggggtggcgcgcgcggtacgacgtacgtgtcggccggccggctcgtttaattcgaggcggtgcttggctgcatacgtctccttttcgccttgaagcgttacggcgcaacagggtgtccggcatattgaccctgacaaacaagtatacggcgctgcatgccgccccttctcacggccttctgcgtcgtcgagtttgtcgtgccgtgtcacctattccttccgtataaaaaaaataaaaaaaaaccttgaatttacgtttctgtccgtcttatatgaattttttttataattagtattttcattgttgttagatgataaaacataattattattttatgcgtgatttgtctttttattttttttcatatttttttcaaataagacggacggtcaaacgttagatatagaaacccagggtttgtcttttttgggacagagggagtacgggtgggacgctgaagcatctaggcccccggtgttaattttggtaattaatgacaagcgctaattgtggactaaccgttgtctttgagctatacattttaagttaggtccacgtcgaatgtgcgcatggatgattatcgatggattaaaattgacgtcgcaaagcaaagggaaagaagacggtaaaactagcgctttaatttagaattgatcgaggtgtagggcgatcaaatttgctagtttatttttagtttcgccgtactattaagaggggtaatgacctagcaaagagataattttaattgccacattaggtcattatgcatttagacttgtgctcacatttcacacacatacacacttcactgggttcgggctgaccaggggcggtcagaccggccacatagtaggggacttcacagggtagtggcggtctgaccggcgtgccctggccggtctgaccggccgcaagaaggcggtctgaccgacgcgtaaggctggtctgaccggcggcacatgcgcggtcagaccggccccctggaggccgggatggtgctgctcgggatggccgatacagagccgacggagccgtattcggtcagaccgagccgatggcggtctgaccgagccgaggccggtctgaccggctaccccatgtcggtctgaccggccaggccgatggggccctttgacagggctacaacggctagttttctagccgttgcagagtagcacggtctgaccggccacatacctccggtcagaccggcagagcacagagttaggggatttcgcccccaacggctagttttggtgggtgggagtataaatactcccccaccagcagcaagggggctctcttggcacccaattcaattgcatacaccccatgcacctttctcacactcacttgagctttgtgttcatccatctagtgtgttagaggattgtttagccaagagtcaagtgcatttgcttccattgtagagctagtgtggcacttgatcatctccacgccgggtcattgcttgttactcttggaggttgccgcctcctagacggcttgtggaggagttgcccgatgacctctccgagaagattgtggaggaggcccggcgccggtttgtgagtgggttggagttcaccaccttcggagtgaaggaagaactaccccgagtgatcgaggcttgggtagtcctctccgtgggccggctcccgccttgcccaccccttgacgaagggggcgtgcggtggcttcgtggttgagcggtggagttgggctcgtctcaacggggagtaggaaaccggcgagtttccgaacctcggtgaaaaatctcttgtctccttgtcttatttgattgtcgcatttacatttgtgcaatttacttttctagagacatacttgagatcatatcatcctaggattgcaaaactttgacataggagtgtgatttactttccttgagatataattgaaccactatcaccctaggtttacaaaacataacttagttgcttagttagagttcacccttaccaagcctagcaatttaggttagttttgattaggtgttatttagttttaaatcgcctattcacccccctctagtcgatatctcgatcctacagacgcgtgccaagaaacattcaaacaagtctgtgaatacagttcagtattacatttacacagcagttagcagtattgctatctaggaattttgctcatcctagatagcaatattctaggatgaaggtaggagtagcacgtagcagagatgagagttgagaccatcacttcgaatccaccgagacggccagtctgaatgtttgctagagagagtatttcatttcagtttgcattactgtttgtatatctatattcaaaaggattttgtatatattacgtactaattctccgctacttctatattcaaaaggattttgtatatattacgtactaattctccgctacttctatattcaaaaggattttacacatgctatttttccaaataatacttattgcactgttctttgatctgttatagattttggatttgcgacatgttctatttactcaacccaaaacccatgagcattatcaattattttgacaaggttgacaaaggcttcaaccaaaagagcttacgtagtactccatcatctgctctttttcctaaccagatacagatgatgatcgaaaataccccatcattgagtacaccattgttgaatttctgagcgtgagcctccgcaactcgatgtcgaagttaaacaatacggtacgctagtcactagtacggggcggcaggggataaatgaactagcggacatgcacgcaacgcacgaatccagtggcgccaccacacggggaggacggtgatccatcatcgatgttctcgaaggatcccgcagaaaaccacgacgagccatgttagctcacttaaaaaaaaaaaagcccctcaccccctcgacctcgcgcttttcgcatagccacgccacggcacggcatctcagggcccgtatacatcgctggcaaaaattttcaccaaatcacatcaaatatttaataaaatattagtaaatatataaaaaaataactaattacacatattgtgtctaaattatgagatgaatcttttaaacctaattattctatgatttggtaatatggtgcttaaatattattaatgacagattaattatacttaataaattcgtcttacagtttacatgtggaatttataatttattttgttattaatttatatttaatacttgtgtgcgtgtgtattcgatgtgacacgccaaaactttacatccatggatataaacactccctcaccctctatcgggtgcaaatacgcggaacaccaaggacctgggtgcaaaaacacccatcaccctcccccgacgaagcaagagaagcttccactagaaaatggcccaatcccgtcgcccccttcccctcctccgctcctcccaaacccaaatccgccaaatttgactcgcgcgaggggcccgattcgtggggcgcgcttccccctgctgctgctgctgctgctgctgggattcggacgagctggtcgcgttcgcgttcgtgtgatctaggggggggatatggggtacttgagctccgtgatccccacggatggatcgccggtcagcggcggcggcctcaggtgggagcgattgattctcgggacgcctctcctgtcctctttttgcgcttttttttttgggtctgattcgtgtttgctttacccgaattctgggttttttttttggagtactccatctagtcaattcgattgtctagcttagctctggcgactagcagtttttgttttagataatggataatctggcaactagtagataatggctgaatgtttagttctaatcaattcagtacggtccaggcgtgtgatacgttgcttgctgcatcgcacgaatttcgtataactgctcgcgtgggtttcctttgctttgaacacgctgtttaagctcaaaagcaaggctggagtatgggataagctatgcaatcccatttttgtttgttttattagtactttttggtgggactataaacaagataaatccagtttggagttatgttgtccgtttaagtaggatattcatatgctacatacctgatctgagcataagcagttgcgtcgaataaatttggacggttattctgaatacagactaaaatgaacttatgtgatgttacgttggagaattattaagtgtagcacgtcctaatgggcatgatagcaaaaggtaagaggccaccttagatgtgcttatacattctatgggttgagatcaaggaaactaatgagtaatgcacggtttgggcatttggtactgttagttgcaagctggaagttcgtctccctcatttctcaaatgcattttctatgaatatgacatcttgcatcatgccatgttagttctttcagtaacagcatatacaataggtcatgttgttgtagctcaccacacaacacaaccggttctagctttttgaaccagtgaactgtaataattgtagtgcctgcaatctggctgcgtctggaagtttaggagtagtgactttatgaataatattctatttccaattaatcaacgttgtcatggtagcttgattttatggtgtaaatgcagttattaggactgttgctctcctatttgctcaacatttctcattctttttttgccagccagaatggtaagtttagctatgggtatgcgagctcccctggtaaaagggcttccatggaagacttttacgagacaagaattgactctgttgatgggcagattattggtctttttggagtttttgatggtatgtatgaatttgtcacattcgtgcataatctctacccattgataattctttatcattttagaaaggaacatttctaagattacactcttccaagttttagacctttctcttttgtaccaaaagaacataccatttatgtttcctttgctaatcttgtatagtataaaaaagctcaaaataattcatttgccttgtaacatttcttatttccgcagttagagctagtatgacggtgagaagtccatggagaaagttttaaagattactcatactagggcacaatgctttaaattgaactagaagtgtggatataccaagctcttgagcttattttaggaaaaataaatgctaaacatacagttcattttataggtcatggtggtgctaaagtagctgagtatgttaaacagaatctcttcagtcatcttctaaggcatccaaagttcatcagtgacaccaaagtggcaataggtattggtttgttctctttccataattcactagatgttgagttttgtgtatagaattgacagaactaccacgtgatattgtttgctgtagatgatgcttataaaagtaccgacagtgaattcttagaatctgacagcagtcaaaaccagtgtggatcaactgcatcaaccgctgtccttgttggtgaccgtctctttgttgcaaacgttggagactctagggctatcatatgcagggggggaaatggtaattgacagttcactgtaccatctcttcagcttcctggttgcatttacttgatactttctgactttatatagcatgacacattattttttttcttttttatggtatgcttaaaaattcaagagagccgattatgtttggcatattctattattaatagagacctctcttaaggtacgaatatttttgcttgttttgttagaatgttgtatttaccactgagcatctgcattgtaccaggcatgagaatcaagatttgttggtgatgaaatgagtgccatgagaaataatctgtaggttatctgtgataatttatcagttcttcacatagaagctctgctggttttttgcagctatagctgtttcaaaagatcacaagcctgatcagacagatgagcgacaacgtatcgaagatgctggaggttttgtaatgtgggcaggtgctaagcactacattatcttattttgtatatgaatggactatgatcgtgttcctaatgatggtattttgttccttaggaacatggcgtgttggtggtgtgcttgctgtttctcgcgcttttggtgacaaactcttaaagcagtatgtagttgtggatcctgagattcgggtatgcaatcctgaccaatttaatgtttgttatgtctacttacctctcaaaatgcatatgtaggtatcaccatgacagtaggtgaacgtttggaatcatgattcccttgtgtcattggattgaatgtcaagagtgatattgatagtagttgccatcttaatcatgatatacttattgaggggatatttgtggcataaattttcgaaggaaaaattaaggatggctttctaccagcctgaacattttattgatcaaaatttgtaccaagttacatacatattgtgaagaggtacgggggatgagggcctgagtggaagctaaagggtcctatatattacaaagtgcgagaaatttgttcccccaatctagtatacattgccagctaaaactatttgtgctgcgatgggaccactggaggtcttccgcacagcgtcttgtcgtagttgctgaaaactttgttgttgaggcacttccagatattccatagcaaaactaatagggcggtatgataaacgaccagggacatattttgtcttcagcattgtttcatttttggcctttttgttatcaatgtcttacagctgcacttctgatctgttctactgccagcttcttagtcgacctgaagaaccatttcctaatatatgttgttaattttttaggcttcagaataatcatcctttatattcacctttcacaaatgatgaccttgttcagtaatgcttttgtgggtcataggaggaagttattgatcactctctcgagttcctcattcttgcaagtgatgggctgtgggatgtagtaaccaatgaggtaaattcaagaaaatgaaaagagaagatttttatgtatcttaatcgtattccttgtgcttgatgtagcccccttttgcatttgctcttatgcaggaggctgtcgacatgaccagatcgattcatgacccagaagaagctgcaaagaagctcttgcaagaggcctacaagagggagagcagtgacaacataacttgtgttgtcgtgcgcttcttgcatgggcaagggagtagtggatatgcttaaaaaacaactggtaaaagttacccaatgtagttgtgtaccaccatgtatacatgttttaattcaaatctcacggggttaaatggagagaaactcggagtaggatacgtgtattctgatggctgaagtaagctgaagggtgagtatgccttaggttaacaataagtttgctggtgaccgatcaccatagttcgttgcttttgaccctggatttgatggtcgtgttgtattgctacgggagactggatcgtttccctaggttcaatgtacgtggatattactcctctatttatttgtttgtatcctccacttccggtgagctaagtttgactttgtagccattcttgttattactgtagacatcagtgagacagtgacagcattatgtatctctgcagtttggtgggttggaagagaagtagagaatccatgctgttctacatggccgaaccagattcagattgcagagtttatggcagagcaaccacatctcaaactgcatgttttttatgtgtgatgctggacgccctggagctctccatcctgaccggccgtccggcggtgagaatcgagatccgacgagaattgcggcgtgtcgtgcccgtgtcgagggcagggaagccggcaccacacaagatatcatcgaagacagatcggagcgtttgattaatcatcaaagacagattggagatggtggcaaagggtttaacagttttggaatgttaataatcatttctagatgattagagttccttcaagtatgttagagggcaaatacagccaccgttatcattgaaggaaaggcgccctgcgccttgtgacctgaacttttcgcagcctaagaagaggcccttctcagggacatgttcagtacatccatttttggcatgccaatgccccatcgatgatttcttttgaccggtgatctacacaggcgctttcacaaacacaatcctcaaaatccaacactttgccagttgttactaacaagcaacgccgttcctgcccatgtgatcaccagcagaaaccatttgggccccgacggccatatcttctgtaatatacaatgactagttagaataatagctgaagagaagtagctgaaacaaatttgaaagactgacaaattttcaatcaaaacatactgagtcacatccaaaatttctcaatgtttgggcagaatttgaagttccaggtttcactctttctaattattgggttgtgtataaaaaaaccaaatatactaatgtggctaatactcatcacccttcaaagatactatttaacagtgcaagtagagtctgccagtaacttaccactttcactatctgatgcatcgtcaagtctggctatagcatcgagtaatgactgctcctggtcctacaaggacaccatttgacctcacaactctagacgaaggatatctataaggagcttttctccatcatacataattctgtagaaaattgcataacaacagacaagccaactcacttgcaaaagtttcttggccttttcgatctcacccatatttggattggacaaaaccctctccacctgggttggaacatacaatagtgaggtaaaaaaccaatatctgaatgcataatatctgatctcatgagataatttacctctatgacaacacttcgagtgttaggtacatcaatgtgaccaatattcctgttaattccattttggggaggagcactatccttagtaggctcatttcgagaaaaccttcctcctcccctacttgccattgccattgtaccgttgttgcctgggtgcctcctcatcccaggatgaggaccccaaccatctcgatttgagatgccttgatcatcaaggtcccatattatatcttcaggtgccaactgagaaatgatttatcatcttcttttgattaaatgttaaacaaacagtggcaattagccaggacgattcaacaattttcatgttctagctaaaaacaagtaaaacttaataaatttataacagatgacatgctattcaacaaactctatactctaataactaactaaattttagtactcctaccggttacactacagttcagcttcagaaacctagataaccaaaggttctaaaatttaggaaaaaaatacattttgacttctaaaactgtcccacctgacaaaacattaaaacccactatacttgaaaaaaataacgtatctaaacatctcctcaaggcggccctgacggtggtcttgccaccaaggcaaataatgtggcccatcacatggtaatgactccgcgaacaaaaaatacaaactcatcgcaaaatgggtgtaaggtgtcataaaaaccctcttttacatccagttccatgactactcaggcactagccatgctgctcaattccaaagtcctatctagtttttactctcccaaatcttatctagcttctacttaacccccatgaccctcaatttgttgaataattgccgcatcatcagctgcagtggtaagatactaagatcatattccaagttgctccaggggagttacttagaaggtatcacatagttttggtaggccatctaaactattgtaatttcctgcagaactactatcaacgtaattatgacaataaatctgcagcaacagaaaaatgtttcctgtttaatttctatgttattgggcacgcgagcagacagtcactagtttgtcattgcaacaaatcaaatgtaacataaaaatatgaatatcccacggccacagatcaagaaagaaaaactttattatggattagtaaaaaaacatctacagatagaaacaaggcaatggttgaaaatactgcttacatcactaagtctgactgactcccaagtctgggctactgtgcccatgtcatagacgagagcatgtttaccctgaaaagtatcaggggtgtccataagcttcgcttacttgacaaaaatgcaaatctgcagcaagtagcaaaaataatagtgaaattaaacaacaaaccgtagcaggattatagtcagttatagtggcctcatagaagttattgtcatctggccatcttgtataaattttccggttaatcaatgaagttggatccgcggatggcacagcgagtggtgtattctgtaatgcataaaaaaagaactcatgatattactactatgggaatgcaacaaacatgacttgtcgtattcaaaacacaccgtcctagtcttcttgccctttgttcctgaaaatggtccccactttgtagatgaaggaactgagggagaaggcatcgcaggggactggaggccagcagaatgtgaaggaatagaaaggggtgtcctttgcctctttgcagctgggccaggttctgtatcatgaaaaattctgctgccacgatgctgtgcactcagggatccacctccctgtctaaactccctgcaaaatattgcgaaggataaataaattactaacgaaaaaataaaatggttggtttaaacatgtgcatgaacaaaaattgaatgattgtatgaagacctcattctgcggatggccacatcttcattaactttgtttaatagttccctgtgttcatcatcagagactcttaattctttcctgagttcagtgatcaaactttctttttcctggacaaaaaatatacattttttattctcaacacaaaaaaggcatgtgcaaagaatggctactaaaactgttagcacaagattcttttttttatacatacatacccaggatatagcatcagattgcactttaaatgctctaagaacaccagtgtacgcctcttgctcaacctgatgtatttcactctccaaatcaccgtgcggcctaatgtaagaaaatggcataacagatgccctgccattcgcactaaaagatcgcactcttaatcctctattttgtgttggagggagatcgtcgtcagtccctgaaattttgatagaatgaacagacaagtcactataccatgaaattcactatatgagaaaaaagacataaatattttgtgaactacagggttcaataactgcccacaacaattgggcttcacaatttggcaagataagccagaatctagagctggccgacgtcatgtcatcagtctgcaccaagggtttggcagcaggatctttctctagttgatcaggaacgcataaacagaaacagtggtttccttaaaacttcacataatatcagaaagataaaaaaaaaaaaggtccatctttattagaacacagtaagcagatccacttcagaagcaactattgccaacctcgtctcaaaggctttcatccatagtggcagagtcttaggccatggttcataaaatgcatagtaaaactatgaaataaatgtctttcactgcattgaccgcctcaattacaaattcataataaccaataacctgccaacaaaacattttttttcttacaatacctacgcacctaatcaaccgatattactgaagcaataattttgaaggaaaaaaaaagacacatgttatcgaaacgaggcagggacgcagcagacaaccaatctgacggaaacaaaaaaaaaacatacaaactacaaatcctggagagggcttaaccgcgcgcgcccaaacctaccagcacaaaaatcctcctaacccgacgcaactcaccgctggaatcgtaggggttattgtaccccatggccttcatgaacacccgccgggacgcgcgacggtgtggaaccctagaaaacccgccgcggcgcgattcctccggatccgggcaccgcggcaacgccccccgctcgaatccggagatgcagcggccggatcgagcaccgcctcgaccgattcgggaggtttagggcttggaatcggatggggatttggggggcgatgggaatcgctcgtgtcggggagaggagaggaggagaggacgactaggtttagccacgcgctgctctgctcggctcagctcggctcggctcgggctcgagccggaccccgctcggctcccacgcgtgcaacgtcggctcgagcttaggtccgggccgagcgagggatgcggcggaagctgtgtcagcctgggatgcgaaacccaaagcccagattagctgccggcccagccgcgtccaactccacattggactcgagttcggcccataattagtactaccatctttagaagtaggcttttgtcggtccatgtccatccagactaatctcaggtctggcaagtgaattactctctagttttaatgcttgaacgccgttaacttctcgttcgttttatttaaaaaaagagagtataatatatgggcgggccctaaacttatagacatatgtcatctaggtccccaaactcagaagacacatttttgggtccctaaactcgcttagccgtacattacctgtccaaatagtatttgacctagtcgctcgccgacatggactgccagcgtggaggggcagggacagctagggtgtgaaatatgaaaaaaaaaatctattccctcatcatttcattcgccaaatatcattttcagtacatttcagataattgcacattttcaactagcctgaaggtagtacacatcttggtcaccacaacaaatacacaacaagctactacacatttcagtcctaacaagttgctctgcagcatgttcatgtccctatgaagtctgaacccagctcaaccaattcatttctctgcacatgcacaacaggagctggacattttgcatggataccagaagctgcaagagccaagatgtcctgtatttgtcaaatactccttatattgatcctcccaataccaaaactcacatccatttccatctcaatgaaaaaacttgcacatgtaaactcaaaatgcttgcaagacaccaatgctctacaacaggagagaagaaataacctgatgtaaaagatgatgcctttattctcagctgtattaagagcaattaatcaacgggattccatgtaaccacaccagccatttgcgcagtagttgtaggacatgtagttgcgctcgggctaggcgacagtgccgagcttggcgtcgtcgagctcctggtggatccgacgaccagggtttcccaaaccgccgggcccggggttaccgcgccccggcggtaagcatggttaccgcggtaatcgtgaaaaaccatacgaaactatgtaaaatttatcaaaaatttaaattattttttaatttatttgaatttaaggaggttaccgtggtatttttattaccgtacccccacggtaaggccggtaaccgctgtaaccgcgcggttaccagcggtattgtaaaccttgccgatgacggccacacaccgacggagttgttgttggtgctgtagccatggtagaacatgacgaatcgcacgcagctctagttgatcttgacgtcgtcacagcgtcactagggaatcaaagaaggggatagtgaatcgaccaagagcttgctagggatttcgttgctcagcatggtggggaaaaaatggggacaggggattcgatatgatttctaggatgagggaataggggggttctttgcatatttgacaccctagctgtccccgcccctccacgctggcagtccacgtcggcgagtagactggctcaaatgcaatttggacaggtgatgtacggctaagcgagtttagagacccaaaactgtattttctaagtttggggacctagatgacatagccttacaagtttaggggccgcccatacattttactccttcaaaaatctcgtgcttttttgttttactatgatttttattattaaacatattcttactatgaattatatttttacaataaaattaaataagacaaatggtccaatgtatatccaagacacctaaaatcaagtgtgtcaaacattaaaaaccggagatgttatacccagttttgcaccaattttgatagatgaggtggtataactggttttgcagttaagggggacgatttgatcaggggcaagagatgagggaggtaaaatagacttgttccattttttttattggcttcattatttagcaggccggtccaattcattcacccgtgctgaatcgggctctttttttctttttaccaggccgcctgttcagcccatgcttgtacacattcagggatgtatcagcaggcacctcagcttgacctcaaaagaaagaaattttggttcttttgattttttttattggcattaacaaatatcgctataatgttagacagatatattactagtttataaaatacatgaagtaagtcggaaactaaacatctctccttcaaagagggtgtgagagggatcaagagtatcctaattatcgcaattaggaatggatccaattctgttgagtctgactcattgtggtcatttctcttttaacaaaccttagttataaaaggattgaacttggatccatttatggatccaattctatttagtctgactcattgtggtcatttctctttaacgaaccttggttataaaaggcttgaacaatcgggatccaattacttattacttatgatacctagttgatattaatagctcgagatttacgtcttggtcaagcgtgtgtgtgtgtgtgtgtgtgtgtgtgtgtgtatatatatatatatatatcgatcgatcctgactccatgagcgtaagaatatgctataatttttaacgatgatatataatcatatagacacttttttttatttgatagtacaatagtataatccggttacagcttagatagatatcctgcatgcaggtttattcagtatacaatacatttattctggtggaacactcttaatttgtgccattttattctagcttcacgcatggccagcgcctactcacgcagcaccaccatcggggcgccggtgtagaacgggtacacctccgacctgaggaggcacctcggcccggcgatcctggcgccgtcgacgttcgccgggaacgtgtcccaccacctggcgacgaggccctcgaggcagccgcggcacgcctccagcgtgatgtcgaacgcgcactgcgccgtcgcgtacaggttggggaaccccgggtcggcgcccacccgctgccccgtcgcgaacagcttcctcgcgatgtcccccgccgcgtactccgcggtggccgccagcagccgcgtcaccgcgcggtcgtaggcggcgacgtcggcgccgctgctgatgttggtgctgctcatgagggtcgtcagctgccccggccccaccttgtcggcgaggaagtcgtccttgtcggagaggcgggcgtagcactcgttgtagacgagggcgacgtccttggcgcggcggcacgcgctcccggcgtccctccacacgctggtgccgcagtcgtagcaggcggcgcgggagatgtcgccgcggcagaggaggaggccgtagacggtgttcggggcggcgccgttggagcccgtggagaagaggatctcctgggaggaggcgccgtcgcggagggtgagggccaggttcaggaggttgttctcgtaggcgctcccctgctcgtacgtgccgtcgccgcaggtagcccacggctggccggcggcgagcgggacgaccgccaccgccgccgccacgaggagaacgagcaaagtgcaccgcgccattgcaatggcagtgatcgttaagctataggttgatggattagcgatcgatgtgtgtgcagcaaagcgtcgagcattgcatgcatatttataggtacggtaacgtactaaggtagttttggacgacacgcatcgccaacctatcgttttggatgaggctctaatttgtcgagatagctagctagttggcaatttggcgtgtgctatttgccgataactaaacacacagttccacaaaacaagctgaattggcgccgattttatgtacgggtttaactgtttaagaaaccggtcaaaaccgttggttctgatttcaacatcgatccagccaatgagagaaccacgcacggcagctgcgctgatctttgatagcactagttcaatgttgcctagtcggattaattcgctggtttcagacgaactatagaggaacagcattgactgttaggtacattcgtcgcactcgcacaggcgcacattcagtggatatttcgttactctactttaattaatttgtagtcaccaaactgaacaccgtctccgatgtactagaacaaaaggatatacttaattactctacttaatctactttttttgtttgaatcatgggctgcgtgcctgcgttctatggtctgtgcaaaggtttaacgggcactttaacaagggctatgtttctatggtctatgcaaaggttaaccgtgagagcccatttttactcaatcggaaccaggtcttctgatgaagaggatttctacatcaaaggggatatctgtgccggatcgttgtttacccagcattcaacgacagcatcaattcatagtttcctaccctctcctccgtcgtaatttggcccagaatcctgcggcaaaacgacggggtttcttgtagcggcgtacgtttccccctggttggctctgagctaggccgaacgactgaagagaagctaggaaccagtgctgccattggatgcggaatgaacggtgatcctacacggatatccttctaacatatagatatcctctatatactaaatgatctggttttactaagtggtctaaagtagagatggcaacgaactggattgtctcggtggaataggaatacgtcttaacaagcttaccgggtctaaaatggaacaaatatacctatgcctgctcgtcaagtacctaaccgaaagtccgaaacccagtcagtacttgtggatattttgcaaaacgtgacataatatatcaaattgatagttaaaaaccatcaacaaattcagagtttagaccatcttgcaagcatcagcattcaacagctagcacaagcaatgaacatgtcggggtcaggtgatcctgacaattttgacgaaatctgattgcttgtacatagaggataacgcaatggtttaagtaataagtatggtcaatatataatgacaccgtatctcaattttctatacaagccatcgcttgtgattaatattatacgtgtgttttgtttttattgtttcttgactggcccccctctcctatcatgcataatcctgctccgccgttgaggaagggaactgtacagtgtactgttccggaaactggatagctttccctacgttcaatgcactacgtggacatcattacttatccattcactctgtttcagcttataagaactactttaaatttaactaaaactaagtttgttgaaaaaaaataatactctctctgtcccaaaatataagaacttatgattacattaaatatttactagtattacaaatctggacaggcagcatgtccagatttatagaactagaaaatgtcacgtcccatactaggtttttatattatgggacaaagggagtaacatttttaagtcaagataaatttattgtgaaaatatattcaattatttattgatgaaactaatttagtattataaatattacttgtctataaatttagttaaaattttaaaaaattaactttgaccaaagttaaaacgtctgaaacggagggagttctcagtatggtcggtattagtatcttgccccaccacttccattgagcaacttgactttgcagccattgttactgtagataccagtgagacagtgattgcgttgtgtcctgtgtaagggtctgattttgtttatctattctaatcttgtcactgtagagtagacaactactccctctataataaaaacattggtaaactatgtcgagatttaaattcaaaaatagttttttatggaggatgtagacattagtaagactgattttttcattttttgtaaggttggaagagaagccatggcatattttttttgtctatgcatcttgctcactaaataattattaccgaaaattatagaaaaaatacatatacatataataaaattgaagatgagccaggacaaaaaatagtatcggattatcttattcagttggaccacactttaacgaaaaatttcgggctgctcatcgttataagctggtctccctctcaggttgaattggcgaggtgggattattttttgctacagtacatcgctgctgctctgctctctctgctctgcttgctgcgctgctgcttgcatgctactgtgggctgccttttgctgctgggccagctagctactgggctgcatgggctggcctgctagctagctttgctctttttccttcttctcttctcttctttttctttttcttttttctctaattatttgcagggcgttacaagatcttataaatagataatagtactaaaagtgcatgtacagtttatttattttttttaaatctttggtgatatttattactagttgatatgtatagtgtgtgcacacggacacgttcccagatccagaaacggtttggggcaaaaagtatagaaaaaatgtacttgttcgtatgtataagcagatgctggaaattggagcatttttgagacaaggcccatgaaaatatttgggcataatagcatcttatataatgtttttgagagaaataatctcaagcatacaacaacgtcgtcagctcataccgggccttggcagaatacacgagttccttcagaatcctttttttttttaaagaacctagcgagctggttttatattatagaagaagtaagaaaacaaaaatgtataaaagggactattcctgtctacacgctttagaaaaatagaagcctactctcttaacataatacattgcactcccttggcgcctgccatttcccacaaatgaagctcatctatgatcttgctagcaagtgccggcggcgtagactcagtgcctctaaaaatgcaattgtttctttctatccaaatctcccaaagcgtggccaagaatactgaacgcagccttttctgttgcaacttttctgcctcatctgtttgctcgcgccaccaattgaggagagtatcgtctatggtcatattgaggaaacgtgacagcctgatcttgcgaccaatgtcccgccatacctgctgcgtgaaggggcactccatgaagaggtgccgtactatttcaagatttctgaacacagagttggcaaaagtaattatttggccagcccctgcattgcaatcaatccgtcgtccatattctattttttgccagcaaccacacgaagaatttgtgtttacccggtgcccaagtcttccatacaagctcggctgattccgaaaatcgttttgcccatgaactgcatggcatatgctgatttcgccgtatacatgccgctggctgaccaccgccggaggattgtgtcatcagccccttcatggatcacatctcctgcattgtggagcacttcccatacacatatatattcctgaagcaactgtattgtcaccttccgcggatatcttcgatccaagcattattggttattgcctcaagagtcgatttgttcttccttttggagtgcttgaaaaggtttggggctagatatttcaacggctgatctcctatccagttggattcccaaaattttgcctttcgtccatctccaactgttaccttgatggcggccacgaacagtgcacaatcggtgagggcggcggggttcctatccaagatttttccgggcttgtccactcgtaccagagccaagagccaacatagcctcagcgatcgtgaaaatttctcgaagcaacgtagttccttcaaaatctgtttccatgcacatcacaacgtacggatcacgatcattactccagaatctgaattctgaaatttccacaaaatggatgaactgatgaagggaagtccagcctcgatccaagattcaatcacaatgtgccacatcggtttgttaagatggtcgtaaacagttgctggtcagaattcttgcttttccttttacaactttttttttggaacaattctgaagaatccttgtcccctgaaggcagaatccttgccttgccttgccaaatggtttagtcgatgacttgaggtccttctaactgttcattctgattctgaacagtctacagattaaggtgaccataagttttagatattattccaaggcatatcaaggaggcccaacctggaggatgtagaggccgttggtttttaatccataactgaaaaaaggactacctattgatacttcgacaaatttatgtcttcaaatcttacagaattttcaactaatggatatagctagttttaaataaaataacaaaaaagagagacaaatatgtcaaaaatcataaatttagagaaaagaactattgtaaaaatctagttttggtgaattgtaacaggatgcaagtgctatgtaactgagtataagtgcactgtaaatgagtataactacaagttagatatacaagaacacaaatcttaatataaagatcctatgaacgaaaaagtaaaagatagaaatataaaaatctgtcgcaagtgaaatactagcaaaaccgaaaaaaaaaatcaaggagccccaacagaatcctcactaaaaacaaaacgagacaaaggacggagaaacactgtcgggagaaaaactcggaagacagcactgaatgtctgaatttttggacttcttttatctaaccatcagataaaacaggcaactaaaacgaaacagcacaaatttaagagcatggaggactcagtgcacagtacgattgtgatcatcaagggcatgcatatgagcaaatgccatgtttaggttcggcgagcgagccttcgttgtttccatcactgtcctccatggccgtgctcacaaatagcgccaacttaaatcagcaaattaacgaaccactgaaactctgaaaacatacgaagaaaagaagaaaattctacttacaagccagaaattaaactcagactcaaaacatgaaaaaaaaacacaaaattaaacctagcacataagagaggagaggataatgatgaatagatggtaattaagcaggatgggtgatttattactccctgcttaatgaacagagcttagccttcttatatatagcactggtatcagcaggaaacagcaaaagggagagaagggttttaatttcttggcgcctacggatttgcgttaggtgagctaatcgtgttggacttttggtacaaagataagagtttaaaatcagagcatgcagaacacgaactattccatcacctaacctaacagtatgattgctaaagctcaaagtcgatatcatacagtattccctcttgctactaagtgatttctgccaattggttctgaaagatcaaattgccgttgttgtgttaacatcatccatcatgttgagactaattttcttagtattagttgccttttggaatagggtaattttatcatcttaaaaaaaatgccgggagatactacacatagtgtaaattttggtacctcgaagtattttttttggtgtaaaaattagataccttgaagtattttttttttcaaattgctattgttgtgttaacatcatccatcatgtactccctccgtccaaaaaaaaaagacaaaccctgggtttccgtgttcaacgtttgaccgttcgtcttatatgatttttttataattagtattttcattgttgttagatgataaaacatgattaatactttatgcgtgacttgtctttttaatttttttataattttttcaaataagacggacgatcaaatgttgtacacggaaacccagggtttgtcttttttttggaacggagggagtaaaatttaagagcaattttaccatccaacatttggtatcttgagatactctctggtgtaaaatttggtacctcgaggtatcaaaattttgtgtgtaaaatctggtaccttgaggcatcaaaaaattttgtgtgtaaaatttggtacctcaaggtatcaaatgttatatggtaaaattgatcataaaatttcactttggaatatgttcaattcatttccaagaatgcagttggcgtaaagtacaaaggcaggttcttcggaagaaaagcgtaatttgcttgagtca

SEQ ID NO: 60067 - DNA, 17889 bp, Oryza sativa
tcgtcctcgtcacgagtcgggccacttccttgccgccacctccccgatgacgacccagactccggcttcgcgcccgacgacccggacctcctctgcaactgccccgtccccgaccgcctcctcgtcgtctccgcgggcgtagccgccaacctcctcttcgccttcctcatcgtctacgccctcgctcgcccgccgccgccgctctcgtctccagcgtcctcggccgcagatggggaagggggagagaaaggggagagagagagaggaagggaggaggaagaaggattggagagagaggatgacatttgggccccatatgtcagtgggtcctacaatatattttttgtgtgaatgacagatgggtcccataattttttttaattctaatgccacttaagcgccatgtgggacgaagaccgggtcaacaccgccacgttagcgccacgtcagcaaaaccgccctccaataccgctgagggagtcaaattgcaccggttcaatagttcggggagtcgttctatccggttttctggttgagaggtacgaattaaattcggcatacaattaagggagtcaaagtggactttttcctatcacgtattcacgtgtgaaatctaaaggggacctgctctatacttttattttttaaaaaaaatatttagaaaaaaaaacttatgataaatcaacgttgtcatgagcttgtgacgtttgttggttggcctcttacgacaaaataacactcgtcacaataatattgccactagactaggttacgacgatttgtagttcgtctcattgatgaaccccttatttttgtcgctaagttacactatcccatagagagcgaaataaaactgaatgacataattataaatagcttcgatgtcaggaaaaattcttcgcaaaaggtcatgtgtgttgtagtggacggattattgcagaataatcagtgcaaggatcagcattttggtccttttgaaaaacttatttcgtaaatagatccctagaaaaacttatcctaaaaatggtcctttttggggcgcccccctgccgacgttgcggggcgatgctgaggtggctagggggagtgcgccagagtggctgacgcccacccccctaaattttttatttttgttttatttgtttgatatttttttcacgcttagagacacacaagaaccaaacataaaaaaaattgaactcaaatggacgtaatatgtgacatgtagaatttttcctctcctctcctctctctctgaactagtgcagaggaaagagatgtgcaacttttttatttttattttatttttttgatatttttttcacacttaggaactcacatgaaccaatcatgtaaaaaataaactcaaacggacgaaatatgtggcatgtgcaattttccaaagctctaccgaaaaacttctctcctcgaaaacacaatcttacaagcggaatttggaggttttaatatcgccgaacctggcgaagcttgggagaatcggatgtaactttttctgtagatgtccatgcatatattatttgtctgattccgagtccgtatgagaaagttacgcctattttaatagatgacatattttgtccgtttcggtagagttttggaaaattctatatgtaacatattttgtccgtttgagtttattttttatacagttggttcctatgttctcctaagtgtgaaaaaaatatcaaaaaaatgaaataaaaataaaaaattgcatctctatgtactgtttaacttatatatgtcatttcatgtggttatagtggtagagtgcattatgtttaacatgctgatcaaagggttttactaaaagaattatggtctaattttagtgaaggtacaaagtagactaagtggtatgctagatattttcagacttagctaagtggtagttctagtttaaattttttttgtggttggttgtattgtgatcctgagtgtgaaaaaacatccgaaaaaataaaataaaaatgacaccgttgcaactccgcacagagaaacagggatgcagccgccggcgccagcacggctggcgccctcctcctgccacgtcggttcacgtgcgccacggtggcaggaggacggcgccagccgccgtcccgttggatgacggcgccagccactctggcgccccaaaaaggaccatttctggtataagtttttttagaggtctatttgtgaaataatttttttaaaaggaccaaaatgtgaaaaatccagctgcaatcgccatagagcaagtgaacgggagtcccgagaacccggatcgcatagtatacttgtatataaatagaagaagttttcttctaaacttttgtatcctgttattctaagcaataagaaacacaccaggttagccccaatttccagattgagtgtcattccacattttatttccctttgttctttgccattgcaggacaactacattcacccgcaaggtgttcgattgaggttctaggcaacaaaggaattccaaagtattgaaagtaaatgtgcaacatattaattataaactgaaatgtaaaaattcgaaaatgtacatttttctgatcgtttttacaggaatatttttatggattgtcttcccaccgtcaccgtgatattatgcataatttatctacttaatttataatcttgtaggtcctgtcatgccatatgatactacaggacagtgtacgtcgtcaatgcgtacaatcagacgggggcagagctaaaataaaatagagaagggtgacacttgcttaatttactctctttagattaagtttaacctgatgcgggtgtctaaatttgtattgagtgggatacacacataatgaaaataagtgagatatagcttaaaaaaaatttcttgaccgggttcctggtacccctccaatactctagtactcgatgctctccgccttcgacgtcgccatcagctcctgtttcgtcttgttgcctttaaaaaaaaagcgttgccagtaagggtgaaaacggtacggaaatttccgagaattccggctaccgtttccggtttgcgccgaccgtttcagtcggtatcggaaatggaaacggtaatcgcttttcggaaatggtagcggaaatgatatggggttttttccgaccgttttgtcggtaaccgttttttatcggtaatttccgtcaaatttccaacaaaattccgaagaagaaagccgactgggcctggctagcaggagcaggagcagcccattaggcattaagagactaaagcagtcgacatcgctgacgcgggtcgcagcctccttcgccccgatggcctccgtcgctgccggccctcttttcctcccccatcctccactgccggcctctgtgccgccgagccaagcgccaccgcgccaagcgccgagcgacgtcgtgccgagcaccgccgcaccgccccggcctcctcttccccaccggcaccgcccctttctcctctctctccttcccccaccgccgcgctgcgccaggccgccatctccggcgcctctctcctctcgggcgcgcgtgaaggagccgaaggcagagaagagaacgggtgagaaaacagagaagaaattgagagagcaggagaaggaaccgagagaagagaaggataagagagagagaaaagaaaagaaagagagaaaaacaaagacagtgggacccaccggcgggccccactatcttgactcttctccgtgacccccttacctggaaactaccaaaaagtctagtttagcatgaagcttaattacaatggtagttatatagtgtcaacaaaaaacttaattacaatggtagttaccacattgtatgctttagccatattgatgttgaaatatcgttgaactttttatattgtttgtcgaccttattgtcaacttattaatcatcgtataacggtgttgtgtggcagcgtgatgatgcaagggtgaaattataaggtcatcttcatacatagttaaatgtgggatgataccacagttcgttgtttccgacatgaatttttgacttccgaccgatatcggtagattcccgttccgacgattccgtttcagatataccgacattactgatatcgttactgtttccgagtagaccgttccgattccattttcgagaaaataaaatgaaaatggaaatggtatagggtttttccgaccgtttctgaccgttttcatcccttaccaagccacagatgttggtttcacctttccttctcgtgccactgtgaagtgattagggacaagcaatggagaagctgtagtcctgcctgatcatgcgtgttaaatgttgtcaacagcgcttgtcgaaacatgaattcggcaataataaaagggggtagcgcacgagacctaaaagtggatggatgcagagacaaggatttagacaggttcaggccccctcgttgagaggtaataccctacttctgtttggggatttgaatccgccatgtatattatagatctgacgatctagttgtctcatgccccctagagggcctcctgcccaccttatataggatgggggccatgattacaagatagaaaccttaaccaatacggtatcggtttcctaaatctactttacaatcttatcaaaccaggactttaggccgttccataatatagagggaaacataatacccaagtcatgatccgttacatatttcatagatataagttatcccctataaccagtcggataactatgccgtatgggtatggggtacccacaatcttcacagtagcccctgagaccttcacagtcgaaaagataatcttttctcgaactagattactccaaagataagtgcttcaatcatcttcgccatggtctcccgagtacttttaccaaatcagaagactgtggagggctgaaaaataattaaatgaaattttaggtgcatcgactagatgcacctaataggtgtagcccccgactatgtggttagttgagcaaactgaacatatagtcaaagagtaaataatccaaccaactgagtgattcttgataattatagtcaactaagtgacttgatagcatatacggtgtgaatccctaaataacatgatccaagtgatataccgactgctttgtagaatatgatgcgtgcaacctaaagttgactacatcattgaaaattcacatagcaaaatagttataaagaagcttgtatgttgtgaataaagaaatttccaaagtattgggcacacaccatgcgcacactgctttaacagatgtgcttaagtccctaaaagacacatggtttcaccacacatggaaatatatggcatatgtagtgtaacatccgagtaaataaactcataaaggatttaccaaccgcctggaaaatgaccaaaatatataatcagcctaagccataatattggtaaataaaaatgcacacttacgtgacaaaaagcaatgatattgtatccaatcaattgcttgataaacccaaacaacaccttgactatataaaaaagtcagcgggacagctatataaagctttactgttcgacaccttttaagatgcattgtaccaactcctaaaaagttgagtaactgtggtataaaaggattttaaggtattgggcacttgatcacgcgcactttgacctaagaaaaaagtgcctaagtccctaaaagaacgtgacaggtcacacctgaaaatatgggctgcagacatattaggcctaggccaaaaaatatgccttcgacaccctttaaaggatgacgcatgtaacatgctctcgagtaataaatcttccgggtgatatagaccaagtgtagctcatatgaatagcttctaatctgagtgattatcccttatgggatactccaaaatagatataataattgaatcccgactggcgcaagtattcggttgataacccttactgggaataataaatagtccagtctttgagcatagaaaatagacccatgatcatgaattcatgttgcatgtatccggaacaagtccaaattgaaggtataatacttgtgtttgagctagtaagcccctgatcatatagcttgtccttttgtcgtagttacaatggtccattgatagtagctgacgcagttggcatagagacaagacgaccaatatagagataatattgcccaccagaggtggcaaaaatattggtggtggtgaagatagtgataccaatcaaaagtgatgaagttgtacaaccgtggaggcgaagaaaccagtcgacagcagtcaggtcagccagcaatgaagatgaaggcgcccaacgataaagttgtgtagccatggcagcgaaataatcagtcggtaactgatgaggcagctggttaagaagatgaagatgcccattagtggcgacataataagccatccatgaaggcgaggataccggtcggtggcgatgaaagcaagccgacggtgaagatgtagacacgcatcaaaggcgatgacgaaatccaccaatcatgaggatgaagaaaatagtcggcgacgacaaacgcaaccgacagtaatgatgataagtagcaatcatagatgattgactatgatgacgaagttgcccatcaaacagcagtagaataggctatgttgaagaggcttgacaggatattgatgaagatgacgatgtcggtgatccagtcaatagcagtgtagcaactgatgataatgatgaagatgctcatcagcgtttgcatagtaggtcatccgtgaagatgaaataacaagtcggcgatgaaagtaggtgatgacagaagcaaccgaaggtgaatacgtagtcaccccttagcaacagcggagacgtcagggccgatgaagtagaggttctgttgatgatgtcagtgacaataatccttcaaattgttgagaagatgtcgaagctcgaatagtttccttgatgcaagcatgtgcataatgaagactgatgcaacgccccttgatttataaagatggcagtagaacttggtgctataactgttgcagatgctttacttagaggaaagtatatgctgttgttcaactcattgaatctgatctgagttgattgtttgatgactccaaactcccagacatgtaaatttaatcttgacctaccggtgtaataattggagtcgctgaagtaaaatgccagctctgaagcgcagacgaagataataactcccagagttgactcgttgattgattgattgcttcatcttgtcaaattttgagagtcttgtatttgtgtagcccccaactctttgattagttgggaaacaactgaacatagagtcgagaactgtagcttcttgtcgtcgagtagccatcacttgagtgaagatatgtattgaggatgtccggagagaaatcttgaatattggagcaccacttgttgtagtaaaataacacggcatcatatttggtgacgcataccgagatgtcgaagctcttgtagacgtcatggctagtgaagtagcaaaacttgcgaagtagcggcaatagagtttgccggtgccgaagacaatgaagatgaagtagctccaccatggtgacaaagttgcatagctgtgatgaagtgaacacgagtcggcggcgacagaaccagttggcgacggaagaagtagaataatgacgaaaacggagatgttctttaacggtggtaaaataggccagccatgaaggtgaagtcacaatgggcggcggtgaaagcaaaccggcgatgacgatgacgccagtcaatgacgatgaagacgcgcagccgtggaggcgaacaagccagtcggcgttagacaaggcgaccagcaatgaagatgaggacgtccatcagtagtggtagcggtataaatcaaccgtagaggcaagggcactagtcagtagcagacgagatgaccggcggtgaagacgataaggccaatcaacactggcagaatcatgtagccatggaagtaaagaaaccagtcggcagcagacgtagacagcttgcgttgaaggtgatgatgcctgtttgcggtggtggcgacgtggccaaccgtgaagacgatagcaccagttggcgtcatatgaggtggccagtcggagaagatgtagacgtcctacaatggcggcataataaaccaaccgtgcaggcgaagacaccagtcggcggcggcgaaggcgagccggcggtgaagacgtagacacccaacaacggcggcataataggccagccatgcaggcggagacaccagtcggcggcgacgaaggcaagccggtcggtgaagacgtagacgcccaacaaatggcggcataatagaccagccgtgcaggcggagacaccagtcagcggtggcgaaggcaagccggtcggtgaagacatagacgcccaacaaacggtggcataataggctagccgtgcaggtggagacaccagtcggcggcggcgaaggcaagccggtcggtgaagacgtagacgcccaacaaacggcggcataataggtcagccgtgcaggctgagacaccagtcggtggcgacgaaggcaagccggtcggtgaagacgtagacgcccaacaaacgacggcataataggccagtcgtgcaggtggagacaccagtcggcggcggcgaaggcaagccggtcggtgaagacgtagacgcccaacaaacggtggtgtgaccaaccaaccgtataggcgaaaacaccagtcgacggcggacgaggcagccagtcggtgaagaaaacggcgcccaacaacggcggtgtgaccacccaatcatataggcgaaaacaccagtcgacggcggacgaggcagccggtcagtgaagaaaacgacgcccaacaacggcggtgtgactacccaaccgtataggtgaggacaccagtcggcggcgacgacggcaagccggtggtgatgttctgactgatccattcctgtaacataggagataagcttaaagccatgaatccctttgatgcatatctggatctggatcctgcagaacaaatatataggatgagtagtatctgatgtaaatacagtacttgagaaagattcaagtattaaaagtgtttataaatatgtatttctcctctcgtcaattttgatttccccgagcagatgactcattacgtttaaacactctgcctgactagtcatagccaccaagcaccgggagtcggcctaggcacttcccaaacatgcatatgagtgacatgagttcgtcattaatggaacaaagtttcacgaatcaaaatttactactcgggtatttttgcaattgttaagagaagaaaataaataaatttatcttatctctatgcttttgatttattccgaatataatacttagcatcttgcgttactcggtccatccaacgagcccccgggtgctaggaatcggcccaaaggcaactatccatcgacaaaccaaacggaaagcataggaagatagaactccataactcgatagtcacttttgtactcagattatgtcgcaagcaatcaagataaatattatgaaaattgttgaaaaaatatgacatagcatctctagcccccgactcactagtcaatggcgaaccaattgatgtagtgagttagaggaaaagaaaaatatcatataaagaagaaaattaatgatgacttagctttgtaatattctccttggtgacggagagatgaccgatataggaacgaagtcatccgtcaatggcgatgaaataagccagtcatgaaggcaaagacatcaatcggcggcgacgaaggtgaccagtcggtgaagacgaagatgcccatcaacggtggtgtgatcaaccaaccgtataggcgagaacactagtcggcgacgacggaggcaagccagcggtaataacgaagacataggcccttccagactcaacgccatgttgtactgatccggtagtggtttataactcaagctcatgatgtcagaggagtgcttgaagggaaaaccggagcatgttttgatggagtccgagataatatctcctgatgatgtcagccaatatatcatatatcctcacgtaggagtatggtgctaggactcctgatctgattagttggcaaggtagccatatatgctcacatgcgtatgagctggatggaaatattaattggtgtcccttattgaggatagctcatgacaaccaattaacgatgtgtatgcctggcaattcttctgggatgtagatgcaaaaccaatagctctggaattgatcaaatgcatagcgttcgttgcttttcccagagctggggtactggtaagtgttggggctcgtgccgaccacattcccagtgctttccttgcatgccgagtgtatttttgttttgacctgatcatccagtagtcagccgagtccgagaatgatccaatcagctaaatccgagtctggacttctattgtacgcctggtataagatcaatacgatctacccatatagagatgtgtgctcagtgagctgatgtcttgatctcccgtgacaatgatcgaaagactcggaggtcagaaccagcaacagtacatgcaaggcatagattaatttaattagtagttatatcagagaccaatctaataacgattagtagattggaacgacgaacctggttattcttgtaaccacaaagtgtagctcctgaagcagagatctttgtggagatgcacaggagatatcggtgaccccgacgattgaagcctccaacttgatgacgtaaatctttgatcgccgttctctcgactggttaaaacccaagtcgaagagggagagattgttggagtcaccatcaaagaagacgaatccgtcaaaaccgaaagccagccttcggggtgaaggaaaatccggccactcctgatcttgattccatcacacttcttgacggaaaacttgacgcacccctacctggcgcgccaactgtcgaaacatgaattcagcaataataaaagggtagcgcacgagacctaaaagtggatggatgcggagacaaggatttagataggttcaggccccctcgatgagaggtaataccctactcctgtttggggatttgaatccaccatgtgtattatagatctgacgatctagttgtctcatgccccctagagggcctcctgcccaccttatataggatggggggcaggattacaagatagaaatcttaaccaatacggtatcggtttcctaaatctactttacaatcttatcaaaccaggactttaggccgttccataatatacagggaaacgtaatacccaagtcatgatccgttatatatttcatagatataagttatcccctataaccagtcggataaccatgtcgtgtgggtatggggtacccataatctccacagcgctagttctatcaccagaaaccggatgaaatcaattcccaatgcctcctaaacctaaaattgacacatggtatttcccttctttttttttgagacggtcgctagttagatgagggtttgtatgtgtgttacgcgtgcgtactaacacctcgaaggatgttgtctaatttgtcaagtgtgactgtgagagtgacttttagggattgggattttgtggatttggaataaacaaagcctatatatgtagtgaaggaatcatctggtttttttttgtttgtttttgggaggaggggttaaattaattatttcgtatacatgtgtcaatgaaacaaactttttatccagttttactaaaggaactccaaagtattgagaggaaatgtacaatgcattaattataaactgaaaggtaaaatattttttttttgaagaaaccgacggtaggagatctaccggaatattataagaagagagttgaccttgttaataagaaaaaccgggctcaaaaaccttacaactgcatagtttgctaaagggaaactgacgaaaccttacacagaagacagagaaaaaagcctgggacaaacgaccgaaccacaaaagtgaccgagggaagagcaagaccttcaaggcgaagcctccaaggaggggaacaacgacagaagccgctgccgacgcctgcccaaaaattggactgagttttcacccaaagggggagagagtccacaaagcagcacctccaagaaggatacgacacccacaagcgtcgatgttgccgattctggaagacaagacagggctttcacccgagactccctccaaaggaggatctacaatgggccagagcaaaagtgttgtgttatcgttgcccagctcatcggctaagcccgatgcagcagctccgactccgccaaacacaaaactctggcactgaagataagcacaccgctccaactcggcactacgataggttcacttagtcgcaggacactagaagcacttgcgaggcccaagagccctgactacagacagactgaaccaccttcatagacgaacacttctcctcaaccaccgaaagactccacggccgagactggaagcagacggccaaaaaaagggaggagcatcaaggaggagagaaggcatcgaaggcatcggtgtcatccatgtttccggcgaggaccccggccttcgcaggacaccccttacagctgcgacaaaccacctccaacttcaccactagcacagagagaggagcactggtgtaagaagcaaagcaactaaacaactaggcagcagagctgccagggaggaagcgagaagaagggagacaagggtggcggacacccccttctgcttgcaaagaggaagaagccaagagaggggagggtggttgtggctactgtcgacaccggaggggtaggtgtggcgatggggggcggctggcgagccagtgtagccgacgcccccagcgacgcgcctcgccgatcgggagccagcagatgtcgccatgccgcctcgcaagcgccgtcctccgcgccaccacgcgcgcaccggaccacccacgcgcgcgctggacttcgccgcctcgcgccgccacgcgcgcaccggccgccgccaaccttgccgcctccgcacacgccgccccacggcgccgccgccagtactccggccgaaaaccggagaggctggccagatccggcgacggcggcgccggatctgccactgcctagcccagaggcctcgccgccaccactccccgacgccggcgaacgtctcctccaccgcgccttagaagggacgccgccgcgaagaaggccccgccgccgccatcctagctcgccagccggcaaaggagagctccggcggcggcgaggtagggggaggggggagggggagcggcgacggaggcgcggcggcgacgcggggggagagttattccttttcagatataacagatctgaaagctaaaatatacatgttagctgttttgcggtctttgatcagtttgtgacaaaaactcgaacctataagcgatagctagctcttcgcataatatcaaagcgaaacatatgtatcgcaaattgctgggcatcactgctagctccagctgacaaggaagtgcaaactacaaaacactgcgaaccatcaattcctttttggatgaatcctgtatgcatcccatgcctaactgataccaggaaacataatctatgctttttaggatgaagcaggtaaaagtttataagaacttggttttagaaaactctacaccatcatcggacaattcgaagagcattttcagacatggattcgattcgtggtgctcgttcaaatagccaaggataaatattttgcctcaaaatcaatttacacgtagatccctttcttctgactagttctgtttgattgttttatttattcttatatgtgtatgcacagtatactattttggtaattttaacatatttcaaaagataccaggagataccatagtttctaatatatataaattaattttgatatcctcgaatgaagtaccaaaaaatttaatataaaatttagataccttgagatactttctcaaatactgtataatttctcataatattttacgtgtccacaatataagaccatatcgtccactctttaccataaaaaaacataatggattattagaggattccaaaggaagcaatgatacaaataggcacatcaggcacagtgggatgtcaattatacaaatttcacattgggctttatactaacacgtctaaactactaagctggtttttacttgggtaaccagattgcacacttccatccataagtagagggaggaggcttggtaagatcaggcggtgtttttctttaaataccaaaacaagaaacagaactgatcgagaggtggcatcaaatcaaaattgatgtttttgatgcgttgaacgtaacaggattagggacaggccatggagcagtttagtctttacctactagtgagagggttcacactgaaactaaggcacatgctgaatttattttgaaaatacatgagatcattgaaaagatgactaaaaagtatagaattaattgctggtagtaaaggtaagcaagaagtgaagtttgaaccgggtgatttagtttggttacacttgcgaaaggatcaattttcagattttagaatgtctaagttaatgcctagagctgatggtcctttcaaaattattgaggaggttaatgataatgcatataaacttgaattgcttcctgagtttggggttagtcccacttttaacatttagatttaaaaccatacttgagagaagaagatgtacttgagtcgaggacgactctaattcaagagagggaggatgataaggacatcactccttcggatacacacaacaatcctccaccggtcattcaaggaccaataacaagagctcgcgcgagacaattgaatttagaggtaagctcgttcctattcttctttgtatgattttgagaatatattgctacctaataattataggaatcatggagaggacaaagagacacttagggtgtgtttgcaacccctttttctcaacccatctccctcgtttttcgcgcgcacgcttttcaaactgttaaacggtgcgttttttacaaaaagtttctatacgaaagttgctttaaaaaaatcaaattaatccatttttaaaaaaaatagctaatatttaattaatcacgcgctaatggaccgctctgttttccgtgtctattgttccggatgggaacatgaaccagcgaacacacccttagagagggacttagaggcgcggaggatcatcaaggacgtccaagtcaagatggaggcccaaaccaagtcgacttcgagtacgattcggagtccaggaccctctgcactaaaacgggcacccagatcgcatacatgctcggattatggcgttctttatatggctggaaagctaagaagataatatttccaatggttctagtcccacgtccaaattctttccaagtcaacaggaatcgaccgaacaatttgacgtcaagaatctgtcccggtgctgcgtcaccgtatttgggcatttgggccgtgtatcgtattggaacccattagggttgcatcaagggttgtttgcacgaccgtaaactctatatatcagtaccagccgtcacctttagggtttaggtttttcttagattattctgttaagaacactttcgccactagatcggtttgtaagacaccaacttgtgagcttaatcattcatctacaattttagttgtattcttccttgttcttgtttgtgttcttcgattcgcaaacagggattagccttttcggcgaggtcttccgcgtttcgatacgggtgataaccagaggagacgtggtgctacgattgcggggctcaagagcgtgttcgttcagaagccggatcgggctgtgtcgcgactccgctcaaattgactgcctattagaacctttcggaagatcggtaaccctcgtccacatcacaatggaccactatgggctgcagttgctactcacaatgaggaacaaactataaaacttggcgttgtcatcggagaggcagatgaatccagtatggctcccatgcctaattgatggataggaagaggaatctgtggtgctttggtttgctggtatccacaatatactccgcaagctttgtatgttacaggggacatgagaaatcactttaagacgcgctctctaggaattgatgttacagaggaagcaatgatacaaacaggcaaatagaaacaacgggatatcaattataggatagacgatctgaagttctgaacgtactcttaaacttttaagtcagaactatcctctggattgaatgaaagttatgggctataaagagaagttcaattcagcagttgtaataaagacaaaatggtactttttttcttctttgattcagtttaagaactagctagtaagcaatatgtaatagtataataaaaaatacaaaaatttcgtttatacattttcaagccactttctgtactttaccagctcaacttactagttcgttgtaaaattgctctatcagtagacactggataaaatcaattcccaatgcctccaaaacctaaaattgagacaaaggtaatcggatgctggtttgtatgtgtgtgtatgagtatgaacgctcgcatactaacacctcgaagattgttgtcagaattgtcaagtgagaatgacttttaaggattgggatttggtggatttgggaataagcaaagcctataatgcaggcatcatctggggtctttttttgtttttgggagaggaggggttaaattaattatttcgtacatgtgtcaatgaaacacactttttttttccaatgatactaaaggaactccaaattaaagattgaaagtaaatgtacaattcattacttaactgaaatttaaaatatccatgttagctagctgttttgcggtcattcagtttgtgacaaaaactcaacctataagccaaacatatgtatcacaaattgctggcataactgctagctccagacgaacagcaaactacagtacagccaaccatcaagtcctttttggatgaatcctgtatgcatcccatgcctaactgataccaggaaaaagatgttggctaaccgatgactcagctcctctcacgcgagcacacacacgagaatgaaacgcaaacaagattaatttcttacaaaagaatctgtgctttttaggatgaagcatgtaaaagtttataagaacttggttttagaaaactctacaccatcatcggacaattcggagagcattttcaaacatggattcaattcgtggtgctcattcaaatagacaaggagaaatacttgcctcaaaatcgatttacacgtagatccctttcttcttattactccttccgtcctaaaataaatcaacttctagatttcaaatttgtcccaaaataaacaacttctaccttcttacctgccaccaatccgcaaaacgagaaattttattacttcaatacccctcacctatccattattcaatacaacattcacgttaattaagagtattgtggtcttttatttctctccttaaaagctccttgggaagctaaggtttgatttatgtagggatagagggagtacttctgcctgattgctttatttattcatatctgtgtatgcacagaataatatttgagtaattttaccattgttaagaaggtactgagagttaccatattttctaatgtaaattttggtattaattttaatgtaaaacttatgtacctcaagatattttctcaagtactgtataacttctcataatattttacatgtccacaatataagatcatatcgtccactttttaccataaaaacacaatggattattagagggttccaaaggaagcagtcatacaaataggcacatcaggcacagtgggatgtcaattatacaaatttcacattgggctttatactaacacatctaaactactaagccggccggtttttactt

SEQ ID NO: 60068 - DNA, 13155 bp, Oryza sativa
atttttttctctttaacttgtgcagaaattggcaatgcagctctgcttctgtggccgcgctgagctgcgaggtgctgggtgcagcggcgctccagtccatggaggctagcgagacgcttgcgtccgatgccgccattgccgattgcttggcacgggcgctgcggcgtgggagccagcgagtggcagaggctgcctgtaatgctataatggatctctctgcttcttctgctggcagggagcatcttgcgggctctgctgttctgcagagcatattgtaagcatatttactgattgatctgattgttttttcaaattcaatatgtatttcggctttagtagcttgtgctatactgatatatactactaaatgtcaagaaccgcttgactcttatgttcacaagatcaacttaaccaatgtgcccatgtatagatcaatggcaagtctgcagttattatgataaacttcctctggtagcatgttaatatgttatgatgaagatggcttgatagtttataactagatgggaagcattgccaggccttttaaatatgatgaatatcttcgactggttgaattcacttcctgtagatatctattttctcaggtggaatttatttctggagtcattgatatcagaagcactgagtgctcaaaaagtgcttctaaagcaaataaatccttctacttgatggttgacacattggtattcatggtgaattcctgtcaagttgataccttgcataatctgcaacaggatgtagttagaaaagttctgcctttgttgcataaaatctggaagaatgttgataaactgggatcgtcaactgactgcatcaactcgaagaatcaacttcaaaggaaagaacatgagatatctgaagctatttttaggctttcaatgaatattgcctgtccagcccacctggaacctgatgaagtcagacgaagcatttttggacaatcggtatctgactatgaaaattttctcctaaactactgggagaagtcgacttacttggtcactaggaaacagaagaatctgcatgtggatagtgtattcacttcactgcttaatgaatttgatctgaaaacacctgatactatcatccagtcacttgtaaatgggattgtttcttgccccgctattgcttcagatgaacttgacattagttcatttctccgtgaggttcaaggttccttgggtgccactgtgaagtataggcaagatatcagagttgtaagaataaatgaccaatgtgatcagacctcaataggttatgcgatggaggaacatttctttgatgatgggatgaccttccaggatgcagatgcattcgttgaaaaatgtaaggatgcatttaaaaatggtttctcagttgccttgcgtggtatggagttccgttctgaaaagattgctgctatagcttctgctgtagctgatttattcggtcaaccttctgtgggagctaatatatatttctcccctccaagagctcagggcctggcccggcattatgatgatcactgtgtacttgtttggcaactgcttggatgcaagaaatggatgatttggcctgacacaaagttacttttgcctagactatatgaaccttttgaacctttagatgacttggtggatgattgtggtgggaggatggaaattttgcttgaaggagacataatgtatgttcctagaggctttgttcacgaggctcacactgatgttgatgttggtggatttgaagtgaactcaactgttgattgctcactccatttgacccttgctattgaggttgagccacccttcgagtaagtactcttcatatctatgtaaaattctcagtgttccatgtctagtgtttcagcatctcactattactgttgttgcaggtgggagggatttacgcatattgcccttcattgttggacggagaaacactggagctctccatttgttaagtcccaagaggaggcacgaacttcgttatttgctctcctgttgcatgtggcaatcaggctgctttcgaaaaatgatgcaaccttcaggaaggcatgcatggttgcagcaaagcttccaccatctagttcatgtacgacaactcactcgaaagctctcagaagcaaccaaagatcattttttgatgagataattaagaaaatcgacaggagctgcaacttcaaggaggcattgatgtgcattgggctcgcagtgagagagaaaaacgatgagcccttccaatggatgtgttggctccggcatctgccgcaacacggaggcacaaatgaccaagtcgatttctgcaacattttgggagcccttgaagagcttcttgaggcagtcagctgcaaccttgagcaatccttaactgaatttacagacttcaagttgaaattttgtaggtgcgtagcgtacgaagacgcgtgtgagagctttgaaatgttgcttcagatgtatagaacgactaggaatcagtacacgaggggaatgctagcattgcacaggaagcatgaaatttaacttctggagtttggagaattccctcctgacagataaagttcagtgatcagctaggtgtatcatttctccctgactagaaaatctgtctggaaacatttgccccacctcaatcatccacaattctgattagattttaactcaactatcatggtcttttgtcttgtggtcttacagttctgattagttacaacttgagttcactattgtcatgatatgactaatgataaaaaatgaatcacttgctcatgctgcaaagctccacagaatctctctgctcaagtctcacactctcacatgaccacctgatctactgctacaaaactgcaagttgataagcaaacaaacacaatttgttgccaccgaccagatggaatccaatctatgacctctggaccccaaatcaacccgttggcgctgcacctgcaaagagatgacgtttctaaaccgctaatctcctcccccaattattgcaccatctgagggtcagtcataacctcagtgacagtcttgtattttctgaatttctggctgcatccccccccccccccccccaagattataaataacaaacaaatactaaatgtacaatttgcaggtcaatgaacgctgcacataaacaacaataaatgggtcgctgctgcgatcggaggtagacgtgacaaggagagccgcatcttccatatccaggagaagagaaaagatttgataaatcgaagaagaaaaaattttggggaaaattttatcctggggacgcttggattgtgtgctggttgcctccgatggtcgcaagggccagaaatctcgtccacccaaaccgcggggagccctatcccctcagcaaaagccaagatgctgctgttcccgcccgccactaaaaatatttatgcacctcctcgcattaaaaattccatcgacgtcgcctcctctcctcctcctcctcgtcgctgcattccggtgagtccgtgcaatgcctgcattttgtgttttcgtgctcggtttcgtctcgtttttgctgatgacaatgttgtttgtttgatgcaggttgagtgagttggtgattatctgtagggggtgaaaatggcgcaggcggtggtgccggcgatgcagtgccaggtcggggccgtgcgggcgaggccggcggcggctgcggcggcgacgggggggagggtgtggggagtcaggaggaccgggcgcggcacgtcggggttcagggtgatggccgtgagcacggagaccaccggggtggtgacgcggatggagcagctgctcaacatggacaccacccccttcaccgacaagatcatcgccgagtacatctggtactgcaaatgctgcatctcacagtgacgcttctgttcttggtttgacccacacaacagtagcagtagcagcagtttcagactttcagatttcagataagccaaatccgcactttttactagcaccaatttagtactactgctacagtttgtaggttttgcactgcaccgttcgattagggaattggatggttgagatatgaatcataggattagctgtgagcaaacattagtagagtacaagttttgccttaaaatagataaaagtttctcaagcatggtggtggctggtggtgactcacactagctgcttttcagttcccacacttgaataataatacttcaggagtgcgaatccccgatgcgttttcctggtgaaagcagcaatatattaacgaatctgcaatcctttttgccacattctgcagggttggaggaactggaattgacctcagaagcaaatcaagggtatgcacttggtatcatcattatcacaaatgttcttgttcttggataaagataccagtgctgtctttaggaagagaagttgcgtttttaggggattagcagtgtacacagcgcctcctttcgttatttactttctacctctttggcccttgaaagaaaaatcgaatgcctgtatttcagacaatatcaaaaccagtggaggacccctcggagctaccaaaatggaactacgatggatcaagcacagggcaagctccaggagaagatagtgaagtcatcttatagtaagaaaaaatattgcagtacatgtgattcttcagtaaagcattctagatttctaattctgtctcttctcttgcgctgtcccccctgatttcagcccacaggctatattcaaggacccatttcgaggtggcaacaacatattggtaccatcccttctccttaatgttttatccttttcaaatgtgcttttcatactaacctgcacataaaagattagctgtgcaatggttagtggcgcatgtgaaaaatcgcatgctagctgatacaaaatctgttgtttcaggttatgtgtgatacctacacaccagctggggaacccatccctactaacaaacgtaacagggctgcacaagtattcagtgatccaaaggttgtcagccaagtgccatggtaactaaacatcaagcacttttgtgctataaattacaatagaaaacatggtttttccatctacttttgtttacatgtgaagttgagacattttctatgcactatttttctaggtttggaatagaacaggagtacactttgctccagagagacgtaaactggcctcttggctggcccgttggaggctaccctgggccccaggtattatactgaacaagaatggagctttgttgatcagataataataaagataaggatggtttaagtccatgtgttgtgtatgcttaataaaacactatcatgctggatattacagggtccatactactgcgctgtaggatcggacaaatcgtttggccgtgacatatcagatgctcactacaaggcatgtctttatgctggaattaacattagtggaacaaatggagaggtcatgcctggtcaggtatgtgtgttgttatttgtcaattagttttctgaatcagtggatatgttttaacttctatgaagaacaaatcctagtgtttaacaagtgaaacttcacaatccttattcatgcagtgggagtaccaggttggacctagtgtcggtattgaagctggagaccacatatggatttcaagatatattcttgaggtatttcaaataataataaaatatttccctacataatgaaattttggttcaaataataataataaaatatttccctacataatgaaattttggttttctctcttaattttcaaaccatggtttaaaaatcaagctgcatgcatattattgccaagacgtttacatgtgcacattttgtgatccaccttgacattcttacaaatcgcttgttgaaagccatcatctttgttttgttcaaaacatcagaatgttgcatcctatgaatggctatacttttgcttatatcaatttctgcatcagtaaaagcacttctaattatcgtttgctcactgtaatcagagaataacggagcaggctggtgtagtgcttacccttgaccccaaaccaattcaggtatgtcctagtaaattgtccccaactttaaagccaatcaaacgttaaaggagactgaacatatataatgtactgacagggagactggaatggagctgggtgccacacaaactacaggtttcattatcttcttctgatgttaaagtatcctgcagcataagaacaaagcttagaacacttaacacagctttgctgacatttttcctttgagagaacaactttgttgaccgaactaatgcctattcagagacaaaaataaattccttgggaatttgataggaaagaaaacatatgtgtaagacctaaaataccaatccaaatacggaccgaatatcaagtgttcgtaggtgttaaatctattatatctataaagtaatagaaaaagaagcctccacgtttgctctcacggtctagaaaatcccccgttaatcgaaagaaaataagaaaaaaagaaaaatagaagggtattaggattaggttttgtgttaacggaaaaaaaaacaaagagtaaacggacaaaaaaagttggaaacggaaaaaaaaagttggaaacggacaaaaaaaaatccaatcggacaagaaagagagaaaaaagtgaaaagggacaaaaaaaaagaaattccaatgttaatcaagaaaaagagaaaaaaaataaccattgggtcatagtagatccagattataacagtttagatttaatatagggtgtgtttggattccaattttttttctaaaaacatcacatcaaatgtttggacacatgtatggagcaataaatgtgaacgaaaaaaaaaccaattgcacagtttgcatgcaaattgcgagacgaatcttttgagcctaattacgccatgattttacaatatgatgctacagtaaacatttgctaataacagattaattaggcttaataaattcgtctcgtagtttcctggcagcatctgtaatttgttttattattggactacgtttaattccttcaaatgtgtgttcatatacttcaaaatttttacacctaaacaactaaacacggccataatagttatataactaatataaatctttttttacggaagcttaaagtaactataggaatcgaagtaaaaaaagcttgagatggaaatgaccaaacaaaccacatgcacaagaaaaaaggaaaaatagaagggtattaggattaggttttgtgtaaatggacaaaaaaacaaagattgggtgtggtgtaaacagacaaaaaaaaagttggaaacggacaaaaaagaaaaaatagaaacgggcaagaaagatagaaaaagtgaaaacagacaagaaaaatagaaattccaatgttaatcaagaaaaagagaaaaaaaataaccattgagtcatagtagatccagattataacagtttagatttaatatagggtgtgtttagattccaaaaaattttggcgaaaaacgttacatcaaatgtttggacacatgtatggagcattatatatggacgaaaaaaaccaattgcacagtttgcatgtcaattgcgagacgaatcttttgagcctaattatgccatgatttgataatgtgatgctatagtaaacatttgctaatgacagattaataaggcttaataaattcgtctcgcagtttacaggcggattcagtaatttgttttgttattagtctacgtttagtacttcaaatgtgtgtccgtatacttcaaaatttttacacctaaacaactaaacacggccataatggttatacaactaatataaatcttttttttacggaagcttaaagtaactataggaatcggagtaaaaaaaacttgagatggaaacgatcaaacaaaccacatgcacaaagtttatttctaatttaaccaattggattaagaactaatgcattaacttatttaagtaataagggcatgtttagatccgctgacaagttatttcactctgtcacatcgaacgttttaacacctgtatgaagtatattatgaagtattaaatataggcgaaaaaataactaattgcacagattgcgactaatttgcgagacgaatcttttaagcctaattgctacatgatttgacaatgtggtgctagagtaaacatttgctaatgacggattatttaggcttaataaattcgtctcgcattttacaggcggattctgtaatttgttttgttattagactacgtttaatacttcaaatgtatgtcagtatatccgatgtgacatggcaaaaattttcacccctggatctaaacacagcctaagaaaattggactccgcgtttgctctcatggcctagaaattctcatattaatcgaagtccatatagaaaaacaatttacatagataattaaaaaataatgaatattggaagagaaggctagagttcatactggtgtacaatttataactaattgaaatacggaatcagagaaaaataataatagagtccatatagaaatacaattttaaatagcttaaattcgaaattaaaaaaaggaatattgaaagaaaaaactccatatcagtatacaatttagaactaactaaactttggaattaaaaaaagaaaatataagtagaagtttgagtctatattgaaatacaatttataaccttaatttataaaaataaaaaataaaaaatattgaaataagagtttacaatctatataaaaatacaatttagaaaaaaaaatgaaaatttggaatagaaataaggaatattggtagctagccgcgcagtttgcgcgggccaccatactagttgttattgaatacaaatccagaataagcctgtattcacttcgattgactgaatgaatgttctttgtttctcaaacaattgaaatatactgattgtcttgcaaatgtagcaccaagagtatgcgtgaagatggaggatttgaggtgatcaagaaggcaatcctaaacctatcacttcgccatgacttgcatataagtgcatatggtgaaggaaatgaaaggaggttgacaggtttacacgagacagctagcattgacaatttctcatgggtatggtttcagcggcctttttatatctttatgttttaatttctatttttaagctatactaacgaaacatttcattaaagggtgtggcaaaccgtggatgctctattcgggtggggcgagacaccgaggcgaagggaaaaggtatatgttcttccatgtcccctgaaattgttgtgtttgggattcagaaaacactaacatccactggtatattaagcaaccaattgagccctccaaaaccagagtaacatagtttttatagcaaataagcacatcatgtagtaactgcccctattgctcatttgtacttccgtaattcaatacttcgttgttacgctccaaatatttcaggtttgagttgaaaatacaaacatttttttttctgaaactatgaaagaacacaacatcagcaaatgcatgtcttgtaatgttgttttcacaattcacaaatgtgcaacttagtatttgcatttttcaactcaatcttattaacttgcccttacaatgctaaatctccttgctgataggctacttggaagaccgtcgcccggcatcaaacatggacccgtacgtcgtgacagcgctattggctgaaaccacaattctttgggagccaaccctcgaagcggaggttcttgctgctaagaagttggccctgaaggtatgaagaacttggacgatgaatcggggcaaataaatcccagcaaaatttgtttgctgcccaccagtcttgatcttgtatttcttctgtctggggattggtctgtacaaatctgcagtttctagaaaaccacgccaccttccattcgccagttaacattttggttgaacaccacacttgatctgggtctgtattttgagtccatttgtgagtgacagaacggatgatgaaacacatcagggacacttttaagtttcttcagtcctgcgtccttccctcgaaataaaaatgtttccttgttttttatcccgggctaaacctgtagttgcgatgaaaacgtcactattggagacttggagaatataatttgacagttgacactcgaccatcatggactggtgttagttctcagctgtggtcagggttcacctttctgatcgagtgcctgacctgaatccgtagcggaatgacatttttcaccaaatttcgatcaaattttggttgaattttactgtttcaaatttgaattctagaaaaccattcgaaatttcactcataatcttctttcatctaggggtgcaagtgggtcacccacgaacccatttataggtcaaaataagtgagttcgcgggttagtttagcctataaataggttttcgcgggtagccacttgcacccttagtttcatccctcgtcaaaacatctaaattttgcggtttttggttggttttcgtcgaaaacttaaaccctggctgtgtcatctctgcagctagctaacagcaatgcatgaacagagcaatggcaacacatacagaagaagcagcagcagaacatcgatcgatctcttgcgaagaagggtacatgtaatttcatgacgaaattaacagtccaagagagtacttagtactagtagtactcctactaactaagctagacaagaagattatacacggacaaacagagaagctgacagcctatggtttctttgggtgcttgcgtttgggtggagacggagagtgcatcgccaccccgctgtaatcagcgctgtcgatcagcccttctcttgcgccctcatcatcatccacccaacctgccttcgtctctgcagtctccttcgtcgtcgcctccatagccactacctggacatggacacaccatgagcttgacaattatttcttgtttttcatctgcatttctagctgaagatggtagtgcacaatgtgctattcactgacattaaaaaaagattatgcagcagaggcaggcacaagaaaacacataaaaattcagttttgcattttatgaacatatgaataatgaactcacctcatgttgctccttgtgcttgccttcatgccggtattggtgtcctgacaagccttctcctatcagttctctgcctctgcgaccaagaactcgagccacttgatcttgctgcctgctcagtgaagaagcagcagcagaagagacatctgcaagatttgctaggacgagtactcctgagacaaacactaagcagagtagcttctgatcaataaccatggttgtgctgatgactggtgacaactaactactggaaatggagatggagagaagatgaactgatgaagcgaatgctccctctacatgtctcctcgaggtttatatataaattggcgaaggttgcagcgacagaaatgggccatggtgtctgcactctaacatatttgcaaaccaggccccatcctgaataatactacttgcaaggaggttagttcacaaaaggctaagctagccattagcatgattgagatccatactccattatgcaaaacatgccgagacatagggcactattgccataatcatgtgtagtttgtggaccataaacgtcacatgcatgtgagtgagcagatgtttggagtgtacagtagttgtgcttattaggtaggggcagaggggacagcaacatttggctacttgctgtaggcttctttgttactaattttttgctcattagatccctgctaaatctgacaaaggtgaaggtcatgaggacccaacacccaagaaaacacccaaaattctgactattgaccaatgctgtctgctctaacagcatgatctgatgacccatgctagctagctgctcaaacttttcttctcatcacggcatcacgcatggtgatggtgtctgaatgttggcttatctcctccatcctagctgcatggacagcatggtgtcgtcagatagtaggagcttgatttgatgttgtctgtcagtgagtgttgcagtgctaattttgttagtaatcgtagacttctagcattgatagagatgagcatatacaggctgatccttgatgatggcagtttattacatatgatccatgaacatgtaactagtgctatatgagacaacaagttagtatatatgcatcacaagaaatggtcctgagaggctgaaatctgagctaacatgaagcagggcaggtgagtgatggcccatggctacaaggatttggtgcgtgcctaaatgcagagagaaggcaattccaaaatggtgtatctttcgatggacacatatgtaggctggaggaatgcaaggttggcagcatgtattggcatgtcattagctttgtattataaagctgatgcatctcattaatgcctggattatactgattagagtatggcatgaggtatgcagtatggggggctcgagacagggaggtcaagctcaggtagggcttcttttatcagaccccagccttgtctctttgctggtcacggagctggccatctctctggattatgtgtatttatgtatggacatgtcaactaaaatagtcgtcagcagccaacagcgttactgttgattgtccgtttggtcatcactaatccatttcctggctgcttcccttgtgctttagaatagagtattaagcgagaaactaaactaaactaagaaatcgaacgaattgtttggtgttgattgacgccagtgttgattgattcgcaacggcctcgcgcatgtaagtaggacgaggggggtttactcgaacggtagtcgcatagtacatggagagttgttcggtgtgagacgagcacgtacgcacgctgtcatgggtggatgggagcacgcacggttgccgttgcagttgcaggcgtgcagcgggaattttttttatttttaattttttttattaaaagttttacaaaaataattttctattttgaaaattgacggaagtagtcgcctaccgccctttgggaaggcgatttttaaaaatcgccctcccagagggcggcgaaaatgacgtggcagacggccgttcgctctcgggcgacggccgtcaacgaaatttgcaggcggcccccttgccgccctccgcgagggcgattttgtactgtgcggggggccgcctgcaaatgggcggcgagggggggcatggaattttgcag

SEQ ID NO: 60069 - DNA, 17383 bp, Oryza sativa
ctagttctagcaacaaacgcaggatgtaatcgattcatgatgcctcctaaacctagctaaaacctgacaaaagcgaaattaagttcattatggtttcagattgaaggggagagggaagttacagaagcagcaagaggcagggtggtggggaagggttttatattgagatgtggtagctggatgaagggtttttttttttaatgtgtgtgtatatatatatccatgcgtgcatggtaggctctcgattggtgttgtcaaatttgccgaaggagaatgaattttaggaattgagatttgaagtattcaagagacaagtgggaaaagaaccaagggaggtaaattgggggcctacatgtgtcatgtaaccggaaaaattcgaaaatatacatttttctaatcgtttttacagaatatatgtgtttatagagagaagtgccaaaaatataccatcgttgcagttaactgctctacgagttcgcttggctgctcagtgaacgggctgggcgcagcagcaagttcgcttgactgcccatcgaactggctggctaatggctaatgacaccgttaaataccatgattacttgttaattactttataatgatattagttaaaagaaacttggaaggaaacctgtgcggatgcacgggcacctcacttattatttatgaaaaaatgctaaaagaaatcatatctcagtacaaattatttaaataaatagaaaaaatatctatgttgtaaaatatacgtagacttaaatatagtaaatattactttgtcttgattatgaatggcaccaaggctttctttcatgctgcctctaaacatggatctcccattgatgtagatctactccttaaaaccagcatgaaccataatttcatattgtctaattcactatcggcatcctcatacataattgcatcgttaagtaggaagttgagttttatcgccaatcgatttaactatatgtatgttcttaccatacttataaaaatatagtaagctctgttatccatgctcgaggccctttagaaaagaacaaagagaaaacgaagatgatgacaatatttttttaatgttatgagttgttttgcagaatagcgtagacgtaatttatttatggtgttaatttatcaataatacttaagtttttattttttaaaatactatacaaacgcatgtgctcataatgccaacccacttacctccctatgtatgcgcaaccacatatcctattcttataatcacctccgaaagattagatcagcatatcttaaaattggtgaagtcagcaccaaagcaagtattcataatgcgcacacatataccttaccctatgagcaccttcaaaagattggaccgatatatcttaagattgatggacctagtcatttgtttacttaccgggtgaattgcagggaaaatatgaaagacatttgttgctgaaaaatcctgtgcgtgtgtgcaggtgcgtttcctttgtgtccattccggccgtgaactcttgagttcgtgcttcgattcagccgtgagtgttcattctcagttgacgcctattggtggccactaaaaactccaattcgagtacaaaaattttaataaaataaatggagataacatgttaccttatcgttgtttctttacactaatgggattctatgagttttgttggtctaacaggttttgcaagtttaggtcataaaatgtaaacatgtcgggatatttgggcttattcccaattgaattttgaaggagcaccaaaactacctataagatatgaaaccaaatcacatatttgagtataccacattgaagtcaacacgacgatagaacagatatatggtttgtctgatttggaatctggacgaaggagatacgataaccagaaaaacaagccatcttgccaagctgagggtggagagtatggggtcaattggaaggaagagaagtcacatggcaacccagattaggaagaaaaacttaactctaaattttcttctcaccttacctctatctctatcgtattttcaaaactaggaagttgattaggtgacgatacttaagaaactaccgattgaaagcaacagtgctatccatggccgccaacgtcgtcaacaaaaatctcatccatctaccaacggtaagttgacatgggaattaaggatatgcattgcggattattgagaaagcagttcacaattaattcataatgccatcaatatgcctgtaccggacagggccatcattgatgtcagtgtcgccgccagactgcggcgtgatctgttccccgaaagatctggtaggagtagccgacggtgatccggggggcgaggaatgagcaggtgtgctcggtagtgatggtgacgcctccagtgagcttgccagggaagaatttcccctttccaccaccaccggttccttgcatggacatctgccgggtgatggtgcttggtaccgcggtacgaagcctaccacagatgtcgtcgagccagctggttgctcgacggtctcctccacatcaaattcagcagagacctactcgcctgtagctctataccatggtcaaacaacattttcttcaaatatgacaccatgacttacatggatgcgacctcgacgaggatcaaatagtcgatgcaccttgctcccttcttccacgcccaagtacacatacggtgcacttcggtcgtccagcttctcgaggtgtggtactgtgttcttcgcgtgtgcagtacacccgaacacacgcaaatgcgcccgcaaatgcgccaagtgcggcttcttaaccatccacgcttcatacggagtgcgatttcccatcgccttggttggcggccagttgagaattgaaggtacactgtgtggcgcactgcctccccccaaagccagcctgacacgctcctccccttcaacagtgagcgcgccatcaccatcattgacctgttgcggcgctcgccaccccgttctgctgcggcgagtacggcactgtcaaatgccgctggataccagccgattcacactgttgtgcaaactcgccggacaggaactcgccaccgtgatccgatctcagcgtctttatgcgccgcccaaccacgttctcagccaggggtttgaacttggtgaaggtttccaaagcttggcccttggatttaatcacaaacacccacatccaccatgtaaagtcatcaacaatcaaaacaaagtatcggttaccagtcattctcgccggtgagatccacccgcataggtggagcaacgactcgcattctcgccggtgagatccacccgcataggtggagcaacgactcgcggcttaacgctccaaaagaaaacttctggatttttcttgaaattttccggcaagttgaaaccagtcatgtactaccctgtttccataagaaaagtgaaaacaaccaaggttagcctgcaaatgacagtgattatatagaggtaaatataaagtattagtcatggtaatctctgttataaatcctccccggcaacggcgccagaaatgttgttggtatttcttaacgacgttactagaaatataattcccagcaatagcgcagaaatacttctggtatattatggttacagagttcatccgcaagcgcacggatataccattgtagcatttcacccgagagtattccaagggtatcgtatttgtttaatcccgtgggaagattataatagagataccatactaataatttatatattaattgtaataatcaaagtctaagcatgagttaatataatccaaagggtagagtgacactaagcacaagcattcatactcttactcataattatctaagctaagtggaaagaacatagaaagatcatattcctatacttctagtatacatacatattatacatacatcctagccatattattacttagctaataacctctttctgataacctactggtgcttcgagaagccaaccctgattgccaagttccttacgacaatccgtcatgaccatccaatcagggctaaatacggaggactaccctccccaggaaattaacttaggactatatacacgcgcggaggaatacatgtactgagctgtcaccatcagcggcccacctcgcttctacaacatataaccccaaataatgatatccagtaatctaaacaccatgcttaaattaccaaatactattctaatatcatcgtcatgacatagagtcatcgtaaatatgatcattatactcacaccattgtatctcccagataagctagcatcataatgaatataacttgaacatatagtaaagtagatattcatatactcgaaaagtaatacaataccaaagtagtataaagaagaatattctaaataaaatataagtcttacaaaagaagaaaaagctactagagtccccgcaaaaaaaaaagctactagaggcatacccaaattcttccgaagactccgaggactgaagattctattatatttctattccgctatactccagggactatactaaatttgagagatgaaatgatcttcttgtttgaggtgtgtcttgaaatggagagagagtgagccttttacagacaggtagtgatggttatggcggttggaaaggttggtaatacccttcaatcgctatagggaagccatccacaccatccatcaccaaccctggatcgagcggcgctgaggagggttcgaccgaaccatgggtcggcccaaccagcccaggttttggctggtggcctcctcttttgctcccatgtgcagacttgtgaattttggcccaattggtcatgtcatttctgcatttttggcccattcgttgataagtctgattcttgacatcgtccgattgaacgatcgcttgttttgatgttgattctcgtccattttttggtcattctatgcaagaggttagtaatcctagtgctagaggactatttattattaaacataaatatgcattgcaagtataactagttctcatttattttagtaatattgacggtcaaaactgatcgctaacgaccgtcaataaaaccggatctgctgccgccggaactatggacatggtgtcagatcagccctcagcccgagtgctctgataccacttgttggcgacaaacctcggatcaaacactttgtgtgcacactgcagcaatccgacacggcaacagacgagaacatagaatgcagaaagggatcttcagaggaagaacagtgaagtttcagagaacaatcgatgtactggaaattgtggggttgattttctgtggtttttattcaactgaatagagtaacatacaactcaaataacatgactagaatccaaggctcaaatcgcgccatcccacgataccacttttcgaattcaatgactcacacatccgcgctaaactcacgcacgcgaaccctactgacacagtctgcttaaggacttgatcgccgcatcatctgcatctgctaacaaactccagcagacttattccttcaacctttgcaactgctaacttctggaacacgtaggagccacagctgaactaacaaactcaacaacgtgtgactatattcatcgcagcttgttagcaacggccaccggcaccgacgccggcgacctagccgatgtagtacatggggtcaggcagcttgaaggtgcgagcgccctccggtgcacccaagatgtcactccactggtctccgatgttaccgacgatgatgaagccggcgtcctgcagcttctgacgctcgccggacttgtacgccacagccgataactggagcccgccggcgacatgagctgccggcttcaacagcagcttctcccatccagtgtagccctgccggcggaggttcgcgacggtgatggccctctggtcctcggtgcggcctgtcaggaacactggcttgacaccgagctccagcagccgccggtacaggcgcctcgtctccggcagcgccggcgcgctcccctctgccacatactcacgaaagctcgtgtcgttgtacggcgtagctctgccaagggattagtaaagataattataattaattaatttcttcatatgcataaacgtatgcatcgttgcatgcaaggcaaagttaattattcgaataaaacagaagctttcaatggaactgtcgaactcatggtacaggaccgaattcacgaataaataaagttgcaagtttgctggaaactgtacaaacttaatcattagtaaaaagaatttatagcatatgagcgtgcagtgcgtccatagctccatacttgtctaggattaaattttcgatatgatatatatagcatgcagacaaaaatgtatctgtcaagttatcttgtcttcactgttcatatgcatacatgcatcatgcatggtcccagggctatacataagatcccgatgctaaatataaaattaggttgtacattgaagaatttccaagatcaaactttttaattctgtttacttatggaattgcaacatatatattttgtaataatactaagaattgcaaaggatattcctgatacaagtgtaaaagatatgctctcttcacgaaattaaataaaggatgttatacgggaaagcgtaacatgtccttgttcaaacaaaagaaagagcaaaaaaaccttgttcgatctgcttgagccttgatgcaatgttgttggaaagttgtaatatctaaagatttcttctatttactgacaacataggccggccgatttcaactttttccatgtagttcatgaattttgattcacgttcaatagtagttcatcctagtttaacactgtcatcagcaagatatatatccttgttgttcatataatattccatatactttgtcagcaagttgaggggtaaatatattacaagattattaaagtcccaacttcaattaatgaagagtatatatacctactgaaattaaatacgttcaaaatactaattccgttttttatttgacaatgttgaattattatataacttttcaaatagaatgaagtgcacgggcggttcttaaacttgtacagatgtgtcatctagatgactagatttctaacatctcaaaaatgcatttttgggtccccaaactcgtcatgtgtcatatagatctaaatggactccaacccgctccgtgagatgacgtggtataccacggtgatactttcgtgtcagtgggatccacatgcatgctagtcatgtagaaaaaaataaaatttaaaaggagatgagaaaataatgttttcaattttgaaaaaataaatgaaaaaagaaaggggaaaaatatttcctttttttttaatatgtggcggacatatatatgagttctattgacacgtaggtgccaacatggctgccacgtcagcacacggggcgggttggaacccgtttggatctatatgacacacgagacaagttaaagggctaaaaagttcattttgagagtttagtgacctagtttagtgatctagttgatacacccatacaagtttagagaccgcccgtgcactttactttttaaatagtaagaccaataatcaaactgtgtctatgtatatacatatatacgggatgccgggccccacgcggcagccgcacggtgcgcccgaaggcggccacgccggcgcagcggcgggaggcggccccccccccccctttgggcccccggcggcggccttaggcccggcggaccggcggccgaaaaaggggaagggaagggggaaaagaagcggcggtccacggctcaccccgggtcgacggcgacgacggaaacggcgaccggagcggaggaaggcggcggcgcggctcgggtggacggggtcgacggtgctccggcggtcggcgagcgaaacggaggggtggacgaggtcgtcggggatgcggtgaagccgaaggtggcgacgccgaggcgggaggtggtccggggcgacgacagcggcggaccggagctcggcggtgacggcggagagagagagcgacggcgcgagctcgattccgacggggagagagggcggcgagtggcggaaacggtggagggtggcacggggaaggtttatataggattgggagggggagggagctgccggacgagggggaaacgggcgcggaagatccggtcgccattgatggcgccggcgaggttaggggagaggtttccaaacgaatgcgagggagagagggagggaaaaatggggggaaagagggagggaatcacggggaatatttccccccactttattgcgcgcgtggacggcgggaggcggcgggattcgcggtggcggcggcgctagggcacgggcgaggcggcgggagcggcgggaggaaggggatgacgggtgggccccacccgtcagtgagggtggcgggcgggcccgcccgtcagcggcacgcgcgcggggaggaggccgaatttgccgcgggggagaggagagagagggagagagatgggcgagccggcccaagagggggagggggggaaaaggactttttagggtttttctttttataaaacctttttaactttgtttatttcttcttaattattatttgtgctctgaaaattccactaaaatttatttacgcattttaggcttttaggaaatatacaaaaatcctccaagccttatttgacttttaactttgcacattttaattgttggaggctttcacacggattttaattattctaggcataatttcggggatgtattttagagtcgttttgggacgcgacaagggcgctctccccggtcgcgggaccatggagagggaaccaggaggtactgaacctgaacctgtcctaggtcacatggttgcggtggaggattatattctctgtggttttctccccccgccttctgagtttctacagtctttctttcctccatttgaaccccaattccatcaccttcctcaatatcttttcgcatctttgtgaggcctacattggggtagagccatttctcgacctttttcgcttctactacaagctgcgttggatggaatccaccagggtatctggatgcgtcggtttccgactccgggatggcctaaagtcgcgctatatccccttccaatgcccttcttctcgcagcaagtggcaggcgaggtggttctatcttcaggtagaggattcagatccaatctttgttgttcctgaggaacaaccagacaagattccgtcttggactgccaaacccgccttgaccccttctcttcagttcttcatcaatcccatcgatgacctccgagtacgaggtttgtcgaggtatgaagtcgctgccgacttcattggtaggcggatccagccgctccaggctcgagcccacccagcctttgactattctgggccggaggacgcgacccgagtttctcctcgggtatttttctttgtgtttaatttgacttccttatgtgcatgttcctcctgacttaccgaattctggttctgtctacaggtttgaacagcgagaccatggagcgttgcgtcggacaattgatgatcagtggcccgacaacggtgagtaacgtccccatccccctttgcgagaaggggaaggctgagcatgaagccgcaattaacgtgagtgtatttgacgaccccctttatttttgctcctagatcgcataatgacttcacgcggtgcaggctctccctctgaccgacgtcattggaccgctcttggaccaccaggcggcggcctcgttgaaggagggcgtcgcccaagaggcgtccgacgcggccattgctgctgctgccacgactagtggcagccgtgtcccgaggaaggggaggaaattcacctccgtgctcggcagccgccggaaagcgtcctcccatcggtaagtctcttgagttgttaactacgtagtcggaagatgtccccctcacgtcgtactcggtttacttaggccttggatgcgtctccgccacctccacgacggcagaatctggtgacacttggcgagaagtaagtggacaaaatttgaggtccttcccttggttgaattctggcgacttgtcttgagggccagacatgttaatcttctgtaggtcggcgcgggcgaaggcggtgcaagacgggtccggagggaactccagcacgtctcctgcgatggcctcgaccgatgtcgtggtcgtgcccaggagccgtgaggtgacgcccaacggcccagccagtgatctcgtgcctgctcgaggcctgcctgctgacgtcctcacctggggggagctccaagtcgagatggggcacatccttgaggttggtgctcatggcataagtcgcgagattgcggaggcgaggacggcagcagcgtcgtcggcaaatgagcgtgccgataagctggcgcgtgacctggcggaggttcgtgaggacctccagaaaatgagggaactagtggccggcaacgagtgacaacggtggggactcgagaacccgatgtcggaactcgagaatgtcacgtccggaaataacccaacgggcgttccttacgtgtgtgtattattccttgtcccaggaggcaaggtacacccaaaagttgatacaattcagagtttaacaagcggaagcgtatatagataatttattacatgggcggcgaaggcccagcacacaagaagacaaacgaaaaacagcagaagactagggcgacgaccacaggcgcttgacggcaggcaccagctagacaccaaagccttcatcttccgggaactcctcttctgggtttgggaaaaattgagcaagactgagtacaaccaccgtactcaacaagacacacccacaagtgcagaataaatgcaagggagtacaagggagttataacataggggttaagttttgcagtaaacagcatttaaaagtcacttagttgccaaaacctattttatgaagacgatcctagagctatacaagattattaatcaaggccgtgaacccacacaaacctgccttaacccaaggcctacgatgattcaaaccgaactggcaacccgaccctgggtcccagctcgtcccaagccaacccaggccaaccattccacattttagttgttaagcaggttttaagaattaaaacactaacttgggtacattgctaggcttgcccataaccgagggcgcggctatttgaataggttttactctgatcagaggtgtacatctttacccacaagacatgtcttcctcacgtgtaaccacatgccacataccaccacggcatacagacggaagacatgacatagtttccaacccatcctagccatagacaagagtaccgacccaaccccacctacggcaggaacctccgggacaggtaggcaggactgagcccctagcagcaggacaccagccccgtgccatgacatctcgactaccgggccgcagctcgtgtagccttcatttgccctagagatgtccatcgacccccgacttcgtccatctgcatccgtgtacttttgtttataaccagactgagccacaaactaagccttacccactagacatgtggaagtacggtagtgctttgcaacagaggcccgaagaccggtccttatgtggccgaggtgctactatcaaaaccatgcaccccgagcccagcctaaaaccattttgagggttttgaatagagggggaggtgtgaatccaattccacaataatccaaccattccaatgtccatgtgatatgaatattcccaatccttggcgcgaagcgtcacagtacaacatgaagtccttgcgagtatccggtaagattaaaaccggcgaggaaaccagcctttccttgagagtttggaatgccttctcgcattgcgggctccacacaaatttctcttctttcttcaacaactgtgtcatgggtcgagcgattttggagaagttctcgatgaacctccggtagtatcctgccaaacccaaaaaactgcgaatttgagtgactgtcttaggttgcttccaatcagtgacggcggtcactgtttcggggtccacagcaactcctttagcagatatcacgtgccctaagaatttgacttcggacaaccagaactcacacttgctaagtttggcatacaattgatgttcccgcaactttcccaacaccagacggagatggtgctgatggtcttcctctgattgtgagtacaccagaatgtcgtcaatgaaaaccacaacaaacatatccaagtattccatgaacactttgttcattaagttcatgaagaaggcaggagcattggttaaaccgaacgacatcaccgtgaattcatatagtccgtatcgcgaggtgaatgcggtcttcgggatatcttcttcacggatgcgcaactggtgatatccggaacgaagatcaatcttggagaataccgtggcacctttaagctgatcgaacagatcatcgatccggggaagagggtacttgtttttgatagtaacttcattgagagctctgtaatcaacgcacatcctcttcgtcttgtctttcttctccacaaaaatcacaggagcaccccagggggaagtactcggccgtatataccccttttctttcaactcttccaactgtttcttgacttcggccagttcatttgctgccatacggtagggtcgcttgtacagaggagtggttcctagagcaagatctatccggaactcaatctctcgcttgggcggcataccgggtagttcttccggaaacacgtctccgaactctctgatgatggggatttccgacagtcttatctgatgaagttctgaactaccgacagaggttgggggtgcaaagaaaacaaccggttgttccggccctcggtacagagtgacagtgcgtcttgcacaatccactactccttggaattgagccaaccaattcatcccaaggatcacatccaagttcttggtgtctagaagaatcagatccgaggaaaaaggaattccctgaatttctataggaacggcagggctataatactttgctgtcataacccctccaggggtggtgatgagcagagggttcctaagcctttctacccccaactgatttctccccacgaatggcacaaatataaacaagtgggaagctccagagtcgaacaaaatggtagcagggatggaatgaatgaggaacgtaccaacgatgacgtctggagttgtcagcacgtcctcggccatcacgtggttcacacgaccccgtatgacatccttaccaccgtggttggagcggggaggcgcttggccttgctggcacctcggctttgggcatttatccgcaaagtgcccaggctcgaagcagttgaagcacagacactgctgaccttgaacgtccctgcggccttgaccaggctgcacggctggcgtaggaggacggggcgcacgagtcccttgctgactctgctgttgctgcggctgtgggacgcgcaccacgaattgaggtcggggcgcggagcgaggttgctgctgctgttgctgctgcgaggaggatctccctggatagggattggtgtagcggtgtagcggaccttttggttagccccctgttggttgcggaaattcgccaagcgacgcttgtgcgactccagttccttgtgcttggcttccaagcggatgctcttgtccaccagacgttggaaatccagatagtccccggagaccagacgcacggacagctcagggtccattcctgccaagaacttctcttgcttctcctcatcttcacgaacatcctccagggcgtaccgggccaggttgttaaactcatgcaaatactccatcacggagcggttgccttgcttcaactctcggaattcccttttcttaagggccatgactccggcgggcacatgggttctccggaaagcggcggtgaagcgggcccaagtaataggctgcccctctggctgcatagcctggaaatggtcccaccatagagatgcgggcccctgcagttggtgggcggcgaagatgacttactcctcatcgctacactgcacggtgtctaactttttccccacggcatgcaaccaatccaacgcgtccacggggttattggagctagagaaggtaggtggacggatgcggaggaactcggcgagtttagagtgttgtgggggtggtggtggagcattatgttgtggcggattttggatgtggtggaggaaagcagccatcatgttggcctgctaggcgaggatttgggtgaggatggagttggtgtctggtggtggtggtggaggcgggggaggaggtggaggtgggctgccatggttgttgtggttgctgccttcggggtgactgccttcaccggtagcagcacttctcctggttgtcaccatctgaaaaccccacacagaaccagcaaacagagagagctgacaattaaaactaaccacccacgactaccataattcttgaatttattactgctattaaattggttcattaaagttcaagttgcttaagcaaataaaataaagacaagctccgacacagttataccacacaccggcataaccatgccccatacgactctagcagaaaaacaaacgagaagaacacacacgcaagcctactaactgctcgtctactactgcgacgggccagggcggaaggtgagcagcagcacatcctccgtgctgccaacgccggaggctccatcctcctgaggaaccacgggcgcgggctcagcacgaggggtctcgacgaagcaggtccacgccagggactgacgaacaagctcgggcctggaggtactcttgcgggcggtgatcttcaggctgcggcagacgcggcgacgcttggggcgacagacctctccctgggcgatcttgagctgacgcagctgcgcgtccactgcgtctaggtccttcttcagctgcagattctcctgacgcagctccaggatcttcatgttgttctcgaccaacccacgacgcaccatctgatggaagtcgatatgggccgcgtcgtacgcctccaccatgcgcgccaggtgcatgatggtagcgtcatcctccgagctagcatcccggaaggtggcgtagtcgcgggctcctccgcggcaagggtggtagcggtagggcgagtgctgcaactcgttcgggtagcactggtggagagtgccgatggcgaggagtgcggcgttctggcaagcggcagagaaggaatctccacccacggtgactaccaacgaagtcctctcgggtgagccagtgaggatcactgcagtaatctcccaagcagcgtggggctctgcatcgtcaccctcctgctccgggagccgcttgccctggtagtccactccatgcggataccccaggacaacgcacatgccccgcagctccaaaacgaagccagtcaggtccagaccacgacggttgatgctgccggccatctacaaacaaaagagaaaagcaacattttaaagatcagattttgacgataaatgaagcagcaggacagagagagactaaaggattttcacaaataagaaaggatttttattttgaaaatattgctaaggcttgggatctacggctcgtcctagggtcaagggggctctgataccaacttgtcacgaccggaaataacccaacgggcgttccttacgtgcgtgcattattccttgtcccaggaggcaaggtacaccaaaagttgatacagttcagagtttaacaagcggaagcgtaaatagttaatttattacatggccggcgaaggcccagcacacacaaagacaaacgggaaacagcggaagactagggcgacgaccacaggcgcttgacggcaggcgcgagctagacaccaaagccttcatcatccaggggctcctcttctgggtttggcaaaaattgagcaagactgagtacaaccaccgtactcaacaagacacacccacaagtgcaggataaatgcaagggagtacaagggggttataatatagagggttagggtttgcagcaaacagcattaaaagacacttagttgctcaaagctattttgtaaatacgatcctagagctatacaagattattaaacaaggccgtgaacccacacgaacctgccttaacccaaggcctacgataattcagaccgaactagcaacccgaccctgggtcccagctcgtcccaagccaacccaggccaaccattccacattttagttgttaagcaggttttaagaattacaacactaacttgggtacattgctcggcttgcccataaccgagggcgcggctattcgaatagattatactctgatcagaggtgtacatctttacccacaagacacctcttcctcacgtgtaaccacgtgccatataccaccatggtatacggacggaagacatgacatagtttccaacccatcctagccatagacaagagtactgacccaaccccacctacggccgaaacctccgggacaggtaggcaggactaagcccctagcagcaggacaccggccctgtgccatgacatctcgactaccaggccgcagctcgtgtagccttcatttgccctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttgaggattttgaatagagggggaggtgtgcatccgattccacaataatccaacaattccatagtgtccaggtgataagagtattcccaaagtctagagttgtaaaccacctaatgttacctaattaaccagcgaagcatctaactaaaatcatactagtggtaccttgagtagagtgtccactagttggggttttgtttattctagggtgaacaaggaaataataacaataacaataataaggtcataacaaaggtacataggcatggctagataaaacagtgataacgcgggaatttaaataaagcgataatgcaaaaatttaaatcaaaataattttataaactgggattcaatatgttcaaggatgatgtgacttgccttgctcgctttcccaaacgtcggcttcaacttccacgaagagcggatcttccgaagctgcagcgtctacacgaccaacggaaaagaaaaggcttttactctaataaactccatataacaagctggaacaaagcacaaaaatgggttcttgacttcttaaggaaaaattagagacttgaacggtccaattccgagttcaaatggccaagttatggtcatttgaagtttatatgctctttaaatgaatatttgcgaatttcttcatttaaattttaatttta

SEQ ID NO: 60070 - DNA, 16586 bp, Oryza sativa
  unsure (1)..(16586): unsure at all n locations
catacctcatctcaatgatcttttgtttggctctccaggcctttgcatagcttatggtgtacttgaatttgttctcgatgtgcctaataattgattttggttcaaagccaatgttaccaacaacactggtgtacatctcacttgccacaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaaggaaactgcccaatgcttcaccgcctccttcatctcatccttatgagcatatcttgcaccctcaattacctcgttctccttatactcccagggtacatgatcaccctctgatataacaagtccagagaagtcctcatttgcccaatcagtggccattacatcaccttcctcatcggatgatgcgtcgtcgtccacttcctcattatccgaattttccctctccatttcatcaacaattataccgactctctccccctcatccgccatgcccatagcctgctcctcccttggttgattttcctcattttgcatcgatggtccaacaacatcccctgcattgataggaccctctacatcttcggtttgcattgaaacatttatatctttctcttgtaccgacacaaatataacgaggggtcatgaccgttcaaaagccatttccacataccgtctccaagcatcagtgctgtccatcggcattagttcccaaaaataaccttctgttgcacgactcactacaactgacactgacattgtgtagacttcttggtctattctaaatcctctcaacaaccaactataaattgactgaaatgttctctccgcaggcctatcgatgcccttagatgtcattacaaaatctaacagatcaacaccatctggaccaaatctaatatttccttcaccgtgaactatctgaaatgtgaccttacttgacattgtgcctgatgaaaacaataactgcgttaacctcgcatttctgtactacgccctaagttacattctctacaatattgttctctaaatttctaaaattacgttacattctccagatcaaactaaactacatcttacaattaacactactgtctatgtctcaattcatactattatattctatgctctggatctacacatatgtgctgtgtgctacagatgtgctaaaatatatggaactaaaactaaaacgcaacatatatactcaaacataacatattagtacaaatgcacaaaagatgtatgggagcatacctgtgatgaattgagcgaaccagcagggcttcgccgctccccttctgctgccctcccctctctctcttttgttttttttggatttttagtgaatataatgaaatttcacagaggagggactgggctttatagggggagaggcaaaaatcgccctcctccagggcggcaagggggccgcctgcaaaattccatgccccctcgccgcccatttgcaggcagccccccccacagtacaaaatcgccctaacggagggcggcaagggggccgcctgcaaaattccatgcccccctcgccgcccatttgcaggcggcccccccacagtacaaaatcgccctagctgagggcggcaagggggccgcctgcaaaattccatgccccccctcgccgccaatttgcagccggccccccgcacagtataaaatcgccctagcggagggcggcaagggggccgcctgcaaatttcgttgacggccgtcgcccgagagcgaacggccgtctgccacgtcattttcgccgccctctgagagggcgatttttaaaaatcgccctcccagagggcggtaggcgactccttccgtcaattntcaaaatgaaaattatttttgtacacttttaataagaanaattataaataaaanaattcccgtgcagcggcatgggatatttgattagtgggaatccttgggccgattccacgtacgtttccactcccagccttgcccatatatggtgggctttggggctttgcaccgagccgtttggtggtggatcatcggcggggcacagcgcgcgggtgggtggcgaatttcgcgtaccgcgccaaagcgtttgacgtctcgtttctgcacaacccacacgcgagtccaggacggacggcccagcggctcgcgcccaggacgaacgcacgcggtccaccagcgacgtgcttcctgccgtatgggcttcatgcgctgcacccggcccctctgtttctcgcatgcacagcacagtgcagcgtcgtcgttgtaaatgcaaagtcctgttcggcacggctgctcaagcttcatttttcttatagttgtaaccttttcatctaaaataaaagtaaaactggttagagagctctcacgaaataaatgagagaggtggagctggattcatactactctatagatctacttcaaccctaacttatagatctactccaaccccaaacttctaaaattaaatttaagggatagagctttaccaaatatgtccgtactaaaggagaacccagctcgtagggggtcacaggtgaaaggactggattccagccaagcgtacacataactgtatgtattctaggggattgtccaagcttttataaactggattttcttcgtttatgaatgaacagatgatctctgatggcccgggaaaagaaaatgcaaggctaacgagaaaagatatccgatggactgaacaaatgcaaggcctggccggcttcgtctctgtggtcaacggacaaacagtgcgtgaaaaagcagctagtgtccagagcgcagctgagcggctgacacgaaacagttatccgaatgcgggcctacacagtcacagatcgcgtcaattcaaggcttccagttccagcccatgaagggtgtacacacatctcgtaaaagggaaaaatatagtaaatgaagagttgaaatggctgcagtcctacactcctactagcatgaaagttgaattttgttcctcgagataatattctcttattttatgcacggtgtttaaaaatttataaaaaaataaaaaaaaatactatgatagatcaatactccctccattctataatataagacacaactatttttttttatgttccataatataatacatacatgcatacatacaattaattaggacatattcttcattaaattattgttttttttaaatccttcaccctcaagatctcaaatttattggatacatgcattatatttattaggttgattcaaactaggagatgataataattgtttcttgatctttgggttaagggtggttgtgccttatattttggaacggatggagtatatgatatatctttgtatgcaaatatgcaagatgaaattcgatttatacgatttgaaacaaaaacgatcatgaattacagtttcattcatagttaaatttattatttttgtttttttatgagtcaaatttaaatatgcaggtttgataaatgatatactccctccatctatttttgatagtcatatttctaaatctgaaaaatttatttttgataggcatatttcaatccaacagcctattctcttaatgactttcttggatttaacgcatgactctctattcttccacacatgattggttacatgggcattgagaaatgtaaatattaatgaatcgtttgtttacgaggaatgactagtaacatgtttaaatggatgataagtaaaattacttattattggtatgtgttgtcgattacatattgatcgatcttactaaattattttaaattttttaatgatttttgagtgacatgtaaaataagagaatattctcttaaaggatgaatggagtttcccctactagtatgtgtcacccccaaacactttcagttagcaagctgtcattcactgatactccactatatcagaaaattttggtggaaaaccacttggccctgccgctaccgccgctgcttctaccgttacgtgaatgccgggctacacgagtcggtgttttttggccccatattatctgatacccagcacgcctgcgccgacaggcgatcggcagctgcgcgtcgcgcgcatggtcggtgggacggtgagcgccagccaagtgcccaagaagcctgcagggtccgcagcttctgcacttgtcttcatctcactcacccacagtacgatgatgctgatgcacagcacaacgacttgctaccaatgcttaaagctttgaaatgcctctgcgtgacatgctatatgcgcctttatttttttctttttcacagatggatctcatctatccggttagtggcgctgcatcatgcaatgcatgcgaccgtgtgctgtgttgtttgcttccatccgttcccttagccaacctctgcacgatacgtggtggacgacgactccactacccctgcattgcagcagcagtgtactagtgtgtgtctccacgaactcactggatcgacggaacagagagagtatccatgcattgtactactaggattatttagctaggtccactctaatcgacaactgctcgatcggttggcttgtgctgctgtgcaacgcatggctgccttgcccatttgttgtaagcgattactctgtctcaagataagttaatttttagctctttctattgatctcaaactaaaattggtttttaagtaatcattgcatcaaaaatttatgaaagtagaagataaatatattgaaagtagataaagtggaaataattgtattgggatttgataaagtggaagtatctaactttttaaattttacacacatgtgtggatggatgaaaaataaaattattttgaaacggggggagtagtaaaattcttcccttatctatactattataaaaattgaagatgtttttgctggtactttggtaggtcattcgtgtttgagtcggtttttaagtttattcgtttttggaaatacggatctgtgtttgagtcgatttttatgttcgttcgcttttaaaaatacaatagatgttttataagaaatctctttaaaaaaaactcgcatgctaactcgggacacttttaaaaatataaaaggagtcgtataaaaattattttaaaaaaacttgcatgctaaattgagataagagttggactcctaattataacttatgattttcaaaaaaaatatccaagcaaattcccacaaggattttcaccctaactaaaccgtataacagtgataataaaactaaaatagccttcatccgtcgtaatgcatggcattttttctagtcacctaaaaacgaaattgaaacggttcggtttttgcagaaatagaggggagaaaacgttgtaccaaatgaattaagcctatgtttcacagccaggcagttgggtcgtctctgcaacagtgacattaggcccctcgattctaggcccatgtagattcaattaagcaggccggcctataaaaaacccgagctttagatattcattttctaactgatgatcacatttactcacagattcacagttcaccattaaaaagatgggattgatgattacagttctgtcttctgccatcatatatagagataaaggcgtggtttctttttatcgctctaaggtgtactctttacgtactttccgtcccttaattaatttgcttatatattcagcatttagaagatcataacaaggacaagacgacaaccaaaaagaagacacgcaaaatgtgcaaattaaagatgatcataataaatgtacgagatatgatataaagatgcatttaaccaaaagagatttactggccccaaatcaatcgaaatgatcagcacgtactaggtaccactgtggtacggtataatgtggcagctgacacacaaaacggcggcagaattgtcatactacttggtgatcatatctaataatcctagctttgtctatgtatgggtcctcaaggttcttgaaagggataacacattgtggtcatagtcatctttgattagcaggtacctaatatcataccttagcacatgcacgagtacctagcatataagggtaatatacaaagtataatacatagactctccacatattcataagaatataaatgaaagctaaaacaatcgagtggcatgactaactagctcaacccgtttgatttagggtttatttgatacagtttcagcttcagctctatttatctatcttagagttgaagcccaaccaaataagagtggagctggttagagtactctcacaaaatgaattagagatgtggttgagtttagacagtttcacaacttcacttcaaatttaacttatgaaattaaatttaggtgttagtcctaccaaataggcttagatcgtcgaacgtgttattgctacatattatagaggtaaatcaaatattttgaaaatcatcctttcaaaaaaaatattgaaactcaaatttgacaaataaattaaaataaatattatatataaagaatacaatagaagaaagttttttagaaaatgtatttttcaaaatttagagtaaataatatatttaaaaaatctaacgaataaccccaaaagatcacaagacaccatggaatcccgtagatcttctggattagctgaacactgcatgcatgttgttgctaacgctatcttaacagtgcagcactgcagcacacagtaagtggtttggttggtcaaaaacgtactagagccacatttacaaagcaaaatgccacgagtactaccgcttgctccaccttgatgttggattagaccacagggctgacctagctaaaatcaattccactgacatggacaactaggcactagctaaagaaaaccctacatattcatacacacgtacagtacatgtatagtagtaccactgtacatatgtgtaccaggtaacaggaaatccttgtacatatacagcaaacagtaggcattgcatattgcatcttttgccagtaaaatagcctgcaaataatgtactagctagtaccaactgaatgaactgataagttcaacccaacgctacatacttactccctccgtcaaaaaaaaaaactaaacataagaggagatgtgatattttctagtataataaatctgaataaagggctatgattcattatcatagaagatgtcacatccttacctatctaggttgtgttttttttacggagggagtatgtccggtgtttttccaataaaaaaatatatatgtccaacttagagcagatgaaaaaaccatcaataagtaaaaattcgtgaaaatcggatctaaaaattctctaatatgaaaaggttctagagatatgtatagacataagatacattcccaccaaacctaaaatccaaacttaactttatttgagagagagagagagagagagagagagataaatttcgatgaatactgtccttttactatccatcttgtatggcacagctgttctcatcttgtatggcacgttctggatcgatcgatgggagaatgagacagggaccgatggatcatggtcgtctcatggatggttgctgttggtttcgttcacctacaaaagcctgcagaaacgacccagaggaggaggaaacggggaaggtttctctgttttttttctctagcaaaacaagctgcttgctagctactcctctctgcttgctgtcgcactcacaccgtgcaatctttcatcagctcatcagctgcacagcccatctctcgctgacccgtttttgtcccctgttttaatatacacacatctcccttttttttagcttgtgcttgctatattgtccaggtgtgatagtacttgtgtctactacatgtaggagcatatgcatgcaagaatttgtgtgtgtgtttctctctatctctgctggattggatacaagaagtaacaggcttgtaccagaagcaaaataaccggccgggatggccataaacccttgtctgtggcattacctctctctctatttatgaaccatgatgcttgtatatttattggcatctaaaagtggtgagaagtgcccatggggcatgtggcattgtggcaaccatcggcagggccttttgaaagcttgttttgaccatgcaccggcgatatagttttagccacaggagtcattacgacccagcctttactactactactacatcgatcgatacgaaaagagaaaattccctatatacccttgaaaatttactcaatcccttcaatacccctgaatttgacattatcccttatatacccctgagttttcattttgatctcctctatacccatctccgttagttgaccattagttgaccgttaaatattttaaaatgactatattacccatcctatacatatgtgtggtacctacccaataaattttcatatgaaaaataaacttatacaaaatacaagcaatataatcatttaatgcccaacttaaaaaataaaacttattattttttattttttaaaaattatgattaaatccatacattagtttcaccagaaaattaagagcaaaaactaaatgttatttaggtttaaatttttgggaagatatacgaaattcatcaaatttgatctgaaatttatttaaaaattttaaatttgttttctaatttgtgataaactaattatatcccctttgttttttcacaacgaatcttttttcactaaatatttgttgaaaagtaattttcaaatcttatgcagaacttttttttacaataaatctttttttattttaatgaaataatgttttattttcaaaaattcatcacaaatatttagtaatttattccttattggttttcacaaatcaaataatttacacataaaacatttctagcttttaacaatataacaaggacaataaagtaatttctacaataactaacggtcaaactaatggtcaactaacggaatgggtatgtaagggatccaaataaaaactcaggggtatataagagatcaaacaaatttcaggggcgtagaagggattgggtgaaattacatgggcatatagggaattggcccataagaaaatgaacagataagcacaagtattttagttaccattgttcatagacatattcaatggaatagttgtctgatattaagtcccctttgaatatcagaaataaaaaaaacaaaacaaataggaaaaacacatggttataataggattgcaaaacacggaaaaaacacaggaataaccgcttgattggaccatagaaaaaacaaaggaatcgggagatagactgaaggaaattttccaagagctttgagctcttgctaagtttcctccaaaatctctataggattatccattccataggaatttcaaaggactatatatgattcaatcctttgattcaaaggcatttatagaaatttttcctataggattgaaatcctccaaaattcttatgtttttcctccaaatcaaaggagcacttaggaggagaaaacttgctgttagatcctatccttttctgattctgaatttttgtttccgcagtctccctagctaatcgatatgtttcatgtaaaaatatatatatatacaaattttcatctattttttttgtaaaacaacttttcaacttcttattcctcccgtatcaaaatatagcaatatagaattagattagatatatccctcgtacaccctgctctgaatgatagtgttgatatacggcgtaaatccggatgattgatgctagggtatgtctattttaggatgaaggaagtaataattaattcatttgtttatacacttaaatagctaatagaaaatcatatgatccatcaacctatcaatttcagctatccccttaaagatgaacaccttttttaccattgtgtgagatactgaatccagctctggatgagaaatagagatgtggagcccctgttcaccaaactttccatttcctccccacctttttgctctgaagaaagtggcctttgtgtagttgtgtgtatgggtgtttccttctcttctttctctttaccaatccctccctctctctctctctctctctatacacagcagctgagacagtggcagggaggagcagagaattgaagatccttaaatgcggtttggtggcatccccccactggcccatcctccatcctttgctcccaatatcacatttgcgttttgcattttttgcactgcatttcattgcattgccacaccagtacaccacccccacctacataaaaacccaatggcaatcttgcaagaactaacctttgccaccactgatccctgctgctactcctcccatcttttacccactttgactccactccacctagctacctagctagctcgcaccttcttcttcgtgttcgttaagcttgccgggcttaccggcaaagaaggtcgtcggcgacgcgatgatgaggaggcggtggtctcgcgcggccgtcgtcgcctgcttactgctgctcgccgccgcgtgcgcggagtcggcgcgcccactgccggccccggccaaggcggcggcggcggttgtcgtcgtcaggccgaggagcgcgttcgacgtggtggtggccgggctcgtcggcatcgggctcgggcaccggtggcggcccggcggcggcgacctggtcgacgacgagaagcggcgggtgccgacggggcccaacccgctgcacaaccgatgagtactacgtggtacgtgtacgtacgtatagctagctagctagcctgccgcggcttggagagacgcgtccatgttatatatatttccgccattagcgtgggcgcgaggagcaagcaaagctccatcgcagagtcgtcatggcggcggcgacgacgacgaggaggagaagaggaggagaagaatgggaaggagaagagaggagttcgtccagtattgtttcccttctgcttccctttcttctttgtccctcttctgatccacttaatttggttttttttatttttttttcttgattttattttgatttttttcctctcttgtattgattggtttgtgaagtggacagcaaggccattctgttgatcgaaagagagatagagatatgagtatagtgtttcttgtttccatatccatctcttaatctatagttttcttgatgattgtgttgttatttggtagtatatattggtacatgcatgctcttgtgtacaatcacatagttgacttccttgcattaattttgggtacaaaatgattaattagctaggctaaattactcaatgaaaacaatcagactactgcatctttgcaggggagtcgtagtgggaaaaagttcacaaaagaaacatcttggattgaagtatacgatagcttttaaaagagaagttcgtcgagaacgcaatggattaaaagggaagtcttgtgggagaagagatgactgtgtgaaaaaaaaaatcaaatcttttttccagaagttaggaaatgatgaacatcaatcgatcaccccaatgtgatgaattcccttttgaatttagcatgaatttcttgtgcctcttttctttattgacgaaagttttgaaccccatttaatttctattgagtctttcatacactcccttttcccaatttttgcattatcatttcctccaattaatttaaggcaacgtcaacgtggacaactaaacaggaaattaaaacaggaaaagcaatgagtgcatgcatttttctctcgaattccaaatatccagtgcatttttttatacgtagatatataagttcagagatacagtttactactaaatcctaagcccttatggatacaaatatcaggaaaaaaacaagaatattgtcaagaagtgaagaaaaacaaaaggaaaatccaatgcatgcctgtccaaatttatttcatctagttggaaattctgcaaggtttcataaatgttggatgtgattggtgggcagataatccagatgtgcgactactatttcagcccagtaattgctccctatcgcccacacaaatctctatcacacatcgatctcttgtcagcactgaagcccagcgtttgttgatatctcaacgccaagactgaatcttcttcctccagggattagttgagactgttcggggaattatgaatttatgatccgtcgtttctgtcacatttgagtggcttaatctggtgaacgatcgatgaagtggaggtgtttgatcgatgtgacgccgttgcaattattttgtcatccttggtgctcgccagaggctctccaagggcattctcaacccaataattagatggtgtccatagcattatataagctgtcacctagaatgaaaaataatgtggcaattgaataaacgagtaaagagaaggaaaccatatcttgtatgagacatagtttctacacaatatccaagacatcatgtgagataagtagcattaaatttaagtatgaaatagtggtgtttgcattagaagagtagtttcgtactagtttcgtgatgatgtggagtttataaaaaccatgtatagtgtcttgggttaggaatagcctaattcccacggagtatcatcaagaggctgtcctcctacagcactcggacaacgagttgcattgatgtcacagctgcttgctgtgcaggttgataggagtgtgttcttggttaattaggtttgcttaaccgtgtaatgggtctaatcctactttaaattgttatattttataacggagggagcatatatttaaatatatttttttctatggtgttgttcttttcagcgtatttattggattattaaaatagattattcgctcaacacttaattttttttataaaaaaaatcttatgttctattaattatatcacttattttgagctatttggtacatttatttctcaaaatatttaaccgatccctgtaattaagtagataacccatggcaataatccattgaacaatctaagtccatgtttgattcagcttagaattatgataatctaaattattaggagtaagctgaaataaacaaatagcttattatgatatattattataatctataagctagattactataatctgataatccattataaatgtgcattttctagattattgggtgactaacagctaataatccagagaatcaaacagctaacaacttattctatgctggcttattataatccaacttatagcaatctgattcaataatctagattataataatcttaagctgaaacaaatagggcctaaatcaaatggtagagacagagatggaatgctattttgttgttttaatgaaatatctgatatcttttactagtaaaaaacagaagaataagttgcaacagaatgacagatgcatgacaattggcaaggacttggcaagaaatacaaggacgagtacgtgctagtacaacaccaattagctggaggaggtagctagctaaccaaggccttgtttagttataaatttttttttaaaacttttaactttttcatcacatcaaaacttttctacacacaaacttccagactttttcatcacatcattttaatctcaaccaaacttacaatttttgcgtgaactaagcacaccccaagtgcagtgcagtgtcaaacaaacagctcaggaatctcatcgacatggacccttctcctacatgggtacgaacagtatccatccatccatccttgaagccagcaagctgatgcagcagtgctgctcgcatcaattgcacatgtctgcatatatatctgtcccagcctctccccagcttacatctgaagtctgagcaacatacatacacatactacacgcgtttcagagattattggtggacggatgcagcaagcaagccgggaaagactttacagaggacatcatgatgtgaaaacggaaactttacgctgcattttcgactgacgatttcctctcgcagctgctattcaggagagtcttaactactagcgcagtagcgctccgctctctatctctgctcgtctctctactgtaccaccggtgaggtgaatggcgtgtagtaaccttctccatttttaaaatctcgcaatttctaatggtaaccgtacagtttttgttgtaaccgtgctattaccgtatagtatatcattacaccgtgagataatgataacccgtaaccctcattaccggattaattagtaaaacaataagagaaattcaagacgaggaagcaaaggaggttttcagtgaaggtggtatatatagatcagaagatatagatccttcgcataactgccaatgcagtagcagtgggccacggtttcccttaccgccggtaaccgcgcggttaccaggcttaccgcgggggtacggtaatataaataccgcggtaacctctttaaatttaaataaatttaaaaaataatttgaatttttgataaattttacacggttttgtatgattttccacggttaccgcgcggtaaccgtgcttaccgccagggcgcggtaaccccggccccaacggtttgagaaaccctggcagcggctgacatccgagttcatgtctataaatcaatagtatttgttactgcaccaacattaccgtagacaatcctcactggtatatcaggatcagctgcttgctgcagtagagagggaggccgggtggccagtgagtcaatacggtagcattgccatctcggcagtgctggctggctggctggctggacctctgccttttgccgttgctccctgcgactgcgagtgagtgcccccatgcttcggtctctagcgctgtctttaatgggagtggggcgagcaacaaaatgtgtttaactagatttgtttcaccccttgttttttttcttggaatagtactactaataatgaattatattttgtccagatatgacatactttagtactataaatctgaaagtatatctatttagaattatagtattaggatatgtctaattcaatattagggcatgtataaaggtagagttagatatgagcgctacgttatctagagactagcatcctacaacagttagagacaatatggtctctaattattaatatatcaaaataccttttcatactcttctattcagacttgtagtattaggatatgtctaattcgatattagggcatgtacaaaggtagagttagatatgagcgctacgttatctaaagactagcatcctacaacagttagagacaatatggtctctaatcattaatatatcaaaatactttttcttactcttctttcctttttttcactaccatgcaacaaaatttgctctaataaatgctaagagtcgactttgagccgttgtcatgcataacaaccatactcatttctctttcttccatatcatcaaatttacttgcatgacaatatagagagaccactaataaatacagttgtatatgatcttagttagtattttatgagacgaagaaagtagaagtagagaaatcatcgtcaaatcttaagcggccctcagattcaaagtttcaaaccagtccttgtctccgataaaaagaaagattcagggcaggagcgttaaaacaggaggagtaattactgcctacgcccataaatggcgttagattatcctgtaatggtaaaaatcggaaccagaggtacggtcgatgctcttctctcttttgccgtgctacattgtcccgttgtgtttcgaactaatcccgagtattatggagatgtttggtacagtaagatattgtttcctctcaacacaacataggagtacataaaaattactccctctgtctcctaataaactcaattttctctccttccgtttattttaaaataagttcatttattattgtatagggtttattaaagtaaaaaataattatagtggaagtgtataaaatagataataattgcatttggaatttaataaagtaggtatattctagtcttttttatcagtatgtgttagatgcgtgaaaaatgttttttagactaagggagtaacaacaacgtgttacttatatttatgagaggcagtaatattatttaacaagggcaaatgattgggggaaaacgagaatgctaaaagaaaaatatataatattgatgaagaacttaaatccatgatgggagcactggtggagaaaccatctttggtcggtcgaccaaatttcacaatagtctcgattccattaaaaaccgggactaaaaacgatttttagtcccggtttaaaaacttttgatctttagtcccggttggtaacaccaaccaggactaaagatgatttgtagtcccggttcatcccctgtcagatgtatgtcagggggtcgagaatctttagtcccggttgatactaccaatcgggactaaaaattaccacttcaccaaccgggactaaagatcgagtgatctttactcccagttggtattaccaaccgggactaaagatcgatctttagtcccggttgaagttatcaaccgggagtaaatatttctctcccacatccgatcggttaagtcccagacagatatt

SEQ ID NO: 60071 - DNA, 9921 bp, Oryza sativa
actagccattagcaaatcaacaacaaaataataataataaaaaatctcgaggaactgtcgcttcccctctttagtctcggttggtacccctctttactcccggttggtaacaccaaccgggactaaagattgatctttagtcccggttatttaaaccgggactaaagatagcgatttttagtcccggattcgtagtcccggttggaaaaccgggactaaaggggggttatcaaccgagactaaaaacagtttctccaccagtggagaacatatttttcatcctccattactctctaggcaatgaatactggatatttcggcacggtattctcaaaagcaactttggtcagtagtctattagataaatatccaattttgttaaagtttttttaaaatcaattatacaaattgtttctatgtttttaaagtaaatactttaaaagttatttataatgagagttttaaaagtttaacattagttttgtttaaaacgataattatttttaagctgaaaggagctcagcacgcaaaacaaagctcgtattattacatgattatttaagtattaactttttttaaaaaatagattaatatgattttttaagataactttcatgtagaaagtttttgtataaataacatcatttaatagtttgaaaaacgtgcgcgtgaaaaatgggagaggtggattgggaaaatgggtgaagaacacagccctagagagaagatagaggcgctagggtgagttaatttgggcagtgcataggtgaaccagtgaaggccggccaaaaatagaggcagcaaccagtgggagaatgattttgaccatgatttcaattctttaatggttgttgaatgcatcaatgcaagtgtgttcaaactacaaaatctgtcatgtcgtcaaccttccttgtagctcactcaaattatcggaaatgccaaccatcattttggagctttctctgcttgtattgaccgtttcacaatcacatcatgaacaacaatgctgctcccaacttttaaagcttaaaaaaatattcctcgtcctactccttccgctgagaaacattaagcatttcgagctccagatatcagattacggtagatttgaagtttgtatgttaaaatatatcagagtagtttaaaattttaatttttatttaaaataaaaataatttgatttatccaaatgttatatacacgtaatatgtatagatttgtgagttaggaataccctgttttataaaatcttatatctgaagttgtgctaaagagggcttaataaaaaatatcttactcactgtattctaaaatataagacacattcgccttttccaatgtttataatacaagaagcgcatgtattaactatgaccttctctctcttttattccctccgttccataatataaggcataactattttattttggatgttccataatataaggcagacatgcatgcatacaagagaccacctatatatttgtcgacaaattttctactaaaaatttaatagatgtaattatagtacaatcgtagtgtaattacactgtaacttgtatgtaattatactgtaacttgcatgtaactatagtgtaacttgtatgtagatttgttctggtgaggaagaaaaaaatcatagcacacacatatgtgaaaagatttgttcccacgacctctattttactgaaataacatgttaccgagagattcttgaaagttacatacaagttacaatgtaattacatgcaagttacagtgtaattacactacgattttactataattacatatgataaatattagggggagaaatttgatgacaaatatctagcaaaatcgtgcatacaattaattaggacctcttcttcattaaattattgcttttttaaatcatccaccctcaagatttctaattctattagatgcatgcattacatttattagggtgatccaaactaggaaataataataattgtttctttgtctttgggttaagggtggttgtgccttatattttggaacggagggattagttcttttctaaaatcctctaccctcaatatttataatcccattggatgtatatatgcattattgggttaatctaaacaagaaggtgatagtagctttagattacaatatagcagcggataacccaaattatcagtccctagtcattcatgaagaatgcagtttttttgaatgagcaatacaaatttgcctctccttccttttcccactcttcttatttggtagtagtactactctgtacaaaactaatactattgtgcaacaaaaaaagcaccatataatgtatagcatttgtgcttgattgccagcaagtcagcaacatccatggcaggtattgctgagacacgatctcgctgtaggacgaaacagttcttaccattccatcatcaccaatggcgacttcaatatatgcgtgggtgcgaccatttatatgccacagctcatgtcgtacggcctgtcgaccatcggcgacggcgtgccgagccagtacgccgtcgacctcatctccgccgccgtgtccgagccgccgccgttgttcttgtccttgaggctcttcctgtccaggaacgccggcctcaccggcgcggggatgacggactgctccgtcgtcttcatggtgagcattagcaccacctccgacatcgccggcctcaggttcgggaatggctgcacgcagagcagcgcgatctggcacacctgcatcacctccttctcgtcgaacccgtcggcctgcagcttcgcgtcgaccagctccagtatcttggattgctcgtacagcctccatgcctgaagaagattcagaatgagagagattcttgtgacagtgtcgtaaactcgtagtaatgtggagtttgggttcagaaaaaagattcagacatgttcaggcaggtactgcatttcgttcgggagagagagatccgtgttcttcctgctgctgacgatctcgagcacgagaactccgaagctgtaggtgtcggctttcactgtgagctcccctctgatggcgtattcaggcgccgtgtagcctctgaaaatccatggatcacaaagttcttcagaaacaaaatttacaaccttgtcatggctcaggtgttcagagctagctagctacgggttaagcgagctgagtactatactttcttcagtacttacagtgtgccggcaaatgccgtgctgaggtatgtctggtcctcggggaagaatcttgccaagccaaagtcactgatcttgggctgaaacttatcgtccaggaggatgttgctcgccttgatgtcgcgatgaacaatcctcaggttggactcctcgtgcaggtactgcaggcctctcgcgatgccgatgatgatctggtgccgcgtcttccagttcagaaatggtgcaccatcaacacctgcaaagttaatggatgtgtaaaaatgtggatcaagtaaacaatgtttttgcttgttcttgacagtttttaggttcaggatgtaatgcttaccaaacagtatcttgtccaagctcttgttcttcatgtactcgtagacgagcagccgttgctggccctccgagcagcagcccacaaggcgaacaaggttcttgtgctggatgctggttatcatgttcacctcgacgaagaactcggactcgccctgacctgacttgccgacgctcagctgcttcacagcaaccttcctgccatcgtctagtttcccctgataatgaacattagcattgcaaacaaccataatgcaatcagaaattgctgtagaatggtaggtgatactgatacagattcagtattgttttgtggcgtttcttggcagaaaaaagtgtaccagataaacaggtccaaagcctcctctcccgagctgattcttctggtggaaatccctcgtggccttcttcagtgttgcataatcaaagtatgttattgtgcgcagattgccgctcatgttgccgctgaaatactcgggtacctctgttacatggacagaaagagaaacagcagagttttatacaaaaattatggagcagtttgtgttttattgttgatcagcaggtttgatgagaatgataggttcacctgacggagccctctttggcctcatcaatctcctcatgatatctggcctgaggaacttccagcagataccaagtaggatgaagatgactatgatgagaatcacgatgaaggccaggaagaccgcactcgcatttgggttcgccattgttgctgtctatttctgcacattcatccacccaaaacctaacattttcagctgaaacttgttctaaaatgttttcgtgccagttacttagttgcctgtactccgtacaagcaaagcagaggtgaattgcacatatgctcagtgacatgccaaacaaaaaaaatacagtaaaaacctgaaaactacttaaaaaaattactcattgtgacatgaacaaatctcatatatccatttatgtatcctatgttagttttcaggttaactcaagcctgaagtaattaagggtaggaacctaataaacaacatgatagaaaacgccatgaactaactaataccacagatcagccatgtcgaggagaaaatacttcctctcaccactatactagactcatctatttagttcaaagaaaactgtagttaagtcatcttgtacctactgtacgtacctttgcagaacagtcggtcgatccaacggcgatgatcaccggacgcgccgccgaagccgtcgccgccgccgccgcttcgtcctctgtacgcagccgtaacagctgcaagtctgcaagattgcaatgcgaggcttccaatgccgtgtggcgatggaaggtaagcagagctatcggtttctccgaggcgctcgcgcgtgtcgtgtgtccgatccgatccggtcgtacttcgcgctggctgcatgctgccactgccggccgctagctagcaagcattcggtaggcaaaagctcgcgaggatattagagtagcgcgacagcgacgccaaaggcatttgttaagctcaattgctagaaaacttatgcaagttttttttttatgtctctaaaatttttagatttgtgaccatatgatcatcttgagatttgtactagaaaattagcgcgcccgttggtgcgcttgctaatctaacctgtatttttctctagcattatgataatacttatacctttataagtagtatttttatttttacgtcgtggaagaattatagttatatacactacgaatcgatgaagatcatattttaaaggatataaaaatttatttttacgtcgtgaaagaatcatagttatatgcactacgaatcgatgaagatcatattttaaaggatataaaaatttattttcttttctaaagattctgcctcgcttctaaatttaagagttttaaacataacctgttagaatttgtagaatttagaagtaaacaatttttatagtgtttaaaattgccactaaatattctaccttttctagacacaaaggatatatagggttaagttacctatttctaattctaacatgtctcatgtcgtatttatcggaatttttctccctgactttcctaaaactgcaaaagttttgtaattaaaaaaaatttaacaccttatgtatttgtttataattcatattcctttttatatgtaaagttttttttaacatgtttgtagagcgtactctctctttttatacatattgtagcttttaaaatgatattgaagttgcactttaaacattaatttatttcataataatcgatacctatgaagtcgaaataaatttcacgttacagcttatatgtgcctaagtaaatatacttatatttcgctgagcttttgtattaaaatattacgcatggcatccaaaactgctagacagtgctgtactgctgtagctgtttcatcacacacactgttatgggccaatttggatttttttggctgtgcgtgcgatggaattttggcccagccatccaggcaaaaacgtattacgggagagatcgagaagggtaccctgccggcgcgtccgcacgattacgtgcacgatttaattcacaagttgcccgtcttattatcgttgctccacgtgtcaacaaattactcgaccatatggaccaatcagattgtataaaacctgccggctttagatatatagatagatagatgtcacgcgtaacatctacgtactaaccaaccaaattatggttgaatataagttttaaataagttataccacagttacagtactataattatcgtgtagtaattatagtatagttataatttaatttaattatattatagttacatcttaatgtttttcgctgaagaatattacctcgaacaagtttggagtttttgttggcgattgattagtggatcgcgcgacgaacttgttccaggccggtagttgtggcctgtgggccggccggtgaagacgcatggccttccacggcccacggaaatcttgagttggtgtccgcatacggcccatcatcaaatctacagcgcgtgatgcaaaattggaataaggtccatgaacagtaacagcattttccaaccagcaaccgacaaaagctgatcgttggattgaaatacagagcatccagccacaggcgccgcccccactcacgcgacgcgaaccggagaaatataaaaaaatcgagcaaagtcatttcaaacaacgaatccccttccccggatcaagcagctagggtttccacctctccctcccccaaatcttctccatggccgccgccgccgccgccgacgcatcggccgaggccgcggccatcgcgcggcgcctggcctcctgcaacggctccgcacgggagcgcgcggtgcggcacctcctctccaccttcctcccggcctcggctccgcacctctccgcctccgacctcctcaagctctggaagggcctcttcttctgcttctggcactccgacaagccgctctaccagtcctccctcgccacccgcctcgccgccggcgtctcctcgggcccctcgccggccgccgccgccgccttcttcgccgcctacctcgccaccctccgccgcgagtgggtccacatcgacacccaccgcctcgacaagttctacctcctcaaccgcaggttcctccaccacgccttcctcctcctcgccgccaactccttcgccgccgacctcacctcccaggtcgtatcgatcctgtcggagaaggtactccttcccgaggccgacaacgtcgccgccggctcgccccgtgggcttgggtaccatgtcgccgaggtgtttctggacgagctgtcgcctgtgctccctgtgagcttacagacaatggaggtgttgctatctcctttcttcgctgtgttggagaagtcatctgatagggtgatggtggctaaggttaagtctagtgtgtttgagaggttcctcgagagcggcaaacaattgctcgagatggcgaagaaaggcgagggggtggagaaggggagcgcagacgagaagattgggaaggttggcttgctgtttgggttcagcaagaggttctcagatattggggcgaaggcggagaccgtgcaagcaaaccgaaaggtgctatttgggctgagggatgcgtttgtgaaggttgagaaaggattggagctctctggggtcgagattgctgtgccagagttcaagagtaccgaggtgacaggggtggagaatggcatggatttggatgaggtgaaggtggagaagaagaagaagaaaaaggcgaagaaagcttcattggtggaaggtgagacagagggggccaaggattcaaagcaagagaaaaaggtcaagaaggagaagaaagagaagaagaaaaagaagaaggtagaggttgttgatgagggagatgtcacggaacagagtacagacgctcctgcagaggaggaccaacagatgggtgatggtactgaggctgttacatttgatgagacattgatgtccaatctccagaagcagtttgagaaggctgcagcagaagctggtatggtcaatggaggcagcagctcaagtgctttgcccgctagtgggaaagctgcaaagaaaaggaagagagcaaaatctgcagataggttatcggtttctgatggagacgatgttagcagcgaaggtacaattatttcccaggatggggagaagagcggtaagaaagtgaggttctcgatgaagaataatctagtttggaagcctcacaatcctttgccgccgcagtgcttgaggctgccaccatctgctactccaagagggagtgcactaaaaaagggtgttctgcctgggcctataaaagaaacgcctacgcctgtgaagaagactaagccaaaagcgaaatctgcaaagaaggtcttgaagaagccttcctcagccgcgaagcgcttgcggaagttgcaaaatttctctgcatgaactcttttatgaattgacactgcagtgatcatgctttctgcatggtgtgtcttttcaaccgtgttctattattacttaattcttcacctaggttagtcttatacgctgttgactatgcaccaaatttatatttatggattgtttaatgttgtgttatgtcatagcgcattcatgataatcatgtgggtgatcattctttggaattagcagtagcaattttgatctggatagtacaagtctgaattcccatggatgtcctttctgttccaactatatatcttcctccattaaaaaaactatacatcttcctgttttctttcacaactgtggcttagtacagagtactggttcagtgattctatatagatgaatcgcttccacaagcttattttcttattgatgatcagacaggcggattcttctgagcattatgatgttccatttgacataagattgttaacatcactggtgtttggcatgaaggcctttagttactagtttgcatgatgaagatagctgttgacatagtttgtttctttcagtacccagtaactttgatggggaatgttctgtctgcatatggtacacaagaatgagatgtgtatgaatgataattagcactacatgtttctgtatgtgaaaccgacctactactgctagatatagatatcatgctcaattgtttctgtccaatatctccgtgatccaagaaagttactgaaatcaagattcaagagcagagcgtttcgaagaggtgagttgttgggagaacatgagcagcatatgttatactgtattgacttcctcagaagttctgatttctgatatcttgtctctgaaaatcccttttggctaaattgcgcctgcactggcaatagacgctgtgctgtcgcaaccggggctcgtcagtattaatttctgctactgatttcacttgtttttcttgtatcagtatcaactcattaattttctcaacagcacgttgcagagacagctatcatcggtgaactgcgattgtgatgcttgtattataattcgtattcgtattattggattctttcttgtggtgaatgatactgctacttggccgcactatttcgtgaaatgtgcatgttgtgaatgtagtagtatgatcaatgtcaagcaatccagaaccgaaaatcaaccactgaaaattgctgtgatcaaagatagcttcctagagagagcgcgcacggatcacgaggcttcagcagcggtcaagatgacactgtgatcgttggcacaagtcgctcttgcttagagagctagagttagttattgtcgtcgtgtagaatatagttagcgaaatgccaggatcaattcatagacgaaattgtagattgcttcacttggttgtaattccaatgtgccacatgaagaagaagaatcatcacaaaggtgaaaaaataagagtcagtagtcacaccaatccacaaccttggcag
